United States Patent
Goldman et al.

(10) Patent No.: US 6,833,447 B1
(45) Date of Patent: Dec. 21, 2004

(54) MYXOCOCCUS XANTHUS GENOME SEQUENCES AND USES THEREOF

(75) Inventors: Barry S. Goldman, Acton, MA (US); Gregory J. Hinkle, Plymouth, MA (US); Steven C. Slater, Acton, MA (US); Roger C. Wiegand, Wayland, MA (US)

(73) Assignee: Monsanto Technology, LLC, St. Louis, MO (US)

( * ) Notice: Subject to any disclaimer, the term of this patent is extended or adjusted under 35 U.S.C. 154(b) by 0 days.

(21) Appl. No.: 09/902,540

(22) Filed: Jul. 10, 2001

Related U.S. Application Data

(60) Provisional application No. 60/217,883, filed on Jul. 10, 2000.

(51) Int. Cl.[7] .............................................. C07H 21/00
(52) U.S. Cl. ...................... 536/23.1; 435/252.3; 800/13
(58) Field of Search ............................ 536/23.1, 24.32; 435/252.3; 800/13

(56) References Cited

PUBLICATIONS

Darwin et al., Regulation and sequence of the structural gene for cytochrome c552 from *Escherichia coli*: not a hexahaem but a 50kDa tetrahaem nitrite reductase. 1993, Molecular Microbiology, vol. 9, No. 6, pp. 1255–1265.*

* cited by examiner

*Primary Examiner*—Ardin H. Marschel
*Assistant Examiner*—Carolyn L. Smith
(74) *Attorney, Agent, or Firm*—Donna E. Scherer; Thomas E. Kelley; Lawrence M. Lavin, Jr.

(57) ABSTRACT

The present invention relates to nucleic acid sequences from the bacterium, *Myxococcus xanthus* and, in particular, to genomic DNA sequences. The invention encompasses nucleic acid molecules present in non-coding regions as well as nucleic acid molecules that encode proteins and fragments of proteins. In addition, proteins and fragments of proteins so encoded and antibodies capable of binding the proteins are encompassed by the present invention. The invention also encompasses oligonucleotides including primers, e.g. useful for amplifying nucleic acid molecules, and collections of nucleic acid molecules and oligonucleotides, e.g. in microarrays. The invention also provides constructs and transgenic cells and organisms comprising nucleic acid molecules of the invention. The invention also relates to methods of using the disclosed nucleic acid molecules, oligonucleotides, proteins, fragments of proteins, and antibodies, for example, for gene identification and analysis, and preparation of constructs and transgenic cells and organisms.

5 Claims, No Drawings

MYXOCOCCUS XANTHUS GENOME SEQUENCES AND USES THEREOF

CROSS-REFERENCE TO RELATED APPLICATION

This application claims priority under 35 U.S.C. §119(e) of U.S. Provisional Application No. 60/217,883 filed Jul. 10, 2000, the disclosure of which application is incorporated herein by reference in its entirety.

INCORPORATION OF SEQUENCE LISTING

Two copies of the sequence listing (Copy 1 and Copy 2) and a computer readable form of the sequence listing, all on CD-ROMs, each containing the file named Pa_00359.rpt which is 39,705,377 bytes (measured in MS-WINDOWS) and was created on Jun. 12, 2001 are herein incorporated by reference.

INCORPORATION OF TABLES 1, 2 AND 3

Two copies of Table 1 on CD-ROMs, each containing 998,830 bytes (measured in MS-WINDOWS) and all having the file name pa_00359.txt Table all created on Jun. 12, 2001, are herein incorporated by reference.

FIELD OF THE INVENTION

Included in the disclosure are nucleic acid molecules representing the, genome of the bacterium *Myxococcus xanthus* and, in particular, to nucleic acid molecules having nucleic acid sequences corresponding to DNA replication elements, genes, promoters, and other regulatory elements found in the *M. xanthus* genome. Also disclosed are homologous nucleic acid molecules, complementary nucleic acid molecules, polypeptides expressed by *M. xanthus* gene sequences, constructs comprising *M. xanthus* promoters, regulatory elements and/or genes, transformed cells and organisms comprising *M. xanihus* promoters, regulatory elements and/or genes, primers useful for replicating all or portions of *M. xanthus* genes or other *M. xanthus* nucleic acid molecules, computer readable media comprising sets of *M. xanthus* nucleic acid sequences, polypeptides and oligonucleotides, collections of *M. xanthus* nucleic acid molecules and methods of using such molecules and sequences including the use of collections of nucleic acid molecules in gene identification and gene expression analysis, development of a stoichiometric metabolic model, and preparation of constructs.

BACKGROUND OF THE INVENTION

*Myxococcus xanthus* is a Gram-negative, rod-shaped bacterium with gliding motility that is classified within the delta subgroup of bacteria. It is a member of a group of microorganisms, commonly called myxobacteria, that generally survive by degrading organic material and other organisms in the soil. Of particular interest within the myxobacteria is the social behavior among cells. Myxobacteria form social interactions that facilitate feeding and, when nutrients become scarce, sporulation. They are the only bacteria that practice both types of social behavior, and the mechanism of communication among cells has been the subject of much research (see *Myxobacteria II*. 1993. Martin Dworkin and Dale Kaiser (ed.), American Society for Microbiology, Washington, D.C.). *M. xanthus* has been particularly well studied, and is the member of the myxobacteria with the firmest genetic and physical map on which to build a genome project. An ordered YAC library and physical map of the *M. xanthus* genome have been constructed (He et al., *Proc Natl Acad Sci USA*. 91:9584–9587 (1994); Kuspa et al., *Proc Natl Acad Sci U S* 91:8917–8921 (1989)). The circular genome has been estimated to be around 9.5 Mbp (Shimkets, "The Myxobacterial Genome," in *Myxobacteria II. American Society for Microbiology*, Dworkin and Kaiser (eds.), Washington, D.C., pp. 85–107 (1993)), which is quite large for a bacterial genome. It also has a very high G+C content (around 70%: Kaiser et al., *Ann. Rev. Microbiol.* 33:595–639 (1979)) which makes sequencing and assembly of the genome a significant technical challenge.

Ecology and Life Cycle of *M. xanthus*

Myxobacteria are predatory organisms that can attack and degrade many other types of bacteria. Whole colonies of myxobacteria generally migrate together (swarm), and the combined production of extracellular enzymes allows more efficient solubilization of nutrients. Motility is accomplished by gliding, but the mechanism of gliding motility is not understood, either for myxobacteria or other types of gliding bacteria. The cells continue to feed communally until nutrients have been exhausted. Once nutrients become limiting, myxobacteria initiate a complex developmental process that leads to the production of fruiting bodies containing myxospores. Myxospores are resistant to heat, desiccation and other environmental insults, and serve as the resting phase for myxobacteria. The myxospores remain dormant until nutrients are again available, at which point they germinate to produce a new swarm of motile cells.

The sporulation process requires aggregation of many cells to an area where the fruiting body will eventually form. Both aggregation and fruiting body formation require a complex set of cell-to-cell communication networks, and a series of genetic switches within individual cells. The genetic cascade leads to differentiation of certain cells within the fruiting body, thereby producing myxospores.

The cells initially form a small, translucent mound. A portion of the cells within the mound begin to develop into myxospores, and the fruiting body eventually becomes about 0.1 mM high and dark as the thick spore walls are formed. The spores allow *M. xanthus* to survive harsh conditions for a long period of time, thus allowing the cells to be safely transported to a new location, perhaps by wind or within the gut of an animal.

Genetic analyses have identified a series of Myxococcus regulatory mutants that are defective in fruiting body formation. These mutants terminate at various points along the developmental pathway, and have defined four different chemical signaling factors, designated A, B, C, and D, that are required for normal sporulation (Kroos et al., *Genes and Development* 1:840–854 (1987); Losick et al., *Scientific American*. 276:68–73 (1997); Lee et al., *J. Bacteriol*. 178:977–984 (1996); Munoz et al., *Microbiologia Madrid*. 11:429–438 (1995); Kim, *Trends in Genetics*. 7:361–365 (1991)). Factors A and C are the best studied. A-factor is required for aggregation of the cells. It is actually a combination of factors, including a heat stable component that appears to be a complex mixture of amino acids (Kuspa et al., *J. Bacteriol*. 174:3319–3326 (1992)) and a heat labile portion that includes a mixture of peptidases that presumably generate amino acids (Plamann et al., *J. Bacteriol*. 174:3311–3318 (1992)). A-factor is diffusible, and therefore does not require direct cell-to-cell contact for signal transmission. In contrast, C-Factor is normally found tightly associated with the cell surface of the signal producer, and transmission requires close contact between the signal producer and the recipient. Thus, C-signaling requires cellular motion and the close physical contact of the swarming cells in an aggregate. Both signal types provide the necessary format for the required message; A-factor to attract distant cells to a focus, and C-factor to maintain communication within the developing fruiting body. Each of the signals leads to a cascade of genetic switches that continues the cell differentiation process.

Many of the downstream regulatory and effecter genes have now been identified in *M. xanthus* using genetic and biochemical approaches, and it is the speed and efficiency with which bacteria allow analysis of the complex networks and metabolic pathways that provides a primary utility of the genome sequence.

The nucleic acid molecules and sequences disclosed herein represent a substantial portion of the *M. xanthus* genome. These molecules and sequences may be used to identify novel genes, for example genes involved in antibiotic production, and sequences in regulatory regions of the *Myxococcus* genes provided herein. The *M. xanthus* molecules and sequences also permit identification of genetic sequences from other organisms, including plants, mammals such as humans, bacteria, other filamentous fungi and non-filamentous fungi such as a yeast, e.g. by comparison of such sequences with *M. xanthus* sequences. The availability of a substantially complete set of genes or partial genes of the *M. xanthus* genome permits the definition of primers for fabricating representative nucleic acid molecules of the genome which can be used on microarrays to facilitate transcription profile studies. Such studies can help to identify regulatory networks and genes of interest in, for example, production of secondary metabolites, cell-to-cell signaling, cellular differentiation, and motility.

In addition, the *M. xanthus* genome fragments and sequences provided herein permit the fabrication of a wide variety of DNA constructs useful for imparting unique genetic properties into transgenic organisms. These and other advantages attendant with the various aspects of this invention will be apparent from the following description of the invention and its various embodiments.

SUMMARY OF THE INVENTION

The present invention contemplates and provides nucleic acid molecules comprising a substantial part of the genome of the bacterium *Myxococcus xanthus*. One aspect of the invention is a set of 1849 contig and singleton sequences comprising coding sequences, DNA replication elements, as well as promoters and other regulatory elements, such sequences being represented herein as SEQ ID NO: 1 through SEQ ID NO: 1849. Contigs in SEQ ID NO: 1 through SEQ ID NO: 1849 are recognized as those sequences whose designations begin with MYX10C. Singleton sequences are recognized as those having designations that begin with MYX10S. The present invention also encompasses complements of the nucleic acid sequences provided herein. Thus, a subset of the nucleic acid molecules of this invention comprises DNA protein encoding regions, replication elements, promoters and/or other regulatory elements of the *M. xanthus* genome as present in SEQ ID NO: 1 through SEQ ID NO 1849 or complements thereof.

Another aspect of this invention comprises a set of about 7842 genes or partial genes of the *M. xanthus* genome including genes represented by SEQ ID NO: 1850 through SEQ ID NO: 9691 and described in Table 1. As used herein, a substantially complete set of genes for an organism is referred to as a unigene set. Thus, as used herein reference is made to specific genes comprising the unigene set of *M. xanthus* as "MYX12U_xxxx" where MYX12U is an acronym for *Myxococcus xanthus* unigene and xxxx represents a number. Moreover, the term "MYXU" by itself is also used herein to mean any of the nucleic acid molecules comprising genes or partial genes of the unigene set for *M. xanthus*. More particularly the term "MYXU of this invention" as used herein means a nucleic acid molecule representing a gene or partial gene of *M. xanthus* disclosed herein selected from the group consisting of SEQ ID NO: 1850 through SEQ ID NO: 9691. Preferred aspects of this invention contemplate MYXUs as identified by value of the gene prediction method, i.e., BLASTX or GeneMark. Certain preferred MYXUs have a BLASTX Bit Score of at least 100, more preferably 150. Other preferred MYXUs have a GeneMark Probability Score of at least 0.6, more preferably at least 0.75. Still other preferred MYXUs have a BLASTX Bit Score of at least 100 and a GeneMark Probability Score of 0.6; more preferably, respective scores of 150 and 0.75.

The present invention also contemplates and provides substantially purified nucleic acid molecules comprising the MYXUs and other nucleic acid molecules of this invention as well as molecules which are complementary to, and capable of specifically hybridizing to, an MYXU or its complement.

The present invention also contemplates and provides substantially purified nucleic acid molecules which are homologous to the nucleic acid molecules of this invention including, for example, those which are homologous to the MYXUs of this invention, e.g., a plurality of related sets of homologous nucleic acid molecules in other species which are homologous to the MYXUs.

The present invention also contemplates and provides substantially purified protein, or polypeptide fragments thereof, which are encoded by nucleic acid molecules of the present invention. Of particular interest is the group of 7134 *Myxococcus* proteins, peptides or fragments provided herein as SEQ ID NO: 9692 through SEQ ID NO:16825 and designated as MYX12_xxxx_prot, where xxxx is a number corresponding to the MYXU nucleic acid sequence which encodes the peptide.

The present invention also contemplates and provides constructs comprising DNA replication elements, promoters, regulatory elements and/or protein encoding regions that are useful in making transgenic cells or organisms. In particular this invention also provides transformed cells or organisms having a nucleic acid molecule which comprises: (a) a promoter region which functions in the cell to cause the production of an mRNA molecule, which is linked to (b) a structural nucleic acid molecule, which is linked to (c) a 3' non-translated sequence that functions in the cell to cause termination of transcription, where components (a) and/or (b) are selected from *M. xanthus* nucleic acid sequences provided herein and more preferably where component (b) is selected from *M. xanthus* nucleic acid sequences which encode the peptide sequences, provided herein as SEQ ID NO:9692 through SEQ ID NO:16825.

Other aspects of this invention include oligonucleotides (and subsets thereof) for amplification or detection of the nucleic acid molecules of this invention. Such oligonucleotides may be used in analysis of *Myxococcus* gene expression patterns, either as probes or as elements on gene arrays, or to generate and isolate nucleic acid molecules representative of *M. xanthus* genes of this invention and homologs thereof in other myxobacteria species. Thus, the nucleic acids molecules of this invention including the oligonucleotides provided, represent a useful tool in genetic research not only for *M. xanthus*, but also for other bacterial species, particularly for other myxobacteria.

The present invention also contemplates and provides computer readable media having recorded thereon one or more of the nucleotide sequences provided by this invention and methods for using such media, e.g. in searching to identify genes associated with nucleic acid sequences.

The present invention also contemplates and provides collections of nucleic acid molecules, including oligonucleotides, representing the M. xanthus genome including collections on solid substrates, e.g. substrates having attached thereto in array form nucleic acid molecules or oligonucleotides representing genes of the M. xanthus genome. The invention also contemplates and provides methods of using such collections and arrays, e.g. in transcription profiling analysis. The present invention also contemplates and provides methods for using the nucleic acid molecules of this invention, e.g. for identifying genetic material and/or determining gene expression by hybridizing expressed and labeled nucleic acid molecules or fragments thereof to arrayed collections of the nucleic acid molecules of this invention.

The present invention also contemplates and provides oligonucleotides which are identical or complementary to a sequence of similar length in an MYXU. Such oligonucleotides are useful, for example, for hybridizing to and identifying nucleic acid molecules which are homologous and/or complementary to the MYXUs of the present invention.

Other aspects of this invention contemplate methods of using the MYXUs, e.g., for determining gene expression, for identifying mutations in a gene of interest and for constructing mutations in a gene of interest.

DETAILED DESCRIPTION OF THE INVENTION

As used herein, a nucleic acid molecule and/or polypeptide molecule, be it a naturally occurring molecule or otherwise, may be "substantially purified," if the molecule is separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The MYXUs and other nucleic acid molecules and/or polypeptide molecules of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic, and thus involve the capacity of the agent to mediate a chemical reaction or response.

As used herein the term "polypeptide" means a protein or fragment thereof expressed by a nucleic acid molecule in a cell, or expressed from a nucleic acid molecule in vitro, i.e. by in vitro translation.

The MYXUs and other nucleic acid molecules of the present invention may also be recombinant. As used herein, the term recombinant means any molecule (e.g. DNA, peptide etc.), that is, or results, however indirect, from human manipulation of a nucleic acid molecule.

Of particular interest are MYXUs of the present invention which encode proteins involved in the production of polyketides. Polyketides are a class of small bioactive molecules that are linked by their biosynthetic pathways (sequence of reactions). The pathways and their products are particularly abundant in soil microorganisms, including Myxococcus xanthus. A large number of major pharmaceutical and agricultural products have been derived from these complex natural products including insecticides, fungicides, antibacterial agents, anti-inflammatory agents, cancer-fighting agents, and cholesterol-lowering agents. Examples of polyketides include Rifamycins (Rifampin), Adriamycin (Doxorubicin), Erythromycin, Mevacor (Lovastatin), Ascomycin (Immunomycin), and Spinosad.

The production of polyketides is catalyzed by the activity of a family of large proteins designated as polyketide synthases or synthetases, which are also sometimes referred to as peptide synthetases, nonribosomal peptide synthetases or ketoacyl synthases. Additional enzymes, such as reductases, are also involved in the synthesis pathways of polyketides. Analysis of the sequences provided herein reveals the existence of an extraordinarily large number of Myxococcus genes that encode polyketide synthases. In addition, there are a substantial number of open reading frames with homology to the NosAB proteins from Nostoc species. These proteins, in combination with NosC and NosD proteins, form a pathway for nostopeptolide, a polyketide synthase (or synthetase) related to the tyrocidine synthetase 3 of Brevibacillus brevis and the syringomycin synthetase of Pseudomonas syringae. The Nostoc NosA proteins also are homologous to the Nostoc NosC and NosD proteins. The NosB protein is homologous to the McyG protein of Microcystis aeruginosa and the MtaD Stigmatella aurantiaca. The Mta genes are members of the myxothiazol biosynthetic gene cluster involved in the production of a number of well known polyketides in Stigmatella species.

Additional Myxococcus genes are homologous to genes in the epothilone biosynthetic gene cluster from Sorangium cellulosum. Epothilones are polyketide natural products that have been shown to have use as anti-cancer agents. They inhibit cancer cells by the same mechanism as the taxanes, and have the advantage that they are effective against many taxane resistant tumors. The genes encoding the PKS in this cluster are epoA, epoC, epoD, epoE, and epoF. The EpoB protein is a non-ribosomal peptide synthetase (NRPS) that catalyzes formation of the thiazole found in the epothilones. EpoK is a P450 enzyme responsible for the epoxidation of epothilones C and D to epothilones A and B, respectively.

Analysis of Myxococcus xanthus using codori preference tables suggests that this organism is remarkably distant from all other known sequenced organisms. In addition, genome signature analysis suggests that little horizontal transfer has occurred. It is thus likely that many of the polyketides encoded by Myxococcus genes will have novel characteristics in comparison to known polyketides from other organisms. In addition, it is likely that different polyketides will be produced in Myxococcus under different growth conditions.

The polyketide synthase encoding genes provided herein can be placed into the genome of a plant to produce a polyketide substance that can protect a plant against damage from insects, fungi, or bacteria. In addition, these genes can be placed in plants or other organisms to generate polyketides for other uses, including for discovery and production of pharmaceuticals.

Genes from Myxococcus xanthus that are involved in the nitrogen pathway are also provided in the present invention. Oxidized nitrogen in the biosphere must be reduced to ammonia for use by all organisms. The most common oxidized form of nitrogen is nitrate ($NO3^-$). Nitrate must be reduced through nitrite (NO2⁻) to ammonia (NH3). Genes for nitrate reduction are found in plants and microorganisms. Two reactions are required for this reductive pathway. The first, nitrate reductase, reduces nitrate to nitrite and the second, nitrite reductase, converts nitrite to ammonia. The conversion of nitrite to ammonia is the often the rate limiting step to nitrogen assimilation so addition of genes that can improve this reduction should improve nitrogen assimilation and thus yield. Transcriptional expression of these genes in plants is usually suppressed by the presence of reduced nitrogen (ammonia or glutamine). The expression of bacterial genes in plants is a method to overcome the transcriptional expression barriers. *Myxococcus* genes encoding nitrate/nitrite transporters are also of interest. Nitrogen fertilizers are often in the form of ammonium nitrate. Addition of nitrate or nitrite uptake systems and their reductive pathways can be used to lower the use of fertilizers in the soil resulting in lower crop production costs for farmers. Thus, *Myxococcus* genes encoding nitrate and nitrite reductases, nitrate/nitrite transporters, such as ABC transporters, and regulatory proteins in the nitrate pathway, such as sigma-54 dependent transcriptional activators, are of use for production of plants having improved nitrate utilization and increased yield.

*Myxococcus xanthus* genes encoding serine threonine protein kinases are also provided in the present invention. Protein kinases play roles in the regulation of protein and enzyme activity in the transduction of environmental, developmental, and metabolic signals in animals and simple eukaryotes. It has been reported that protein kinases also act as signal transducers in plants, and activities of plant protein kinases have been reported to be responsive to various environmental stimuli and developmental changes. A majority of the reported plant protein kinases are serine threonine protein kinases. Serine threonine protein kinases are not generally present in microbes, but analysis of the genome of *Myxococcus xanthus* reveals the presence of a substantial number of genes encoding serine threonine protein kinases. Such genes are of interest for use in production of transgenic plants and microorganisms to produce plants and microorganisms having altered growth and development patterns, and particularly for providing organisms having improved responses to environmental stresses. Such modifications are of particular interest for increasing the yield of crop plants.

The present invention also provides *Myxococcus xanthus* genes that encode sigma factors. Sigma factors are prokaryotic transcription factors that bind to DNA and help initiate transcription by recruiting RNA polymerase and inducing helix unwinding. These gene products might be used to alter the regulatory pathways of microorganisms or to better express prokaryotic genes that are used in transgenic organisms.

Also of interest in the present invention are *Myxococcus* genes encoding antiobiotic resistance proteins. Such genes may be used, for example, as markers for selecting transgenic organisms, such as plants, animals, fungi or bacteria, so that genes linked to these markers can be introduced into the target organism. Alternatively, such markers can be used as a counter-selection, i.e. to select against the donor of a transgenic cross. Additional genes that find use as markers for selection of transgenic organisms are genes encoding proteins which confer resistance to UV light, such as UVR genes.

Additional classes of proteins encoded by genes of the present invention are readily apparent by examination of the sequences and the associated annotations provided in Table 1 here. Another example of genes of particular interest in the present invention are genes encoding DNA methylases and restriction enzymes. Such proteins can be used in DNA technology to alter DNA for manipulations such as DNA isolation for cloning and the polymerase chain reaction.

It is understood that the nucleic acid molecules of the present invention may be labeled with reagents that facilitate detection of the nucleic acid molecules, e.g. fluorescent labels as disclosed in U.S. Pat. No. 4,653,417, chemical labels as disclosed in U.S. Pat. Nos. 4,582,789 and 4,563,417 and modified bases as disclosed in U.S. Pat. No. 4,605,735, all of which are incorporated herein by reference in their entirety.

The term "oligonucleotide" as used herein refers to short nucleic acid molecules useful, e.g. for hybridizing probes, nucleotide array elements, sequencing primers, or primers for DNA extension reactions, such as polymerase chain reaction. The size of the oligonucleotide molecules of the present invention will depend upon several factors, particularly on the ultimate function or use intended for a particular oligonucleotide. Oligonucleotides, i.e. deoxyribonucleotides or ribonucleotides, can comprise ligated natural nucleic acid molecules or synthesized nucleic acid molecules and will generally comprise between 5 to 150 nucleotides or between about 15 and about 100 nucleotides, or preferably up to 100 nucleotides, and even more preferably between 15 to 30 nucleotides or most preferably between 18–25 nucleotides. The sequence of the oligonucleotides will ideally be identical or complementary to the sequence of a fragment of similar length in a *Myxococcus* nucleic acid molecule provided herein.

This invention provides oligonucleotides specific for nucleic acid molecules of the present invention. Such oligonucleotides find particular use as nucleic acid elements for use on solid arrays (e.g. synthesized or spotted), as hybridization probes, and as primers for amplification of protein encoding regions of this invention. Oligonucleotides for use in polymerase chain reaction (PCR) primers are preferably designed with the goal of amplifying nucleic acids from either the 3' or the 5' end of an *M. xanthus* gene or gene fragment, e.g. about 500 to 800 bp of nucleic acids.

The term "primer" as used herein refers to a nucleic acid molecule, preferably an oligonucleotide whether derived from a naturally occurring molecule, such as one isolated from a restriction digest, or one produced synthetically, which is capable of acting as a point of initiation of synthesis when placed under conditions in which synthesis of a primer extension product which is complementary to a nucleic acid strand is induced, i.e., in the presence of nucleotides and an agent for polymerization such as DNA polymerase and at a suitable temperature and pH. The primer is preferably single stranded for maximum efficiency in amplification, but may alternatively be double stranded. If double stranded, the primer is first treated to separate its strands before being used to prepare extension products. Preferably, the primer is an oligodeoxyribonucleotide. The primer must be sufficiently long to prime the synthesis of extension products in the presence of the agent for polymerization. The exact lengths of the primers will depend on many factors, including temperature and source of primer. For example, depending on the complexity of the target sequence, the oligonucleotide primer typically contains at least 15, more preferably 18 nucleotides, which are identical or complementary to the template and optionally a tail of variable length which need not match the template. The length of the tail should not be so long that it interferes with the recognition of the template. Short primer molecules generally require cooler temperatures to form sufficiently stable hybrid complexes with the template.

The primers herein are selected to be "substantially" complementary to the different strands of each specific sequence to be amplified. This means that the primers must be sufficiently complementary to hybridize with their respective strands. Therefore, the primer sequence need not reflect the exact sequence of the template. For example, a non-complementary nucleotide fragment may be attached to the 5' end of the primer, with the remainder of the primer sequence being complementary to the strand. Alternatively, non-complementary bases or longer sequences can be interspersed into the primer, provided that the primer sequence has sufficient complementarity with the sequence of the strand to be amplified to hybridize therewith and thereby form a template for synthesis of the extension product of the other primer. Computer generated search programs such as Primer3 (Steve Rozen, Helen J. Skaletsky (1996,1997); code available at genome.wi.mit.edu/genome_software/other/primer3, STSPipeline genome.wi.mit.edu/cgi-bin/STS Pipeline), or GeneUp (Pesole et al., *BioTechniques* 25:112–123 (1998)), for example, can be used to identify potential PCR primers. Exemplary primers include primers that are 18 to 50 bases long, where at least between 18 to 25 bases are identical or complementary to a segment of corresponding length in the template sequence. Preferred template sequences for such primers are selected from MYXO sequences provided herein as SEQ ID NO: 1850 through SEQ ID NO: 9691 or complements thereof, particularly those sequences which encode peptides whose sequences are provided herein as SEQ ID NO: 9692 through SEQ ID NO: 16825.

This invention also contemplates and provides primer pairs for amplification of nucleic acid molecules representing *Myxococcus* genes. As used herein "primer pair" means a set of two oligonucleotide primers based on two separated sequence segments of a target nucleic acid sequence. One primer of the pair is a "forward primer" or "5' primer" having a sequence which is identical to the more 5' of the separated sequence segments. The other primer of the pair is a "reverse primer" or "3' primer" having a sequence which is complementary to the more 3' of the separated sequence segments. A primer pair allows for amplification of the nucleic acid sequence between and including the separated sequence segments. Optionally, each primer pair can comprise additional sequences, e.g. universal primer sequences or restriction endonuclease sites, at the 5' end of each primer, e.g. to facilitate cloning, DNA sequencing, or reamplification of the target nucleic acid sequence.

Nucleic acid molecules or fragments thereof are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure along a sufficient portion of the molecule to allow for stable binding under laboratory hybridizing conditions. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Molecular Cloning*, A Laboratory Manual, 2nd Ed., Cold Spring Harbor Press, Cold Spring Harbor, N.Y. (1989), and by Haymes et al., *Nucleic Acid Hybridization*, A Practical Approach, IRL Press, Washington, D.C. (1985), the entirety of both of which are herein incorporated by reference. Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization, for example, incubation in 6.0×sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1–6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

Preferred embodiments of the nucleic acid of this invention will specifically hybridize to one or more of the nucleic acid molecules of this invention or complements thereof under low stringency conditions, for example at about 2.0×SSC and about 50° C. In a particularly preferred embodiment, a nucleic acid of the present invention will include those nucleic acid molecules that specifically hybridize to one or more of the nucleic acid molecules of this invention or complements thereof under moderate stringency conditions. In an especially preferred embodiment, a nucleic acid of the present invention will include those nucleic acid molecules that specifically hybridize to one or more of the nucleic acid molecules of this invention or complements thereof under high stringency conditions.

In another aspect of the present invention, one or more of the nucleic acid molecules of the present invention share between 100% and 90% sequence identity with one or more of the *Myxococcus* nucleic acid molecules of this invention or complements thereof. In a further aspect of the present invention, one or more of the nucleic acid molecules of the present invention share between 100% and 95% sequence identity with one or more of the *Myxococcus* nucleic acid molecules of this invention or complements thereof. In a more preferred aspect of the present invention, one or more of the nucleic acid molecules of the present invention share between 100% and 98% sequence identity with one or more of the *Myxococcus* nucleic acid molecules of this invention or complements thereof. In an even more preferred aspect of the present invention, one or more of the nucleic acid molecules of the present invention share between 100% and 99% sequence identity with one or more of the *Myxococcus* nucleic acid molecules of this invention or complements thereof.

The present invention also encompasses the use of nucleic acids of the present invention in recombinant constructs. Using methods known to those of ordinary skill in the art, a protein encoding sequence and/or a promoter sequence of the invention can be inserted into constructs which can be introduced into a host cell of choice for expression of the encoded protein, if an encoding sequence is used, or for use of an *M. xanthus* promoter to direct expression of a heterologous protein. Potential host cells include both prokaryotic and eukaryotic cells. A host cell may be unicellular or found in a multicellular differentiated or undifferentiated organism depending upon the intended use. It is understood that useful exogenous genetic material may be introduced into any cell or organism such as a bacterial cell, fungal cell, fungus, plant cell, plant, mammalian cell, mammal, fish cell, fish, bird cell, bird or bacterial cell.

Depending upon the host, the regulatory regions for expression of *Myxococcus* sequences, particularly MYXU sequences, will vary, including regions from viral, plasmid or chromosomal genes, or the like. For expression in prokaryotic or eukaryotic microorganisms, particularly unicellular hosts, a wide variety of constitutive or regulatable promoters may be employed. Among transcriptional initiation regions which have been described are those obtained from bacterial and yeast hosts, such as *E. coli, B. subtilis*, and *Sacchromyces cerevisiae*, including genes such as beta-galactosidase, T7 polymerase and tryptophan E.

Furthermore, for use in transformation of *M. xanthus*, constructs may include those in which a *Myxococcus* protein encoding sequence or portion thereof of the present invention is positioned with respect to a promoter sequence such that production of antisense mRNA complementary to native mRNA molecules is provided. In this manner, expression of the native gene may be decreased. Such methods may find use for modification of particular functions of the targeted host, and/or for discovering the function of a protein naturally expressed in *M. xanthus*.

The present invention also encompasses the use of nucleic acids of the present invention in constructs which provide for mutation of genes within *M. xanthus* by homologous recombination. Such constructs, for example, may contain two regions of a protein encoding sequence harboring a heterologous portion of DNA (such as an antibiotic resistance marker) between the two encoding segments. Such constructs may also contain, for example, other deletions, insertions, or base changes, or combinations thereof, relative to the *M. xanthus*-derived DNA sequence. Introduction of these constructs into *M. xanthus* can be used to generate mutations in the DNA of *M. xanthus*. Such directed mutations are useful, for example, for functional analysis of the mutated genes.

Homologs of MYXUs

Genomic sequences can be screened for the presence of nucleic acid and/or protein homologs utilizing one or a number of different search algorithms that have been developed, one example of which are the suite of programs referred to as BLAST programs. In addition, unidentified reading frames may be discovered using gene prediction software such as GenScan (available for downloading from the Stanford University web site) or GeneMark. In this manner, novel homologs of the nucleic acid and/or peptide sequences of the present invention are provided, including homologs from plant, animal, fungal or bacterial organism, including other *Myxococcus* species and other myxobacteria. Of particular interest are nucleic acid molecules which encode polypeptides which are homologous to polypeptides encoded by *Myxococcus* protein encoding regions of this invention where the percent identity between the polypeptides is between about 25% and about 40%, more preferably of between about 40% and about 70%, even more preferably of between about 70% and about 90%, and even more preferably between about 90% and 99% and most preferably 100%.

The degeneracy of the genetic code allows different nucleic acid sequences to code for the same protein or peptide, e.g. see U.S. Pat. No. 4,757,006, the entirety of which is herein incorporated by reference. As used herein a nucleic acid molecule is degenerate of another nucleic acid molecule when the nucleic acid molecules encode for the same amino acid sequences but comprise different nucleotide sequences. An aspect of the present invention is that the nucleic acid molecules of the present invention include nucleic acid molecules that are degenerate from the *Myxococcus* protein encoding regions of this invention.

A further aspect of the present invention comprises one or more nucleic acid molecules which differ in nucleic acid sequence from those of a *Myxococcus* protein encoding region of this invention in that they encode the same protein but differ in nucleic acid sequence and protein sequence as the result of one or more conservative amino acid substitutions, deletions or insertions. Codons capable of coding for conservative substitutions are known in the art. For instance, serine is a conservative substitute of alanine and threonine is a conservative substitute for serine.

Regulatory Elements

One class of agents of the present invention includes nucleic acid molecules having promoter regions or partial promoter regions or other regulatory elements, particularly those found in SEQ ID NO: 1 through SEQ ID NO: 1849 and located upstream of translational initiation codon sequence at the start site of a protein coding region. Translational initiation codons in bacteria are most commonly AUG, occasionally GUG, or rarely, UUG or AUU. As used herein, a promoter region is a region of a nucleic acid molecule that is capable, when located in cis to a nucleic acid sequence that encodes for a protein or peptide to function in a way that directs transcription of one or more mRNA molecules that encodes for the protein or peptide. Promoters may be located directly 5' to the protein encoding sequence, for example where a promoter regulates transcription of a single gene. Alternatively, such as when a promoter regulates transcription of a group of genes in an operon, the promoter may be located some distance upstream from a particular encoding region. Promoters of the present invention will generally be recognized by their presence 5' to, or upstream, of the start site for a protein coding region and/or by the presence of the −10 and −35 consensus core promoter elements found in bacterial promoters. In addition, promoters of the present invention may contain additional non-core sequences which can affect promoter strength. Such additional regulatory sequences may be located upstream of, downstream of, or between core promoter elements. Examples of additional regulatory elements include UP elements (−40 upstream region) and DSR elements (region immediately downstream of the transcription start site).

In a preferred embodiment, the promoter of the present invention is present in a recombinant construct and located upstream of a nucleic acid sequence for expression in *M. xanthus* cells, including nucleic acid sequences that encode an *M. xanthus* protein homolog or fragment thereof. For the most part, the promoters of the present invention will be located in contig sequences which generally represent longer nucleic acids than do singleton sequences of the present invention. Contigs in SEQ ID NO: 1 through SEQ ID NO: 1849 are recognized as those sequences whose designations begin with MYX10C, as opposed to singletons whose designations begin with MYX10S.

DNA Replication Elements

The present invention further encompasses *Myxococcus xanthus* DNA replication elements, such as the origin of replication from which replication proceeds, and the terminus, or ter site on the circular chromosome. (Marians, *Annu. Rev. Biochem* 61:673–719 (1992)). The origin or replication may be recognized by the presence of conserved DNA structures Eckdahl et al., *Nucleic Acids Res.* 18:1609–12 (1990); Moriya et al., *Saibo Kogaku* 15:13–22 (1996); *Network Sci.* [Electronic Publication] (1995), 1(4, Avail. URL: http://www.awod.com/netsci/Issues/Oct95/feature4.html). As increased gene dosage has been suggested to occur near origin of replication and ter sites under certain doubling time conditions, identification of such sites is useful for use for insertion of recombinant DNA constructs for expression in *Myxococcus* cells.

Polypeptides

Other aspects of this invention comprise one or more of the polypeptides, including proteins or peptide molecules, encoded by a *Myxococcus* coding region of this invention or fragments thereof or homologs thereof. Coding regions and the encoding protein or peptide molecules of the present invention can be identified using known protein or peptide molecules as a target sequence or target motif, for example using BLAST programs as described herein. In a preferred embodiment the protein or fragment molecules of the present invention are derived from *M. xanthus*, particularly those protein molecules having amino acid sequences provided herein as SEQ ID NO: 9692 through SEQ ID NO: 16825.

As used herein, the terms "protein molecule" or "peptide molecule" include any molecule that comprises five or more amino acids. It is well known in the art that proteins or peptides may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine, and homoserine.

One or more of the protein or peptide molecules may be produced via chemical synthesis, or more preferably, by expression in a suitable bacterial or eukaryotic host. Suitable methods for expression are described by Sambrook et al., *Molecular Cloning, A Laboratory Manual*, 2nd Edition, Cold Spring Harbor Press, Cold Spring Harbor, N.Y. (1989), or similar texts.

A "protein fragment" comprises a subset of the amino acid sequence of that protein. A protein fragment which comprises one or more additional peptide regions not derived from a base protein is a "fusion" protein. Such molecules may be derivatized to contain carbohydrate or other groups (such as keyhole limpet hemocyanin, etc.). Fusion protein or peptide molecules of the present invention are preferably produced via recombinant means.

Another class of agents comprises protein or peptide molecules encoded by the coding regions of this invention or, fragments or fusions thereof in which conservative, non-essential, or irrelevant, amino acid residues are present, substituted or deleted either by intentional manipulation of the peptide or underlying encoding sequence, or as a naturally present homolog in a related organism, for example in a *M. xanthus* strain that is other than the *M. xanthus* disclosed herein. Such a homolog can be obtained by any of a variety of methods. For example, as indicated above, one or more of the disclosed sequences for primers of this invention can be used to define a pair of primers that may be used to isolate the homolog-encoding nucleic acid molecules from any desired species. Such molecules can be expressed to yield homologs by recombinant means.

Antibodies

One aspect of the present invention concerns antibodies, single-chain antigen binding molecules, or other proteins that specifically bind to one or more of the protein or peptide molecules of the present invention and their homologs, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules. In a preferred embodiment the antibodies of the present invention bind to proteins of the present invention, in a more preferred embodiment of the antibodies of the present invention bind to proteins derived from *M. xanthus*.

Nucleic acid molecules that encode all or part of the proteins of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be "fusion" molecules (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal. It is understood that practitioners are familiar with the standard resource materials which describe specific conditions and procedures for the construction, manipulation and isolation of antibodies (see, for example, Harlow and Lane, *Antibodies: A Laboratory Manual*, Cold Spring Harbor Press, Cold Spring Harbor, N.Y. (1988), the entirety of which is herein incorporated by reference).

It is understood that any of the antibodies of the present invention can be substantially purified and/or be biologically active and/or recombinant.

Recombinant Vectors and Transformants

A further aspect of the present invention relates to recombinant vectors comprising nucleic acid molecules of the present invention. In a preferred embodiment a recombinant vector includes at least one nucleic acid molecule of the present invention which can preferably be (a) a protein encoding region of this invention or fragment or homolog thereof, (b) a regulatory element, promoter or partial promoter, or (c) a DNA replication element of the present invention. In a further preferred embodiment of the present invention, a recombinant vector includes a regulatory element, promoter or partial promoter of the present invention and a protein encoding region of the present invention, such nucleic acid molecules of the present invention having a sequence within a contig or singleton within the group identified by SEQ ID NO: 1 through SEQ ID NO: 1849 or complements thereof or fragments of either. In a further more preferred embodiment of the present invention, the recombinant vector includes a regulatory element, promoter or partial promoter of the present invention and a nucleic acid molecule encoding an *M. xanthus* protein or fragment thereof, for example the corresponding promoter for a MYXU which promoter may be identified and obtained from the source contig or singleton for the MYXU.

Preferably, such recombinant vectors of the present invention are introduced into a *Myxococcus* species cell, more preferably an *M. xanthus* cell, particularly an *M. xanthus* DK1622 cell. It is also understood that such recombinant vectors may also be introduced into any other cell or organism, including a plant cell, plant, fungal cell, fungus, mammalian cell, mammal, fish cell, fish, bird cell, bird or other (non-*Myxococcus*) bacterial cell, so long as appropriate components, such as functional promoters, replication elements, and selectable markers are selected for the particular host to be transformed.

The recombinant vector of this invention may be any vector which can be conveniently subjected to recombinant DNA procedures. The choice of a vector will typically depend on the compatibility of the vector with the host cell into which the vector is to be introduced. The vector may be a linear or a closed circular plasmid. The vector system may be a single vector or plasmid or two or more vectors or plasmids which together contain the total DNA to be introduced into the genome of the host. Methods which can be used to introduce recombinant vectors into *Myxococcus* species include triparental mating (Ditta et al., *Plasmid* 13:149–153 (1985); Ditta et al., *Proc. Natl. Acad. Sci. USA* 77:7347–7351 (1980)), electroporation (White et al., *Meth in Mol. Biol.* 47:135–141 (1995)) and P1 Transduction (Avery et al., *Mol. Gen. Genet.* 191:99–109 (1983)).

The vectors of the present invention preferably contain one or more selectable markers which permit easy selection of transformed cells. A selectable marker is a gene whose product provides, for example, biocide or viral resistance, resistance to heavy metals, prototrophy to auxotrophs, and the like. Various selectable markers may be used depending upon the host species to be transformed, and different conditions for selection may be used for different hosts.

A nucleic acid sequence of the present invention may be operably linked to a suitable promoter sequence. A nucleic acid molecule of the present invention that encodes a protein or fragment thereof may also be operably linked to a suitable leader sequence. A leader sequence may be a nontranslated region of an mRNA which is important for translation by a host cell. A leader sequence is operably linked to the 5' terminus of the nucleic acid sequence encoding the protein or fragment thereof. The leader sequence may be native to the nucleic acid sequence encoding the protein or fragment thereof or may be obtained from foreign sources. A polyadenylation sequence may also be operably linked to the 3' terminus of the nucleic acid sequence of the present invention, particularly for use in eukaryotic host cells.

To avoid the necessity of disrupting the cell to obtain the protein or fragment thereof, and to minimize the amount of possible degradation of the expressed protein or fragment thereof within the cell, it may be preferred that expression of the protein or fragment thereof gives rise to a product secreted outside the cell, especially in the case of expression in bacterial host cells of bacterium or bacteria. To this end, the protein or fragment thereof of the present invention may be linked to a signal peptide linked to the amino terminus of the protein or fragment thereof. A signal peptide is an amino acid sequence which permits the secretion of the protein or fragment thereof from the host into the culture medium.

A protein or fragment thereof encoding a nucleic acid molecule of the present invention may also be linked to a propeptide coding region. A propeptide is an amino acid sequence found at the amino terminus of apoprotein or proenzyme. Cleavage of the propeptide from the proprotein yields a mature biochemically active protein. The resulting polypeptide is known as a propolypeptide or proenzyme (or a zymogen in some cases). Propolypeptides are generally inactive and can be converted to mature active polypeptides by catalytic or autocatalytic cleavage of the propeptide from the propolypeptide or proenzyme. The propeptide coding region may be native to the protein or fragment thereof or may be obtained from foreign sources.

A protein or fragment thereof encoding a nucleic acid molecule of the present invention may also be linked to a transit peptide coding region. A transit peptide is an amino acid sequence found at the amino terminus of an active protein which provides for transport of the protein into a plastid organelle, such as a plant chloroplast. The transit peptide coding region may be native to the type of cell to be transformed, or may be obtained from foreign sources.

An expressed protein or fragment thereof of the present invention may be detected using methods known in the art that are specific for the particular protein or fragment. These detection methods may include the use of specific antibodies, formation of an enzyme product, or disappearance of an enzyme substrate. For example, if the protein or fragment thereof has enzymatic activity, an enzyme assay may be used. Alternatively, if polyclonal or monoclonal antibodies specific to the protein or fragment thereof are available, immunoassays may be employed using the antibodies to the protein or fragment thereof. The techniques of enzyme assay and immunoassay are well known to those skilled in the art.

The resulting protein or fragment thereof may be recovered by methods known in the arts For example, the protein or fragment thereof may be recovered from the nutrient medium by conventional procedures including, but not limited to, centrifugation, filtration, extraction, spray-drying, evaporation, or precipitation. The recovered protein or fragment thereof may then be further purified by a variety of chromatographic procedures, e.g., ion exchange chromatography, gel filtration chromatography, affinity chromatography, or the like.

Plant Constructs and Plant Transformants

Of particular interest is the use of nucleic acid molecules of this invention for plant transformation or transfection. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including but not limited to the plants, alfalfa, *Arabidopsis thaliana*, barley, broccoli, cabbage, citrus, cotton, garlic, oat, oilseed rape, onion, canola, flax, maize, an ornamental plant, pea, peanut, pepper, potato, rice, rye, sorghum, soybean, strawberry, sugarcane, sugarbeet, tomato, wheat, poplar, pine, fir, eucalyptus, apple, lettuce, lentils, grape, banana, tea, turf grasses, sunflower, oil palm, etc.

A variety of methods can be used to generate stable transgenic plants. These include particle gun bombardment (Fromm et al, *Bio/Technology* 8:833–839 (1990)), electroporation of protoplasts (Rhodes et al., *Science* 240:204–207 (1989); Shimamoto et al., *Nature* 338:274–276 (1989)), treatment of protoplasts with polyethylene glycol (Datta et al., *Bio/Technology,* 8:736–740 (1990)), microinjection (Neuhaus et al, *Theoretical and Applied Genetics,* 75:30–36 (1987)), immersion of seeds in a DNA solution (Ledoux et al., *Nature,* 249:17–21 (1974)), and transformation with T-DNA of *Agrobacterium* (Valvekens et al., *PNAS,* 85:5536–5540 (1988); Komari, *Plant Science,* 60:223–229 (1989)). In most, perhaps all plant species, *Agrobacterium*- mediated transformation is the most efficient and easiest of these methods to use. T-DNA transfer generally produces the greatest number of transformed plants with the fewest multi-copy insertions, rearrangements, and other undesirable events.

Many different methods for generating transgenic plants using *Agrobacterium* have been described. In general, these methods rely on a "disarmed" *Agrobacterium* strain that is incapable of inducing tumors, and a binary plasmid transfer system. The disarmed strain has the oncogenic genes of the T-DNA deleted. A Binary plasmid transfer system consists of one plasmid with the 23-base pair T-DNA left and right border sequences, between which a gene for a selectable marker (e.g. an herbicide resistance gene) and other desired genetic elements are cloned. Another plasmid encodes the *Agrobacterium* genes necessary for effecting the transfer of the DNA between the border sequences in the first plasmid. Plant tissue is exposed to *Agrobacterium* carrying the two plasmids, the DNA between the left and right border repeats is transferred into the plant cells, transformed cells are identified using the selectable marker, and whole plants are regenerated from the transformed tissue. Plant tissue types that have been reported to be transformed using variations of this method include: cultured protoplasts (Komari, *Plant Science*, 60:223–229 (1989)), leaf disks (Lloyd et al., *Science* 234:464–466 (1986)), shoot apices (Gould et al., *Plant Physiology*, 95:426–434 (1991)), root segments (Valvekens et al., *PNAS*, 85:5536–5540 (1988)), tuber disks (Jin et al., *Journal of Bacteriology*, 169: 4417–4425 (1987)), and embryos (Gordon-Kamm et al., *Plant Cell*, 2:603–618 (1990)).

In the case of *Arabidopsis thaliana* it is possible to perform in planta germline transformation (Katavic et al., *Molecular and General Genetics*, 245:363–370 (1994); Clough et al., *Plant Journal*, 16:735–743 (1998)). In the simplest of these methods, flowering *Arabidopsis* plants are dipped into a culture of *Agrobacterium* such as that described in the previous paragraph. Among the seeds produced from these plants, 1% or more have integration of T-DNA into the genome.

Monocot plants have generally been more difficult to transform with *Agrobacterium* than dicot plants. However, "supervirulent" strains of *Agrobacterium* with increased expression of the virB and virG genes have been reported to transform monocot plants with increased efficiency (Komari et al., *Journal of Bacteriology*, 166:88–94 (1986); Jin et al., *Journal of Bacteriology*, 169:417–425 (1987)).

Most T-DNA insertion events are due to illegitimate recombination events and are targeted to random sites in the genome. However, given sufficient homology between the transferred DNA and genomic sequence, it has been reported that integration of T-DNA by homologous recombination may be obtained at a very low frequency. Even with long stretches of DNA homology, the frequency of integration by homologous recombination relative to integration by illegitimate recombination is roughly 1:1000 (Miao et al., *Plant Journal*, 7:359–365 (1995); Kempin et al, 389:802–803 (1997)).

Exogenous genetic material may be transferred into a plant cell by the use of a DNA vector or construct designed for such a purpose. Vectors have been engineered for transformation of large DNA inserts into plant genomes. Binary bacterial artificial chromosomes have been designed to replicate in both *E. coli* and *Agrobacterium* and have all of the features required for transferring large inserts of DNA into plant chromosomes. BAC vectors, e.g. a pBACwich, have been developed to achieve site-directed integration of DNA into a genome.

A construct or vector may also include a plant promoter to express the gene or gene fragment of choice. A number of promoters that are active in plant cells have been described in the literature. These include the nopaline synthase (NOS) promoter, the octopine synthase (OCS) promoter, a caulimovirus promoter such as the CaMV 19S promoter and the CaMV 35S promoter, the figwort mosaic virus 35S promoter, the light-inducible promoter from the small subunit of ribulose-1,5-bis-phosphate carboxylase (ssRUBISCO), the Adh promoter, the sucrose synthase promoter, the R gene complex promoter, and the chlorophyll a/b binding protein gene promoter. For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea, the chloroplast fructose-1,6-biphosphatase (FBPase) promoter from wheat, the nuclear photosynthetic ST-LS1 promoter from potato, the phenylalanine ammonia-lyase (PAL) promoter and the chalcone synthase (CHS) promoter from *Arabidopsis thaliana*. Also reported to be active in photosynthetically active tissues are the ribulose-1,5-bisphosphate carboxylase (RbcS) promoter from eastern larch (Larix laricina), the promoter for the cab gene, cab6, from pine, the promoter for the Cab-1 gene from wheat, the promoter for the CAB-1 gene from spinach, the promoter for the cab1R gene from rice, the pyruvate, orthophosphate dikinase (PPDK) promoter from *Zea mays*, the promoter for the tobacco Lhcb1*2 gene, the *Arabidopsis thaliana* SUC2 sucrose-$H^+$ symporter promoter, and the promoter for the thylacoid membrane proteins from spinach (psaD, psaF, psaE, PC, FNR, atpC, atpD, cab, rbcS). Other promoters for the chlorophyl a/b-binding proteins may also be utilized in the present invention, such as the promoters for LhcB gene and PsbP gene from white mustard (*Sinapis alba*). Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435 and 4,633,436, all of which are herein incorporated in their entirety.

Constructs or vectors may also include, with the coding region of interest, a nucleic acid sequence that acts, in whole or in part, to terminate transcription of that region. For example, such sequences have been isolated including the Tr7 3' sequence and the nos 3' sequence or the like. It is understood that one or more sequences of the present invention that act to terminate transcription may be used.

A vector or construct may also include other regulatory elements or selectable markers. Selectable markers may also be used to select for plants or plant cells that contain the exogenous genetic material. Examples of such include, but are not limited to, a neo gene which codes for kanamycin resistance and can be selected for using kanamycin, G418, etc.; a bar gene which codes for bialaphos resistance; a mutant EPSP synthase gene which encodes glyphosate resistance; a nitrilase gene which confers resistance to bromoxynil, a mutant acetolactate synthase gene (ALS) which confers imidazolinone or sulphonylurea resistance; and a methotrexate resistant DHFR gene.

A vector or construct may also include a screenable marker to monitor expression. Exemplary screenable markers include a β-glucuronidase or uidA gene (GUS), an R-locus gene, which encodes a product that regulates the production of anthocyanin pigments (red color) in plant tissues; a β-lactamase gene, a gene which encodes an enzyme for which various chromogenic substrates are known (e.g., PADAC, a chromogenic cephalosporin); a luciferase gene, a xylE gene which encodes a catechol dioxygenase that can convert chromogenic catechols; an α-amylase gene, a tyrosinase gene which encodes an enzyme capable of oxidizing tyrosine to DOPA and dopaquinone which in turn condenses to melanin; an α-galactosidase, which will turn a chromogenic α-galactose substrate. Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

Thus, any of the nucleic acid molecules of the present invention may be introduced into a plant cell in a permanent or transient manner in combination with other genetic elements such as vectors, promoters enhancers etc. Further any of the nucleic acid molecules encoding an *E. nidulans* protein or fragment thereof or homologs of the present invention may be introduced into a plant cell in a manner that allows for over expression of the protein or fragment thereof encoded by the nucleic acid molecule.

Uses of the Agents of the Present Invention

Nucleic acid molecules and fragments thereof of the present invention may be employed to obtain nucleic acid molecule homologs from other hosts, particularly from other related bacterial species, such as other myxobacteria species. Such related nucleic acid molecules include those that encode, in whole or in part, protein homologs of MYXU encoded proteins, sequences of genetic elements such as promoters and transcriptional regulatory elements, and sequences of DNA replication elements. Such molecules can be readily obtained by using the above-described nucleic acid molecules to screen cDNA or genomic libraries, or by applying PCR. Methods for forming such libraries are well known in the art. Such homolog molecules may differ in their nucleotide sequences from those found in one or more of the *M. xanthus* genes of this invention or complements thereof because complete complementarity is not needed for stable hybridization. The nucleic acid molecules of the present invention therefore also include molecules that, although capable of specifically hybridizing with the nucleic acid molecules may lack "complete complementarity."

The disclosed nucleic acid molecules may be used to define one or more primer pairs that can be used with the polymerase chain reaction to amplify and obtain any desired nucleic acid molecule or fragment thereof. Such molecules will find particular use in generation of nucleic acid arrays, including microarrays, containing portions of or the entire encoding region for the identified *M. xanthus* genes.

The nucleic acid molecules of the present invention may be used in construction of physical and/or genetic maps of *M. xanthus*. Physical mapping, in conjunction with linkage analysis, can enable the isolation of genes and the elucidation of pathways. Nucleic acid molecules of the present invention can also be used in comparative mapping. Comparative mapping within families provides a method to assess the degree of sequence conservation, gene order, ploidy of species, ancestral relationships and the rates at which individual genomes are evolving. By comparing the results obtained by genetic mapping in model organisms, with those from other species, similarities of genomic structure among species can be established.

In a further aspect of the present invention, one or more of the agents of the present invention may be used to detect the presence, absence or level of a organism, such as a *Myxococus* bacterium, particularly a *M. xanthus* bacterium, and more preferably, a *M. xanthus* DK1622 bacterium in a sample. This aspect is of particular use in the development of sensitive and specific methods to assay for low levels of myxobacteria.

In yet another aspect of the present invention, one or more of the nucleic acid molecules of the present invention are used to determine the level (i.e., the concentration of DNA or RNA in a sample, etc.) or pattern (i.e., the timing or kinetics of expression, rate of decomposition, stability profile, etc.) of expression of the encoding sequence for a protein encoded in part or whole by one or more of the nucleic acid molecule of the present invention (collectively, the "Expression Response" of a cell population). As used herein, the Expression Response of a cell population is said to be "altered" if it differs from the Expression Response of a control cell population. Differences may include changes in level, timing or stability of expression in one or more of the sequences being monitored. Such alterations may occur, for example, across a temporal profile of *Myxococcus xanthus* growth, or in response to various treatments of a population of *Myxococcus xanthus* cells, such as changes to growth substrate or temperature. To determine whether a Expression Response is altered, the Expression Response manifested by the cell population is compared with that of a similar cell population which is not being grown under the treatment in question. As will be appreciated, it is not necessary to re-determine the Expression Response of the cell or tissue sample of similar cell population which is not being grown under the treatment in question each time such a comparison is made; rather, the Expression Response of a particular organism may be compared with previously obtained values of a control cell population.

Of particular interest is the use of nucleic acid molecules of the present invention to monitor gene expression in *Myxococcus* by transcriptional profiling. For example, a microarray-based method for high-throughput monitoring of gene expression may be utilized to measure gene-specific hybridization targets. This 'chip'-based approach involves using microarrays of nucleic acid molecules as gene-specific hybridization targets to quantitatively measure transcription of the corresponding genes. Every sequence in a large population, such as one representing the entire genome of *Myxococcus xanthus*, can be queried at the same time.

Transcription analysis conducted in such a manner will allow for valuable discoveries related to the *Myxococcus xanthus* genome. For example, coordinately regulated genes may be identified and such information in combination with identification of gene function by comparison to sequence of known related genes will allow for development of a stoichiometric metabolic model of the *Myxococcus xanthus* bacterium. Genes can be identified in the bacterial genome and such knowledge leads to the identification of a significant fraction of the enzymes available for cellular metabolism. The collection of enzymes can be organized into a metabolic (or stoichiometric) model for the organism (Selkov et al., *Nucleic Acids Res.* 26(1):43–45 (1998)) to provide insight and hypotheses required to direct effective metabolic engineering.

Thus, the provided MYXUs, which represent substantially all of the genes in *M. xanthus* genome, will find use in transcription profiling work to analyze genes and pathways, including identification of branch points, rate limiting steps, and changes in response to stimuli. Of particular interest is the use of such methods to identify functions for uncharacterized genes and/or genome regions, identify and characterize previously unknown genes, analyze metabolic pathways, such as those involved in carbon utilization and intercell communications. For example, if unknown genes are disrupted or overexpressed, transcription profiling can be carried out to understand effects of the genetic modification.

Several methods have been described for fabricating microarrays of nucleic acid molecules and using such microarrays in detecting nucleic acid sequences. For instance, microarrays can be fabricated by spotting nucleic acid molecules, e.g. genes, oligonucleotides, etc., onto substrates or fabricating oligonucleotide sequences in situ on a substrate. Spotted or fabricated nucleic acid molecules can be applied in a high density matrix pattern of up to about 30 non-identical nucleic acid molecules per square centimeter or higher, e.g. up to about 100 or even 1000 per square centimeter. Useful substrates for arrays include nylon, glass and silicon. See, for instance, U.S. Pat. Nos. 5,202,231; 5,445,934; 5,525,464; 5,700,637; 5,744,305; 5,800,992, the entirety of the disclosures of all of which are incorporated herein by reference. It is noted that additional methods for generating arrays of nucleic acids may be developed which may utilize different substrates and provide for arrays of higher nucleic acid densities. Such methods may be applied equally with the nucleic acid molecules of the present invention as do the methods currently available.

Sequences can be efficiently analyzed by hybridization to a large set of oligonucleotides or cDNA molecules representing a large portion of the genes in a genome. An array consisting of oligonucleotides or longer DNA molecules, such as cDNAs or amplified gene regions, can be used to determine the identity of a target sequence, measure its amount, and detect differences between the target and a reference sequence. Nucleic acid molecule microarrays may also be screened with molecules or fragments thereof to determine nucleic acid molecules that specifically bind molecules or fragments thereof.

The microarray approach may also be used with the *Myxococcus* polypeptides of the present invention (U.S. Pat. Nos. 5,445,934; 5,143,854; 5,079,600; 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides.

It is understood that one or more of the molecules of the present invention, preferably one or more of the nucleic acid molecules or protein molecules or fragments thereof of the present invention may be utilized in a microarray based method. In a preferred embodiment of the present invention, one or more of the *M. xanthus* nucleic acid molecules or protein molecules or fragments thereof of the present invention may be utilized in a microarray based method. A particularly preferred microarray embodiment of the present invention is a microarray comprising *M. xanthus* nucleic acid molecules encoding genes or fragments thereof that are homologs of known genes or nucleic acid molecules. A further preferred microarray embodiment of the present invention is a microarray comprising *M. xanthus* nucleic acid molecules having genes or fragments thereof that are homologs of known genes and *M. xanthus* nucleic acid molecules that comprise genes or fragment thereof that elicit only limited or no matches to known genes.

The microarrays of the present invention comprise at least 50 nucleic acid molecules that specifically hybridize under high stringency to at least 50 nucleic acid molecules encoding *M. xanthus* proteins or fragments thereof. In a more preferred embodiment, the microarrays of the present invention comprise at least 100 nucleic acid molecules that specifically hybridize under high stringency to at least 100 nucleic acid molecules that encode a *M. xanthus* protein or fragment thereof. In an even more preferred embodiment, the microarrays of the present invention comprise at least 1000 nucleic acid molecules that specifically hybridize under high stringency to at least 1000 nucleic acid molecules that encode a *M. xanthus* protein or fragment thereof. In a further even more preferred embodiment, the microarrays of the present invention comprise at least 5000 nucleic acid molecules that specifically hybridize under high stringency to at least 5000 nucleic acid molecules that encode a *M. xanthus* protein or fragment thereof. It is, of course, understood that the sets or 50, 100, 1000 or 5000 nucleic acid molecules for the most part comprise non-identical nucleic acid molecules. While it is understood that a single nucleic acid molecule may encode more than one protein or fragment thereof, in a preferred embodiment, at least 50%, preferably at least 70%, more preferably at least 80%, even more preferably at least 90% of the nucleic acid molecules present on the microarrays encode one protein homolog or fragment thereof.

While it is understood that a single nucleic acid molecule may encode more than one protein or fragment thereof, in a preferred embodiment, at least 50%, preferably at least 70%, more preferably at least 80%, even more preferably at least 90% of the nucleic acid molecules present on the microarrays encode one protein homolog or fragment thereof. In a preferred embodiment, the microarrays of the present invention comprise nucleic acid molecules that specifically hybridize under high stringency to MYXUs selected from the group having SEQ ID NO: 1850 through SEQ ID NO: 9691 or fragments thereof or complements of either. In a more preferred embodiment, the microarrays of the present invention comprise at least about 50, 100, 250, 500, 100, 2,000, 2,500 or 5,000 nucleic acid molecules that specifically hybridize under high stringency to a corresponding number of MYXUs selected from the group having SEQ ID NO: 1850 through SEQ ID NO: 9691 or fragments thereof or complements of either. Alternatively, such microarrays can comprise oligonucletides, primers or polypeptides corresponding to the MYXUs, particularly the polypeptides provided herein as SEQ ID NO: 9692 through SEQ ID NO: 16825.

Nucleic acid molecules of the present invention may also be used in site-directed mutagenesis. Site-directed mutagenesis may be utilized to modify nucleic acid sequences, particularly as it is a technique that allows one or more of the amino acids encoded by a nucleic acid molecule to be replaced by other amino acids, e.g., threonine replaced by methionine or a larger segment replaced by a marker. It is understood that mutants with more than one altered nucleotide can be constructed using techniques well known to those skilled in the art such as isolating restriction fragments and ligating such fragments into a vector. Methods for site-directed mutagenesis include (a) homologous recombination, (b) cassette mutagenesis, (c) primer extension and (d) methods based on PCR. See also U.S. Pat. Nos. 5,880,275, 5,380,831, and 5,625,136. Any of the nucleic acid molecules of the present invention may either be modified by site-directed mutagenesis or used, for example, as nucleic acid molecules for targeting other nucleic acid molecules for modification.

Collections of Nucleic Acid Molecules and Polypeptides

Another aspect of this invention considers collections of nucleic acid molecules and/or polypeptide molecules associated with the MYXUs. The collections can include from about 50 non-identical members or more, e.g. at least about 100 or 250 or higher, more preferably at least about 500 or 1000, most preferably at least 2000 or higher, up to about 4000, or 6000 or even higher, say about 7500, or more non-identical members. Preferred collections of nucleic acid molecules, for example, can be selected from the following groups of MYXUs whose sequences are provided as SEQ ID NO:1850 through SEQ ID NO:9691:

All MYXUs;

MYXUs having a reported Bit score of at least 100;

MYXUs having a reported GeneMark probability score of at least 0.60;

MYXUs having a reported Bit score of at least 100 and a reported GeneMark probability score of at least 0.60;

MYXUs having a reported Bit score of at least 150;

MYXUs having a reported GeneMark probability score of at least 0.75;

MYXUs having a reported Bit score of at least 150 and a reported GeneMark probability score of at least 0.75.

Other preferred nucleic acid collections include any of the above groups but where such groups also include fragments of such sequences.

Collections of polypeptide molecules are also considered in the present invention, including collections of all peptides listed in Table 3 and whose sequences are provided herein as SEQ ID NO: 9692 through SEQ ID NO:16825. Other preferred collections of polypeptides include:

Polypeptides encoded by MYXUs having a reported Bit score of at least 100;

Polypeptides encoded by MYXUs having a reported GeneMark probability score of at least 0.60;

Polypeptides encoded by MYXUs having a reported Bit score of at least 100 and a reported GeneMark probability score of at least 0.60;

Polypeptides encoded by MYXUs having a reported Bit score of at least 150;

Polypeptides encoded by MYXUs having a reported GeneMark probability score of at least 0.75;

Polypeptides encoded by MYXUs having a reported Bit score of at least 150 and a reported GeneMark probability score of at least 0.75.

Another aspect of this invention provides genes, nucleic acid molecules, polypeptides and/or primers in a substantially pure form. For instance, by use of primers specific to nucleic acid sequences of this invention, nucleic acid molecules, such as MYXUs, can be produced in substantially pure form by PCR.

Another aspect of this invention is to provide methods for determining gene expression, e.g. identifying homologous genes expressed by non-*M. xanthus* organisms. Such methods comprise collecting mRNA from tissue of such organisms, using the mRNA as a template for producing a quantity of labeled nucleic acid, and contacting the labeled nucleic acid molecule with a collection of purified nucleic acid molecules, e.g. on a microarray.

Computer Media

One or more of the nucleotide sequence provided in SEQ ID NO: 1, through SEQ ID NO: 9691 or complements or fragments of either, or the protein sequences provided as SEQ ID NO: 9692 through SEQ ID NO: 16825, or fragments thereof, can be "provided" in a variety of media to facilitate use. Such a medium can also provide a subset thereof in a form that allows a skilled artisan to examine the sequences. In one application of this embodiment, a nucleotide or protein sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; optical scanner readable medium such as printed paper, and hybrids of these categories such as magnetic/optical storage media. A skilled artisan can readily appreciate how any of the presently known computer readable mediums can be used to create a manufacture comprising computer readable medium having recorded thereon a nucleotide and/or protein sequence of the present invention.

As used herein, "recorded" refers to a process for storing information on computer readable medium. A skilled artisan can readily adopt any of the presently known methods for recording information on computer readable medium to generate media comprising the nucleotide and/or protein sequence information of the present invention. In addition, a variety of data processor programs and formats can be used to store the sequence information of the present invention on computer readable medium. The sequence information can be represented in a word processing text file, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide and/or protein sequence information of the present invention.

By providing one or more of nucleotide and/or protein sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST and/or BLAZE search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide and/or protein sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide and/or protein sequence information of the present invention, or a memory access means which can access manufactures having recorded thereon the sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 30 to 300 nucleotide residues or from about 10 to 100 amino acids. However, it is well recognized that during searches for commercially important fragments of the molecules of the present invention, such as sequence fragments involved in gene expression and protein processing, the target sequence may be of shorter length.

As used herein, "a target structural motif," or "target motif," refers to any rationally selected sequence or combination of sequences in which the sequences are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences that contain various amounts of the target sequence or target motif and identifies the degree of homology contained in the identified fragment.

Having now generally described the invention, the same will be more readily understood through reference to the following examples that are provided by way of illustration, and are not intended to be limiting of the present invention, unless specified.

EXAMPLES

Example 1

Generation and Assembly of *M. xanthus* Genome Sequence

This example serves to illustrate the generation of the 1849 nucleic acid sequences listed in Table 1 as contigs having SEQ ID NO: 1 through SEQ ID NO: 1849. Approximately 58000 genomic nucleotide sequence traces were derived from a double stranded plasmid library prepared from *Myxococcus xanthus* strain DK1622. The two basic methods for the DNA sequencing are the chain termination method of Sanger et al., *Proc. Natl. Acad. Sci. (U.S.A.)* 74:5463–5467 (1977) and the chemical degradation method of Maxam and Gilbert, *Proc. Natl. Acad. Sci. (U.S.A.)* 74:560–564 (1977) using automated fluorescence-based sequencing as reported by Craxton, *Method*, 2:20–26 (1991); Ju et al., *Proc. Natl. Acad. Sci. (U.S.A.)* 92:4347–4351 (1995); and Tabor and Richardson, *Proc. Natl. Acad Sci. (U.S.A.)* 92:6339–6343 (1995) and high speed capillary gel electrophoresis, e.g. as disclosed by Swerdlow and Gesteland, *Nucleic Acids Res.* 18:1415–1419 (1990); Smith, *Nature* 349:812–813 (1991); Luckey et al., *Methods Enzymol.* 218:154–172 (1993); Lu et al., *J. Chromatog. A.* 680:497–501 (1994); Carson et al., *Anal. Chem* 65:3219–3226 (1993); Huang et al., *Anal. Chem.* 64:2149–2154 (1992); Kheterpal et al., *Electrophoresis* 17:1852–1859 (1996); Quesada and Zhang, *Electrophoresis* 17:1841–1851 (1996); Baba, *Yakugaku Zasshi* 117:265–281 (1997). For instance, genomic nucleotide sequence traces are generated using a 377 or 3700 DNA Sequencer (Perkin-Elmer Corp., Applied Biosystems Div., Foster City, Calif.) allowing for rapid electrophoresis and data collection. With these types of automated systems, fluorescent dye-labeled sequence reaction products are detected and chromatograms are subsequently viewed, stored in a computer and analyzed using corresponding apparatus-related software programs. These methods are known to those of skill in the art and have been described and reviewed (Birren et al., *Genome Analysis: Analyzing DNA,*1, Cold Spring Harbor, N.Y.).

Over 58,000 quality genomic sequence traces are assembled generally as follows:

(a) all traces are "vector-trimmed" i.e., 5' and 3' vector and linker sequences are removed;

(b) a PHRAP assembly is run using default assembly parameters;

(c) Contigs and singletons files and their corresponding quality files are united to create "islands"; and (d) the final set of 1849 nucleic acid sequences (identified as SEQ ID NO. 1 through SEQ ID NO:1849) are run through the annotation and gene selection processes as described in Example 2. Contigs in SEQ ID NO. 1 through SEQ ID NO:1849 are recognized as those sequences whose designations begin with MYX10C. Singleton sequences are recognized as those having designations that begin with MYX10S.

A list of the contig and singleton sequences of this invention is provided in Table 1 and the nucleic acid sequences provided as SEQ ID NO: 1 through SEQ ID NO: 1849.

Example 2

Identification of *Myxococcus xanthus* Genes

This example illustrates the identification of genes within the 1849 islands assembled as described in Example 1. The genes and partial genes embedded in SEQ ID NO. 1 through SEQ ID NO:1849 are identified through a series of informatic analyses. Homology-based searches were used to detect conserved sequences during comparisons of DNA sequences or hypothetically translated protein sequences to public and/or proprietary DNA and protein databases. Existence of an *Myxococcus xanthus* gene is inferred if significant sequence similarity extends over the majority of the target gene. The homology-based method used to define the *Myxococcus xanthus* gene set was BLASTX. For a description of BLASTX see Coulson, *Trends in Biotechnology* 12:76–80 (1994) and Birren et al., *Genome Analysis,* 1:543–559 (1997). BLASTX takes a nucleotide sequence, translates it in three forward reading frames and three reverse complement reading frames, and then compares the six translations against a protein sequence database (e.g. the non-redundant protein (i.e., nr-aa) database maintained by the National Center for Biotechnology Information as part of GenBank and available at the web site: http://www.ncbi.nlm.nih.gov). BLASTX is run with the *Myxococcus xanthus* contigs and singletons represented by SEQ ID NO: 1 through SEQ ID NO: 1849 as queries against the GenBank non-redundant protein data library identified as "nr-aa". To identify genes solely by BLASTX, the minimum BLASTX E value is set at 1E-08.

Since homology-based methods may overlook genes unique to *Myxococcus xanthus*, for which homologous nucleic acid molecules have not yet been identified in databases, gene prediction programs are also used. Additional *M. xanthus* genes with no known homologs under the above BLASTX analysis parameters were predicted using the GeneMark sequence analysis program (Borodovsky et al. *Computers & Chemistry* 17:123–133 (1993)). GeneMark is available from Gene Pro (Atlanta, Ga.) or from Georgia Tech University (e.g. at the web site (see http://genemark.biology.gatech.edu/GeneMark for details). GeneMark calculates the probability of a gene being present based on the presence of a gene-like 'grammer' in the target DNA sequence (i.e., start and stop signals, and a significant open reading frame) and statistical analyses of protein-coding potential through biases in putative codon usage. GeneMark uses inhomogeneous Markov chain models derived from comparisons of known coding and non-coding sequences to predict the presence of protein-coding regions. The GeneMark program is "trained" with *M. xanthus* characteristics. Predicting full-length genes is comprised by point mutations in the unfinished contigs, as well as by the short length of contigs relative to the typical length of a gene. Due to the errors found in the full-length gene predictions by GeneMark, inclusion of GeneMark-predicted genes is limited to those genes and ORFs of partial genes whose probabilities are above the threshold of p.>0.5.

The results of the homology based and predictive analysis methods were merged into a single set of predicted coding regions, and their most probable translation. In setting criteria for confidence of gene prediction, a "high" BLASTX match as used herein means a match having a BLASTX Bit Score as provided in Table 1 of greater than 150; a medium BLASTX Bit Score is 100 to 150; and a low BLASTX Bit Score is less than 100. "Bits" refers to information content, and the score in the "Bits" column indicates the amount of information in the hit. A higher BLASTX Bit Score indicates a better match. Low complexity matches (which can generate high BLAST scores if they match over long stretches with other low quality data) are inherently low information content, and hence do not generate high Bit Scores. A "high" GeneMark Probability Score as used herein means a score as provided in Table 1 of greater than 0.75; a medium GeneMark Probability Score is 0.60 to 0.75; and a low GeneMark Probability Score is less than 0.60. Confidence in accuracy decreases with decreasing BLASTX Bit Score or GeneMark Probability Score. For example, medium confidence is associated with BLASTX Bit Scores of from 100–150, as well as with GeneMark Probability Scores of 0.60–0.75. Confidence increases if a predicted gene has high or medium scores by both BLASTX and GeneMark analysis, as opposed to just having been identified by one or the other types of analysis. Thus, the order of confidence for the MYXUs is generally as follows:

| Confidence | BLASTX Bit Score | GeneMark Probability Score |
|---|---|---|
| high | high (>150) | high (>0.75) |
|  | high | — |
|  | — | high |
| medium | medium (100–150) | medium (0.6–0.75) |
|  | medium | low (<0.6) |
|  | low (<100) | medium |
| low | low | low |

In Table 1, protein encoding regions in the *Myxococcus* nucleic acid molecules of the present invention are identified and results of the BLAST and GeneMark analyses are provided.

A list of the predicted proteins is provided in Table 1 and the amino acid sequences for the *Myxococcus* proteins are provided as SEQ ID NO:9692 through SEQ ID NO: 16825. Predicted proteins are provided where predicted by both BLASTX and GeneMark and for most genes identified solely by GeneMark. The predicted amino acid sequences are the most probable translations for the identified start and stop signals, and the biases in codon usage seen in *Myxococcus* genes.

Legend for Table 1

Seq num

Provides the SEQ ID NO for the listed sequences.

Seq id

The arbitrary identification assigned to each contig or singleton of genomic sequence for SEQ ID NO: 1 through SEQ ID NO:1849 where the "Seq id" for a contig name begins with MYX10C and a singleton name begins with MYX10S. The arbitrarily identification assigned for each MYXU (*Myxococcus xanthus* unigene) for SEQ ID NO: 1850 through SEQ ID NO: 9691 where the "Seq id" is MYX12U_xxxx. The identification assigned to each translated protein of the MYXUs for SEQ ID NO:9692 through SEQ ID NO:16825, where the "Seq id" contains the identification for the corresponding MYXU followed by the designation "prot", for example MYX12U_6967_prot.

Position

Indicates contigs or singletons from which the MYXUs are identified and the location of the MYXU within the contig or singleton. In cases where the first numeral is higher than its corresponding second numeral, the *A. tumefaciens* protein or fragment thereof is encoded by the complement of the sequence set forth in the sequence listing.

Ncbi gi

Refers to National Center for Biotechnology Information GenBank Identifier number that is the best match for a given contig or singleton region from which the protein encoding region was identified.

Bits

Bit score for BLAST match

Blast Expect

The entries in the "Blast Expect" column refer to the probability that matches occur by chance.

% id

The entries in the "% id" column of the table refer to the percentage of identically matched nucleotides (or residues) that exist along the length of that portion of the sequences which is aligned by the BLAST comparison.

% cvrg

The "% cvrg" is the percent of hit sequence length that matches to the query sequence in the match generated using BLAST (% cvrg=(match length/hit total length)× 100).

GeneMark prob

The "GeneMark_prob" is a measure of the likelihood that a region of DNA codes for a protein sequence as determined by the GeneMark gene-prediction program.

Description

A description of the database entry referenced in the "NCBI gi" column. Sequences were analyzed by BLASTX against the non-redundant protein database maintained by NCBI, and a description of the top hit is provided.

Example 3
Design and Preparation of Oligonucleotide Primers

This example serves to illustrate the design of primers of this invention that are useful, for instance, for initiating synthesis of nucleic acid molecules of this invention, specifically substantial parts of certain MYXUs of this invention. Such primers may be designed with the program Primer3 (obtained from the MIT-Whitehead Genome Center) with a "perl-oracle" wrapper. The criteria applied to design a primer include:

Primer annealing temperature (minimum 65° C., optimum 70° C., maximum 75° C.)

Primer length (minimum 18 bp, optimum 20 bp, maximum 28 bp)

G+C content (minimum 20%, maximum 80%)

Position of the primer relative to the gene

Length of the amplified region (200 to 1000 bp, optimum 500 bp)

PHRED quality score of the gene template (minimum of 20)

Whether the gene was defined from one or two contigs

Maximum mismatch=12.0 (weighted score from Primer3 program)

Pair Max Misprime=24.0 (weighted score from Primer3 program)

Maximum N's=0

Maximum poly-X=5

The primary goal of the design process is the creation of groups of primer pairs with a common annealing temperature ($T_m$). When the program can identify a primer pair for any gene that fit the criteria, the gene can be removed from the bin of genes needing primer design. Genes remaining in the bin are subjected to additional rounds of primer-picking, with the gradual and simultaneous relaxation of the criteria (i.e., lowering the annealing temperature, increasing the size of the window where primers could be predicted, expanding the range of permitted size and G+C content, removing the need for a G/C clamp), until a sufficient number of primers are picked for the MYXUs of this invention.

After the *M. xanthus* specific portion of the primers is selected, an additional common primer tail sequence (universal primer) can be added to the 5' ends so that subsequent reamplifications of any primer pair can be done with a single set of primers. In addition, the primer tail sequences may contain restriction digestion sites, preferably for 8 bp recognition restriction enzymes (i.e., NotI and SgfI) and 6 bp cutters (i.e., EcoRI and XhoI) to facilitate cloning of MYXUs into vectors.

Example 4
Discovery of Polyketide Synthase Encoding Genes in *Myxococcus xanthus*

*Myxococcus xanthus* genes encoding polyketide synthases were identified by a series of predictive and homology based methods. Known polyketide synthase gene and protein sequences were used in homology based identification. A list of genes encoding, polyketide synthases discovered in *Myxococcus xanthus* is provided in Table 2 below.

TABLE 2

| GeneName | SEQ ID | SEQ NUM | Organism |
| --- | --- | --- | --- |
| (AE005305) beta-ketoacyl-[acyl carrier protein] synthase | MYX12U_2293 | 4142 | *Escherichia coli* O157:H7 |
| (AE005305) beta-ketoacyl-[acyl carrier protein] synthase | MYX12U_2298 | 4147 | *Escherichia coli* O157:H7 |
| (AF188287) MtaB | MYX12U_4398 | 6246 | *Stigmatella aurantiaca* |
| (AF188287) MtaB | MYX12U_5330 | 7178 | *Stigmatella aurantiaca* |
| (AF188287) MtaD | MYX12U_2103 | 3952 | *Stigmatella aurantiaca* |
| (AF188287) MtaD | MYX12U_2104 | 3953 | *Stigmatella aurantiaca* |
| (AF188287) MtaD | MYX12U_4706 | 6554 | *Stigmatella aurantiaca* |
| (AF188287) MtaD | MYX12U_5343 | 7191 | *Stigmatella aurantiaca* |
| (AF188287) MtaE | MYX12U_4908 | 6756 | *Stigmatella aurantiaca* |
| (AF188287) MtaF | MYX12U_1043 | 2892 | *Stigmatella aurantiaca* |
| (AF188287) MtaG | MYX12U_1440 | 3289 | *Stigmatella aurantiaca* |
| (AF188287) MtaG | MYX12U_1442 | 3291 | *Stigmatella aurantiaca* |
| (AF188287) MtaG | MYX12U_4799 | 6647 | *Stigmatella aurantiaca* |
| (AF204805) NosA | MYX12U_1172 | 3021 | *Nostoc* sp. GSV224 |
| (AF204805) NosA | MYX12U_1195 | 3044 | *Nostoc* sp. GSV224 |
| (AF204805) NosA | MYX12U_1266 | 3115 | *Nostoc* sp. GSV224 |

TABLE 2-continued

| GeneName | SEQ ID | SEQ NUM | Organism |
|---|---|---|---|
| (AF204805) NosA | MYX12U_3988 | 5836 | *Nostoc* sp. GSV224 |
| (AF204805) NosA | MYX12U_4232 | 6080 | *Nostoc* sp. GSV224 |
| (AF204805) NosA | MYX12U_4340 | 6188 | *Nostoc* sp. GSV224 |
| (AF204805) NosA | MYX12U_4877 | 6725 | *Nostoc* sp. GSV224 |
| (AF204805) NosA | MYX12U_4909 | 6757 | *Nostoc* sp. GSV224 |
| (AF204805) NosA | MYX12U_5006 | 6854 | *Nostoc* sp. GSV224 |
| (AF204805) NosA | MYX12U_7749 | 9597 | *Nostoc* sp. GSV224 |
| NosA | MYX12U_6066 | 7914 | *Nostoc* sp. GSV224 |
| NosB | MYX12U_4852 | 6700 | *Nostoc* sp. GSV224 |
| NosB | MYX12U_7008 | 8856 | *Nostoc* sp. GSV224 |
| NosB | MYX12U_7307 | 9155 | *Nostoc* sp. GSV224 |
| (AF204805) NosB | MYX12U_1520 | 3369 | *Nostoc* sp. GSV224 |
| (AF204805) NosB | MYX12U_391 | 2240 | *Nostoc* sp. GSV224 |
| (AF204805) NosB | MYX12U_3994 | 5842 | *Nostoc* sp. GSV224 |
| (AF204805) NosB | MYX12U_4068 | 5916 | *Nostoc* sp. GSV224 |
| (AF204805) NosB | MYX12U_7308 | 9156 | *Nostoc* sp. GSV224 |
| (AF204805) NosC | MYX12U_4894 | 6742 | *Nostoc* sp. GSV224 |
| (AF204805) NosC | MYX12U_5491 | 7339 | *Nostoc* sp. GSV224 |
| (AF204805) NosC | MYX12U_5524 | 7372 | *Nostoc* sp. GSV224 |
| (AF204805) NosC | MYX12U_6349 | 8197 | *Nostoc* sp. GSV224 |
| (AF204805) NosC | MYX12U_6959 | 8807 | *Nostoc* sp. GSV224 |
| (AF204805) NosC | MYX12U_6961 | 8809 | *Nostoc* sp. GSV224 |
| (AF204805) NosD | MYX12U_4568 | 6416 | *Nostoc* sp. GSV224 |
| (AF204805) NosD | MYX12U_4892 | 6740 | *Nostoc* sp. GSV224 |
| (AF204805) NosD | MYX12U_4897 | 6745 | *Nostoc* sp. GSV224 |
| (AF204805) NosD | MYX12U_5176 | 7024 | *Nostoc* sp. GSV224 |
| (AF204805) NosD | MYX12U_5237 | 7085 | *Nostoc* sp. GSV224 |
| (AF210249) peptide synthetase NRPS5A-4-3 | MYX12U_1175 | 3024 | *Streptomyces verticillus* |
| (AF210843) nonribosomal peptide synthetase | MYX12U_151 | 2000 | *Sorangium cellulosum* |
| (AF210843) polyketide synthase | MYX12U_4260 | 6108 | *Sorangium cellulosum* |
| (AF210843) polyketide synthase | MYX12U_6135 | 7983 | *Sorangium cellulosum* |
| (AF210843) polyketide synthase | MYX12U_6506 | 8354 | *Sorangium cellulosum* |
| (AF210843) polyketide synthase | MYX12U_7140 | 8988 | *Sorangium cellulosum* |
| (AF217189) EpoC | MYX12U_4619 | 6467 | *Sorangium cellulosum* |
| (AF217189) EpoC | MYX12U_5715 | 7563 | *Sorangium cellulosum* |
| (AF217189) epoD | MYX12U_6046 | 7894 | *Sorangium cellulosum* |
| (AF217189) epoD | MYX12U_6520 | 8368 | *Sorangium cellulosum* |
| (AF217189) epoD | MYX12U_6564 | 8412 | *Sorangium cellulosum* |
| (AF217189) EpoF | MYX12U_4758 | 6606 | *Sorangium cellulosum* |
| (AF299336) MxcG | MYX12U_4896 | 6744 | *Stigmatella aurantiaca* |
| (AF322013) ID930 | MYX12U_6264 | 8112 | *Bradyrhizobium japonicum* |
| (AJ006977) Ta1 | MYX12U_3797 | 5645 | *Myxococcus xanthus* |
| (AJ006977) Ta1 | MYX12U_3798 | 5646 | *Myxococcus xanthus* |
| (AJ006977) Ta1 | MYX12U_3801 | 5649 | *Myxococcus xanthus* |
| (AJ269505) peptide synthetase | MYX12U_2593 | 4442 | *Anabaena* sp. 90 |
| (AJ269505) peptide synthetase | MYX12U_4152 | 6000 | *Anabaena* sp. 90 |
| (AJ269505) peptide synthetase | MYX12U_5002 | 6850 | *Anabaena* sp. 90 |
| (AJ310530) siderophore non-ribosomal peptide synthetase | MYX12U_6276 | 8124 | *Pseudomonas putida* |
| aklaviketone reductase | MYX12U_3952 | 5800 | *Mycobacterium tuberculosis* |
| pksd | MYX12U_3807 | 5655 | *Bacillus subtilis* |
| polyketide synthase ORF2 | MYX12U_3998 | 5846 | *Bacillus subtilis* |
| POLYKETIDE SYNTHASE PKSL (PKS) | MYX12U_4009 | 5857 | *Bacillus subtilis* |
| POLYKETIDE SYNTHASE PKSM | MYX12U_5033 | 6881 | *Bacillus subtilis* |
| polyketide synthetase pksP | MYX12U_7099 | 8947 | *Bacillus subtilis* |
| polyketide synthetase pksP | MYX12U_7100 | 8948 | *Bacillus subtilis* |
| polyketide synthetase pksP | MYX12U_7302 | 9150 | *Bacillus subtilis* |
| acrA1 protein - *Mycobacterium tuberculosis* (strain H37RV) | MYX12U_6211 | 8059 | *Mycobacterium tuberculosis* |
| ketoacyl reductase - *Deinococcus radiodurans* (strain R1) | MYX12U_1777 | 3626 | *Deinococcus radiodurans* |
| multi-domain beta keto-acyl synthase | MYX12U_3095 | 4944 | *Streptomyces coelicolor* A3(2) |
| non-ribosomal peptide synthetase PA2402 | MYX12U_536 | 2385 | *Pseudomonas aeruginosa* |
| non-ribosomal peptide synthetase PA2402 | MYX12U_537 | 2386 | *Pseudomonas aeruginosa* |
| non-ribosomal peptide synthetase PA2402 | MYX12U_538 | 2387 | *Pseudomonas aeruginosa* |
| non-ribosomal peptide synthetase PA2424 | MYX12U_4962 | 6810 | *Pseudomonas aeruginosa* |
| saframycin Mx1 synthetase A | MYX12U_4567 | 6415 | *Myxococcus xanthus* |
| saframycin Mx1 synthetase A | MYX12U_4826 | 6674 | *Myxococcus xanthus* |
| saframycin Mx1 synthetase B | MYX12U_2812 | 4661 | *Myxococcus xanthus* |
| saframycin Mx1 synthetase B | MYX12U_3575 | 5424 | *Myxococcus xanthus* |
| saframycin Mx1 synthetase B | MYX12U_4754 | 6602 | *Myxococcus xanthus* |
| saframycin Mx1 synthetase B | MYX12U_4961 | 6809 | *Myxococcus xanthus* |

TABLE 2-continued

| GeneName | SEQ ID | SEQ NUM | Organism |
|---|---|---|---|
| saframycin Mx1 synthetase B | MYX12U_662 | 2511 | *Myxococcus xanthus* |
| saframycin Mx1 synthetase B | MYX12U_730 | 2579 | *Myxococcus xanthus* |
| saframycin Mx1 synthetase B | MYX12U_736 | 2585 | *Myxococcus xanthus* |
| syringomycin synthetase | MYX12U_3155 | 5004 | *Pseudomonas syringae* pv. *syringae* |
| TYROCDINE SYNTHETASE III | MYX12U_1929 | 3778 | *Brevibacillus brevis* |

In Tables 2–4, GeneName corresponds to the name of the homolog gene used to assign function to the listed *Myxococcus* gene. SEQ ID lists the MYXU number from Table 1 for each gene. SEQ NUM provides the SEQ ID NO for each gene. Organism indicates the organism encoding the homolog listed in the GeneName column.

Example 5

Discovery of Genes Encoding Serine/threonine Protein Kinase Proteins

*Myxococcus xanthus* genes encoding serine/threonine protein kinase proteins were identified by a series of predictive and homology based methods. Known serine/threonine protein kinase gene and protein sequences were used in homology based identification. A list of genes encoding serine/threonine protein kinase proteins discovered in *Myxococcus xanthus* is provided in Table 3 below.

TABLE 3

| GeneName | SEQ ID | SEQ NUM | Organism |
|---|---|---|---|
| (AF159691) serine/threonine kinase PKN8 | MYX12U_1090 | 2939 | *Myxococcus xanthus* |
| (AF116463) regulatory protein Wd1A | MYX12U_1171 | 3020 | *Streptomyces lincolnensis* |
| (AF163841) serine/threonine protein kinase | MYX12U_1240 | 3089 | *Myxococcus xanthus* |
| (AF163841) serine/threonine protein kinase | MYX12U_1244 | 3093 | *Myxococcus xanthus* |
| (AF159689) serine/threonine kinase PKN3 | MYX12U_1371 | 3220 | *Myxococcus xanthus* |
| (AL358672) serine/threonine-protein kinase. | MYX12U_1392 | 3241 | *Streptomyces coelicolor* A3(2) |
| (AF159693) serine/threonine kinase PKN13 | MYX12U_1430 | 3279 | *Myxococcus xanthus* |
| (AF163841) serine/threonine protein kinase | MYX12U_1469 | 3318 | *Myxococcus xanthus* |
| (AF159691) serine/threonine kinase PKN8 | MYX12U_156 | 2005 | *Myxococcus xanthus* |
| (AF159693) serine/threonine kinase PKN13 | MYX12U_1588 | 3437 | *Myxococcus xanthus* |
| (AF159691) serine/threonine kinase PKN8 | MYX12U_1621 | 3470 | *Myxococcus xanthus* |
| (AF159691) serine/threonine kinase PKN8 | MYX12U_1735 | 3584 | *Myxococcus xanthus* |
| SERINE/THREONINE-PROTEIN KINASE PKN1 | MYX12U_1886 | 3735 | *Myxococcus xanthus* |
| SERINE/THREONINE-PROTEIN KINASE PKNB | MYX12U_1894 | 3743 | *Mycobacterium tuberculosis* |
| SERINE/THREONINE-PROTEIN KINASE PKN6 | MYX12U_2020 | 3869 | *Myxococcus xanthus* |
| (AF159689) serine/threonine kinase PKN3 | MYX12U_209 | 2058 | *Myxococcus xanthus* |
| (AF159690) serine/threonine kinase PKN7 | MYX12U_2165 | 4014 | *Myxococcus xanthus* |
| (AF163841) serine/threonine protein kinase | MYX12U_2208 | 4057 | *Myxococcus xanthus* |
| serine/threonine kinase | MYX12U_2237 | 4086 | |
| (AF159691) serine/threonine kinase PKN8 | MYX12U_2319 | 4168 | *Myxococcus xanthus* |
| serine/threonine kinase | MYX12U_2332 | 4181 | |
| serine/threonine kinase | MYX12U_2432 | 4281 | |
| serine-threonine kinase Stk1 PA1671 | MYX12U_2459 | 4308 | *Pseudomonas aeruginosa* |
| (AF159690) serine/threonine kinase PKN11 | MYX12U_2478 | 4327 | *Myxococcus xanthus* |
| (AF159691) serine/threonine kinase PKN8 | MYX12U_249 | 2098 | *Myxococcus xanthus* |
| SERINE/THREONINE-PROTEIN KINASE PKN1 | MYX12U_2565 | 4414 | *Myxococcus xanthus* |
| serine/threonine kinase | MYX12U_2577 | 4426 | |
| (AF159690) serine/threonine kinase PKN11 | MYX12U_267 | 2116 | *Myxococcus xanthus* |
| (AF159691) serine/threonine kinase PKN8 | MYX12U_2771 | 4620 | *Myxococcus xanthus* |
| (AL583925) possible regulatory protein | MYX12U_2810 | 4659 | *Mycobacterium leprae* |
| (AF159693) serine/threonine kinase PKN13 | MYX12U_2824 | 4673 | *Myxococcus xanthus* |
| serine/threonine protein kinase | MYX12U_2864 | 4713 | *Streptomyces griseus* |
| (AF159690) serine/threonine kinase PKN11 | MYX12U_2913 | 4762 | *Myxococcus xanthus* |

TABLE 3-continued

| GeneName | SEQ ID | SEQ NUM | Organism |
|---|---|---|---|
| (AF159690) serine/threonine kinase PKN11 | MYX12U_2916 | 4765 | Myxococcus xanthus |
| serine/threonine kinase | MYX12U_2986 | 4835 | |
| protein kinase-like protein | MYX12U_2997 | 4846 | Streptomyces coelicolor A3(2) |
| (AF159691) serine/threonine kinase PKN8 | MYX12U_3061 | 4910 | Myxococcus xanthus |
| (AF026951) ATP-and/or GTP-binding protein | MYX12U_3109 | 4958 | Myxococcus xanthus |
| serine/threonine protein kinase | MYX12U_3418 | 5267 | Myxococcus xanthus |
| (AF159689) serine/threonine kinase PKN3 | MYX12U_3470 | 5319 | Myxococcus xanthus |
| (AC005802) L6202.3 | MYX12U_3482 | 5331 | Leishmania major |
| (AF159689) serine/threonine kinase PKN3 | MYX12U_3490 | 5339 | Myxococcus xanthus |
| (AF159689) serine/threonine kinase PKN3 | MYX12U_3523 | 5372 | Myxococcus xanthus |
| (AF159692) serine/threonine kinase PKN12 | MYX12U_3553 | 5402 | Myxococcus xanthus |
| SERINE/THREONINE-PROTEIN KINASE PKN6 | MYX12U_3566 | 5415 | Myxococcus xanthus |
| serine/threonine kinase | MYX12U_3673 | 5522 | |
| serine/threonine kinase | MYX12U_3675 | 5524 | |
| SERINE/THREONINE-PROTEIN KINASE PKN6 | MYX12U_3704 | 5553 | Myxococcus xanthus |
| probable protein serine-threonine phosphatase - Deinococcus radiodurans (strain R1) | MYX12U_3753 | 5602 | Deinococcus radiodurans |
| SERINE/THREONINE-PROTEIN KINASE PKN2 | MYX12U_3773 | 5621 | Myxococcus xanthus |
| SERINE/THREONINE-PROTEIN KINASE PKN6 | MYX12U_3853 | 5701 | Myxococcus xanthus |
| (AF159690) serine/threonine kinase PKN7 | MYX12U_3882 | 5730 | Myxococcus xanthus |
| (AF159690) serine/threonine kinase PKN7 | MYX12U_3971 | 5819 | Myxococcus xanthus |
| (AF159690) serine/threonine kinase PKN11 | MYX12U_4114 | 5962 | Myxococcus xanthus |
| SERINE/THREONINE-PROTEIN KINASE PKN2 | MYX12U_4166 | 6014 | Myxococcus xanthus |
| (AF159690) serine/threonine kinase PKN7 | MYX12U_4332 | 6180 | Myxococcus xanthus |
| (AF159691) serine/threonine kinase PKN8 | MYX12U_4494 | 6342 | Myxococcus xanthus |
| SERINE/THREONINE-PROTEIN KINASE PKN2 | MYX12U_4519 | 6367 | Myxococcus xanthus |
| (AF159692) serine/threonine kinase PKN12 | MYX12U_4581 | 6429 | Myxococcus xanthus |
| (AF159689) serine/threonine kinase PKN3 | MYX12U_471 | 2320 | Myxococcus xanthus |
| (AF159690) serine/threonine kinase PKN7 | MYX12U_473 | 2322 | Myxococcus xanthus |
| (AF159689) serine/threonine kinase PKN3 | MYX12U_4797 | 6645 | Myxococcus xanthus |
| SERINE/THREONINE-PROTEIN KINASE PKN1 | MYX12U_4837 | 6685 | Myxococcus xanthus |
| (AF159690) serine/threonine kinase PKN7 | MYX12U_4899 | 6747 | Myxococcus xanthus |
| SERINE/THREONINE-PROTEIN KINASE PKN5 | MYX12U_493 | 2342 | Myxococcus xanthus |
| SERINE/THREONINE-PROTEIN KINASE PKN6 | MYX12U_4970 | 6818 | Myxococcus xanthus |
| hypothetical protein PH0425 - Pyrococcus horikoshii | MYX12U_5054 | 6902 | Pyrococcus horikoshii |
| (AF159693) serine/threonine kinase PKN13 | MYX12U_5133 | 6981 | Myxococcus xanthus |
| SERINE/THREONINE-PROTEIN KINASE PKN1 | MYX12U_5170 | 7018 | Myxococcus xanthus |
| (AF163841) serine/threonine protein kinase | MYX12U_5314 | 7162 | Myxococcus xanthus |
| (AF159692) serine/threonine kinase PKN12 | MYX12U_5323 | 7171 | Myxococcus xanthus |
| (AF163841) serine/threonine protein kinase | MYX12U_5332 | 7180 | Myxococcus xanthus |
| (AF159690) serine/threonine kinase PKN7 | MYX12U_5594 | 7442 | Myxococcus xanthus |
| (AF159690) serine/threonine kinase PKN11 | MYX12U_5598 | 7446 | Myxococcus xanthus |
| serine/threonine kinase | MYX12U_5600 | 7448 | |
| (AF159689) serine/threonine kinase PKN3 | MYX12U_5613 | 7461 | Myxococcus xanthus |
| (AF159694) serine/threonine kinase PKN9 | MYX12U_5656 | 7504 | Myxococcus xanthus |
| (AF159690) serine/threonine kinase PKN7 | MYX12U_5659 | 7507 | Myxococcus xanthus |
| (AF159689) serine/threonine kinase PKN3 | MYX12U_5664 | 7512 | Myxococcus xanthus |
| (AF159690) serine/threonine kinase PKN7 | MYX12U_5719 | 7567 | Myxococcus xanthus |
| serine/threonine kinase | MYX12U_5728 | 7576 | |
| SERINE/THREONINE-PROTEIN KINASE PKN1 | MYX12U_5906 | 7754 | Myxococcus xanthus |
| SERINE/THREONINE-PROTEIN KINASE PKN6 | MYX12U_5926 | 7774 | Myxococcus xanthus |
| SERINE/THREONINE-PROTEIN KINASE PKN6 | MYX12U_60 | 1909 | Myxococcus xanthus |
| serine/threonine kinase | MYX12U_6146 | 7994 | |
| SERINE/THREONINE-PROTEIN KINASE PKNB | MYX12U_6292 | 8140 | Mycobacterium leprae |
| serine/threonine kinase | MYX12U_6330 | 8178 | |
| (AF159689) serine/threonine kinase PKN3 | MYX12U_6392 | 8240 | Myxococcus xanthus |
| probable multi-domain regulatory protein | MYX12U_6422 | 8270 | Streptomyces coelicolor A3(2) |
| (AF159691) serine/threonine kinase PKN8 | MYX12U_6523 | 8371 | Myxococcus xanthus |

TABLE 3-continued

| GeneName | SEQ ID | SEQ NUM | Organism |
| --- | --- | --- | --- |
| SERINE/THREONINE-PROTEIN KINASE PKN1 | MYX12U_6670 | 8518 | Myxococcus xanthus |
| serine/threonine kinase | MYX12U_669 | 2518 | |
| SERINE/THREONINE-PROTEIN KINASE PKN2 | MYX12U_67 | 1916 | Myxococcus xanthus |
| SERINE/THREONINE-PROTEIN KINASE PKN6 | MYX12U_6754 | 8602 | Myxococcus xanthus |
| (AF159691) serine/threonine kinase PKN8 | MYX12U_680 | 2529 | Myxococcus xanthus |
| (AF230361) serine/threonine kinase | MYX12U_6914 | 8762 | Nostoc sp. PCC 7120 |
| (AF159502) Pkn10 | MYX12U_7161 | 9009 | Myxococcus xanthus |
| (AF159690) serine/threonine kinase PKN7 | MYX12U_7171 | 9019 | Myxococcus xanthus |
| (AF159693) serine/threonine kinase PKN13 | MYX12U_7192 | 9040 | Myxococcus xanthus |
| (AF159690) serine/threonine kinase PKN7 | MYX12U_7258 | 9106 | Myxococcus xanthus |
| serine/threonine kinase | MYX12U_7300 | 9148 | |
| (AF159691) serine/threonine kinase PKN8 | MYX12U_7557 | 9405 | Myxococcus xanthus |
| (AF159690) serine/threonine kinase PKN7 | MYX12U_7706 | 9554 | Myxococcus xanthus |
| SERINE/THREONINE-PROTEIN KINASE PKNB | MYX12U_7778 | 9626 | Mycobacterium tuberculosis |
| SERINE/THREONINE-PROTEIN KINASE PKNB | MYX12U_7804 | 9652 | Mycobacterium tuberculosis |
| (AF159690) serine/threonine kinase PKN11 | MYX12U_7829 | 9677 | Myxococcus xanthus |
| (AF159501) pkn4 | MYX12U_862 | 2711 | Myxococcus xanthus |
| (AF159690) serine/threonine kinase PKN7 | MYX12U_950 | 2799 | Myxococcus xanthus |
| (AF159690) serine/threonine kinase PKN7 | MYX12U_981 | 2830 | Myxococcus xanthus |

Example 6
Discovery of Other *Myxococcus* Genes of Interest

*Myxococcus xanthus* genes encoding antibiotic resistance proteins, DNA modification enzymes, sigma factors and nitrate pathway proteins were identified by a series of predictive and homology based methods. Known gene and protein sequences for antibiotic resistance proteins, DNA modification enzymes, sigma factors and nitrate pathway proteins were used in homology based identification. A list of genes encoding antibiotic resistance proteins, DNA modification enzymes, such as DNA methylases and restriction enzymes, sigma factors and nitrate pathway proteins discovered in *Myxococcus xanthus* is provided in Table 4 below.

TABLE 4

| GeneName | SEQ ID | SEQ NUM | Organism |
| --- | --- | --- | --- |
| RESISTANCE MARKER GENES | | | |
| Chloramphenicol resistance protein | MYX12U_1125 | 2974 | |
| nogalamycin resistance protein snorO | MYX12U_1436 | 3285 | Streptomyces nogalater |
| probable MFS transporter PA3573; chloramphenicol and florfenicol resistance protein | MYX12U_1480 | 3329 | Pseudomonas aeruginosa |
| probable transmembrane efflux protein - Streptomyces coelicolor; chloramphenicol and florfenicol resistance protein | MYX12U_1643 | 3492 | Streptomyces coelicolor A3(2) |
| acriflavin resistance protein acrF - Synechocystis sp. (strain PCC 6803) | MYX12U_1681 | 3530 | Synechocystis sp. |
| hypothetical protein sll1053 - Synechocystis sp. (strain PCC 6803); acridine efflux pump | MYX12U_1682 | 3531 | Synechocystis sp. |
| acriflavin resistance protein acrF - Synechocystis sp. (strain PCC 6803) | MYX12U_1953 | 3802 | Synechocystis sp. |
| ragD protein - Bradyrhizobium japonicum; acridine efflux pump | MYX12U_1995 | 3844 | Bradyrhizobium japonicum |
| (AF188287) MtaD; gentamicin resistance protein | MYX12U_2103 | 3952 | Stigmatella aurantiaca |
| gentamicin resistance protein | MYX12U_2433 | 4282 | |
| macrolide 2'-phosphotransferase I; gentamicin resistance protein | MYX12U_2604 | 4453 | Escherichia coli |
| (AP001511) BH1390-unknown conserved protein in others; BICYCLOMYCIN RESISTANCE PROTEIN (bcr1) | MYX12U_2684 | 4533 | Bacillus halodurans |
| multidrug resistance protein D VCA0267 | MYX12U_2792 | 4641 | Vibrio cholerae |
| probable multidrug resistance protein VC0914 | MYX12U_2994 | 4843 | Vibrio cholerae |
| probable RND efflux membrane fusion protein precursor PA0156; acridine efflux pump | MYX12U_2995 | 4844 | Pseudomonas aeruginosa |
| excinuclease ABC chain A DRA0188; nogalamycin resistance protein snorO | MYX12U_3090 | 4939 | Deinococcus radiodurans |
| acridine efflux pump | MYX12U_3215 | 5064 | |
| (AB007646) UVB-resistance protein UVR8 | MYX12U_3288 | 5137 | Arabidopsis thaliana |
| (AB007646) UVB-resistance protein UVR8 | MYX12U_3518 | 5367 | Arabidopsis thaliana |

TABLE 4-continued

| GeneName | SEQ ID | SEQ NUM | Organism |
|---|---|---|---|
| probable RND efflux transporter PA2527; acriflavin resistance protein | MYX12U_3698 | 5547 | *Pseudomonas aeruginosa* |
| BICYCLOMYCIN RBSISTANCE PROTEIN (bcr1) | MYX12U_4106 | 5954 | |
| (AF097407) chloramphenicol and florfenicol resistance protein | MYX12U_4423 | 6271 | *Salmonella typhimurium* |
| (AF212366) spinster type I; chloramphenicol resistance protein | MYX12U_4610 | 6458 | *Drosophila melanogaster* |
| ACRIFLAVIN RESISTANCE PROTEIN A PRECURSOR | MYX12U_5142 | 6990 | *Escherichia coli* O157:H7 |
| RND multidrug efflux transporter MexD PA4598 | MYX12U_5143 | 6991 | *Pseudomonas aeruginosa* |
| chloramphenicol resistance protein homolog ybcL - *Bacillus subtilis* | MYX12U_5360 | 7208 | *Bacillus subtilis* |
| tetracycline-efflux transport - *Deinococcus radiodurans* (strain R1) | MYX12U_5499 | 7347 | *Deinococcus radiodurans* |
| beta-lactamase inhibitory protein II precursor | MYX12U_5989 | 7837 | *Streptomyces exfoliatus* |
| gentamicin resistance protein | MYX12U_5992 | 7840 | |
| EXCINUCLEASE ABC SUBUNIT A; nogalamycin resistance protein snorO | MYX12U_6339 | 8187 | *Thermus thermophilus* |
| EXCINUCLEASE ABC SUBUNIT A; nogalamycin resistance protein snorO | MYX12U_650 | 2499 | *Bacillus subtilis* |
| (AF146029) putative multidrug-resistance protein | MYX12U_6609 | 8457 | *Aeromonas hydrophila* |
| probable drug transport protein - *Deinococcus radiodurans* (strain R1) | MYX12U_6778 | 8626 | *Deinococcus radiodurans* |
| gentamicin resistance protein | MYX12U_6779 | 8627 | *Enterococcus gallinarum* |
| EXCINUCLEASE ABC SUBUNIT A; nogalamycin resistance protein snorO | MYX12U_7290 | 9138 | *Thermus thermophilus* |
| UVB-resistance protein UVR | MYX12U_867 | 2716 | |
| GENES ENCODING DNA MODIFICATION ENZYMES | | | |
| (AE005037) Vng1035c; EcoVIII modification methylase | MYX12U_1692 | 3541 | *Halobacterium* sp. NRC-1 |
| MODIFICATION METHYLASE AGEI (CYTOSINE-SPECIFIC METHYLTRANSFERASE AGEI) (M.AGEI) | MYX12U_207 | 2056 | *Ruegeria gelatinovora* |
| NAEI VERY-SHORT-PATCH-REPAIR ENDONUCLEASE (V.NAEI) | MYX12U_208 | 2057 | *Saccharothrix aerocolonigenes* |
| (BC001341) Unknown (protein for MGC:5621); endonuclease | MYX12U_7760 | 9608 | *Homo sapiens* |
| MODIFICATION METHYLASE LLADCHIB (ADENINE-SPECIFIC METHYLTRANSFERASE LLADCHIB) (M.LLADCHIB) (M.LLADCHI B) (M.LLAII B) | MYX12U_6856 | 8704 | *Lactococcus lactis* |
| methylase | MYX12U_7014 | 8862 | |
| SUCCINATE-SEMIALDEHYDE DEHYDROGENASE; endonuclease | MYX12U_6375 | 8223 | *Deinococcus radiodurans* |
| threonyl-tRNA synthetase NMB0720; endonuclease | MYX12U_6237 | 8085 | *Neisseria meningitidis* MC58 |
| (AF204951) EsV-1-164; methylase | MYX12U_5304 | 7152 | *Ectocarpus siliculosus* virus |
| (AL138977) putative DNA methylase. | MYX12U_475 | 2324 | *Streptomyces coelicolor* A3(2) |
| site-specific DNA-methyltransferase XF2313 | MYX12U_4885 | 6733 | *Xylella fastidiosa* |
| EcoVIII modification methylase | MYX12U_2131 | 3980 | |
| SIGMA FACTOR GENES | | | |
| RNA POLYMERASE SIGMA-B FACTOR | MYX12U_1226 | 3075 | *Stigmatella aurantiaca* |
| RNA POLYMERASE SIGMA FACTOR SIGZ | MYX12U_1453 | 3302 | *Bacillus subtilis* |
| probable RNA polymerase sigma factor - Streptomyces coelicolor | MYX12U_1962 | 3811 | *Streptomyces coelicolor* A3(2) |
| RNA POLYMERASE SIGMA FACTOR FOR FLAGELLAR OPERON (SIGMA-F FACTOR) (SIGMA-27) (SIGMA-28) | MYX12U_219 | 2068 | *Escherichia coli* O157:H7 |
| extracytoplasmic function alternative sigma factor | MYX12U_2210 | 4059 | *Mycobacterium avium* |
| (AF023662) sigma-D factor | MYX12U_247 | 2096 | *Myxococcus xanthus* |
| (AF023661) sigma-E factor | MYX12U_3542 | 5391 | *Myxococcus xanthus* |
| (AL589164) putative ECF sigma factor | MYX12U_3909 | 5757 | *Streptomyces coelicolor* |
| RNA polymerase sigma-E factor - *Thermotoga maritima* (strain MSB8) | MYX12U_4090 | 5938 | *Thermotoga maritima* |
| (AF190580) alternate sigma factor AlgT | MYX12U_4625 | 6473 | *Pseudomonas syringae* pv. syringae |
| (AL390188) putative ECF-sigma factor | MYX12U_523 | 2372 | *Streptomyces coelicolor* A3(2) |
| RNA POLYMERASE SIGMA-C FACTOR | MYX12U_5322 | 7170 | *Myxococcus xanthus* |
| (AF049107) putative ECF sigma factor RpoE1 | MYX12U_5673 | 7521 | *Myxococcus xanthus* |
| (AF023662) sigma-D factor | MYX12U_5880 | 7728 | *Myxococcus xanthus* |
| probable sigma factor - *Streptomyces coelicolor* | MYX12U_6110 | 7958 | *Streptomyces coelicolor* A3(2) |

TABLE 4-continued

| GeneName | SEQ ID | SEQ NUM | Organism |
|---|---|---|---|
| RNA polymerase sigma-E factor VC2467 | MYX12U_6142 | 7990 | Vibrio cholerae |
| RNA POLYMERASE SIGMA-C FACTOR | MYX12U_6425 | 8273 | Myxococcus xanthus |
| (AL391515) putative ECF-family RNA polymerase sigma factor | MYX12U_6450 | 8298 | Streptomyces coelicolor A3(2) |
| RNA POLYMERASE SIGMA FACTOR RPOD (SIGMA-80) | MYX12U_6510 | 8358 | Myxococcus xanthus |
| RNA POLYMERASE SIGMA FACTOR CARQ | MYX12U_6746 | 8594 | Myxococcus xanthus |
| probable sigma-70 factor, ECF subfamily PA2896 | MYX12U_6862 | 8710 | Pseudomonas aeruginosa |
| RNA polymerase sigma-H factor XF2239 | MYX12U_697 | 2546 | Xylella fastidiosa |
| (AP001507) RNA polymerase ECF-type sigma factor | MYX12U_7164 | 9012 | Bacillus halodurans |
| RNA polymerase sigma-E factor VC2467 | MYX12U_7301 | 9149 | Vibrio cholerae |
| probable sigma factor - Mycobacterium tuberculosis (strain H37RV) | MYX12U_7558 | 9406 | Mycobacterium tuberculosis |
| extracytoplasmic function alternative sigma factor | MYX12U_759 | 2608 | Mycobacterium avium |
| sigma32-like factor RpoH1 | MYX12U_7661 | 9509 | Bradyrhizobium japonicum |
| RNA polymerase ECF-type sigma factor (sigma-Y) | MYX12U_2854 | 4703 | |
| RNA polymerase sigma-E factor | MYX12U_2934 | 4783 | |
| RNA polymerase ECF-type sigma factor (sigma-Z) | MYX12U_3078 | 4927 | |
| RNA POLYMERASE SIGMA FACTOR CARQ | MYX12U_3164 | 5013 | |
| Sigma D factor | MYX12U_3715 | 5564 | |
| Sigma D factor | MYX12U_6271 | 8119 | |
| (AL132973) hypothetical protein SCF91.02c; Sigma D factor | MYX12U_7245 | 9093 | Streptomyces coelicolor A3(2) |
| RNA polymerase ECF-type sigma factor (sigma-W) | MYX12U_3817 | 5665 | |
| RNA polymerase ECF-type sigma factor (sigma-W) | MYX12U_6753 | 8601 | |
| Sigma factor | MYX12U_6138 | 7986 | |
| GTP-binding protein HflX - Deinococcus radiodurans (strain R1); sigma factor | MYX12U_7461 | 9309 | Deinococcus radiodurans |
| NITRATE PATHWAY ENZYMES AND REGULATORY GENES | | | |
| small subunit of cytochrome c nitrite reductase | MYX12U_1126 | 2975 | |
| transport protein MsbA PA4997; ABC transporter, ATP-binding protein | MYX12U_1139 | 2988 | Pseudomonas aeruginosa |
| (AF273214) SasR; response regulator of the NtrC family | MYX12U_1270 | 3119 | Myxococcus xanthus |
| frdD homolog socA2 - Myxococcus xanthus; quarternary ammonium determinant | MYX12U_142 | 1991 | |
| (AG273214) SasR: sigma-54 dependent transcriptional activator | MYX12U_1421 | 3270 | Myxococcus xanthus |
| probable formate hydrogenlyase transcription activator (fh1A) - syphilis spirochete; sigma-54 dependent transcriptional activator | MYX12U_1486 | 3335 | Treponema pallidum |
| putative sigma-54 dependent transcriptional activator | MYX12U_1620 | 3469 | Myxococcus xanthus |
| probable phosphoesterase (EC 3.1.-.-) yvnB - Bacillus subtilis; nitrate reductase (NADH) | MYX12U_1821 | 3670 | Bacillus subtilis |
| small subunit of cytochrome c nitrite reductase | MYX12U_1848 | 3697 | |
| probable two-component response regulator PA4726; sigma-54 dependent transcriptional activator | MYX12U_1882 | 3731 | Pseudomonas aeruginosa |
| (AY013246) putative ABC transporter | MYX12U_2224 | 4073 | Hordeum vulgare |
| (AE005611) putative arylsulfatase regulator; heme biosynthesis protein (nirJ-2) | MYX12U_2233 | 4082 | Escherichia coli O157:H7 |
| (AL353832) molecular chaperone; quarternary ammonium determinant | MYX12U_233 | 2082 | Streptomyces coelicolor A3(2) |
| ATP-binding cassette, sub-family B, member 12; Abc-mitochondrial erythroid | MYX12U_2362 | 4211 | Mus musculus |
| probable periplasmic cytochrome C Cj1357c nitrite reductase | MYX12U_2790 | 4639 | Campylobacter jejuni |
| (AJ245540) small subunit of cytochrome c nitrite reductase | MYX12U_2791 | 4640 | Wolinella succinogenes |
| (AJ223604) gacE2, quarternary ammonium determinant | MYX12U_294 | 2143 | Pseudomonas aeruginosa |
| (AL353832) molecular chaperone; quarternary ammonium determinant | MYX12U_6026 | 7874 | Streptomyces coelicolor A3(2) |
| (AF205943) quaternary ammonium compound resistance protein | MYX12U_949 | 2798 | Escherichia coli |
| NrpB; ABC transporter, ATP-binding protein | MYX12U_3072 | 4921 | Proteus mirabilis |
| heme biosynthesis protein (nirJ-2) | MYX12U_6232 | 8080 | Pseudomonas putida |

TABLE 4-continued

| GeneName | SEQ ID | SEQ NUM | Organism |
|---|---|---|---|
| probable pqqE protein - *Mycobacterium tuberculosis* (strain H37RV); heme biosynthesis protein (nirJ-2) | MYX12U_3100 | 4949 | *Mycobacterium tuberculosis* |
| molybdopterin biosynthetic protein A1 PA3870; heme biosynthesis protein (nirJ-2) | MYX12U_5060 | 6908 | *Pseudomonas aeruginosa* |
| ORF393 protein; heme biosynthesis protein (nirJ-2) | MYX12U_1954 | 3803 | *Pseudomonas stutzeri* |
| formate dehydrogenase homolog yrhE - *Bacillus subtilis* | MYX12U_348 | 2197 | *Bacillus subtilis* |
| DMSO reductase chain A - *Aquifex aeolicus* | MYX12U_4661 | 6509 | *Aquifex aeolicus* |
| probable formate dehydrogenase - *Streptomyces coelicolor* | MYX12U_5029 | 6877 | *Streptomyces coelicolor* A3(2) |
| probable oxidoreductase PA3534 | MYX12U_7098 | 8946 | *Pseudomonas aeruginosa* |
| ADENYLATE CYCLASE 2 (ATP PYROPHOSPHATE-LYASE 2) (ADENYLYL CYCLASE 2) (AC2); small subunit of cytochrome c nitrite reductase | MYX12U_3654 | 5503 | *Stigmatella aurantiaca* |
| ACETOACETATE METABOLISM REGULATORY PROTEIN ATOC (ORNITHINE/ARGININE DECARBOXYLASE INHIBITOR) (ORNITHINE DECARBOXYLASE ANTIZYME); sigma-54 dependent transcriptional activator | MYX12U_3816 | 5664 | *Escherichia coli* K12 |
| regulator protein pilR - *Myxococcus xanthus*; sigma-54 dependent transcriptional activator | MYX12U_5547 | 7395 | *Myxococcus xanthus* |
| sodium ABC transporter ATP-binding protein XF2329 | MYX12U_3898 | 5746 | *Xylella fastidiosa* |
| probable ABC transporter ATP-binding protein APE2579 - *Aeropyrum pernix* (strain K1) | MYX12U_6313 | 8161 | *Aeropyrum pernix* |
| HYPOTHETICAL 52.8 KD PROTEIN SLR0074; ABC transporter ATP-binding protein | MYX12U_6731 | 8579 | *Synechocystis* sp. |
| glutamine ABC transporter, ATP-binding protein (glnQ) | MYX12U_7636 | 9484 | *Archaeoglobus fulgidus* |
| probable ferredoxin reductase PA4331; nitrate reductase (NADH) | MYX12U_3929 | 5777 | *Pseudomonas aeruginosa* |
| short-chain alcohol dehydrogenase homolog socA1 - *Myxococcus xanthus*; nitrate reductase (NADH) | MYX12U_4384 | 6232 | |
| hypothetical protein Rv3230c - *Mycobacterium tuberculosis* (strain H37RV); nitrate reductase (NADH) | MYX12U_6620 | 8468 | *Mycobacterium tuberculosis* |
| probable esterase/lipase - *Streptomyces coelicolor*; nitrate reductase (NADH) | MYX12U_72 | 1921 | *Streptomyces coelicolor* A3(2) |
| catalytic subunit of cytochrome c nitrite reductase | MYX12U_3952 | 5800 | |
| catalytic subunit of cytochrome c nitrite reductase | MYX12U_4144 | 5992 | |
| catalytic subunit of cytochrome c nitrite reductase | MYX12U_4550 | 6398 | |
| catalytic subunit of cytochrome c nitrite reductase | MYX12U_6724 | 8572 | |
| COLICIN I RECEPTOR PRECURSOR; RNA polymerase sigma-54 factor | MYX12U_3964 | 5812 | *Escherichia coli* |
| hypothetical protein PA0830; RNA polymerase sigma-54 factor | MYX12U_5307 | 7155 | *Pseudomonas aeruginosa* |
| RNA polymerase sigma-54 factor | MYX12U_5344 | 7192 | *Myxococcus xanthus* |
| ATP-DEPENDENT PROTEASE LA 1; RNA polymerase sigma-54 factor | MYX12U_6280 | 8128 | *Myxococcus xanthus* |
| (AL353861) hypothetical protein; RNA polymerase sigma-54 factor | MYX12U_6691 | 8539 | *Streptomyces coelicolor* A3(2) |
| (AF305914) HydG, response regulator of the NtrC family | MYX12U_5069 | 6917 | *Klebsiella oxytoca* |
| probable response regulatory protein (atoC) - *syphilis spirochete*; response regulator of the NtrC family | MYX12U_6204 | 8052 | *Treponema pallidum* |
| (AF305914) HydG; response regulator of the NtrC family | MYX12U_7272 | 9120 | *Klebsiella oxytoca* |
| (AF273214) SasR; sigma-54 dependent transcriptional activator | MYX12U_5333 | 7181 | *Myxococcus xanthus* |
| (AF170176) *Salmonella typhimurium* transcriptional regulatory protein (HYDG) (SW:P25852); contains similarity to Pfam domain PF00158 (sigma54), Score = 609.2, E = 2.4e-179, N = 1 and PF00072 (response_reg), Score = 158, E = 1.6e-43, N = 1 [*Salmonella* | MYX12U_6325 | 8173 | *Salmonella typhimurium* LT> [ |

TABLE 4-continued

| GeneName | SEQ ID | SEQ NUM | Organism |
|---|---|---|---|
| *typhimurium* LT>; sigma-54 dependent transcriptional activator | | | |
| probable response regulatory protein (atoC) - *syphilis spirochete*; NtrC/NifA4-like protein regulator | MYX12U_5532 | 7380 | *Treponema pallidum* |
| NtrC/NifA-like protein regulator | MYX12U_6285 | 8133 | |
| (AF204400) FrgC; NtrC/NifA-like protein regulator | MYX12U_7311 | 9159 | *Myxococcus xanthus* |
| (AF204400) FrgC; NtrC/NifA-like protein regulator | MYX12U_3361 | 5210 | *Myxococcus xanthus* |
| (AF163841) putative response regulator; NtrC/NifA-like protein regulator | MYX12U_19 | 1868 | *Myxococcus xanthus* |
| ACETOACETATE METABOLISM REGULATORY PROTEIN ATOC (ORNITHINE/ARGININE DECARBOXYLASE INHIBITOR) (ORNITHINE DECARBOXYLASE ANTIZYME); nitrogen regulation | MYX12U_5690 | 7538 | *Escherichia coli* K12 |
| putative sigma-54 dependent transcriptional activator | MYX12U_5871 | 7719 | *Myxococcus xanthus* |
| probable two-component response regulator PA4726; nitrogen regulation | MYX12U_7707 | 9555 | *Pseudomonas aeruginosa* |
| (AF273214) SasR; sigma-54 dependent transcriptional activator | MYX12U_6056 | 7904 | *Myxococcus xanthus* |
| ACETOACETATE METABOLISM REGULATORY PROTEIN ATOC (ORNITHINE/ARGININE DECARBOXYLASE INHIBITOR)(ORNITHINE DECARBOXYLASE ANTIZYME); sigma-54 dependent transcriptional activator | MYX12U_6103 | 7951 | *Escherichia coli* K12 |
| (AF273214) SasR; sigma-54 dependent transcriptional activator | MYX12U_6776 | 8624 | *Myxococcus xanthus* |
| (AF305914) HydG; sigma-54 dependent transcriptional activator | MYX12U_7061 | 8909 | *Klebsiella oxytoca* |
| ACETOIN CATABOLISM REGULATORY PROTEIN; sigma-54 dependent transcriptional activator | MYX12U_7337 | 9185 | *Ralstonia eutropha* |
| (AE002331) ABC transporter, ATP-binding protein | MYX12U_6558 | 8406 | *Chlamydia muridarum* |
| putative sigma-54 dependent transcriptional activator | MYX12U_2120 | 3969 | *Myxococcus xanthus* |
| regulator protein pi1R - *Myxococcus xanthus*; sigma-54 dependent transcriptional activator | MYX12U_7240 | 9088 | *Myxococcus xanthus* |
| (AF047554) putative ABC transporter | MYX12U_7747 | 9595 | *Myxococcus xanthus* |
| (AF026065) positive phenol-degradative gene regulator; PoxR; putative sigma-54 dependent transcriptional activator | MYX12U_3535 | 5384 | *Ralstonia* sp. E2 |
| regulator protein pi1R - *Myxococcus xanthus*; putative sigma-54 dependent transcriptional activator | MYX12U_4901 | 6749 | *Myxococcus xanthus* |
| (AP273214) SasR; putative sigma-54 dependent transcriptional activator | MYX12U_6635 | 8483 | *Myxococcus xanthus* |

All publications and patent applications are herein incorporated by reference in their entirely to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (16825 sequences)

SEQ ID NO: 1 - DNA, 527 bp, Myxococcus xanthus
aagattccctacccggaggagggcaggcccacgccaccatcaccaagcctcccgaactggtgcagcaggtggaggcgcagtacccgcccgaggcgctagcacaggggctcaccgcgtccgtgcggctcatcatgaccatcagggatgacggctccgtcgccgaggtgctgcccaccgagccggtgggcaacggcttcgacgaggcggccatcgcggcggtgcgccagttccgcttctcgcccgccgaggtcgacggcgtgcccgcgccggtgcaggtggagtatgtctaccacttcaccctcaccgcgccggagccggaggcgggcgccgaggccgtggaggccgagcagcccaaggccacgctcaccggtcagctcatctcccgcggaagccgttctcgcgtgcccaacgccaccgtgagctgcggcgaccacgcggacgcgcccgaggtgatgtccgacgaggacggccgcttcacgctcgaggtgcccgcgggcacctgcgaagtgcgcgtggtggccacgggc

SEQ ID NO: 2 - DNA, 505 bp, Myxococcus xanthus
ccgtgctctaaagcccttcgccttttagtgagaggctcgggttttgcccctgccgctcgcagccccatctggggagttagttcagttggttagaacgccggcctgtcacgccggaggccacgggttcaagtcccgtactcctcgctagaaagcccagcaatcctccggggttgctgggcttttctttttcctctgtccccctatgtggcctcagtgtgccgctccggcaccgttggccggagcggcgtggcgctggacgtcgcgggcaaggcggcggcatcctccgcggacctgcgcagtcgacgtgctcgtggacggggtccccaccgggccccaggacgtgatggtccagtgcgcccagaaggccgaggccctgcaggcgcccctgaagcggggcgacgtggagctccggttccaggagggccagtggaaggcctacgacgcggcgaaagcccacctctccaaggggcgcaagagcgaggcgctcgcgcagctcaacgattgc

SEQ ID NO: 3 - DNA, 608 bp, Myxococcus xanthus
  unsure (1)..(608): unsure at all n locations
tctcaagaggaggactggccttcgaccctggcggcgcgcgccggggggggcctcaggggacgcgggggcaccccgggctccacttcgtgcgcctctccgcagcggaagggcaccggcacttcctggagcgtgccctgcccgcgcgctggctggccgacgccgcgctgcgcacccgcgccctgcgccgcttcctggaagcagggcccgcgctccgggagatggggctgatgtaccagttgctggccctgctccggcgcacgcggccggatggacgcttcgtccatccgctgaccgtcgtcgacctgcccgccacgggacacgcgctggcgctggccgccttgccccagcgcgtgctgtccctgatgcccggagggcccatcggacgcgacgtgcgggaggggctcgacttcctccaggatgcggcgcgcaccgcgatggtcctcgccagcctgccggagccgctgcccgtcagcgaggcgctcaccgtggccgccgagctgcgccggctggagctgccgctgtccgcggccgtcctcaaccggatgccggaggaccccttcacgcccgagtcccgcgcccgcctgcaccggatgctcgccgngcacgga

SEQ ID NO: 4 - DNA, 720 bp, Myxococcus xanthus
cgtgctctcagtaacagatttgtgatcaatttctccgcttccgtattgtcctcgtacaacatcgcgagctacttcttgtgctggaattttcctcagtgactccattactttttgcttttcttctaaaatgttttctgagcaaattcgttttggaagatgcatggctgtcatcatgagaacctgcagcatatgattttgaatcatgtcgcgtatggctcccgtatgatcataataccctgcacgattttcaacaccgactgtttcacttgctgtaatttggacattcgcaatgtgtttgttattccacaatgattgcagtacagggttcgtaaattcaagcgcttctaaattttgcaccatcggtttacctaaataatgatcaattcgataaatttcttcttctttaaacgtactgcttagcttttcattaagctttcttgcagaagcaagatcatgtccaaatggcttttcaatcataagacgcttccagccgctcgtttggtctaagccgcttttttttatatgcagcgcaattacatcgaagtattctggtgctacggacaaataaaacaaacgatttcctttacttctatgagttgtttcttgctcattcacaagctttagcagctgtttgtaatcttctgttttgcttgcgtctactgcttggtaatgaaacagcgacaaaaaatcttcctcgttactttccattttccgtcttga

SEQ ID NO: 5 - DNA, 539 bp, Myxococcus xanthus
tgctctaaggctgctgatcgtggacccggagtcgcgcgtgccatgtgcgccgggtcaggtgggcgaaatctgggtctccggtggaagcgtcgcgcagggctactggcgcaagcccgaggacagcgtggacatcttccaggcggtcccggtgggggctgaggccggtccgaagtacctgcgcaccggcgacctggggctgctgctggaggacgggcagctcatcgtcaccggccggcgcaaggacctcatcatcctgcggggccggaacctgtatccgcaggacgtggagagcatcgtggagcgggcccaccgcaaggtgcgtccaggctgcatcgcggcgttcgccatcgagactccagagggcgaggccctggcggtggtcgcggaggtgtcgcgagacgtggcggagggcgcggacccggccgcgctgggcgccgtggcggacacgctgcggaaggccattgtcgcggagcttcaggtccagccgcacacactggcgctgctgccgccgggctcggtgatgaagacgtcgagcggga

SEQ ID NO: 6 - DNA, 695 bp, Myxococcus xanthus
ataacaggtcctaccgatacctcgctcgtttatttcgcttcctcggttttcaggtggttttcatgagcgttattttgctcttttaccatgctgcatgctcctaacaacaacagaacaaagactacgcatccgttcattatcaacttttgcatccgagattcctccttttgcttatttatcaccatcctttcactattttcctttttttagacatcaaaactaagattgagacatacgttcaccttaccaaagaaaaaatccgaacgagttggattcttaataaagaacctcaattcatcgttcggattttccttcaactaaaatactttgttttaacgtcttacttttgattaaagttgtattctttttccgttccgtttgaaaaacgaacttgtaattcaaacgactgaaaatcttttttcaggccaaacgcatcgattacttccttttttacatcttcatcgggggtgcgctgatcaaaatttaactttttaaatgtggaagataatttattaaacgctttgtctccgttcaagtgctcatagacaatattatcatccactttggcttgtatctcatcggtttcattttcatagccggcttcataatcattattaagcccctttgaaggactactttttaaattcaaattttgcaaaaagttaaaaaagatggtggttttcacattttggatt

SEQ ID NO: 7 - DNA, 666 bp, Myxococcus xanthus
cgaggtcggactcgcggtactgcacgcagtagtcgcgcttggggtactcgccggtgagcgccagccggtgctccaccttggcttcatccagcaccttgtggacgatgtccgggacggtcatctcctggtagatgcggctcttgcggcggtggcgcagcgtccacagccgcggcaccacggtggcgcggtagcggcggcgctccgggccattgccttcatcccaccgtgacatgcgcgacacgatgccgtggaagaagcgcgcggtgccgtctccgagcatgacggtgagccgcgcgtcctggcccagcagcgccttctcatccacgtccacgtccggccgggcggccagtgcgacctccaccgcgtagggctgggacagcgtctcctcggcttcaaagccaaggacggccagctctccggcggtgaagggccctgcctggaactcgaactcagcctggttggctttcaaggcggcgttcgcgatcatccacagtcccccagcgcggggcctcgtccatgggattgggcccgattgtggtgcggcagcatgccacgaattggcgtaccaggggggcctgacacgaaattttcattgcggacgtgcgctggcactggagcgaccccattccaggtcggacttcggtgtagagtggaaaaggggggctg

SEQ ID NO: 8 - DNA, 704 bp, Myxococcus xanthus
agaggaaagagcaagctattatgaccattcaggagccattcgagatatggttcaaaatcatatgctgcaaatgctgatgatgacggctatgcacttaccggcccgcattagcgctgatgatattcgaaacgaaaaaataaatgtgttaaaagcgcttcgtccgcttgtaaaagaagatatggatctagacgttgttcgcggtcaatatgaggctggaaaaataaacggggcttcagtgccgagctacataaatgagcccggtgtatcaccatcttctcagacggacacgtttttagcagccagactatatatcgataattcgctttggaacggcgttcctttctacattcgtacagggaaaagaatggcggaaaaagcgacgcgaattgttattgaattcaaagactcgctaaaagagttgtacttagacaaaggagaaacaacatctccaaatctgttgatcattgaaattaacccgcacgaaaatattacgctgcagttaaacagcaaaaatccatttaatcatggtcatattgagcctgtacaaattaatttttcaggtcagcaagaaggagcaccggaagcatatgaacgccttattgcagatgcatgcgccggagattctacattttttgctcattggaaagaagtagagctagcttgggaatgggttcagccgcttcttgaagcatttcaggaaaata

SEQ ID NO: 9 - DNA, 638 bp, Myxococcus xanthus
atttcgattcgtttaatatggtgatgttcaatatcaatgactttaaatgaaaaaccttcgtttttgatgctatcacctttagcaagatcaaacttttcggtcagcatccagccgccaatggtatcaacgtcttcttgttcaatagttgttccgagtaaatcatttacttcttcaatcaacaccttcgcatctagtacgtagtgattttcattaattttgtgtacgtccggtatttcatcatcatcaaattcatcacgaatttctccaacaatttcttctaaaatgtcttcaaccgttacaagccccgttgttcctccatactcgtctattaagatggccatgtgaattctgtccctttgaattttaagcaataagtcgtaaatggcgatggaatcaatgacttgaatgatgggtttcatatacgtttgcacgggacgtggtttgatatcatcttcttttatgtaatccgctaatatttctttaatattaactaatcccaccacttgatctttgtttccatctataactactggatagcgagtatattgctctactctagccatttttaagaaatcttctatcgtttcatctgctgatacgctaacaatttctgtacgaggcaccatgatttctttagc

SEQ ID NO: 10 - DNA, 708 bp, Myxococcus xanthus
atggtgaactagatttcatgtagctgtttctagctgttgattagagggcaaggcgaagactcctgcgaaaaaaagtgatgtagttatgtcttaatctctttgaattcaccgccggtttgagctttttttatgagtttcttgggaaacactgatagaataaggaatgtaataaatttgtaacactcttatcaaggtaatttttttagggaaaggaattttcaagagatgattaaattatttgtaagcgacttagatggaactcttttacacgaagaaaaatacgtagaacagcataatgcagacgcacttagtgaacttcagcgccaaggagtagaggtttgtcttgcttctggacgaatggatacggaaattctaaagatttctactgatattaataatacatttcatcgcattagccaaaacggaggatttgtgtggaccaaagaaaatcaagaacttcatggaaaagtgtttgaagatgatttagcggttcaactttataaaaaaacgatagatcctaaccgtattacgcttgtctgttcaaacgacacgaattatgtagagcagcgaaatgaaattattgaagcaattgaaactcacatgtttttccctatcgaagaacaaattgaaatgacagattcatttggtcacgctctttctccatctaaaatcacggttcttggagatcatgatgaaatggtagctctg

SEQ ID NO: 11 - DNA, 762 bp, Myxococcus xanthus
ctttctccttgtttgacgtcatatttttccgttaagacccagcctccaattgtatcaacatccgtatcatcaattgtcgtgccaagcagctcgttaagctcacttactaataattttccatctacaatataatgatcgggtttgactttctgaattaatggaagttcatccgcatcaaattcatcacgaatttcaccgacaatttcttctaaaatatcctctactgttacaatccctgctgttccaccgtattcatcaattaaaatagccatatggatgcgttcacgctgcatcttaagcaataaatcatgaataggaatcgattcaattacttcaataacaggacggatatactgttttaaatctattttttccttgctgttgttcatgacaatctcggttaaaatttctttcatattgaccattccaataatatggtctttatctccatcgatgaccggatagcgggtaaaccgttcttcttggaccatctcaaggatgtattcgaccgtatcttcctggtcaattgaaacgacttccgtacgcggcaccataatctccttggcaacgcgatcatcaaagtcaaaaattttacttacatatttaaactccgattgattgatttcaccgcttttatagctttctgataacaagatgcgaagctcttcttcactgtgtgcaagctcattttctgaagcaggctttagaccaaataaccctgttattaaacgagaagaactgttttataaccaaatgaaagga

SEQ ID NO: 12 - DNA, 1164 bp, Myxococcus xanthus
cgtgaggagaagctaaaacgcacagctgacgtatggattacatcttacccaacgctgcgtcaagatatcgatttgtatcagcatcttcattttcatgctttaattctagatgaggctcagagtattaaaaatcatacaacgaagacagcagtagctgttaggactatttcagctaaaaaacgttttgcgcttagcggtacgcctattgaaaactcacttgatgagctttggtcaattttccagaccattcttcctggcttatttccagggcttcgccagtttaaaaacatgtcatcggagcaggtcagccgaattgtaagaccatttttactgcgacgagtaaaaaaggatgtgttaaaagaactgcctgataaaattgaaaccactcatttatctgagctgactaaagaacaaaaagagttgtatgtaggctatttagagcagttaaaatcatctttagccggtgaagattttaataaaaaccgaatgaagatcttggcgggattaacaagacttcgccagatttgctgtcatccgtccctattcgttgaaaattacgaaggggattcaagcaaattagagcagctgctggagattacaagaaatgcggttgccaatggaaaacgcttgttaatcttttctcagtttacaagcatgcttcatattattcgagaagagcttcaaaaagaaaatctctcgtacttttatttagacggtcaaacgccatcaaaagaacgagtggaaatggcggatcggtttaataatggagaacaagacattttcttaatttcattaaaagccggaggcacgggtttaaatttaacgggagccgatacggttattttatatgacttatggtggaaccccgcgattgaagaacaagcggcaggccgtgcacaccgcattggacaaaaaaatgtggtgcaggtcatcaagcttatttctcaaggaaccatcgaagaaaaaatttacgccttgcagcaaaagaaaaaagaactcattgaacaggttattcagccgggagaaacaatgctttctagtttgacagaagaagagctccgagaactgcttagtatgtagcaaaggatgtgtgaggaatgaaaaaatgggcgtttatatcaaattttgatggaacgatttcaaaaaaagaattttactggattg

SEQ ID NO: 13 - DNA, 579 bp, Myxococcus xanthus
aggtctcgggatgagggtctgcgcgcgctcctgcttaggatgctgcgtcaggaactccacgatctgcggcttcatctgctcggaggtggaaccctcgggcagctggccagcggcaccgtcgtagacttccttgatgcgctcctcggtgggcgcggggaccttgtcgtcgatctccgccttcagatacgcctcttgggagaggccgcgcttcttggcctctgcatccacgagcttctccgtcaccatgccgtccaggccacgcttcaggagctgcgacttctgcttctccaggttggccagcggctcctggaggcgctcgctgagctccttgtaggtgatcttctgcccgtcgccgaacgtcgcgacgacagtgtcgggcgcgggctcacccgcagcctgctgcgccgcgggagcggtggccggcgccttctccttgttacagccggcggtgaaggaggccgccaggagcgccgcgaggatgacgcgggtgggacggttgagcatatcccgcccacttagccgagccttaccggacctgcaagttaatgacgtcaggcgacaagcggctcgaagtccagc

SEQ ID NO: 14 - DNA, 603 bp, Myxococcus xanthus
  unsure (1)..(603): unsure at all n locations
ctctaaagccgcgtagaggttgtcgcggatgcccagcgagttggtgagcgccatctccgcctcgacgcggcggcgcttgcgcatggagtccgcggcgatgttgcccagcggcgagtcaccacccgtggagttgttgcggcgctgcacgtcgcgcggcgcgtaggagaagatggacgtcagctggaagttgaagtccatgcccaggatgtacggctggagcagatgcgtggtcatccggtcctcctggttcttgcacgcctggatggcctgacggactcgctcgtcgcggaggaactggccctcctcccagaacacgctgttgtcgtggcggaagcggcgcatggcgtcgtcgcaccacagggcgtccatggggaacacgcggtagtcctggctgatgatttcgccgccctcaccggtgccgagcacctcgggcatcttcaccaccagctccagccggcccacgtacttggcgaaggcgccagagtgcgcgagcaccaccttgcggcccgcggggtcggtgagcagctgcggcgggttgagcacgacgtgcaggtggccacccatcaccgngtccacgcccaccacgnccgggggatttgcgca

SEQ ID NO: 15 - DNA, 569 bp, Myxococcus xanthus
gtgtgctctacagcaacccgggcgcgcccatggtgcgcctgcccctcaagggcgtgtcccggcagagctgcctggtggcgtcgccatccttcgtggacttcgggcccatccgctacgactgcgctgcggcgccccggaagacgtacgtggccaaccggtgcagcagccccgtcacggtgacgggcgcggacatcggcaacggcaccagccaccagttctcgctggtgatgcccatgacggcgcccgtcacgctggggccgggcgcgggcttcgagctggagatcggctacgcgcgcaacgtgcacggacagcacttcagcccgctgtacctgcgcacacccaatgagccttcacccttgctcgtgccgctgctggcggagacgaaccacgagggcatccaggtggaccgctacacgcagggcaccgacagccaactggacgtcctcttcgtggtgtccaacaccaccaccatgcagcagtaccaggaccggctgaaggaggcgattccgcagtggctgcaggcggcccagacgaacggcgtggacgtgcgcgtgggtgtcaccagcacg

SEQ ID NO: 16 - DNA, 592 bp, Myxococcus xanthus
gctctaaggcatccagcatccgccaccgctcgccggtgcgcaccaccagccgccgcagcaccgcgagcgtcatcagcgccaacgccgccacgtgcagcccgctgacactcaacacgtgggccagtcctgcgcgagagaaggcctcttcccacgagtcatccagcgccgcgcgttgccccgccgccagggtgaggaagagcgccgccgcatccgtcgaaggcgacaccgcatggaccgccgccgccagccgcgtgcgcgtgtcctccaatgacacccgccacgccggggcaggggagagcaccatcaggcgccgcgcgtccatgccaccggtgaaggccacgccctgtcgccgtcgcgctgctccgaaatccttctcgcctgggtttgatgggggcgcgtctggctgcagcttcgtctctgcccggacacgttgcccgggcaggagcggcggtggatcgccgcgcagcgacaggttcatccggaaccgtacgggcgcgagcggcccgggagagacgcccgcccgcgcgacggccaatcggacacgcgtcgtcccgtcgaagcggtccacccgctcccgttccccctcgatgac

SEQ ID NO: 17 - DNA, 809 bp, Myxococcus xanthus
gtgctctaaagacctgcaaccttattgacaaaattaatgagtctttgttacccttatacacgttgtgaaaaatttaaaagtgaatgttaaggaaagcagccgttttgatgaacgatcaatcaaatcaggttctttcctttttatatttttactaaggcagatactttgctaaataaagtttcgctttatacaccgtgttctctttgtcataggcgcgtttagaccgaaaacagacggaaaggagtataaaatgtttactcagcttacagaaaaaaaccagaatgcagaagaactaaaagaaacacttgatgatttagagtttcagctatttcgcatgcaggataatttaaaagaaattgctaaaaagtacgaagttatcggtgtcgatcagcctgaagataatcagttagttattgtatcggcacaaaatgacggaaacgcatgtaaaattatgctaaatgaatgcacaaaagcctatagaggggcttgggattttgccatcgatggcgtatatgaagataatcacacgatttttattggtgatattaaaggtcccgctaataagggatatggctctgtatgtatgaattatttaaaagaagtagcgggtgatcaaaatgttcatgtcattaaaggagatattgctgagcgcgactgtgatcatctcgaaagattaattcatttttatgaaaaacataactttgaagtgaatattgcttatacgaatacgtgcgtagaaaatgaatggactccagcttatcaataaaaaacgaacagacggcgtcttgtcggttttttatttgatatat

SEQ ID NO: 18 - DNA, 607 bp, Myxococcus xanthus
  unsure (1)..(607): unsure at all n locations
tgtgctctaaagcagatgctgtggaagggaggggagggattgtggccgagcatcctgaagtgagtgaacccgaggaagcgcgcgcggcatgtgcttccgtgtcggcggtgacagcggagcatcccgctgtcgcgcgcaacgtggcagtcacgggaggggtcgcgtcgctgacgccccccatggacggagcgcccatggcgcaaccggacgcgggggcggcggagcacgtgcggcatcgtcaccgtgagcgcgcggtggtgggcgaccggtggattgcgcgggtgctgcgcgtcggcgcggtggtcagcggcggaatgttcgtcctgtcgctggggctggaggccatgccccaatccgagcgcgtgcacgtcgccatcgacttattgcgaaagggcgccgcgtcactgctgttggtgacgcccgtggcgcggctcgcggtggcgggcacgctgttgggcctgaggggtgagtggcgctacatggcgatggccgtgggcgtgctggggctgctcgccatcgcggtgggcgccggcatccaagcctangaagagcgcgtgtgacngcgctctccccggtgtcagggaggagcgctcacacnccgcgcgcg

SEQ ID NO: 19 - DNA, 743 bp, Myxococcus xanthus
tgtgctctaaagagcgggcctggagctcgccgaagcggtcctccaggccccggatgaagggcccctcgctgtcgggggcggaggccagcacctcatgcgccttggcctgggcggcggcgagccgctgggtcatgaggggcgagttgtaggtccgggccagccggatgaaggcgcggcggatttcgacgttgccttcttgaatcaggcgctcggtgtccttctcctgggtggcgtggaaggtctccagctccgcggcgtcctgggagagctggaggtagccctggctcaccagccggatttccagccggttgcggtggagctccgtcacgctgaacagggacaccagcccgaaggtgccgagcaccacggcgtagcccaggaagatgcgtgtcgcgagagagagcttcacgggcattcctcgctacgtggcgggccgtccaaccgcaagtctcgtctccagggggcgcaggcgcctgctcgggggccgccgagggggaggggctacctccagcgggcctcagcgtactccagggggagcatcccgacacgtctcgactgtgctgactcggtcttccaggaccccgggctcgggaaggtcaagagcttggtttgtgctacatcttgcccaccgggacgcaggactggtttgtcggtacaaactccaaacagatggcgtgaggatttgtataggagattgcagggggggtggaaatttcaattccacatggccttgtttgactttt

SEQ ID NO: 20 - DNA, 460 bp, Myxococcus xanthus
tgctctaacgggacgagcagtccgccagcttgcccggcaggttgagccggtggctgaccgccgtcttgcggctcaccgcctgcgacgcggcccggctggcctcgcgcgcgcgagcggcaaggacgatgcgggccaccactgactcggcgatggacttgttgtcgttgagccacttctccagcgccggacgcagcacgccgtccacctggccggacacctcggggttgttgagccgccccttcgtctggccctggaactgcggctccaccacgtaggtggacaggatggcggtgatgccctcgcggatgtcctccgcggtgagcgtcacgcccttgggcgcgatgccgtgcgtctcgatgtagttgcgcaccgacttcaccaccgagctgcgcaaacccgactggtgcgtgccgcccagtggggtggggatgccgttgacataccagcggatgtgctcgtc

SEQ ID NO: 21 - DNA, 646 bp, Myxococcus xanthus
tgctctaagggaccgcctggtggaggtggtgcagcgcagcctccaccagtcctctggcacctccaccagcgtgggtgaggtgctggtggtggacgacgactcggccacccgcgagctggtcagccgcaacctgcgccgcgccggcttctccacctccgaggcccgcagcggcgaggacgccctgctcaaggcgcgcgtgtccccgcccgccctggtggtgctggatttgatgatgcccaacctggacggcttcgaggtcctgcgccggctgcgcgcggagaagctccaggtgcccgtggtggtgctcaccggcaagacgctctccgcggaggaagaggccctcttgcgtgacggcttcgccggcttcgtgaagaagggcggccacgcgctggaggacgtcatcgcccaggccaagggcctgctgctgtcccagcgcgccgccagcgccggcaagctggcccgcatcctctatgtggaggacagcgcgcagaaccgcgacatcgtccgccgctacctcaacggccacttcgaagtcatcgaagcggaggacggcgagcacggcttggagcgtgccatccgcgacgccccggacctcatcctgatggacctgtcgcttccccgcctggacggctgggaagtcacccgc

SEQ ID NO: 22 - DNA, 789 bp, Myxococcus xanthus
ctctaaaggcgcttgatttctgcaagcggcatgccagttgagcgcagagctaagataaaacggatccactcaatattcgtatcgttataaaggcgctttccattttcatcacgttctacaaaaggaaggattccttctttttcataatagcgcaaagtcggtgcggaaagcccggttttttcattcatttctttcatgctataagacaagattgttcactcccacttatgaatcgtaaagcttactttaaggtatatgataatcgatagttgaacgttttatcaaattctttttcggttatttttaaaaaaatggaacttttatacattttgtccgtaataacaagtagacaataagaaacttactgtaaaaggttaagtaaaggggatagagtaatgaaaaaaataaaatggattagttttatactgctgctgatttcaagcggagtgttttttatcaatcatcagtacgccattttactagcggcttggaccgcttacggaatggctttatcagtcctggtttatttcttttcatacggcatgagtgattcaaatcaagaataaaaaccgtatgcgcatttcttattgtcttcaaaataaaagcaaaaaatgaaagggtggaagaaatgggagaacttttttggatgatttttttcggagcgtgtatttgggttccactaatttggaataaaattgcgattggcaagcgcatcgcttacgaagaaaagaaagcaggacgtgatttaacaagggaaatcaatccgtttactggaggaagaatgtaaat

SEQ ID NO: 23 - DNA, 809 bp, Myxococcus xanthus
gggcggacgcggacgatgctcgcctctcgaatggcctcatcgaagggctttccgtgctgcatgagcagcttcgtctgcgccaccagcaccaggccattctggacggcaatgccaaacaggccgatgaggcccaccaggctggacacgttccatgtctccccggcgatgagcagcgccaggatgcctccgacgaaggcgtctggaagggtggcgatgatgaccagcgactccgccagcgagcccagcgccaggtagaggaggatgaacaccgcgagcagggccaccgcgatggcgaccgtcatcgcctgcgcggcgcgctgctggctctccacccggccgcccatgtccaggaagtaaccggtcggcagcttcagctccgacgccagccgctcgcgcacctcggccgctgtgctgcccaaatcccggcccgcgacgctggcctccaccgcgatgcgccggctgcccgcctcgcggcggatgctgcccgcgccgaatgtctcctcgatggtggccagttggctcaacgggatgcgcgtgccgtcatgcccgtccaccagcagaccccggatggcggtggcgtcgccccggcggtggtccgccagccgcagcagcaagtcatagcggcgctggcccttccacacctgggcgaactcctggcccaccatccccaccttcacggcgtggatgacgtccccgggtgtcaggcccacgcgcgccactgcggcgcggttcacggtgatgcggagctggggaaggccggtcagcttctccgcccgcaagtccttcacgcccttcaccttcgccatgat

SEQ ID NO: 24 - DNA, 717 bp, Myxococcus xanthus
tcagaattccaaacatggctggagggcgcgcgtgagcggttggacaagcttcgccgccgggccggcgtgacaactttttatgggagattttgatgaagagtttgagcaactagctttcatgaatgggattgatcctaaaggctatgaacttgttcgtaaaaaaattgattctactcttactcagttacaagaccaagtggaaaaacaagaagcctaatatcaaaagggggagaaagaatgactcgtatttcaaaggaattagaacgtattttagaggactatgcaccgattgtgaaggaagggcatcaggtgttgattggattgctagatggtactgtacagctagaaaaagaacaggagggagaagcgcctgtacaaattcgtgtttctcctctggatgaacgattagaaataaccgttgatacgttgtttcaaggcatgtaatacgtgcataaggagatgagcagatgaaagatgaagaaattcttgaaaagctacatgagttttcggagtacttagatgttggaaatattctcacttatttattaccgaaattgggctggggatgtattcaagttcttttatttctagtggatggaccttgaaggggattaccgaccgtggtattaggccgttaaaaccgtttttttaaatttctccctgatatttcaagaactttatttaccgaaagaattcaacccctttttttaatatggg

SEQ ID NO: 25 - DNA, 615 bp, Myxococcus xanthus
ctctaaagaaggcgcggcaccgcaccatggacgcgtggacactcgaaggctcacgcatcaccgacccggacacgttgagccgcctgcgcgagatgctggcgaacaagagcccgctcatcatcgagcaccgcttctaccgggagacgcgcgccccgcaccgcttcatctgtgacgatgccgacgtgctggacgagtatctccaggagtcacgtcctggagactcgttctgcgtgtggtcctacaagagcctctgccggggcgacaacctgctgctccaggggaagatgccggacgcgcaggggcggacgccgggcggcgtggcctgagtcaggcggccacgggctccatgcgcggtcgcgtccgtgcctgggccgtcttgcggccaccgcccttgcgcagcaggtccagcgtcacctcgtcctccgtggccagcgccatgagccgctggaggtcgtccacgctgttcaccggccgctggttgatggccagcagtaagtcatccacctggagtccggcctcgtgggcaggtgtcccgtcctgcacgcggagcaccttcaccgcgcgggactggccgttctcccgggtgagtcgtgcgtccaggctcaccgccgtcgc

SEQ ID NO: 26 - DNA, 720 bp, Myxococcus xanthus
gggcagccggcacgcctttagctttcgtacaggcgatgctaacactgtttcctgatcccacacctgggtactatacagataaatcctttgctcatagacgatatgaatgaaatctctgtagaaaaccttgtgattggcagtgggaaactttcattaacggttaaaaaagaagaaagcgaaactattatttacgtgaaagaaaatacgacaaaatacgagcttctatctcaatgtaaagtaagaaattatgtaggttaatgttacttcgaccgcggcttattaagcgtcaattaataagccgaaggtcaatgaaatgaaaggagacagctaatgaagaagtggatactcgctttaagtttggttctggcagtggctggagcagctttaactggatgttcaaatgtacaagaagtttccggggaaaatgatcaagtcgaaattgtattagccggctggggaggcaacccaacagagacgaagctgcttaatcaaactattcaagactttgaaaaactccatccatcaattcatgtgaagcatgaagtaatcactgatcaatacatggatattttaaaaacgcgtttaataggtggaaatggtccagatgttttttatcttgatgcacttgaagcgccgggtcttattaatacaggggttttagaacctttaaattcttatgtaaaatctgattttgatgttcaggattttgagaaaccatta

SEQ ID NO: 27 - DNA, 843 bp, Myxococcus xanthus
gacgctcacccagggcgaggtgctgcgcgtcgccgtgtcggtctccgaggcccggacctttcgttggtacgtgtaccggatggggcactacggcggcacgggcgctcgtgaactggcgcgcggaggcccggtggcgggtgtgcgccagggcgactgtcccgcggaccggtccacgggcctcgtcgcctgtcgctgggcgcccacgctggagatacccgtcggtgaacactgggtgcgcggcgtgtacgtggtgaagctggtgcgtgaggacaaccaccagcgctacgtgcccttcttcgtgcgcgacgcgaatccgcgtgccgaggttgccgtcctcatccccaccgccacctgggccgcctacaacacctgggggggcaccagcctctatgacgaccgcgaccgggtgatgcgcgagcacggcgtcagccgcgccttccgggtgtcctatgaccggcccaactaccgggggcatggcagtggccacctgctgacggacgacctgagcctggttcagtggctggagtcgcaggacctggacgtgggctacttcaccgacgaggacctggacgccagctacgacttgctggccggcgccaaggccttcttcatgtcgggccacgacgagtactggagcccgcgcatccgcgagcacgcggaccgggcggtggcggaaggccggtcgctgctcaacctgggcgcgaacaatgcgtactggcagattcagatggagccatcccaggacggggcgcctcggcgcatcatcgcctgctacaagggccacgcgaacgacccgtacacgggcgcccagcgcacggtgaagttccgcgagcgcgtcgtggg

SEQ ID NO: 28 - DNA, 738 bp, Myxococcus xanthus
gctctcaaggggccgaaggccgggtgggccgtgctctgcagcagggggaaggcccacggcgtggggagggcgcggttccactcgcgcaggtagcccagcggtgtgtacgccttcaacgtcttggggtggatggcccacgggcggcccgcgtccgtcgtcaccagcagcatccgctcgccctcgaccaggaagggcgccgtgttgggcgtctcctgcgggcccagcgtgagtgacacgtccgccagcgtcgttttgcggaagcggttgagcagccgcgtcagggggcctcgcgccgtcgcgcccgcgtccacctgctggcgcgcgtagtgcgagggggtgcgcatggtggcggaggtgaaccgggcgccgcccacctggaagtccaggcgcagcacgagcccgtccgaggccagggccggtgagcccgcgtgcacgctgggccccgcgacatagacgtgaccctgcaggtcctctggcagcgtgccgacgagcactcgcagcggctcgttgacgtactccaccgggctggtggtcatcgcgttgcgtggcatgccaggcctgagcccccggtgggacgtgcagaccggggagcgcatggccgtccgcctcacgcgagagggacgggggcgcttcggtcgccgcgggggcggggtgcttcaggacggattcagtctcgggcatgacgcctccggaggttggggtgagtgaagccccccatcggggatggggggcggggga

SEQ ID NO: 29 - DNA, 1164 bp, Myxococcus xanthus
gtggcaatggtgaaatacgcaagtaaaaaattcccggttgttcaatggtctgctgaagatgcatgtcgcacagatttaccgtttttagctagaattgtagaagctgttatcgatgctggtgcaaaagtcgttaatattccagatacggtaggatttatcacgcctggtgactatcaatccgtatttaattacttaaaagaacatgtatcaaatattcataaggtcgatttgtcagctcactgccacgatgacttagggctagctgttgctaattcaatggctgctattgaagcaggagctactcaaattgaaggaacgattaacggaatcggagaacgtgccggtaacgctgctcttgaagaagtagcacttgcgcttcatgtccgtcaagacttctatcaagcgagcacaggtttgatcttgcccgaaatcaagcgtacgagtgacattatcagtaagcttaccggaatgaatattgcgccaaataaagcaattgtcggaaaaaatgcttttgctcatgaatcaggtattcaccaagatggcgtcttaaaaaatccgttaacatatgagattatttccccagaacttgtgggtgttaaacaaaatccgattgtgctgggtaaacactcaggccgtcatgcgttccgtacacgcttagtagagcttgggttcacattggaagatacagaagcaaacgtgctttttgagaagtttaaagacttagcagataagaaaaaagacattaccgacgatgatttattggcattagtcattcaaaagcaagttagcaaagacagtgaatataagcttgaaagtctgcaagttcagtatggtacgaacaatattcctacggctacgattacgcttcgcaaagaaaacggcgaagagattcaagaagcagctacgggatctggaagcgtggaagctatctataatacgctgcagcgctgtgttgagcaagatgtcaaactattagactatcgtattcagtctattaacggcggtccggatgcactggctgaagtatttgtgaaggttgaaagcgaaggaactgaagcaagcggacgcggagtagcatttgacgtattagaatcgtcagcgaaagcctatttaaatgccattaatcgattaatcgctattcagcagcatcgtacaaagcaagaa

SEQ ID NO: 30 - DNA, 412 bp, Myxococcus xanthus
tgctctacagacatcgaggtgtgcccggtgcagctccccggtcgggagaaccagctgcgcgagccacccctgcgcgcgctgccggacgtcatcgcgcccctggtggacgtgctggccaagcacacggacaagccctacgccctcttgggacacagcatgggcgcactgctcgcataccagctgacgcgggcgctgcgcgagcgcgggctgccggcgccgctgcacctcttcgtcgccagctaccgggcgccgcacacgctccaggcccacacaccggccacggccacccatgacatcgacgcgtccgaagcccggcgcctgggtgagtcacgcgccgtgtcgggcgagatggcggaagagctgctgactttgatgcgcgccaccatgctggcggacaccgccgtgtgcgagg

SEQ ID NO: 31 - DNA, 696 bp, Myxococcus xanthus
taaaagtaactgcatcgggaaatgaacttgatttgcatatagacaataacttcacccttactgcaaaagatgaaactttttcaaaaggattgtttggactacatgttaatcaatcttcagtccggtttcaagacgttaacatgacaaagtttattgatacagatgaaaaagaaattaaaaataaaagttttgaaataggagatctcaccggctggaaaacgataaagggaaatgcattcacaaacgatcatgtaacggatgcaatcgcaaattggagcggtctttttgaacaaaaaggaaagtatcatttatggggtttttctgataagcaagatggcgataatgccactggagaattacattcgtcttattttaaattgagcgggtcaggtgaaattaatttgttaatgggaggcggaaacgaccccacaaaccgttatgtagccttagtccgggcatccgacgataaagaattgattcgtcaagcgaatacaaagtttgcagatgaaaagtaccagcgctacgtatgggatgcttctaagtatataggagaagtactgtacattaaagccgttgatcaagctgtaggcggatgggggcatattaatctagatgatgtaaatgtatttaatacagaaaaaatgccggacaatgtacacagtgtatcaaaagaaccagaggaagctaaacaaagag

SEQ ID NO: 32 - DNA, 923 bp, Myxococcus xanthus
gctctacattcaagagcaactgtagggaggacatctgcgggacggccgcgtgatgatcaatggcgcggcgcatggtcccctcagcaggggcgggggtgtgtcagctctacatgcgccgctttccggacggtgcgctgctggtgatcgagccctggcgcgcgcggtcgtttcctgtgctcaaggatctcatcggcgatcgcagcgcgctcgaccgaattattggcgctggcgggttcatctgggtgccaacgggggccgcgcccgaggcgagcacaccgtccgtcttgtaacagaacgccgactgggcgatcgacgcctcggcttgcatcggatgtggggcctgagtcgccagctgcccgaacgcctggtccgagctcttaacctgcgcgaaggtctctcacctgacgctcctgcctcatgggccgtcggagcggtagcggcgggtgctctccatgaccgcgctgatggatgaggagggctttggcaactgcacctggcacgcggagtgccaggcggctgtgcccgaagtcgatcagcatcgatgccatcgcgctcatgaaccatgaatggctccgggcatcgatcgcatcccaacgcgaagtgtggcgcgagcctgaggcggacgcccagagccaagacccggaaagaggaggaacggcatgacccaaccgatacatcccgtaggcggagcaacgttcgacctggcggcagtcgagcgtgaaatgcggcgagaagacgcctaccagcgggagggacacacggcgcggactctggtgcgcgagcccgacctgcgcatcgtcctcatcgtgatgaaggccggcgcacggatggcggagcatcgcgccagcgaaaccgtgtcggtccacgcgctctccgggcacgtgcgacttcgcctgcccgacaggactgtggagctgccgttc

SEQ ID NO: 33 - DNA, 759 bp, Myxococcus xanthus
gcactgagatgctcccgcccatgggcttgacgatttgacgggtgatggagaggcccaggcccagaccgttgtagtgccgctacgacaccgagcgctcgaacttgcggaacaggcgcgccatgccgtcctcggagatgccaatgccctggttcttcacggcgagcaccgacgaggggccctcgctggcgagcgacacctccaccggctggccgccgccgtacttcaccgcgttggagagcaggttcaccagcacctgctccaggcgcagcgaatcccattcgcccagcagcggtccgtccacgtgcagcgacaacgtgctgccggcgcgggtgaactcctcggagaaggcctccgccatctgccgcaccatctgcgccaggtccagctcccggggctccagcgacagccggcccgcggccagccgcgacacgtccagcagcgtgttgaccagccccaccagccgcgacaactggcggcccagcacgcgggccctgggcgccagctccgcgggcggctcctggttcgagccgcccacctggcgcagcagcaattgcaggtgcaggcgcaggctggtgaggggcgtgcgcagctcatgggcccgcacgctgaggaactcatcccgggcgcgcacgggctcctgcgtgtcggcagggcctgctcgcgcaccgaggggtcccgggccgcgcccgcgtcgcgctgggcctccacgcggggggggctcccgtcatgtgcttccacgtaagaatgcaccgcggggga

SEQ ID NO: 34 - DNA, 565 bp, Myxococcus xanthus
gtgctctaaactgagcgtgcgcgaggcgatggagcacttcggagcgcaccgcgacatcatgcgggtgctgcagacgctccatgacgtcggcctgggctacatccgcctgggacagccctcccccaccctgtccggcggcgaggcccagcgcatcaagctggcccgcgagctggcgcgcgtggccaccgggcgcaccctctacatcctcgacgagcccaccaccggcctgcacttcgaggacatccgcaagctgctgtccgtgctcaaccggctggtcgaggcgggcaacagcgtgctcgtcatcgagcacaacctggacgtcatcaagagcgcggattggctcatcgacctgggccccgagggcggcgcgggcggcggcaggattctggccgctggcacgcccgagcaggtcgccgaggtcgaaggcagccacaccggccgctacctgggccacgtgctgaccaaggcccgcagggcccgcgtgggcgtgcgcgtggacgacccggtgcccgtgaagaagggcgcgcggggctgacgacgcaccgcgcaatgcctcctgggaaaa

SEQ ID NO: 35 - DNA, 684 bp, Myxococcus xanthus
gcgccggggcctccgcctggggcgcgggggccggtggtgccgcttccttgttcgacatgaagttttccgcgccgcccgcgatgaggcccgccaccacgaggcctcccaggccacccgtgagcagcgtgcgctgccgggcgcgcttgacgtcccggggcacctccacgctgatgtccaccgccagcgtgtcaccggattcggtgttgttgcccacgttggagaacagcgtgggggacgggtaggggcccgtcgtcgtcgcgccgccgggccgcttgaagatgccgctgttgccgcccgcggacatgctcgcttcgcgcaggccctccagcagctcgtccattgtctggtagcgccgcgccggatccttctccaggcagcggcggaccaccgcctcgatttccggcgggatgtggaggtccggccgcacctgctggaaggtgggtggggcttccttgtagtgggcgaagatgagctcgatgtggtcgcgcgcgatgaacggcggacgccccatcagcatctggaagagcacgatgcccagcgagtacacgtcgctgcgcgcgtcggtggcattgcgcgcctgctcaggcgccatgtactgcggcgagcccaggaacgtgccgttctgggtgatttcaggagagagttgcccctcctggggcgccgccaccgacttcctttagagca

SEQ ID NO: 36 - DNA, 561 bp, Myxococcus xanthus
tgtgtgccattccgcgcacaatttgtccgaataggactgttcgtgaagccctcggtggcctctcggtgcggcgcggtgaagtcctgctccgtgtaggagttgatggcgttcttgccctcgtagcgggcgaagaacctcggcctccacgcccagcctggtgaaggcctcgcgcgcgaagggcagctcgaaggcgagcccgttgatgttcacgtcgcccgacggctggatgtagatttcgtcgaaggcggacgccaggtagtatcccagcgtgctgttgcccagctcgccgaaggagtcggagtacgccaccgccttcttgcccttggcgcggaaggccttcaccgcgttgcgcagcttctgcgtggcggccggcgtccccggatggtcgatgcgcaccagcagggacttctcgcgcgcgtcgtcttcgggcttctccagcgcctacaccacgtcacgcgccgtggtgtgtttctcgtcaaaggccgccttcataaactcctgtaccatgagctccgaccgcgcgtctttctggaacaggtgtaccacctggcttgagggcac

SEQ ID NO: 37 - DNA, 765 bp, Myxococcus xanthus
cggtccagtgtctcgaagggcttgccgcggcggttggagcgctcgtggcaccagcgcgccagccgtgacttgcccgcgccggtggcgccgctgatgaggatggtctcatcctgcagcgcgaagacgcggaggatgggcagcagctccgccatggagcgccccaccaccgggaggaactcatccacctccggccgggccacgggccgctgcggcagccgggccaggtacggcgccgccacgtccgccagcagttggagccggtcccctgcctccagccagacgaagtcctgccccatcgcggccaggcagtccgcctccagcgaaatcatgccctcgatgtccccacccggcgtgcgcagcggaagcacgcagacgtgtgtcgcatgacggcccaggaagcgctgccggctctcatggctgttgaagcccgccaggctcgggtctcccgtcacgggggcgttgggcgcatggggctgcaccgtcccgacattcacgtcgatggagaccgcgcaccggtgctccaccaccgcgcgccaggccgtggcggaggtgaagaagggcgtgcctacactggcatccgtaatctccgcagcccctacctccagtgcggccagactgcggtaggcctcgccggggcggaggtggacgatgcctcgcaacacccggccccgggctgcgtaccgactggacgcaacggcctcctgggcgacggcctgcagccgccggagcgttgcggcagccgcggcctcgaagtccttggctccc

SEQ ID NO: 38 - DNA, 1158 bp, Myxococcus xanthus
tgctctaaagtctgccaagcaggctatcactttatccatatgcatactccaccgccgcgtccctgactttgtctcattctcatttataaaaaagctctcgtttagtatattaaacgaagagctttattttctattcaaataaacgcacaagcttttttgtatagggatgcctgtttttatcaaatagctgtgcacggtcaaattgatcgataacctcgccttgctgcataaccatcatgcgactgctcataaattttactgctgctaaatcatgcgaaatgaaaagataagacagctgaaaagtctcctgcaaatcttttaataaatttaaaatctttgcttgtaccgtaacatcaaggctcgctgttggttcgtctaacagtatcagagacggacctacactaatggcacgcgcaatcgctacacgctgaagctgtcctccgctcagctaagaagcatagcttttatacacgcgttcattaggtaaattcaccgcttttaaaacctgaaaaatggcggctttcctgtcttttttagacagttcactatgtgtacgaaccgtttcctcaaactgctttccaattgttaaaaaaggcgtaaaagcgcttcgataatcttgaaagatatatgaaatatcttttccaaggataggcgcccctcctttctgcttaaagataatagatcctcctttaagcgttacatctgaaggcagcagtcctcctatcgaagcagcagtgatgcttttcccgcttccgctttctccaatgagcgccatccactgtccttgctcgattgtaaaagaaacgtcttttatgatttgttttgttttattatgaatggctagatgctttacttctaaaacgatgacgatcacctcttttatcgattaacttgatattttcctcgaatatattcacctaaagctgtaaacgtcagcacaaataaaataatggtcacacctggtatcaacattagctgcggagcattgtaaaagtaagccctgccttcatttagcatcgttccccattccggagtaggcggctgagtccctagtccaatataggataatgaggccatcattaaaatgattttccctatatccagcgtagcaagaacaagaatatgtcccccgacgtgaggaagaaagctttagagcac

SEQ ID NO: 39 - DNA, 174 bp, Myxococcus xanthus
tggacgcgcgcgccaactacaacttcctcttcgacaaggacttcgccccgggcatcgaccggggcggcgatgacttccagggaggcggcagctaccagggcacggtcagcgtcggcggtaccttctgacgcgaagacgaagccccaggtggttcgagcttgaatcggcggcgcg

SEQ ID NO: 40 - DNA, 579 bp, Myxococcus xanthus
tcccatcaactacggccgcgcggacgcggcggcgccgacgggtgtgacgctgcgttggtccgggccggaggtgctcacggggcggaacaccttcgcggcgtcgtggctggtgcagggactggttcgcgccatcgccttcgaccccgaggtcgccgcgtggctggtgctgcgtcgcaaggccttcgcggaggtgccatcgcgcaagacgctgcccgcgccggagagcgcggaggcgttgctgccccggctggtggaggcggtggatggaacgcgcacgctcgcggggctcgcatcatcgctgggcgtggccccgggcatggcgcgcgaggctgcgcggatgggctgcgaaaagggactgctgacgcatcagctcgaggtgcccgcggccacgcatcacccggtggacgacctggccgagcgcgttgcgggcctgccgtgttccgcggcccggcggcacgtggagggcttgagcgcgctgctggcgttgatggccgggtatggcgccgcggatgccgcggggaagatggcgctccaggccgccttcgcgaagcgcgcgaatgagcagtggggcgtggcgcc

SEQ ID NO: 41 - DNA, 418 bp, Myxococcus xanthus
ccagtgtgctctaaagacgaggaaggactcgacttccggcaggccctgctcgcggacgaggacctgcggaagatgatgacgcccgaggagatttccgactgcttctcctcgggctaccacacgcgccaggagcctgcgttctacttccgtcgccgggcgcatgacccggacgacaagtgggtgctggggcagcgcatccccggtcagcggagcgtggcggatggggagcaggtgttggacctgctggcgcgacacccctccaccgcgcgccatgtcgcgagcaagctggcgcggcgcttcgtctcggacacgccgccgccggcgctggtggagcgggtggcgaaggtgttcctcgactcgggcggggacctgcccaccgtgtaccgcgcgctcttcctgtcgctttagagcacactgg

SEQ ID NO: 42 - DNA, 802 bp, Myxococcus xanthus
tctaaggatgggggtaacgattgccaccattccaatcattgtcttcttcctagcacttcagcgtcattttatttcaggaatgcttggaagtgcagtaaaataaaaagcagcagatgttgagaaaaaagtatgttagttaaaggaggatccgaaagaatctgattgttgatcgagaatcaaattcgttcggattttttcctttctaggatgaacgtagatttaattgtagttaattgcttctaggtgttgattggagggcaagacgaagactcctgcgggaaaagcggaacaggtgagaccccgcaggagcgtaagcgacgaggaggctcaccggccgcccgcggaaagcaaagtcttgcacggaaatcaacagctgtgtaacaagtaattcatactagttcaatttgttcgtctttagattgggttgatttagccatagttcaatcactttcttaatgaacagggggagagaagatgggagaaatacctgtaggagtacagctttatacgctgcgtgaagaaacgaaaaaagattttaaagggacgcttcaaaaagtagctgctttaggataccaaggggtagaatttgcagggtatgaaggatatacagcgcaagaagtaagagcgtggataatggatttgcagctgaagccagcttctagtcatattccacttgaacaattagaatctaatttacagcaagtgattcactttgagcagcaaatcggagatcacatattgttagtcttatttatgcctgacgtcaacggaggagggattacaactataattcttaatgatt

SEQ ID NO: 43 - DNA, 338 bp, Myxococcus xanthus
tggacactgagcccacgctgaggctgaagatggccatcagggccagcccgaggatggcgagcgcctccaccacttctcagcagcgagaaaccctgggcgcgcttcatcgggggacctccagcgcctcggcgacaatctgcaccttgccggtgagcggcgacacgtccagcgtccagacgttgtctccctgctgcacgtagacgtaggccttctccgtgtagccctgcgggaagaagtagaggcacgccacgccgttctccaccggctgacgctggttgcgcgtgcacacggagaccttgacgtccgccggcagctcacgcgcggggacctcctcggac

SEQ ID NO: 44 - DNA, 518 bp, Myxococcus xanthus
catccgcacgctcttcgacctgcacctgctccgcgacccggacctcttccaactcacgctgaacatccccgccggcatggaggagattcccgtcccgccgctcgtgctgctccccctggcggagaacgcggtgaagcatggccccgccgccggccaccgcggccccctgtccctggacgtcaccgcgcggggacacgaggtggaggtcgccatcgagaacccgggcccctcccgggggccttacgaggacaggctggtgcttaccatcagggaccagcgcctgctcaagcactccgggggcggctgtgatatccacggcgcagacgagatggacgaccacatggtgatcaacacggtgttgatggacgcccaactcatgcaatgggtgttccagaccgatcggttcgagtactcgcctctgacgacaatccagtattggaacttccgcttcagcagactttgacggatctttaaacccctcacccggatgatctgtgtacgctctgtgggggccaact

SEQ ID NO: 45 - DNA, 711 bp, Myxococcus xanthus
gctctacgtgacgtgatgtccctggagcaacgtgccttgcatcccacgccgcgagcggcttgcatcgcgcgcgttcgcggcacttccgcccggagggactccatggaggacgagtggctctggggctgggaccccacgccgggcatcgtctccgtgtgggcggagcccgacggccgcgccttcgtctggcgccgcgtccccaagacgggggagctgcttcgcgaggacgtgcgcttccgcccgtggttgctgctcgcgtccctggaggacctggcgcacctggggcctcggctgcgtccggagtcggatggccccgcgcgctaccgggtgacgtggcaggaactcgaagggcccggtgcgttgcgctacctggtccgcggagatgacggccgcgcgctcaccagcgcggtgctggaaggcgcgtcacgccgcctgggccagccggtgagtcacctgaaggagctgggcgcgaacacggtgctcgcgctgcctccggaggagcagtacctcacgatgtcgggccgcacgtatttccgcgacctcgccttcgatgcgctgcgccgcatgcagttcgacctggagaccaccgggttggacccggcgcatcaccgcgtcttcctggtggcgctgcgaggcccggacggcgcgacggagacactcgaagcccagggggatgacgactcggcggaggcgggacctgctctaccacct

SEQ ID NO: 46 - DNA, 575 bp, Myxococcus xanthus
cttcgagccatacacgaccccgccggggccccctccggacggtggccgggtcctatccagcgccagtctttgcaggacgagcgacagcaggacggagcggttcgcgtagaagtgcatgcgcgcgggggcacctcgtgagtgcacggcgcgcgtggatgccatcacctccgtggtggatttcatgctgcccggaccgcgcgcccccacaggaggcccctcgcgccgggggagccggagtcactcccgtagctcgctgtgtgtccatctccccggggtccaccgagacgaagcgcacgcccgtgccctccaggtcctggggccagacgcgccccaggtgttccagcgcgttcttggacacgccgtatgcgcccccaaggggataggcggacccactcgcatcctaggtgatgtgcatgaccagccccttgactttacccgacatgtacccggccaccgccttggtaaggaggaaggggcccaccacgttgacccttcagcacgcgcttgaggtccttgcaggcggggtccagaaccaacggcagcggtgggggccccagcgtgcttcttttggggac

SEQ ID NO: 47 - DNA, 788 bp, Myxococcus xanthus
acagccgttgatgtaagtgtaggtaaaaaataaataatgcgaaaaactttttctgcttttagccctgcatttaatgtggcagccagtataagtgccaatgcggtttgtaccggtacaacaattactacatacttcaccgtattccaaagagcaattttagctttctcatcttcaagaaccttcatgtagttctcaagccctcgaaaatggaactcagttcctcccagcaattgaactttatgtaaagacaaaaagatggcataaaaaataggtgcaataacaaacagcaatagtacaaacagtgtaggtgtcataaaagcatatccttgccctacatcacgaggtttgtacgttcgtatttttccgtctttcatttcctccactcccccgccgagccttattcataaatactaatctcttgatttgcctgcttttgtgctcttttcaaagctgtttctaaatcactttgtcccaaaaaggcgcttaaaaactggttattaaagttattcatgataataggcaaatacggaccatcttgccagacagttgcataagcagctccttttactaatggacctcgtttttcgtcttcagcaaaaccaagcttatccgctacggattttcttgttggcaatgcataacccttgcttgtccaagttttccattccttcttttccggttaagtactgaatgagctcccaagatgcttttttcttttttgagtcagcattcattacatacgcgaccgtaaatgccatcgtatttttgtgaccgtttattgtcggaac

SEQ ID NO: 48 - DNA, 325 bp, Myxococcus xanthus
gggcactgggcactggcgggctcggggctgaaggccggtgacacgctgtggatggccaacggctacgaagtggaccagttggtgagcaacggcagctcgccggagggcctggaggtgctggccgagtccccattgctgtcgctccagggcgccttcggcttcggccacatggtgctgcgcaagcagggcagcgcctacgtcttctcctcgggcggaatcgacttcgtgcgcacgctggcctccgaggacatggcggacccgcgcgcggcccgcatcgtcgcgaacgtgctctacaaggcgctgggccggccggtacccgacacgc

SEQ ID NO: 49 - DNA, 1114 bp, Myxococcus xanthus
tgctctacagatggccagctatttgataaaagcaggtgcaggaacgtgctacttagctggaggcgttgaaagtacaagcacttctccttttgaaaaaagagcacgtttttctcctgacaaaattggtgatcccgacatgggaattgcagcagaaaacgtggcccagcgatacaacatatctaaagaccagcaggatagatatgctcttttaagtcataaaagaagctgggagtcttttgaaaagagattgtttgaagaagaaacgcttcctcttcgaaatgtgatgcaagatgaagcatttatgaaaaaacgaaacctaacaaagctgctgcaaaaagccagccccgtctttttaaaaaatgaaggcaccgtcaccgcagccaacagctgtggaattaacgacggagcctgcattacgcttgtgatggaagaacaaaaagcacgcgctttaggctttcagcccgttttgcgttttattgacgctgatatttcaggagtgtcacctctttaccctgctattgcgcccgtttctgcgattaaaaatatcttgaagcgaaattcgcttacggtagatgatattgatttatttgaaatcaatgaagcatttgctgttaaagttgtcgcttgcatgcaaaaactggggatatcagaagagaaagtaaatatttgcggaggagcattgacgctaggacacccatacggagcatcaggagctattttagctacgcgtcttttttatgaaagtaagcgccgtgacgtgcgatatgtaatagctgctttaggaagcggaggcggaataggaacagcggtattatttgaagtaatcaaataataccgctgtttttatgccttttttattacattatgttgcatcaaatattgctcaatatctttaaatgtctcaaccggaacaaatgaaacgttttgttcgcgcagtaaatcttgcaaagaatctttcgcaaaggtaacatctgcatattttgctggatgcgaatccggctcgctgtcgccagcaaaataaattgtttcatatgcctcttttagttcttgaataacagcagatttatcgatgccgtagcgttctgaatgccatctgtgagcaggatctagacgc

SEQ ID NO: 50 - DNA, 508 bp, Myxococcus xanthus
acgtccagcttgctggaatgggggcagagggattcgtcccggctgccggcggcgaagaggagcagcaggcgcgagccctggggaatcttcaccccgcccagctccacgtcctccttcgcggtgcgaatcatggcgtgggagacggagtcgtagcggctggactcctcgaggaacttcggcaccaggtcgcggttgtcgcgcagccgctgccacaggccatgctgcagggccagcttccaggcgttggccatcagcgcggtggtggactcatggccggccgacagcatggacgcgcccacggccatgaccagctcgtgcatcgtcagggcctcgccgtcgctctccacggccaccaggtagctggtgaggtcctcctgcgggttcttcttccggtcctcgatgaggcggatgcagtactgctggaactcgatgacgcccttcgccatctccacttggagctcgggggccacgtactcgaagacgagctgctgccagtgcgtagctccag

SEQ ID NO: 51 - DNA, 743 bp, Myxococcus xanthus
ccctgacagccatgcccccgaacacgagcgcgagcccgcacacccagcccgcccaacgccctgcctgatccattccgttcctccaagccacggcgattgaccggagggtagccacgaacactcaggagggaagcgggtgccctcctggagcaatgattgggatggagcacccgaacaaaagcccagggatgggaaaggcctaccctcccaagagctctcggtgcagccgggccgtcagcgccttcaggtgtgctttgtccaccagcagcgtcagttgcaaaggcgacgtatgggccgcgtggacgtgcgcccccaactcctcggcggcggccagcgcgcggcgcagcggcgcccagtcggcgttcaaccccacgcccacgcaggtgacggtgcccaggtcctcgcgccaggacacggcgtcaccgaagcgcgtggccagctcccggcgcagcgcgtccgcaccgtggatgtccgccaggggcacggtgatgaccgtcctgcgtaccccacccaccgagccctcgcagtccagcgtccgcccgcgcacggggcgcgcatccaggaattccagcagctccgccaggcggatgggctccgaggcggaaagcacggccatctccgcgtcggcggtgacgcccttgaggcggtggtccgtggggacggccagctcctggaccgcggtgcccgttccctggccgtgcgcggtgcgcgcgagaatggtgatgccgcgcgccttgggccac

SEQ ID NO: 52 - DNA, 640 bp, Myxococcus xanthus
cggccagttgaccgagcatcgcatctggatggcgtgacctctcgcggactccatcagatcgctgttagaacgccgccgcgtgggtccggtgatggaactacccccgccaaatcaggcacgacttggattggctcacccttttacgcgacaacttccctgacgcagggggggaaggtgctgtgtcctggtacgaagaccagcgtgcgaggccattgcggcagcgttgaagcaccgtaagtatccggccaacgacgtgctgagagccgtgcaggggccccgattagcactactgcgtcagggccccgacgggtggacggggagatcgggtgggctgcgcgaggagcgtgggtggttggagcggtggcaggtggggcagcgcggcagccaggtggcaatcccccgggccatggcgagccgagcggtgatgaagctgtcgcggaaatggcgctcaggccgagagtggctgcgcgtaggcttcagccgcccctcgggccgaggggggaaaacgccgcacgcgttcagccacgatgaacgcgtagcagcacagtgctaccgaaacatggtggtgccagccagggaagcggcggccttcataatggtccaaacccagttcgcccttgagtttctcgtagacgcgctc

SEQ ID NO: 53 - DNA, 1234 bp, Myxococcus xanthus
gtgctctaaggatagtttgtctacttgtttctttgcaatcggatctttaatattaaaacggtcaaccgttggaatattgtgatccattgtagcaaacgttaagtccggacgcttcacttgacgatttgccacgcgaagaccttcgaatgcttgaggagacgttacttcatgaataagatgaagatcgatatataataagtccggcttcccctcttctcgacgtacaacatgttgttcccaaagcttatcaataattgtttttggtttcatactgctcctcctttctgattatgaaaaacgtttctcacaaaacgtgagaaacgcatgattaactgtaagctgtcataatgcttgaaatggcagaatcgttggcaataaccgcagttattgcatccaccattttatcggtacctaaataatgattaccgtctgctaagtcagctgttcgatgacctgcatgtaatacactttcaaccgcttgttcaatcaccgctgcttctgtttctaatccaaatgaatgtctaagcaacattgctgcagataaaatagcagcaatcggattagctttgttttgtccagcaatgtctggtgcagaaccgtgaaccggttcgtataaagatggaccatcaaccgttaaactcgcagatggaagcatccctaacgatcctgtcagcatagaagcctcatcactcaaaatatcaccaaacatattttcagttaccactacatcaaaatatttcggattacgaattaactgcatagcagctgaatctacaagcatatgctcaagctctacatccgggtagtcttttgctacttcttcagctacttcacgccacactcgactagactcaagcacattcgctttatcaaccgacgttacctttttacgtcgatttacagccgtttcaaacgcttggcgaataatcctttctatttctgtacgcttataaaataacgtgtcgacaactgtctcttcatttccttctgttcgacgctcgctaggctgaccaaaatataagccccctgttagctcacgaacgataatgaagtcaacaccttcaatgtattcttttttcaaaggagaggcatctgctaagctatcataaaacgtcactggacgaaggttagcatataaatccaattcttttcgaatagctagcaaacctttttctggtcgcaaatgtgaagggttacgatcccattttggccctccaacggatccaagtaagac

SEQ ID NO: 54 - DNA, 636 bp, Myxococcus xanthus
gctctaaagaggcacctgaagagcgtcggactctcgtcccgcgccgctgcattgccacggagggcgcgggagccaacaccgagaacgcgcgctccaccgcagcctttaccaagcgttgctgctccaccaggtgctcgtggaccaatcgttcaatcttcgattccagcgtcccaagggctttcatgctcatccgccacgggttgcacaccgcgacggaggcctcaacaccacccctgaacggttaccgcatcccatgaggtgcgaggtaggggcctgggcctcttggctattgcggctcgggcctcaaaagcagtcacgggattgccttcgccgcggcgaggctctctaagaactcgggaacttgctcatggcggctgcaatcaatgattcgaatattgtattcacgctcaatacggtcatggtcgttagctgccgcgtctcttagcaacacatagtgtcgctgcgtggtgattccgaatgactcaacattgcttttgagcgccaaatcaagatcaagcggatcattcatcccgtagcctacaaacaaaaaaagatgttcttggagtagatgccgtagaactgcttgataacccgagttggagtgagcctcgcggtactcaacttccgacataacta

SEQ ID NO: 55 - DNA, 584 bp, Myxococcus xanthus
aacatcggtgcgcgcgtcgggtcctgctccacgcccagtgcactcagcagcggttcgaaaggaacatgcgcgttcgcgaaggcctcctcggtgtccgccttcgcgcggcgcagcagttcacggtagcccggccggccggagaggtccgctcgcaggacaagcgactcggcgaagaggcccaccagccctttcgtctccttcctgccccggttcgtgtgcgaggcgccaatgagcaggtccttctgcccggtgtaacgagaaagcaggacctggagccccgccagcactgccatgaacaacgtggcgccttcggcctgcgccagcgactcgaggcgttccacccatgacacgggcaacaaggccctgcgctgagcagcccgtccggtcgcggagcgccgcgggcgatccgtgagcagctccagttcatgcggcgcgccctccagccgcttgcgccagaactccaggtgcgcgtcgagcgcgtcaccgcgaagcttgccccgctgccaggacgcgtagtccccatattggagcggcaacacaggcagcggcgacggctggccctgggcgaaagcgtcatagagcgc

SEQ ID NO: 56 - DNA, 840 bp, Myxococcus xanthus
cctccaccacccactccggcccgctgatgggcacgtccttgatgtaggccgccgacttgccctgctcgcgcaccacccggccatccaccttcacctcggccgtggcgggctccgtcgtgagcaccaacgccgcggtgcgcaccaggctctccagcaccgcctgcacgggcgtgacgtccttcccctcggagacatccaccgtcttcgtgaaggtgttgtagccctccgcgctcaccaccaccatgaccttgccggcgggcacctcgcgcaggagcgtcgcgctgccaccctccaggggcaccaactgcgtgtccaggcgcacctgcacgcggttgcggacctccgagggcacgccctgcaggtccaccagcacgtagcccacaccgggccccgacaccgcccagccgatcagcgccagcaggagcacggcgaccccgccgatgccgccgaagagcaccttcctgggaatgggcgctcggccgcccacggccggcgtcgcgccggtggtccgctccggggcatccccatcgtcttcatcgtcatacgcgggggccaccggcgcgggcggagccacgggagacggtggcggcaacgggcgggccgcggcctgcgaggcgtcgagcacctgcacatcccgcgtcatccgcggcaagcccccaccccgactcgtccgaggcgtggcccccgaggcgggcggcggcgcgtccgagggcggcagcgtgggcacggacatggacggccgcaccacggggatgttcgcgtgcgacagccgtggcgggccgacgggaggcgacaggggcgagggcggccaaatgaccgccgtcctgccgctgacgggct

SEQ ID NO: 57 - DNA, 675 bp, Myxococcus xanthus
gtgctctacagactgtccgcgagggcgctccaagcctccggagagaaggatgaacacagcgcgccccccagcaccgaatgcgccaccagcagcccccgacgcgacaccgggacgtgcacggacagcgtcagcgacgcggcgatcgacaccaccatcgcccccagcaacgccccagcaggcaggtgggcgagctccgcgagtccagcggcgagcagcgtcgccacggagacggccaccacgcggcgtaagcggcgtccaggcgcggagtcattggtcatcacggcgccgaacgtaccaatgaaggatgggacatgcgccgggtatccgccgaggagggccccgcacgcttacccgtgctagacgccctcctcatgcgatgctggcaatggaagtccttccaggcgctgtccctcgacgagctgtacgacgtgctcgccctgcgacaggaagtcttcgtggtggagcagcgctccatctaccaggacgtggacggtttcgaccggagcgcggaacacctgctgctccacacggagtcgcagggcccccggctgctcgccgggtacttgagggtgctgccccccggtgtgaagtatccccaggagagcagcctgggccgcgtggtgacgtcgccccgcgcacgggccccagggctggggcgagagctggtggcgcgtg

SEQ ID NO: 58 - DNA, 618 bp, Myxococcus xanthus
gtggtgtaatagctgcgctgttctggacggaggcgtacacgacgccctcacccgcggccatggtgtgctgcagcggagtctgggccgtcagcgccaccggcgtgccgttggcgccgaagcgcacgttggccgccttgtcgcaggacacgttgacgcgctgatccctgctgaacgtgtccgactgggcccagttgacgatggtggggtccgcgttgacggaggcggtgaaggtctggatgcgcccggggacggattcgtccaggcccgccgaggcggcgccggtggggttcatctccacgacgaactggccgaagccgttgtacgtgttgcgctcggcgcagtggacccccgcgaactggccaatgcccatggtgcagtcgatgttgcactgccgctcggcgatgtccggatcgttcgggttgtccgtgccgcagcttccccacgtccccgcgcgggtattgggacagaagaaggggacgttgccgttgccgttggcgtcacagttgtggaagacgcgcgggaacttcacccggctgagcttcaccagtgacgactccaggctctccatcttgtagttgccgtagctgtaaccgcacagcgggtccgtcatgtagagcg

SEQ ID NO: 59 - DNA, 793 bp, Myxococcus xanthus
tctaaagccctcctgatcgctcgcgcccacggagcgggctgcccaactggcaccgccgcttgggcagacctcggggccttcgacattcccgtcacagttgttgtccagggcgtcgcacaactccggcgcgccagggtaggtgaacgggttgccgtcgttgcagtcgccaccggtggtggcgtagtccgtgccaggcgggacgcaggacgacacggccgtgccaacaccaaagccatccccgtcgccatccaggtaccagttgttggggaacatcgtgggctggcaggtggtggcgatgccggaggcgtcacagacgtagacgccagcgcactgggcggctgcggtgcacgccgtgccgaggtcggggaaggtctcgtcaatctggtcgttgcagttgtcatcgacgccgttgcagagctccgtcgcgccaggccggatgctggcgttgttgtcgttgcagtcatccgcgggacccgtgacatagccctgcgggataccggtgcagaatgcgacgggagcggctttccggtcgccatgtctgtcctggtctacgtcggggtaggcatacacggccaacggcatgtcgcagagaacctcgccgttcccaccgcacgcgcggacgccctcacagccttcgccctccgtgcagctctggcccaggcgcagctctaccgtgtccgactgtccgttgcagttgtcgtcgacgtcgttgcaaagctcggttgcagccgggtggatgctcgcgttgttgtcgttgcagtccgttccgccggtgagcacggagacgtagccg

SEQ ID NO: 60 - DNA, 757 bp, Myxococcus xanthus
ctaactgctgccaatgggcagggccgcgccgaggtgcaggctccaaatccatcagccctccgcgctgctcggagaggattcccgcgcgcgcctggacccacggcgtgccaagcgcgctcgtggacggcgtggcgacgcccagcgccgcggtgtccggtccccactgggaaacgatgggcacctgcgcgccgagctccaaccagtcggtgatggcatatgcaccactgaggtgcaccgtcacgcggttggagacgatgacaccttgttgctctccaccggagacgagcaccaagggctccttctcatagtgcccggtgaagccgaggcggtactcgccgcgggacatgaggtcgccggtggacaacaccagactgtcgcgtgcaccgggattgagttgcagccgctccagctcgatgccgggaatgcgctgcgcctgggcctgagccgtgaccgcccagaggacggccagacctccaagccatgggtgatacggatgtgaagacaagagttcctccccctcgcgtggcgccggaaaagcgcacgcgggcgtccgccatacttgagacgcggagtgttttgcacgcaacgcgccacgtttgttgcgggggggacctcagaggtgtgtgagagggacctgtgaagtgggttgggtccggagggggcggttgacgtgtcagcgccgtgtcgcgtcgccgcctgacgcgtcaatgacgtgtcaggtgaggtcccggcgccggatgtttaaggtaagtaaggg

SEQ ID NO: 61 - DNA, 908 bp, Myxococcus xanthus
taacagggttggggtccgatggtcaagggggcacggcagtttcaacggtgacggtaatagtcacgccagtgaatgttgcaccgacggtgccaaattacacgtttagtacgcaagaagacagtcctgtggtaggagcagtggtaggaacggacgtggatggaaatcctcttagttatcagctgcaaaatggtccaacaaatggaatagctgcagtgaatgcaaatggaacgtttagttatcaaccaaacttgaattttaatgggacggatcagtttacggtattggtgtcagacggtcagggaggaacggcagtttcaacggtgagcattaatgttatccctgtcaatgatcccccaattacgtccaatgttagttttacgattgcggaagatagcacgttaatcaatcaagtagtggcggtagatcccgatggaaatccgttaacgtttagcttacaaacggcaccgggcaacggagtggccgtggtgaatacggatggaacgtttagttatcagccgaacctgaactttaatgggacggatcagtttacagtgttggtgtccgatggccaaggaggaacggcagtttcaacggtgacggtaatagtcacgccagtgaatgatgcaccaacggtgccaaattacacgtttagtacgcaagaagacagccctgtggtaggagcagtggtaggaacggacgtggatggaaattctcttagttatcagctgcaaaatggtccaacaaatggaatagctgcagtgaacgcagatggaacgtttagttatcaaccaaacttgaattttaatgggacggatcagtttacggtaatggtgtcagacggtcagggaggaacggcggtttcaacggtgaccatcaacgttatccctgtcaatgatcccccaatgacg

SEQ ID NO: 62 - DNA, 700 bp, Myxococcus xanthus
gggacgccggaacgattctcaatccggagcgcgtgcgctcacagatggagggctcgatcatcttcggcatgagcatcgcgttgcatggcgccgtcaccatgaagcgcggcgtgacggagcagtcgaacttccgcgacctcaagctggtgcgcatcggcgaggcgccgcggaagattcatgtcgacatcgttcccagtgagctgccgtccgggggcattggcgagcccggcgtgcctccggtggcgcccgccatcatcaacgccatcttcgcgctcacgggcacgcgcatccgcgagttgccggtgtcccgcacgctggcagtctgagtgtcacgtccggtgcctggggtgtgtcgccaggcaccgggacgtcgcgcctcggatttcgggcgcgcgctgcgtcaggtgcttcaccgcaggcactcagcacgcccagcggaatgatccacggcagtgctcccttccagctccgacgcagcgttccgacctcattgagaaggcggaggcgcggggggcttgggcggcttcacttcaggtgtgggtcattcgcgggccacggagctccgttgccttcgtgtagggcaggttttcttgtgggtacaccagacccctgccattggaacaacaacccgccaatctattggcaggtgtgatgacaggtgggcggagcgcctgtatccagggggcatgacgcagagcac

SEQ ID NO: 63 - DNA, 455 bp, Myxococcus xanthus
gccccgtcttctgttttctcggcgctgccggccgcgggcacttccatgtcgagccgcgtcggcgcacccgacgcgaccacggtcggcgaagcggcggccgcatgctggggggccgccggtggcgggacgggagaggtgtgctccgcgccgccggccggcgcggtggaaagcagcgcgatgagcgcggccacacccgaacccagcgccgcggcgcccagggccacacccaccgtgctcaaggccccgcgcgaaggcggcttttcgtcgtgggagacggcgggcacacccagggcaggggttccaccggggccgcgcaggcgcagcagggcgttgccgagggacacctcgtcccccggcatcagctcgacctccgaggtgatgcgatggcggttgaggaaggtgccgttctggctgctgaggtccttcaagaaagaggcgctcgccgcggcggggtc

SEQ ID NO: 64 - DNA, 1329 bp, Myxococcus xanthus
ttggtggggagcgcgttgttggtggccgcgggtctgctgccggaagaggcgtggctcgcggcactcgtgacgggtcaggccatggtaggcttcaaggcgcccgctcacggcctcgtgctctgggaggttcgctaccctccccaagtggaccccttcaccgccggggagcgtctccatcccccggggcttccgctggagccacccttccacatcgggtaacgcgcggtggggcccggacggccgtcttcagtcgacgagccgctcttcgtacttcgcgagcagatcggagatggcctcgcggaggtactcgctctgacggatgcgcgtggtgcgcgacaggtccttgagggcgtcgagcttctcgcggttgagccggaagaccactgaggtaagacggggattcatgtccatgtgcgcgacctcctacagatgcgcacacattctcacaagtcggtctgatcgcaagaaattcacttcgatccgaccgggaagatccactgaaccccagtgaaggcttccgcgtctccgcgcaggcccgcgccgaacccgagcgcaagcccgagtcccccgaacaccgcaagccgctcggagaaggtgtgtcgcacgcccaacgctacgcgaggccccagccatggcccagaaaacggcctgatcagcaggcccagatcatagaaggtctgccaggacccatcgccgtagaagttccggaagccgccggccaccgatagatcggggccgcgcaggctgccgcggatcacgacgaagacctcgtccccgtcgtagcccacggtccggctgcccccgaggtccaggtgcgcgtccccaccacgcttcgcgtcggactctgagcgatcaatggactcggtgtaggaggcgccggggccgaggatcagcgagaaggcccgtcgttccgcgtacggcgcgtccacgtactccgccgcgccggctgccgcgggcaggagcacggcacaggcgctgatcagggtgtggacgcggcgtgtcaggcgggaacccaccctgaggaatgtggagtgatcgcgggccatggcgcggatcacgtttctatcagggtcagcgcccgaggatgtgccagtccgtggtcccctcccctggcgaggcggccaggggcacggtgcgcgcacggaatcggacgttctgatcacgccccacccttccaccggagccaggacagggcttggagcgccgagaaccaggcccccgcgctgagcacatgacgcaggtggttcatccgcgcccacgtcaccgcggtctccactgcggcggcgttgtcgggagcatccagcagccggaccatcgtcgggatgaagt

SEQ ID NO: 65 - DNA, 640 bp, Myxococcus xanthus
tgggccatggaagcgcggcaggtgtgctgggcccacctcttgaggaaggttttttcattctcggagcgtgacgggccagccggagcgattgggcgcgagctactcgactacatcggcatcctcttcgactattggggacgactgcgcagcggcgagttgcagcgggacacgctgcgtgagcgcatggcctcggtgcgcacgcaggtggaagccttgcttgagcgcgccgtggccgcgaggctgccgcacgtctctggctcctgtgaggacatcctccagcaccgggcggcgctgtggactttcgttgacagggagggcgtcgagcccaccaacaaccatgccgagcgcgagctgcgggccttcgtcctgtggcgcaagcgaagcttcggcacccagagccctcgggggaacctcttcgccgagagggtgatgacggtggcgcataccgcccgcaagcaggaaaagaatgtgctcgagttcctgacggcctgctgcaccgccgcccggacggggatgcccgcgccctcgctcttcgccgcgccctgagcgctacgcggccttctttcacatcgggaagtacctcgtcgcgtttcgctcacccgccctgcgcacacgggcctcttgcttcaggcgcatcatc

SEQ ID NO: 66 - DNA, 694 bp, Myxococcus xanthus
cggtgcgggaaaggccccgctccgccagtccttccgcggcgcgcatggcgcggcgcaccgggttctctcccgcgtccgggtcgaagacggcggcgatgcgctgggcgtcggagaaggccaggtggccgccataggaggccagggccttctggagcgacacggggttggcgcgcgaggtgaggaacaggatggcgacggagcggcgcacctgcgcggggcgcggttcgcccggcgccgcgggccgaggcgtcgcgggctcggttgcgcggtgggcgtgctcgaaggcctcgcgcagcgcgctgcccagcgcggcggcgttctccggacggcgggcgggctccttcgccagacagcgcagcaccacctcctccaccgcgggcggcacgggcgcgaagtcggacgggggcggtgggcgcagcgacaggtgggcctggagcacgtccggggtggggccgaagaagggcggccgtccggtgagcatctcgtagaggaggacgcccagcgcgtacacgtccgtgcgcgtggagatgtccgcgttgcccgcacattgctcgggggccatgtactccgcggtgccggcgaagccagacgcgtcactgggcgtggaggcatcgctgggctgcgaggcgctctccgtggtggcgccccgcaccaggccgaagtcgaagacgcgcacgcggcccgtcgttttcgt

SEQ ID NO: 67 - DNA, 627 bp, Myxococcus xanthus
gcggtggcggtatcgctgagccaggtgcgggagacggggctcgcgcgctcactgggggccgcgccgccggggtaccgggtgctggagccatcccaggccctggcctccgtggccttggcggtggagcacatgcccgcgcacctgctgtcaggcgtggtgggggcggcctggccctggcgtcaggcgggattgggcgaggggcagggcctggacgcggcccatgtcttcctggtgcagcggccgggagacgtcccgcccgagggactctccgacgcggtactccattccctgccggaatggccctgccgagcggacggcgcggtggaccgtgaggccctggccgccgacctctccggggcgggggacggagccgccgccgggccattcgagacggtggtgatggacgccttccacgaggtgctcggagcccagggcgtgggcgtcggttctgacttcttcacgctgggcggcagctcgctccaggccacccgggtggtggcgcgcatcaacgagcgcaccggcctgcaactgcgcgaggtggccctgttcgagcaccccacggccacggcgttggcggagcacgtgcggcgcgtggtggacctgacgcagttggacaaccttatagca

SEQ ID NO: 68 - DNA, 1028 bp, Myxococcus xanthus
  unsure (1)..(1028): unsure at all n locations
tgctctaaaggccttgctgctctggttgacctcctgggccaccaccgcgctcacaccgaacgaggcgatgttggcgaagtagcgcgtggcgggctggcccgcgttgtcgatgaactccagttggcccacgtcgaacggctctgtcgtgccggagcgcagccgctccaacgacgaggccagctccaggtcccacccgaaggtgcgccggaagtcgccacccgtgccccgaggaatcagccccagcgccgcgttcggattcagcgccttgccgtcctcgaagaagccgttggtgacttcgttgagcgtgccgtcgccacccaccgcgacgatgcactcgtacccgtccaggagcgcctgacgggtgatgcgcgccgcatccatgccaccctgggtgaagccgtggccgaaatcgcccagcgccctgccgacctgcgcggaaatctccgcccagcgctttcccgtctgcccgttggcgctgcgcggattgaccacgaggaacgtcttcatctggccctacccctcccttggccctccctgtttacgcggttgcgcaccggcactccactccgtggccatgttcagggcacggcgggcctgccgccaccccgcgtcaaaaggggtggcgggaccgcgcgagcgagggctcgcgtctgacgaactangccttgggcgccacgggcaccggccgcacgtggatctgacgcagctgtcggccatgcacctggccaggggcgcccatggtcaagtgggagcacgtgttcgacttggggaacggaatgacctctggcagggactctgcgcccctgagcaaaatggacagtcggtccctgcccagtgcgatgcccgcatggggggtagaggccaactttatggcgtccaccatgaagccgaacttggggcgctcgtcctacccgttgatgcccatggccttgaacacctgcttctggacctttgggtcatggagactgatggagccctccgctatgtcgacgacagtgaggaccacattgtatgggtggcacttcacc

SEQ ID NO: 69 - DNA, 825 bp, Myxococcus xanthus
gtgctctaaaggagcgcagcagcggggggtaccgtctgttcgtgcgctggtagcccgccagccccgccatggagccccgcgtgtcctacccgcccagactcgcccatctcgccacccgcgccgtggtggtggcgaagctcgtccccacctacgcgcaggcccaccacatcgacgaggaagaagcagcgcagcggctgtccagcgcgctctccggacggatgctgcccacgttgctggatgtcacgtggaccgccatgcgcggcaaggcgaagcggctcaccgacgacgggctggtggagaaggtggccgccaccttgagtgagcggcccctgcggccgggacgcatcgcccccgtgggtccggcgctcagcgccttcttcatcctggtggacctggaggtgggcaccgcgggtgacgccgcgcggcgggtcatggaatcggacgagggacgccgccggggggaggaaggactggcggaagccggacgcttcctcgccgcggagctgactcgcgggaagtagcgcccggacggccgtggcagcagtgggcgcgcatcgttataggctcgccctggccctggcccaggccccgacgatgtcgacaccgctccccaccacgctgcgaatcctgcgctccctcaccgacatcccccgcgccacgtgggatgcgctggtggacgcccaggccacgccgttcctggagtggaccttcctcaccgcgatggaggagagcggctgcgcggtgccggcgcggggctggcacccccggcacctgacgctctggcgcggctcgcgcctggtggccgccgcgcccgcctatcgcaag

SEQ ID NO: 70 - DNA, 1007 bp, Myxococcus xanthus
gcgggagggcaactccctgtgcgcccttgctcgcgagatatgccgcgctgtgggcgcggcgcaatggccagcgggagctgtgggtgggagcaccggccgtgggccgcgagggcgccgagctggcggagacgatcgggtacttcgtcaacccgtcggtgctccggctggaactggatggtgggctctcgttccgcgcgttgatggcgcaagcgagccggaccgtccatgaggcgctcgagcacgcggccatgccgttcagcctcctcgtcgagcgtctggcccccctgcgccaggcgagccgctccccgctgttccagacgattttctccttccagcaatctccgccgcggagcgagaaaggactggcggccctggcccagggcacgggcggcgcgaggctctcgctcgcgggcgtggccatggagtccctggagttggagctcggaacggcccagctcgacctcgccctctccatcgctgaactcgacgggcgcttccacgtggcgctcgaatacaacgtggacctcttcgagcccgggacggccgagcggctgttgcggagatacgagtcgctgctgcgcagcgccgtggaccagcccgatgcgccgctggccgtgctgcaactcgaccccgcagaagaccgggcgcggttgctcgcctgggggcgggccctggagacgccgccgcccgcctgcatgcacacctggttcgaggcgagcgcgcggcactcgccggagacgggcaccatcctgtccggagagggctcgctgacgtatgggcagctggacgcccgggccaacgcgctggcctggcggttgcgccagctggtcttaagacccgacacccgcgtagtgctgtacctggaacgctcgatcgaccaactgataacggtgctagcgattctcacgcccggaggggcctacgtaccgctggaccctgaattcagcaacgcgcggtgcgcggacgttcttgtggagtctgaggcacggatcgccgtcacccgtgca

SEQ ID NO: 71 - DNA, 1101 bp, Myxococcus xanthus
gccctcaccgaagcggaaccggttggcgatgtgcttgcgctcccggtacgcgtaggtgctggtgagcttgagcagcggcgtgccggcctcggcgccgtccaccaggaagaaggcgccgtggtgcgcggagaccagcggcgtcagctcgctcatgatgaggcggctgacggcgtccaggctcttctggccctgcatcatgccgctgaacttcgccaggttcgtcttgagccagtcctgctcctggttcttctgcgtcgtctcacgcaggttgacaatcatctggttgatgttgtccttcagcgcggcgacctcgccctcggccacgacggtgatgcttcgcgtgaggtcacccttcgtcaccgcggtggccacgtcggagatggcgcgcagctggctcgtcaacgtgccggccagctggttcacgttgtcggtcagctgccgccacgtgccgcgcgcacccggcacgcgggcctggccgcccagcttcccttcgatacccacctcgcgggccaccgtcgtcacctggtcggcgaaggtgcccagcgtgtccgtcatgttgttgatggtctccgccagcgcggcgacttcgcccttcgcctccacggccagcttctgcgtcaggtcgccgttggccaccgccgtcacgaccttgacgatgccgcgcacctgcgtggtgaggttggaggccatgaagttcacgttgtccgtgaggtccttccacgtccccgcgaccccgggcacgcgggcctggccgcccagcttcccttcgacgcccacctcgcgggccaccgtggacacctgctcggcgaaggtgcccagcgtgtccgtcatgttgttgatggtctccgccagcgcggcgacctcgcccttcgcctccacggccagcttctgcttcaagtcgccgttggccaccgccgtcacgaccttgacgatgccgcgcacctgcgtggtgaggttgcgggccatgaagttcacgttgtccgtgaggtccttccacacgccggacacgccgcgcacttcggcttgaccgcccagcttgccctcggtgccaacctcgcgagcgacgcgcgtcacctccgcggagaagctgttgaggtggtc

SEQ ID NO: 72 - DNA, 858 bp, Myxococcus xanthus
cactgatcgaggtggcgtcgtcctcgctgttgtcacccgtctggcccagcagttcggagaggagcgcggacgcgggcttcttgcgcgggtacacctccacgttgacgcgggcgtcggccggcagcttcgcggcctccttcgccagctcgagcgccttcgggtagccgcccagtgcatccaccagcccatgcgccagggcgtcctcgcccgtccacacgcggcccttggccagcgactgcagcttctccagcgggagcttccggctggccgccgcgcgcgtcgtgaagtccgcgtagatgcggtccagcgacgcgtccatgcgggcctgctgctccggcgtgtagtccgcgtccgagccgaacatctccgcgttcttccccgcggccacgctgtcgaaattcacccccagcttctcccagaagcccgccgtgacgaacttgcccgcgtacacgccgatgctgccggtgagcgtgcccggatgcgcgacgatgcggtccgcctccatggcgacgaagtagccaccgctggcggcgtagctgcccatggtgacgatgacgggcttgcccgcctccttcgcgcgctgcacctcgcggcggacggtgtcactggccacgtagctgccgcccgggctgtccacgcggaagacaatggccttcacgcgcgagtcctcggtggccttgcgcagcgccgcggcgacgctctccgcgcccatggactgtccgcccgacagcgggttggactggttctttccgcgcatcacctcgcccacgccgtacaccagggcaaatggtgttgccggacacgtttggcttgccagcgcgctccaggtactttttcacatagagaaagcgcgcgccc

SEQ ID NO: 73 - DNA, 1030 bp, Myxococcus xanthus
cccccccccccgtttgatcttcgatgttcaatcgcagagctgccgcgctcggacgccgacacgctgcacacgctggtgtccgagggctacctgggcacggacctgggagacatggccgcgcggctgagcgcggcctcccaggccaccaccaacgaactgcaccagcgggccctggccggtgaagcgctccccacggcgcgcctgcgggagtccggcgcgctcttcgacctggctcgagacacgggggagccgtccgccaaggccgctgcccaggcgcctttcctggaagggctcgcggcgctccagagtggagactccaccggggcgcagcgcctgttcgcgaaggccgcatcagcggcgcccgagcgcaccgagtaccgcgtgtggcgcgccgccgcgctccagcgcgccggagatttggacggcgcgctgacggtgctggagacggacctgccgcaagatgcgcgcacggacgtgctccgcgcggcctccgcccagcgaaagtcccccgaggcgggggctcgcgagttggagcgcatactcttccagcgctacgccccggccacgcgctgaccgcggtcccctcccctccggccaagcaaggacaccatgtcgctcttcatctgccagcgatgcgaggcccagcatgagaagtgggacggcgcctgtccggcctgtggtggcaccgagctgctgacggtggcgccggccgtggaccggatgctcggccgtgtcgtggcgagccgcttccgcatcctccggcggctgggccagggcggcatgggttcggtgtacctggccgaacaggtgggcatcggccagcaggtggcgatgaagttcctcaacagcggcctgtccatggacccggacgtggcccgccgcttcctcaacgaagccaagagctacgcgcgagtggcccaccccaacgcagtgacgctgcacgacttcgggcaggacgaggaaggcagcctctacatctccatggagtacgtggagggggatgacctcaagagcctgctcgcggcgtgtg

SEQ ID NO: 74 - DNA, 794 bp, Myxococcus xanthus
ctctacagattacgcccggcggcctcccggacgctcaagcgcgaggctgctggaacggcgccatctgggccgccagggcgcgctggaaggcgggccgggcctcacagcgttccttgtacgccttcagcgtgggaaagccgtcgagcacgtccgtgtgccggaggatgcggagcaccgtcgccatcatcaggtcgcccgccgtgaagcagtcttccaggtactcgcgctcacccagatgcgccgcgagttctcccaggcgctccttcagcgactccaccacgcccggcctgcgcagcttcgcccactcctcctgggcgaagaaaaggtccacctcggcgagcggctgaatcacgatttcgatggagttgagcgccgcgaagagccacgtcaccgcgcgagccctgcccgccgagtccgccggcagcagcgcctcacacttgttggcgatgtggagcacgatggcgcctgattcaaagaggacgaggccgtcctcctccagcaccggcacctggccgaaaggctggagcttgcggtagtcgggcgaggcctggactgtgttgtcgatgagcttcacctgatacggcaaccccgcctcctcgagcgcccaccgcacccggaggtcccgcaccaggccctgtgcgaacggcggaacccacttgaacgcgctgacggtcatcatcgtgatgtctcctggtcggtgagcggtttgggcgcgccgaagcgcgtcatccggcgcagcgctctcaagcatgcgccccgggctccgtcaacgcggtaacggtcctcgggatgtc

SEQ ID NO: 75 - DNA, 840 bp, Myxococcus xanthus
gttgtgaccactacaggttacgtcgaccggcccaagccgcttttggccggcatgcagatggtgcaggaccagtccacgtccaacgcctcctccattggccagaaggccgcgctggcggcgttgcaggggccgccggacaccatcgccgccatggtgaaggagtaccgcgagcgccgtgacttcttcatcgcgggactgaacgcgctggatggcgtgcgctgccggatgcccgagggcgccttctacgccttcgcggacgtgcggggcctgctgggccggtcgtacaagggcaagccggtgacgtccgcgatgcagctgtcggaaatcctcctcgacgacttccgcgtcgccgccgtgcccggcgagccgttcggcgcggagggctacgtgcgcatgagcttcgtcacctcgcgcgaggtgctgcagaagggccttgcccggctgggtgagctggtcaaggccctgagctgaccgctcagtccgtgtaggcgaaggcgcggaactcgtcgcggtacttgcggtagacgaggacagcggggcggccggagatgttacccacggccgtccacacgtccttggggttgcgcaggtccaagcccagccgcgcgggcgccttgccgtacttcttctccatggcctccagcggcatcacttcgacgtcatagagggtgatgaggtccgtgcgcttcagtcgcagctgcttcacccacgccgacaccagctcctccggcgtggacgtccgcctccaggctgaacgggtagagcagctcgttcgaggcggtgcgtacgtcccccgtcagcagggactggaggaggaagcgcgcgtccgcccggagagca

SEQ ID NO: 76 - DNA, 780 bp, Myxococcus xanthus
ccggactcagcatgacgtccaacctctccctggtcgacgccgcgttccacacgggcatcttcgtcgccccacagagcgggtgggtgggcagcacgctcgcccactggctgtcgaacggcgtggagttcgactcggatgagagcggcgggccgctggtggacctggacacgctgatgcccggcgagtgtgcggtggaccggggcacggacctgaggctgccctactgcggcaccgcgccggacatcggcgcggtggcgtcggactgccccgaggccaccaccgccgcgctcatggagtaatcgcgcgcaccagcgaattgccggcgtccgccacgtagaggcggccgtccggccccaccgtcagaccggccgggaggacgaggtccgcagcatctcccggcccgtccgagtggccgtagcgcccgctgccggccagcgtcgtcaccttccgcgcgttgccgtccgcgttcaggacgacgcggcgcacgcggtagttgcccgggtccgacaccgcgagcgagccatccttcagcaccgcgatgcccaggtacggcaggaactgggacgactccggcgcgccgtcacggaagcccggcgtcgtgcccgccaccaccgacgtgagaccgtcgcggatgcgcaccacccgggacatgccggactcgacgacgaacagggtgttgccatgcgcgctcaccgtcacgcccgagggccggtagagccagtcaccctgtagcgtggtcaccgggtgggccttgcgcaccaggtcgatgcggcgaatcac

SEQ ID NO: 77 - DNA, 853 bp, Myxococcus xanthus
gttctctaagacgcgggctcgccgtcaatctggcggcgtcggtggccctgctggtggccgcgctgcgtgcccgggacgccttgaaggtgacgtcgttccccacgctgttgctgttcaccacgctgttccggttggcgctcaacgtatcctccacgcggctcgcgctcgcggaggggcacgcgggagacgtcatccaggccttcggtgagttcgtcgtccggggcgactacgttgtgggtgcggtggtgttcgccatcctcacgctggtgcagttgctggtcgtcaccaagggcgcggagcgggtggcggaggtgtccgcgaggttcacgctggacgcgatgcccggcaagcagatgtccatcgacgcggatctgcgcgcgggcgccatcgaccaggcgcaagcccggcgccggcggcgtgacctggagcgcgagtcacagatgttcggcgccatggacggcgcgatgaagttcgtgaagggggacgtgattgcgggcctggtcatcgtcgccgtgaacctgctcggaggaaccgtcattggcgtgctgcagggtggcatgcccctggccgaggcggcgtcgacattcgcgctcattgccattggtgacgggcttgtgtcccaggttccctcgctgtgcatcgccgtggccgcgggcctcgtcgtcacgcgcgtcgcctcggagaaggaagaggacacgctgggtgcggagattggggcccagttcttcggagaggcgcggacgctctgggtggtggcgggcctgtgcgtcgcgttggccctcatgccgggaatgccgcatgtgacgttccttctgctggcgggaggcctgggggggcttggccatgtgctgag

SEQ ID NO: 78 - DNA, 563 bp, Myxococcus xanthus
gagccttgcctgctggcgttctttatttccacgttcataatccaatgatcaacagtactaaagcattacaacctgatcaaattgaagccgaaatcttcaagaagtttaaaatgaaaggactacttttaggggacgaggaagcagtacgattaatggatgaaacgttagaatcagggcactcacaagttatatcggcgggcattaaaaagacagggggcttttattccaattcttcggttgcgagcgaagaagattttacacatctccgtcagtatgtgcgaggtaagtttgtggaggcaggtacagagattacaaatggaaaaattgatatttcgccttataagctaaaagataaaacaccatgcgcgttttgtgaataccgctcaatctgtcagttcgacgaatcaatggaaaacaatgaatatcgtcagcttagtacagagagccaaaatgttattttagataaaattcgagaggaggccaaacgagatgagtaaagatatacacgtaaaaccggccgactcccagtggacggatgatcagtggaacgccattgtttcatc

SEQ ID NO: 79 - DNA, 1470 bp, Myxococcus xanthus
  unsure (1)..(1470): unsure at all n locations
ctctaaggttcatctggagcatgtggggaccagagccccggctcgcccacgcgctggtcaacgccgtggccgttctcatcatcgcgtgcccgtgcgccctgggcctggccactcccatctccatcgtggtgggcatggggcgtggcgcgcaggccggcgtcctcatccgggacgcggcggcgctcgaggaactggcgaaggtggacaccctcgtcgtcgacaagacgggcaccctcaccgagggcaggccgagcctcaccacggtggtggccgcccccggcttcgacgaggcgcggctgcttcacctggccggcagcatcgagcgcgggagcgaacacccgctcgcgtccgcaatcgtgaagggcgcagaggcacgtggtgccgtcctcaccgagacgcacggcttcaagtccgtgacgggccagggcgtgacggggcgtgtggatggtgcgcaggtggcgctcgggaatgcccggctgctcgagggactcggcatcgaggcaggggcgttcctggagagggcggaggccctgaggcgagaagggcagacggtgatgttcgtcgccgtggacggcaagccggccgggctgctcggcgtggccgacccggtgaaggccagcacccccgaagccgttcagcagctccgtgccgatgggctgcgcctcgtgatgctcacgggtgacagccggacgacggcggaggcggtggcccggcgcctgggcatcgacgaagtccacgctgaggtgcgccccgaggagaagaacgcgatggtgaagcgcctccaggccgaaggccacgtggtggccatggccggagacggggtgaacgacgcgcccgcgctcgcccaggccaacgtgggcatcgccatgggcacgggcactgacatcgccatggagagcgccgccgtcacgctggtgaagggtgacctccgaggcatcgtccgcgcccggcacctgagccggggcaccgtgcacaacatccgccagaacctcttcttcgcgttcatctacaacgtgctcggcgtccccatcgcggcgggggtcctctacccgttcttcggactgctgctgagccccatgattgccagcgcggcgatgagcatctcgtccgtctccgtcatcgccaatgccctgcggctgaagcggctggacctctgaccgccacctcgccggattcaagaggagaataccccgtgaccttgcgccgtaccgtggtgggtggactggctgtactgggcgccctgacgctcatcctgggcgtgagcggcggggtgtatgggctgacggtggcgcgccgcggcttctcggcccgggaggccccctcggcgctcgaagcgaaggtggcgcgtgcggcacggagcttcagcatgcccgcgggggcccgggagctgaagaatccgctcgcgcccctctcaccgcaggccctcgccgaggcgcgagcccattgggnnctgaccactgcgcccatctg

SEQ ID NO: 80 - DNA, 681 bp, Myxococcus xanthus
tggagcggccgtcaccctagctgctttactgctgattcagcgccatacagctctagattattctgagcaaacactatcatcatagaggctgagacaaaagtattttagctgaaggaagatccgaacgatgaatcgagattcttgatgaagaatccaacgcgttcggatttttttattgctatggtaaacgtaagtttcatgtatgtaggtacttctagctggtgattggagggcaaggcgaagactcctgcggggtctcgcctgttccgctttccccgcaggagtcttcgccttgccttccaatcaactagaagaaacgaaacagataaactctatgttcaccgtaacaaaaaaaacgaatcattaatcaaacaatttgattaatgattcgttttttacttcggctaaactacttttgtccagtctcagtttttacatttttatgatatctccagaagaagcagcctttgctttttgaatcgttcgataagaagagtatttgctttggtcttcaaaatcgttacagattgttttttcttctgctttacttggcacaatttctttaaatcggcgatagactgccattaggtgatcacgctcaatacctttttcataagctcgttcaatgctttcaaaaaacttcactacatcaataatttcttctgtactccaatcaagggg

SEQ ID NO: 81 - DNA, 1229 bp, Myxococcus xanthus
cgttctctaaagacgctggaggccgtcagcactaccgccgcgcccagcacccaccacggccgcttcaggccccaggccagggtgcgcgcgtagacgcgctccagcttctcgaagccccggtccacccagacgccaatccggctgcggccttcacgcgacgtcttgagcaactgcgcgcagcgcgcgggggccagggtgatggcctccacgtaggacaggagcaccgccacgcacagcgtcacgccgaactggaggaagtacttgccgatgacgccgctcatgaagacgacgggcaggaagatggctaccaccgccgccgtcgccgccagcgcggcgaaggtgatttccgcggtgccctcgcgcgcggggcgcacccggtccttcccctcttcggagtgccggtagatgttctccagcaccatgatggcgtcgtccacgacgatgcccaccgccagcgccaggcccagtaacgtgaaggtgttgagcgtgaagcccaggaagtagatgaccgccaccgtccccagcagcgacatggggatggccagcaccacgttcatcgtgctggagatcgagcccaggaacacccagcacacgaaggcggtgaggatgcacgcgagcatcagctcgaactcgatttcgtggacgctctcctcgatgaactgcgtcgagtcgaagttgatgcccagctgcatcccctccggcaggtccttctgcatcttgtccagctcggcccggatgccctgggccaccgccacggcgttggcaccgcgctgcttcttgatgcccaggccctgcgccggctcgccgttgatgcgcgccatgcggcgcacgtcctcgaagccgtcctccaccagcgccacgtccttcaggtagacggggaagccgccctgctcgcgcacgatgatgcgccgcagcgtctccaggtccagcgcctcgcccatgacgcggacgttgacctcgcggccctgtgtctcgatgcggccggcgggcagctccacgtgctcgcgctggagcgccgcggacacgtccgtcaccgtgaggcccagcgcgtccagcttctgcgcgtccacccagatgcggacgttgcgctccagcatgccgcccagctgcacctcgcccacgcccggaatcgtctggagcttctccttcacgcggtagcgggcgtagtcactcaccacctgctggctgaagggcccggacacgccgacccagaggatgggtcttgagaa

SEQ ID NO: 82 - DNA, 886 bp, Myxococcus xanthus
ccactacgcggggagccggtaccagagcgaacgcccgatgaacgtgaccgcgatgaagggcatggcacgtcagtggccggacctgctctcgctgaccgagcagttccgcaaggccttcctcgcgcgcatgccgccccggaccccgggcgtgctcaccgcgggcgagctccacatgatggtcgtctgcacgctcgcgtcggtcgggtacgtgctggtgcggggcacccagccggtgccgaacggagagctcgacagcgggctcgcggccatgttccggctgatcgacggagttcgcctggtcaccaatgacctggtgcgcgacgcccccgagcagcccgtcaccgcgcaatcgatcgtggactatgccgagcgtcacgcggtcttccatggtccgcacggcgtgtgcgccgggccgccggcgctgatcaacgagtacatgcaggtgttgaccggctcggccccggcacccatcgaggcccagcccgacatcgcagcgcgcctcggcgatctcgacgccgcgctcgattacggcctgctcgggcagcgcgtcgaatcggtggtccgcttcctcggcgcgacccaggggctgctccacgaacggctccgggcggcgttcgccggacacctcccgcgcaccgggctgcaagagtgcgtggaggcgcccatcgatgtcgcgcattacccgttgctccgggacgatttcccgctcgccgagacataccagcgcgagatcaagctcagccgctggttgttcgcgcgcatcggcgaggcgttccccggcacgccacagggcacctcgctggacgagctggcgaagctggaccccaccgaacaggccacgagccagcggggactggccgagctcttcgcgcatgggctgccggga

SEQ ID NO: 83 - DNA, 786 bp, Myxococcus xanthus
gccggacggcgagcagccagagagaggaagccatgcagaagctgagggttggatacacgatccttgtcatggccggggccgaagcctccgagaagaacccggcgaccaagcgcggcaaggtactgaagatcgatcgcgaggctgagcgcgtgacggtcgagggcctgcgcctggtcaagcgtcacatgaagaacacgcctcagagcccggaaggcggtatcgtcgagaagccgggcacgatcgcgctggcgaacgtgcaggtggtttgcgccaagtgcgacaagccgacccgagtgggcattcgtactgaaggtgaagagggcaagaagaagcggttctgcaagaactgcgacgccctgattgactaggtgtccgcgttggtgcatgtatgcgcgccctttgcccaccctggtggtggcgaagggcgggcgtgcaggcatggagggcccgtggagcaacaggggccctcgcggtgtttccaggttccatacgaaggactgatcgggcgtgctgggtccacgacggcgccccgaagcagaggacaggacgatggctgacgagaagaaggccgagcagaaggaaaagaaggcgaagcggggcaagaaggaagaggccaagaaggttggcttcgccgccaatatcgaggaaggcctggagtccaagccggcccgtctgaaggtgcgcttcttcaaggaaggtgttccgtccctcctgaaggagctgagcctgaagaacccgatgcaggttccccggctggagaagatcgtcgtcaacatgggtctgggc

SEQ ID NO: 84 - DNA, 993 bp, Myxococcus xanthus
ggtcacccaccggcaccatgggcgtggagcgcacggtgcgcgtcaccgccaatgtgaagagcgccgccattcccacgaagccggcgagctcgaacacccccagggcgacaccgtccggctgaccaccaggcaccaccatcaggtacaggtccagccagcggcccaccaggaggatggcggccacccgcagcaggtgcgacggattgcgcttcgcgggcctcggcagcagcagcacgaagggcagcgcccagttgagcgccacgttcacatagaaggccaccgcccaggtgccgtgcagccgggtgacgaagtagaccgtctcctccgggatgttggcgtaccagatgagcaggaattgcgagaaccacagataggcccacagcgtggcgaagccgaacatcagcttgcccaaatcgtgaaggtggctggtgttgagctgcggcagcgcgcccgcgcggtggagcaggatcgccgtcacggtgatggcgcacaccgtggaactgagcaggcccgcgatgttgtagagcgcgtagatggtgctgaaccagtgcggctccagggtcatcaaccagtcgaacgcggccagacagaaggtcagcgagaagagcaccaggaacaccgccgacaccgtcacgttgcgcccggccagctccagggagcgctccgcgtcctgccgcagggagatgcgccgcagcatccacgtgaagcccacccacagcgccagcatcaccaccatgcgtaccgcgaagaagggcacgttgaggaaggcggccttctcgtgcagcaggtggtccgtttccatgacgcccggcttcgcccacggatacagcgaggacacgaagggcagcagcgccagaatcgtcacggcaccccagggcacgtaggccgcgaaggcctcggggatgcgcttgaacacggtgaaccagcccgcgttggccacgtacatcagcgccaggaacaccgcgccgcccaggcccaggcagaggaagtaga

SEQ ID NO: 85 - DNA, 712 bp, Myxococcus xanthus
tcaccgcagatgatggcgtccacagtcgcgagctgtggaggagtacgggcaccggcggtaaacaacgctggaggaagcctgccacggcccaggacggcaggttcggcccacatacccggccggccaaccggctttccgagctggagcggcggcgcattctcgccgtggccaacagcaaggagttccgcgacatctcgcccaagcagattgtccccaggctggcggataggggcgagtacgtggcaagcgaggcgagcttctaccgagtactgcgcgaagcggggcagctcgcgcaccgaggctgcgcctagcactactgcgtcagggccccgacgggtggacggggagatcgggtgggctgcgcgaggagcgtgggtggttggagcggtggcaggtggggcagcgcggcagccaggtggcaatcccccgggccatggcgagccgagcggtgatgaagctgtcgcggaaatggcgctcaggccgagagtggctgcgcgtaggcttcagccgcccctcgggccgaggggggaaaacgccgcacgcgttcagccacgatgaacgcgtagcagcacagtgctaccgaaacatggtggtgccagccagggaagcggcggccttcataatggtccaaacccagttcgcccttgagttcctcgtagacgcgctcggttctccagcgttgcatcaccaagcggatgagttgcttgttcgt

SEQ ID NO: 86 - DNA, 649 bp, Myxococcus xanthus
gacagcagcgcgtgctggaggacctggtgacggccttcctcgcgcgcggccacgtactgctggagggcgtgcccggtgtggccaagacgctcaccgcgcgcagcatggccggcgcgctggggctgctcttcacgcgcatccagttcactccggacctgatgccggcggacatcctgggaaccaacgtcttccagccccaggaccacgccttccgcctcgtgaagggccccatcttcacggaggtggtggtcgcggacgaaatcaaccgcaccccgcccaagacgcaggccgcgctcctggaggccatggaggagcggcaggtcaccatcgacggcgtgtcccacgcactgccgccccacttcttcgtggtggccacgcagaaccccctggagttggagggcacctacccactgccggaggcccagttggaccgcttcctcatgcgcgtgcgcgtgggctacccggaggcctcggcggagacgacgatgctccgcgcctttcaccagcgcgaaggcaagccggccaccacccgccaggtgctggatgcgcccacgctgctggagttgcagtcgcgcgccgcccgcgtgtcgtgtgacgactccatcatccagtacgtggtggccatcgtccgggagacgcgcaccaaccc

SEQ ID NO: 87 - DNA, 1068 bp, Myxococcus xanthus
ctctacagatcagcgctcttctcattgaatattcgttcagcaatcgccgcaggcgccccaagcacaaccaccgcactgcaagaaacactgcgtggccaggaagagctatttaaccgtctctgctacgcacacacagagaaagaaacagactcaggcctagccaaggcaaccttgataattcgcgccaatagcgcagaggaagaccaagacaagctctggaggagatccaacatagcattctatgttggctgcacactattcattatttcactcacgggtcctgcggttacatactggatgattgccaagggaatacttaccgactggcgccaatacctaccaggaatatccgcttcaatcatcatggtcacagcagccgcaactcttttgcgctacgacgggaaactacgtgaccacttccaagcaaagtcagacgaagtcgcatatttcaacaggctccaattggcgatcgactccgcgcacgcactgtcggaaaaagcatatcgaaacaccttgcggagagtaatacgccagctaatcagtcctccatcgagcctcgtaaagacagccctccctccccccccagcaaatgatgcatcctctcgcgaaatcctcgacggaaccatctccgatcttgtcagcgcgatcaatcgcatttcaaaaacaccctcaacgccggacaccgatcgaccacaaaagacggcacacaactcaacaacagccgacatttcctagcggtctcgcctcacccatcctcgaaacaaggccgcgagttcgcaagcacgtgtacatcaggggatataccaacgggtcttcctgacgcaatgagcgtggccataccacttctggacgacatgctcgaagcgaccgtgcaccatccaagtagtgcagtccaaatcctcgggtagttgcgtgttccggcgaaggtgagcccccattccggcgcaagccgatcagccgttccggccattgggagcagtcggagcgtcagcgacgatgggacgttcgttctctactgaagttgccccggttccgcagagcgttccgggcttttgccctcaaacggga

SEQ ID NO: 88 - DNA, 1259 bp, Myxococcus xanthus
tgtgctctaaaggagaacgactgcggaagtttttattcaaatcgatacgttttccgaactggcgaccatcttgtgtaaagcgcttgtactttgttaagaataaaaatggctccgctaaacgaaagcggtaaatggattgttttacatctccaaccataaataaatttccttgttcttcactatctctcgtcactaatttaattagtgtttcttgaaccatatttgtatcttgatattcgtcaacaagtacctctgcaaactgagtgcgatatttttgggcaatggacgaaggcttaagcacaccgtctttttttacactcaagatttgcaagcaataatgttctaaatcagaaaagtccactaaccctttctcttttttaatgtgttcatatcgttcaccgaagcgctgaactaaaaagattagcgtttcaataaccggcttcattttttcaaaatcagccatgtagccttgcaaaggcctagaaaacagatcagcatgaagcttttcaaggcttgtcttagcttttttgcgaagctctccgaagtcatctaaaagctgaagggcgtatgcttctcctttacatggctttaaacgagtaaaattcaaactctgcatttcttcatgcaaatcatcaaaagaatgcttagaagcgctgagcagccgatgaatttgagccaagtcttcctctgcattaacagcgcgaggagcaggccctcctggcagctttgctagctctaagcattgttttaaaatcgattcaatgccaatcagctgcgttgttacttcttgtaaaagaaaagatagaaacggaagtgaatcaatagaagagtcctctgtgacatcatattgactcacgatcatttcaagccagccgtttgggtcagggttagatcttgcaaagtcatatagctttcttaccataagctgaatatctaaatcgtttcggtcacttgtataacgatcaattaaatcaaagaatcgctcgttctgttcaatactgtactgttcttcaaacagttcttccaatacttcttcacgaaggagctctgcttccgtatcatccgcaattcgaaaaccagggtctacatcaatcatataataatacgtacgaatgacttctaaacaaaaagaatgaagcgtagaaatagacgcacggtttaataaattaagctgtctgcgcaagtgtaaagaagatggattcttttttaactctctttctaatgcttgggcaattcgatttctcatttcagctgcggga

SEQ ID NO: 89 - DNA, 542 bp, Myxococcus xanthus
ggtgtccgggcgcgcttcctcccggacggcatcgagcagctccgcggtcgcagacatacgaggcctgcttccctatccccatgcggagcctcgtgcaacccgggcctcgttccgggtgcggcggggtgtcagggggtgtcccttgtcatcagggcgcggtcgtcgtgagcggaaagtccgcgcgcgcccaggccttctcgaaagcggagcgggtgcgagccgcctcctcatggcgtccctgcgcttcgagcgactgcgtcaagccaaacaggccccagccattcttcgggttgcgccgcaggtcctcgcggtagacggcctccgcttcctgattgcgcccggcctccagcagcgcggcgccctggtagtggcgcaccggatagaaccagtccgcgggctcggcgtaggagagccggtccgcggcgtcgacggcttcccgccacagcgtcagggcctggggccggccttcggcctgggccacgcgggccttcaacacgcgcaccgcgacgcccagcacgtctttcgcggtgttgaggttcgcg

SEQ ID NO: 90 - DNA, 775 bp, Myxococcus xanthus
cacccgggcaccaacatccagatcaacggccagtcgctggacatcaccggcacctacaagatcgccgtcaacgactacatcgccaagggtggctcgggcttcaacgtcctcaagcgcaacaccacccgcatcgagacgggcatctcgctgcgcgactcgctcatcggctacatgcagggcttctgcacctgcgaggacatcctcgcgggccgcgagacgtccaaatcgggccactactgcggcaacctcgtcaacggccgctggacggtgaacgaacaggtggtgggctcctgccgcgccgctgccgacttcaaggccgcgctggacaagcaggtgggcagctgtgactgcaaggatctgctgtcgctcccctcggacgccgcggagcgctgcggcgtgccgggcctgacggccgaggatatccagagccagtgcgacgtgccggagggtccgtacacaggccgctgcagctgccgggatgtgctggcgggcaacaaccccatctgcggcacagtgacgaaccagctgcggaacttctgtgagaaccccacctccgtgtccatcgcggacgcggttgaggattcccgtatcggccggagggtgaagtaaatgaagcgcctgctcttcctgtcggccctggcggcggccggctgttacacccaagaaacgccgcagcctgatggcgtcgcctcgttccgggtcaacctcacgggcatctacacccgcggcacgcgtaccccgctgccggtggtgaatgagtgcgccaccgcgcacg

SEQ ID NO: 91 - DNA, 1266 bp, Myxococcus xanthus
gtgctctaaagaaccggagtccttcgggtccactccgttgaaggaacggggggtggaatcccactgcgcgtaccacgcctttccgctcgcgagcgtcgggtagagcatctggattccgaaacggtccgtcgcccctccatcgctcgaggtatcatcggcgccgggacctccaacgctcgaggcatcatcggcgccgggacctccaacgctcgaggcatcatcggcgccgggacctccaacgctcgaggcatcatcggcgccgggcgcgcctccgcacgcaccggccagacccatgagcacggtggaaagcaacgtggcctttatccatcggatgtgcatatcgatgttactcctagctgtagatggcactccttaccgtcgcggaccgaaggcgccgactcgggcagcctcaggtccgggcggaagggatcacgagcgcgggtcatctacgagaagcagcaggccaagggcccgctcccatgctcgctgtacgggtgtgcctacccaaaattcagtcgctgcgtcatgagtgcgtcaaggctgcgtcaaaacgcgcgtcatgacgtgagcgatacgcataacgagccgctgggtcctctcttccatttgatagaggtcggaattacgcccggctcagacgcctcaacacctctctgcccgcgtgtggacactcccatcccgtcctgcgaacgcaagtaggctggtgcagcacgcgcgcacctgcgagggtgttgttggaagaaccgagacgctacgcagcgcggcgctcgtaccggtggtggagcccgaagacttcccgtagctctatcaccttggctccgtgctccgggccctgcacctcacgcgtctcgggcgcatctttcccgagtgacaggtgcgtccggctcgcattgtagtagcgctggtactcgcgcagcaggcaccgagcgtgggcttcgttcaagacgacgacatggttcagtagctccctacgtatcgagccgatgactctctccgcatagggattctgccacggacaccgtgctgcactcggcacctcgcgaatccccaaatagttaaacgtggcgcgaatgccctcggagtagagcttgtccctatctcggtgcaagtatctcggagcactggcccagggaaaggcctctcgcaactgcggccttgtccattcttccgtcgggtgcgctgtcacattgaggtggaggattcgcctgtcccggtgactcacaaccacaaatcccaacagcaccccaaacgccgcagtcggaatga

SEQ ID NO: 92 - DNA, 1057 bp, Myxococcus xanthus
  unsure (1)..(1057): unsure at all n locations
agatgctgcgtgttgttatgaagcggccgattgaagaacagcgtctgccgcttgggcggcagcgccttgatgacgcgccgcacgtcgtggatgaagcccatgtcgagcatgcggtccgcctcgtcgagcacgaatacctcgagcgagcgcagcgacacgaagccctgctccatcaggtcgagcaggcggcccggcgtggccaccagcacatccacgccattgcgcagcgtctggacctgcggattctggcccacgccaccgaagatgacggcgtgacgcaggggaagccccttgccgtaggtcccgaagctgtcacccacctgacccgccagttcgcgcgtgggcgtcaggaccaggcagcgcaccgggcgcgccccgcccgcgggcgccttggcggacagccgctggaggatgggcagcgcgaaggccgccgtcttgcccgtgcccgtctgggccacgccgagtacatcccgcccggccagcgcgtgggggatggccttctgctggatgggcgtgggggtggtgtaaccctctgccttgacggcgcgcaggagggtgtcgtgaagctgaagatcgtcgaaagtcatgggttcctgacgttgaagtgagcccgcctcctccccaggggaggaagcccgcgcagcgcgcccagtcggacgtatgtccggggcgcctggcggtgcgcggtcgggcccggccggccgaaccgctttgggaacggatgggaacagggggtctcccctacccattccggagaatcggcgcgggaccctgcactttcccgtcccggaagtcccgtgaaatcaacggcttgctttccggttttgtggcccctgatggacatttgtacagggtccagatccttcaaagtcgaaaaacccggaatgccctacaggccccagganccacttntggctcccggggccgcccttcacctcaggcacgggcctccgccgcgtaagaggcctggagtgcctctggcaccggctcgtacgcgcccagccgcatgctggcctgggcccggccctgggtgcggccgcgcagcccggtactttag

SEQ ID NO: 93 - DNA, 1351 bp, Myxococcus xanthus
tgtccggggcgactcgcagaatctgttcgcgcagctccgttcgttgtcgttccttccgttctgcaatccccatgctcccagtgtaggccttgacccactgaacgcccagcagtagatgaacggcgttcatgaacggtgtttacaaaccactcgccgttcgggaaagggagcaggacatgggcacggttgcgttgttcggcgccacgggcgtcgtcggacacagcatcgcgcaggcgctgtgggggcaggggcggggctaccgcgtggtggggcgctcccgggagggactccagcgggagttcggggcggacccgcaggcggagatcgtcacctggaatcccgacgacatggcctccatccaggccgcggcccggggcgtccagacgctcatctatctggtcggcgtgccctattggcaattccacctccaccccgtgctgatgaagcgcacgctcgacgccgccatcgccgagggcgtggagcgcatcgtcttcatcgccagcgtgtacccctacggccggccgcgcacggacgtcgtcaacgagtcccacccccgcgtgccgcacacgaacaagggccgcttgcgcaaggctcaggaggacctgttgctcgcggcggacaaggcgggctccatccaagtcaccatcctccgcctcccggacttctacggcccgggcgtggagaacagcttcctccaccgcgccttcgtcgcggcctcacagggcaagcgcgcccagctcatcggccccatcgacacgccccatgagttcgtctacgtgcccgacgtggggcccaccgtgacggcgctcatggaccatccgggggcctacggccgcttctggaacctcgggggcgcgggcgtcacctcccaggcggccctggtggaggacatctacgcccaggccggccaccccgcgaagtactcagtgctggggccggggatggtgcgcctcatcggcctcttcagcccgttcatgcgcgagctcggggagatgcactacctgcacacctcgcccgtcatcatggacgactcggcgctgcgggcgctgctcggcgacatccggaagacaccgtaccgcgacggcatccgccagacgctcgcggcgctcagtccagcccccgttgccacaggtcatcctcatccagccccatgaggtgaccgacctcgtgcatgacggtgatgccaatctgctcgatgagctcctcgcgggtgcgggcaaagcgctccaggttcttctggtacagcacgatggacgcggggacgtggtcgaacgcgttcgtcacactgcgctcgcccaccgccaggccgcggaacaccccgaggatgctcggtgacaggggctttagagca

SEQ ID NO: 94 - DNA, 812 bp, Myxococcus xanthus
cgccgccagttcgtccaacacgcccccggcgaagcgcaccacctcggagagttcccggggggacgccgggtccgcgcgactggcggccagcgtcgtcaccgccgacgtgaagcgccgcgcgtagaccagcagcgccatcaccggctccaggtccttggcgggcccggtccactcactcagcagccgctggaaggacgcctccgccgccagcagcgccaggcctatcttccgccgggcctcgcgcaccgcgggctccgagtccgagtgcgcggcggccaccgccatcaggtattcgcggtccgcgcgcaacgcgaaggccacctgctccggcagacgcaggtgctccgggctgggccacaagagccgcgtcaccgtcagcgcaatcagccctcccagcagcgtgttgacgatgcgcaccccggccagctcccagtccccgctctggagttccgccagcagcaccagggccggagtcagcagcacctggaacgcggacaggctgagcggctggatgctcatcgccaccgcgaacagccccccgatggccagcaggatgatggccgggtccctcaccaacgccaccagacccgcggccagcgccgcgcccagcagcgtgcccgcgatgcgctgcaggctccgctggaacgtgaggcctgcgtagggctgcaggacgacggtgacggtgatgatgacccagtagccgtgattcaatcccagcgcccccacgagcgcggtggccagcgcggccgcgacgcccagccgcagcgcgtgacggaagatgacggagcggacgttgagattctcccgcagct

SEQ ID NO: 95 - DNA, 1458 bp, Myxococcus xanthus
ctctaaagccgcgctcaagaagctgcgctggacgttctaggagtaagtacggttccccatggctgagcccgaacccctcattggcatcgacctgggaacgacgaacagcatcgtcgccaccgtccaggacggccagcccgtcgtcatcaagaaccgcacgggccaggggctcacgccctccgtcgtggccatggcgaagaacggcaagcggctggtgggcagcattgccaagcggcaggccatcaccaatccgcaggagacggtgtacgcggccaagcggctcatcggccggaagttctcctcgcacgaggtgcaggactcgctgcgcgcgctctcctacgaggtggtggccgggcagcacgacgacttgcgcatccgcatgggcggcaaggacctgtccgtccccgaaatcagcgccatgattctccaggagctgaaggcggacgcggaggcgcacttcggccggcccgtctccaaggccgtcatcacggtgccggcctacttcaacgacgcccagcgcccaggccaccaaggacgcgggccgcatcgccgggctggacgtgctgcgaatcatcaacgagcccacggcggcggcgctggcctatggcttcggccgcacggtgaacgggcgcgtggcggtgctggacctggggggcggcaccttcgacgtgtccgtgctggatatctcccagggcgtcttcgacgtggtgggcaccggcggtgacacctatctgggcggcgaggactgggacaaccgcatcatcgaatggctcgttttcggcttcgcgaaggagcacggcatcgacctgcgcaaggaccgcatggcgttgcagcggctcaaggacgcggcggagaaggccaaggtggagctgtccagtgtgcgtgaggcggggctcaacctgcccttcatctgcacgccgcctggcggtggtgcggcgctgcacctgcaagccacgctgagccgcgacaagctggatgacctgacgtccgacctggcggagcgcgtggtggggcttaccaccgaagtgctcggcgaggcgggcgtgcgcgcctccgagctcaaggaagtcatcctcgtgggcggcatgtcgcgcatgccgaaaatcgtggaggccgtgcgcggctacttccgccgcgagccctgcaagggcgtccatccggacgaggtggtggcgctgggcgccgcgattcaggcccacgcgctggtgcagccggagcatgagctgctcttgctggacgtgacgccgcagagcctgggcgtggccatcgccgggggcaccgtgcgccggctcatccccaagaacaccacggtgcccacgtcggccacggaggtcttcgccacgtcgaaggacttccagcgcgtcgtgaagatcatggtgctccagggggagcacgacctggcgcaccagaacgagctgctgggcgagttcgtcctcaccggcctgcgggaggcgcctc

SEQ ID NO: 96 - DNA, 800 bp, Myxococcus xanthus
gcacggggcggacccgcgcatggacgacaccgggtacacgcagccggcgctcttcgtgctggagtacgccttggcggagctgtggcgctcctggggcgtcgagccctgggcggtgttggggcacagcgtgggtgagtacgtggccgcgtgtgtggcaggggtgctggaactcgaggacgcgctccggctcatcaccaggcgcgcgcggctcatgcaagagctgcctcgcaatggggagatggtgtccatcacggcgagcgaggcggtcgtcgcgcaagcgctgactccgtacgcggaccgggtgtcgattgccgcggtcaacgggcccgcggacaccgtcatcgcgggtgaacgtgaggcagtggaggccctctcctccgcgttccagacgcaaggcctcaaggtccggcggctcaccgtgtcccacgcgttccactcgccgctgatggagccgatgctggatgcgttcgagatggcggcgggacacctgaccttgcgggcgccgcgcatgcacctggtgtccaacgtcacggggcaggtgctcgaggagggcacggtgctcgacgccgggtgcttccgccgccacgtcctagaggccgtgcgtttccacgacggactcaaggcgatccgggcattggggggtcccgtcttcgtctaggtcggcccgcatccggcgctcatgggcatggcgctcaagggcctcggggacctcgcgggcacctggctcccgtcgctgcgcaagggacagcccgaccaggcgcagattctctccagcctggccgcgctcttcacgcagggcg

SEQ ID NO: 97 - DNA, 851 bp, Myxococcus xanthus
cgtgctctatgtcggggcgcaggtcgcagcggctcttgagcacgcgcacgccgcgaaggacgagcagggacggccgctaaacatcgttcatcgagccgttgacgttgagcacatcttcgtcaactgggacgggacggttcagctcgccgacttcggcctcgcgctgtccgacttgccggggcgcgtagcttcatccgcgcgcggccctttgggggaccacttctactcatcaccggagatgctgctcggagggagcgtcgacgcccgcgccgacctcttcacgctgggcgtcgtgctgctcgaactggcaacggggaagaacctgcttttctgcccggacgacatcacgcccgacgtcatggcctcgttgcccacgaagaagcgtcggcgggttgctcgggcggtcaagcgggctacgctcgcaggggcgccgccgttggtggccgacgcaatttggcgcgcggcgacactgacggttgcggacgtagacgcaatgaccgaagggctcccccagggcctgcgagtgacgctgaaccggctacttcgggttgcccctcgggagcgttaccagtcggcgggggagttggcggccgacctgacggcctggcttggcggcactttcgcgaaggccgacgccgcagccgagctgaagtctcggcctgctcaggcagaagcggcgctggattcgatggcgaccctgccgcctcgcggtcgcggcaagcgcaagccggataatgtgacgacggcgtgattgatgtgcttctgagccagtcgacgcagtcgggaaacaggctgcgttggcccgcgaaggaacaacacggagcggccaaaaacaaacggggttggacggt

SEQ ID NO: 98 - DNA, 1166 bp, Myxococcus xanthus
atgcgcaccattcgcagcgcccagactgtgggagcctggccgagcccacagtccccaggcggacgagcagcagcgcctgctcgccaacgtgctgcaccagacgagcaccacgccgctgccgcgcctctggtacttccccagcgccaagaaggccgtcgtggtgatgacgggcgacggacacccgggtggcgccaccacccagcgctggaaccagtacctcgcggacagccccaccggatgcagcgtggacgactgggagtgcatccgaggcaccatctacgactacgtgggcggcctgagcgccacccaggccaacacctacgtggcccagggcttcgagtacgccctgcacatcaacaccggctgcgcggactacacggccaacacgctggacccgaacttcttcaccccacagctcgccagcttcgcgtccgccttccccgctgtccccgcgcccgtcaccaaccgcacgcactgcatcgcgttcagcgactggtccacccagcccaaggtgtcgcgcctgcacggcatccgcctggacaccaactactattactggcccgactactgggtgcaggaccgcccgggtatgttcactggctccggcctggccatgcgcttcgcggacctggacggcactccgctggacgtctaccagctcgccacgcagatgacggacgagtccggccagtcctacccgctgcacatcgacacgctgctggacaacgcgctggggcccacgggctactacggcgccttcaacgccaacatgcacgtcgactcgcagccatcggccggcgcctccggctcggccgccatcatcgcgtccgccaagcgtgacggcgtgccggtcatcaccgcgaagcagttgctggagtggctcgatgcccgcgaggccacccaggtgtccaccgtggccttcaccggcacggtgctcaccttcaacctcacgagccccgcgcgcaacctgtccctcatggtgcccacccgcaccacgacgggccgcacgctgctgtccgtcacccgcgcgggctccgctgtgacgacggtgacgcgcaccatcaagggcgtggacttcgccttcatcgacggcgcgctggccggcacctacaccgccacctacaactgagtcactcgcgccgcccaaggcgcgtcatcctccgggg

SEQ ID NO: 99 - DNA, 986 bp, Myxococcus xanthus
cgctctcaagctgcatccgcatggccaccgctccctcgtgtttgatgatgcgtcccatgacggctcaggcgctccgcaggttggagatggccgtcttcgccatctcgtggaacttcgaggacatgttgctcatcaggtcgaacatcgccttgcgcttctccaccagccgctgaaggcgcagctccagctcctgcatgctgctctccagcttcgcgcccgccttccggtccgcctcaccggtgcccaacgaggcgcgctggtcgcgcacgttcgccatctgctccatcacgtcgagaatctcctcgtccgtgtcgctggagatggacatcaagatggcttgaatcttgtcctcgatgctcatgttcgggttgtcgacgatgctccgcacattcgacgaagcgccgcccactggccggctccccccagcgccactcgcgggctgcgttccggatgacgcccgtgccgtatccgcctgtcgcagcgcggccgtgacatccggccgacccacgatgccgtccctcggccccacgcccgcggccatctccagccggtcgtagtacgcggggtggtccttgaagaactgcgcggcgcgcttcagcgtcgatgatgccgccgggctgttcaggatggcgtccaggttgtcgcgcgtgagcacgttgtcccgggctcccaccgcggtatcgaaggtgtcccagttcgcattcagcacgcgcaaggcctcgtggtactcgtggaagtccgggtccagcgggctcgctggcgacgtcggcgggctgcccgagacaggcgcggagccaccgccgccggacgtgccgcccgtccccggcgccgtcgtgccaccaccgccaggcgtgcatcccgtcccaggaggcgtcgtaccactgcttccagggcgcacaggccggccataccgcgcgaactccgcatccaccgccttgagctcgcgctggaggtcctgcaccgagaaggtgtcgaggttgtacagc

SEQ ID NO: 100 - DNA, 883 bp, Myxococcus xanthus
cccgctacccagaagcgctgcaccggcccgtcgttgaactggtagtagcccgtcatcgtccacccgggcgtggtgccgttgatgttgccccgacactgcgtcagccggtccacgctgtagtggatggccgcggtggagccgaagggcagcgggttggaggacgcgaacacgttccagccctgcgccggcgactggaaggtgatgctggaggaggactgcgaggaagcggccgttccggcgagcagcacggcgacggcggcggcgagacaccagcggggggattgacgcggcaaggcaaagctccaggttgagaggaagctgcgttgcggatacgcacagcgtggcaggcaagggctgtgacggtccgccagtggaccctcacgggtttgtgccgctcaatcgtggactcctctagagtcaggctcctcacctttacgctccgcgccatggccgactttcttcctcgcttctatcgactcgccgtccgcgtggacgcgcactatgacgcgctgagccgcaagcttcgccagaagctgggaatcgcgccgccgctgcgcatccttccctaccggggctacggcacgcccgagcgcgccgtcatcaaggcccgcgtgttggaggaccggcacgtgcgcccgccgcaggagcgctacacgctggtgggcagtgcggtggcctcctacaagcgctacatgacgcgcgaggtgccgggtgcacacgtcgcggtgcgctggggtgacaagcgctgggagggcaccaccgacgaggagggcttcctggagctgtgggtgcctccgccggacggggtgcgctcgggctggcacatggtggagctggagctgctgtcgccggacgcggagggcgtgtcccgccttgagagcac

SEQ ID NO: 101 - DNA, 1383 bp, Myxococcus xanthus
ccgggtatggtgcgctcatagatcgccaactcggcgtcggttgtcattctccaggtgatcgccgttggggggcggcccgtctaagatggggcgccactccttggtcgcaaggccccccaacgtttcgcggggtccgccttgttgagcccctgcaggtcgccgtagttgcgctcgttgagggcggcgtcccggatggtggggacctgctgtcccaacgtgtccaacagaatgagcagcgtctcctgcgcccggatgagcgctgttgatataggcgacgtcgagcgtcatcccgctcagcgcctccgccgcgcgccgggcctcctggcgcccctggtcggtgagggggacgtcgacgaggccggtgaagcggttctcttgattccacagcgactgaccgtgtcggaccaggacgagggtaggcatggccttcaggtaattcagaagccctggggcggccaggggtgtacgcgtccacccggggccgggcgttccaggctccacagtctcgcgcttcgttcaggctgctttctcacgcggtgcccctggtggagccggggcccaccgcactagagggaatggaggaggagacaccatggctcgcaaggtcgccgcatccgctgattccgcgctgagcatcaccctggcccgcgcccgtgcgcactggctgcggacgcaggggctcgcggagccgctgaaggggagcctggaagaggtggtcgccacgacgggctgggtgcggacgctgggtggcgtggacgtgtacctggcggtgcgggcccgagtgccggggctgcggcgggcggacctggacgcggcggcggaggcgtcccagctccaggtgattcccgcggtgcgtggctgcatctacctggtgcctcgcgcccacgtgcccctggtgatgcgcgttgccgaggaggcgtaccgcaagcgggccgaccgcgagcacgagaaggtgggcctgggcgcgaaggaactggcggacgtggccgaggccgcgctggtggcgctgcgcaaggggccgctgtccacggacgcgctgcgcaaggcgatgcccgcgggcgtggtgcgcagcctgggcgaggtgggcaagaaggtgggcctgtcctcgacgctgccgcccgcgctgcgccacctggagttcgagggcaaggtggaacgccgcaccgagggcgggcggctggatacggagcgctacctgtggcggctgacggctcgcaaccccttcaccggggccaaggtgcccgccgcggcggaggagcgcaacgcgcggctggcggccctcttcttccggcagttcggtccggcgacggtggaggacttcgcggcgtggtcggccttctcacagcgggacgcgaaggcggccgtggcgcgggcggggctggt

SEQ ID NO: 102 - DNA, 959 bp, Myxococcus xanthus
ggtgacggcggcgatttgccagagccgcgcatcgaggcacgcggcggtctgcctggcctggtccgcggtgtcgcccgttgcggccaggcaggcctccgtgcgaagcgcctgccattgagcggtgtggtcgtccatcaccgccgcgaactgcgtccaggcctgggctgcgtaggtcatgccggtggcgaggaaggctgtccggatccgttcgcgccgcgcggggctccatgccaccgcgagcttctccgcttcccgcgcacagctggcatcgcgccgttgcgccgtcgtcccgtaggccgcgaggatgcccatcgctccggccacggtcgtcgtgacgagaagcggcacaagtctccggtgcggcgggggagcgagggccgccagcagggactgcatggtggggaagcgatcctcgggcttcgcgctgagcccccggaagacggcgcgtcgaactcgggtcgggaccttcacctcgcgcttcggagggctcatcctcccttgctgcgcggccaggaccacctcctgcagcgtctccccttggaaagggcgcgccccaaagagggcctcgtgaagcgccacgcagaagctgaactcgtcggagcgggcatccgcgcgctgacctcgcaccagctccggggcgatgtaggcgggcgtgcccagcaactggcccgtccgggtgagccgacccgtgggagtgacaggggcctcaatgtgctcctggtgcgacgcgccttcttcctgctggaggagccgggcgatgccgaagtccgtcacgaagacccgcccgtccttcccaatgagggcgttggcgggcttgaagtcgcggtggaccagtcccgcggcgtgcgcggcggccagtcctttgccggcttcaaggaagacccggagcacctccttccagggacgccgctccttcatccactccgccagggtggtgccttccaccagctccaggtcag

SEQ ID NO: 103 - DNA, 671 bp, Myxococcus xanthus
cggccacgtgtcgtattcgctgtacgcgcccatgccacgctgccgtcctgcatccactggacggtggcatcggggttgagcttgagcgtgcgaggcaactggggcgccacggcggtgtggtggagcttctccagcgtcttcagctcgatggtgccatccaggcccagcagcttctccacgccgtccgggggcagcgccttcaccatccggtagcactcccggaagtagtcgagctcgagtccctcgtaaccctgccacagcgccgcgtaggccttggcgggcggcgcggtgtcatccaggtcctccacggtgagcggcccgggctgtgtctccgcgcggtccctgccggtcagcacgtagtcggggaggagctggagcgccgtccagcgtgacagttggatttcggcgagcgtcaggtacgtcttgagggacatccagaacttgcggccgtccgcgcccgccacgtacttgcagaagaaggtggagcagacggcttcgcggtagggccagatggtgcagccgccgctgtccgcggagaagtagccgcagcgcagggacgcggcccggccgaagaactggtggccgttcttgtagaggagctggaacttggcgggaggcttcacccactgcggcgtgacgcccacgcggctggcgatcttcgccttcatgcg

SEQ ID NO: 104 - DNA, 943 bp, Myxococcus xanthus
  unsure (1)..(943): unsure at all n locations
gcctatccgccggacccggtgcggctggagcgcaccctgccccgccttcgcgccatcatccaggacgccgaggccacggtggtgctcaccacgtccggcatcctctcactcgcggacttcgtcttcgaacaggcgccggacttccgggcgctgaagtggctggcgacggatgagctgcccgcgggcggggagtcgtcgtggattgagccccaggtgagcccggatacgctggcgttcctccagtacacgtctggctccacgggcacgcccaagggcgtgatgctcagccacgcgaacctgattcacaacctggggctgattgccggcgccttccagacggggccgcaaagctcgggcgtcatctggctgccgccgtaccacgacatgggcctcatcggaggcatcctccagccgctgttcgcgggcttccccgtgacgctcatgtcgcccatgtccttcctccagcggcccatgcgctggctggaggccgtgtcccggtatggcggcaccatcagcggtgggacccaacttcgcgttcgagctgtgcgcgcggcgggccacgcccgaggacatccaggcgctcgacctgcgggcctgggacgtgcccttctgcggccaggagcccattcgcgccgccacgttggatcgcttcgcggaggtgttcgcgcccagcgggttccgccgtgaggccttctacccctgctacggcctggccgaaggcacgctcatcgtcacgggtgaggagaagggccgcgtgccgcgggtgcacgtcctgcaggacgccgcgctcggccgagggcaggcggtccgcgtcgagcccggctccgaaggttcgaggccccatatcggtgcggctccacgttggccgacagggtgtgatcgggacccggatccgcgtgccatgtgcccggtcagggcaaattgggtctccggtgngaagcgt

SEQ ID NO: 105 - DNA, 548 bp, Myxococcus xanthus
tgcccatgggttacatcccggtcctcgcgccgagcatgggccttgcctggcgctccaggggtgttccggtgttggacttcaccaaggcggggtggctcttgccactcctgacggagacggtcgccttcgaggcgggcgcgccggctccgtccgcgccgccgctgggctccgggcgggcccgggctcgcgcgtacctgcggcggacgctgcgcgccagtggcctgctgtacggcacgcccgcggacgcaccctccgcggcggacgtggcgcagcccaccgagctccaggcgcttcatgcgtggcgtgggcccaggcctgctatcttcgcgggcttcaacggacacctgagggacgacaccatgcgaagcgggctgaagcggaactgggcggcgttcgcggtgggcggcctgctcggcgcatgggtgctcggctgtggcggctcaacgacggaggggctggagtcgttggagcaggggaccgcgccgcccccgtccgtctccgtggacctgtcgagcgtggacctccgcacccggcttgaaagcgcccca

SEQ ID NO: 106 - DNA, 960 bp, Myxococcus xanthus
ggtgattgacgaggcgcaccggcagggactgcgggtcgccgcgcacatccatgatctggaggacgccaagcgcctggtcgcggcgggggtggatgtgctcgcgcacggcgttcgtgacatggaggtggacgcggaactcgtggacgcgatgaaggcgcggggcacctggtacatccccacgctgggcctcaatgagtcgttctacatctacgccgagggaccggcgtggatggccgaccccttcttccgccgcgcgctgtcacctgacctggcgcgccagttggatgacccggcgtggcgcgccagcgtgctggaggatgggaagacagctccggtgaacaagaaggcgctgaccatcaacctgaagaacgtgaagacgctccatgacgcgggcgtccggattggcttcggcacggactccggcgccacgccggtgcgcatcccgggcttcgcggagcaccgcgagctgaagctgctcacggaggcgggcctcacgccgttgcaggccatccggctggccacggcgaacgcggcggagttgctggggttgaaggaccggggcgtcatcgaagccgggcggcgggcggacctggtggtggtgcaaggggacccgtcgacgagcatcgacgacctctcccgcatcgagtcggtgtggcaccgaggcaagcaggtgccggggcccacctcggcccccgcccaggagtgaggcgatgacgcgtcttcagcgccggttgcttcgcggcgccctggccaccaccttcctgctgggagctccgggcatgacacagacgacactccaaccgtccacgtcgaaggtgcagcaggcggcatcacctgaacggctgctgttcaaggatgacgggatgacgccgaacagccgcttgcccacgctcgtctatcgcggcgtgacgctggaagggggacaggcgagcgcgctggagacgctgttctccgcgaatg

SEQ ID NO: 107 - DNA, 1250 bp, Myxococcus xanthus
tatggaagggggaaacccgctctccgaccgtcggtcggtcgagttccgcagccgtgacgcgctgttcaacgtgattccgctgccgcccgccgaggccgcgctggatgattcgggctactccctgcacgggacgggcgcggatgccatcacctgctccgtgggcacgttggatggcgccattggcgtggtgacgcggctgagccccaccgtggtgtgggtgatgcccaagggtgaggtggacacctccgacgcgcgcgccctgcccgtctatctgtccggctgcggcgtgacgctgggtcccatccggggcgccttcatccgcacggacgcagagacggccgggaccccggtggggctgcagttggcgaacgtctcccttgagcagggccgtcaaatcctgacgctgctggcggacgcgctgaagcgtggcgtcgcggagccggccgcgtctgcccttccggtacaggacaccatcgacgaggccgagcgcatccgcgccatcctcctggccatcagcaccgcgggcaacaagggtgtgctgcgccgcatgggccgcaccgtccgcctggtgttggagcgctacaacgcggagacggagcaactggagtggcacgccgaggacccggtgaccgactggggcgaggcgccctacgacatcgacgtcatcggccacaacagcgcgtaccgcatgcgcctggaggcgggaacgccgggcggccagcgcttcacgtcgccgctgcccgacgtcctcttccgcatccgtcaccgctggcaccgccgctcgcccgcgcccgagggcgtgcgcgtcaccttccaccacccgctgtggcgcgagcagggggagatggagcgcgcggtgttggacctgtccttctccggcatgtgcatccgctgccgcccggaggacctgctgttcccgggcctgctgccgcccctgctcgagctccacacgccggacggccagtccatcagcctgcgcggtgaaatccgctacgtcaccagcgcgcgcgctgacggcaccgtgctgtgtggcctgagcgtgtcgccctactcttccgacgaggcgcgctgggtgcgcttcgtctcccagacgaccaatcccaacacttgcaccagtgatgtgcaggaagaggggctctgggatgtcttcacgctgtctggcttcttcagcctggcgaacaagtcctctcaggaattcgacgcgctgaagcaagccttcagccacatggccaagcgcgccgcggggagtt

SEQ ID NO: 108 - DNA, 738 bp, Myxococcus xanthus
caccgccccatccccttgggggtggtgcctccgtgacacgctgcgaacgctgggggtgcttcgcaacgcaaggtccgcgcccgggcggctcctggcatggccgcatgcccctgggcgaattgcgcgtccggaacaccgtccccatccctagctcggagacaccatcgacggtggggccgcgtgtgccggccggtcgcgcaagcgccagcaacgggcgcacgcgctctccggggcggggcccgtcctgggaggagcatcctgatgccaacgtccgccaccaggtccgcggcctcctggctctcgcgtgccgtcccctttctcgagtcggtccgtggctaccgcgccacgtggctgaagcgggacacggtgggggcgctcaccgtgacagccctcctcatcccagaagggatggcctacgcggagctggcgggcctgcccccaacggccgccttctacgcggccccggcggggctggtgctctacgcgctcttcggcagctcgcgccagctcatcgtggccgtgtccgcggcggtggcggtgctgtccgccgcgaccgtgggcgcgctggcacaggcgggctcgccccgcttcgtcgtcctcacggcggccctggctttgatggcggggctcatctcgctgctggcgggcgtgctgcggctggggcgaatcgctcagttcttctccgcctccgtcctcaccggcttcgtcttcggcctcgcgctcatcatcgccatcaag

SEQ ID NO: 109 - DNA, 990 bp, Myxococcus xanthus
gttgccgggtcgccgtcgcctagtctttcccggtgtattttctgatgaagccgccctcaaagcccatctctttggagtcgaagtccttggtgttcgtgagatcattcatcgaccgcgcaaccggttcccctgatgaaacaagacgttgggcgcgggctttgacgaaggatttggaggccgtggagacatcgggatcgacgtgctcgatgcggtgagcgagttcgtggtgcatggtctccggcttggggtttttgcccagattgatggagttcgcgtcatgatcgtaatgcgcacgcacgtcgcgaggttggctccccttggtcaggatgaagccttgggggagatcgttgcccgtcattcgatagtgtctttcgatatcggtgcgaacatctgcctcggtgcgtttagaggcattgatggcattctggcccgccggtgtgatggtcactccggcagcgatcgccgttgcctgtggagtcggagtccccagaagcgcattgcgcaattcaaccatcaccctcgtggccttttcctgattgtcgctggaccgctgctcgatctctttgaggagttggttacggtcgttcttgaggcgggcgtactcatgtcggaggtcctcttgtagtgcgagggttcgctcgatgtcctccggggatggcttgcggccgttctcgccgacccaggcgttcttcgtattaagcgggtcttcggaattggccgtaatacgggcgtcaatatcggcaagtgcagcagcttcgttcgggagaatcttgtggacgaggtcatccaggcggctacgcatccccttggagataccctccatgaagtcgatgccatttttgatgaactcaagatgtgtcgcgctcgcggtcggggtgccggggatgtcagaccagcctactgtctgacgcgctcgatcgtttgggttgaattcaatgtcgacaaaggtgtcacgattattcgagggactcgtactggcggcgcttgacg

SEQ ID NO: 110 - DNA, 695 bp, Myxococcus xanthus
gctctaaaggatttcagcgggggcctgctcgtcggcggccacgggcttggaggcgctgtcctcttcggggtgcgccgacagctccagttgggagttcatgggaacctcttgttcgccgcgctcggaagtccctgccgcctcggaagaggcaacctcgcgcgcgtcattctcgggcgcaggtggcagcagaccgccggcaggcggcgtctcagtcaaatctcgcgtcatcagccagggacaccccatcggggcgcttgtaggcctgccgtctataccgcatcctccgggtagggagtagcgatggacgacattgttgtcggatgtcaccgggcagcgggctcccccgcccgctttcctgctcccaaccaggggacagggcacgcgcgaagcgtgggggccgcgggcctgtgtcctgtatcaacacagcgtccgccggaaacgttctggggccggcccgcgaggggaacgcaggcccacccggggggcagccgagcggcctgcccctactgcggcttggtgcgccccttgtggttccggggcagcgcgtggtggatgagggagacatagtccaccgcctgcaccggcggggggggcggcggcgtgcccagcgcggccaggcgcttgctgaaggcggccaggatgtccggcatgggccgcatcgccgcgagcagcttgttgggcccctccagtgcctg

SEQ ID NO: 111 - DNA, 1288 bp, Myxococcus xanthus
tctacagcttgcttcatccgtacgccgcgatcagaggccccgctcgccgtccgcccagtaggccttgctgcgcacgtcgcgcttcgcgaagccgcgccagtcgagcaactccttgcacagcatgacgacaggtgctgccggggccgtggccatggaggaagaagacgacctcaagcgccccacgcgctgggtcccccagtgacggcgtgtcgtgccggaatgccgtcgggccaacacggaactccacttcgtggccgggctcgccgcggacacccttgagcgactcgccctcgacgcacacgcggcgcagccgaggggccagcgtctccaccgaagtgacgcgggtgggcttcgcgaatcacggcacgagggtgtttgcgaggactgcgggcatttccgacatgggcgctccagaaggccgatgattccatgggtcgaatattgaatatgagaatcgttatcaattatggtgccgcgcgtggaggccggaatggcacagcgccgtgtgcgccttgtcctggccatgggtggtctccggctccgcaccatccgagggagagggccgttgatgaagactcacaccgaagaaacgatgcacacgaaggccagcaagcagggcctgtgggtgctggccgccgtggcgatggcgctggccctgttggtgaactgtggttcgtctgatgaagaccccaccccggtgcccgacgccggacagacggactccgggacgaacccgatgccggactctggaacggagcccgagccggacgcgggcacggagcctgagccagacgcgggcacggagcccgagccggatgcgggcacggagccgctgtgccagagcgacgtaccttgccgagagcagagcatcgaccggctgaacctgctcacgacgccgtcgacgacggcgatgtacgaggaggaggcgccggcgggcgagttccgttcgtacatcgacgcccgagcgggtggcctcacggtgaaccagtcctacacctacgctcgcttcacgcccgagggcctggcgcgggtcaacatcgacgaccagacgtcgctgggcgaccacggctgggacatcgcgttccgtcgctactacatccggctgaacggaggcacgtccggcccgtcctgcattggcgtggcgcggctgcccacgggcacccgcttcgagaccgtgacgtccgtacccgcggacctgaccttccagtccgacgcctggtacaccgacacgtgtgagttcatcccggacaactcggggctcgcccggccgacgatggcgctgagcagc

SEQ ID NO: 112 - DNA, 981 bp, Myxococcus xanthus
acgtcaagctcgtggggctggatgacgtgcgcgcatcactgaagcaggccggcgaggaagggcaggcgctccgtgacaaactgcagcgcttgttctggagcacggatgccgcaggtgtgctggatatcattgcctatgcagaaggactcgaggaggtcgaccgggctttgcttgctcaggcggccgtcgacttgttcgccgatctctaagctcacttctggtcagtcgaagacctcgggaagctgagggcggcttgggggcccttggatttccgaggcaccccttggagcatggcgtcgcccgcgtcacgcgggtggctgctcagctgacgggcctcgtctgcgatggcgtatgtcttgctcggctcggacagtcactggttcgtgggaggacattcatgatgaagcaaggcaagcgtgttccggggctgaagtgggtcatcgccgcgttcatcctggcgggctgtcgtggtgccgagggcgaggtgcccacggagaccgagtccaggctgtcgttgaaggagggccaggtgcttggcccggcgtgtaccggggagcagaagcaatgccccgagggcctctcctgcgcctcgttcaacctgggctcgggccccgaaatccgctgcgtccagtccccggaaatctgtgacttgttcaagtgcagcagcggcgagtgtgtggtgctggagagccatccaatccaggttcgttgcagcggctcctgagccgcgcgttacgcgtcgaagggcgggtgcttcccaagtccggtgagcgcccgttgcccggcggcgatgtactccggccgtccctgcgtctgaccgaaggcgatgtcggccaccgcgcggcaggcggcgaacccccgcgcccgcgtgaggacggcggggctgaccgcgccatacgtctccatcgaggcggtcagcatgggcgctccgccccagtggagcagtccggcgaaatccctcgcgaagtctccaactggaga

SEQ ID NO: 113 - DNA, 798 bp, Myxococcus xanthus
ggcggtgggcctcttcggcgtggatgagacgctggcgcagctggcgccgctgccagggccggacgcgctggggcaactgcggcccgtgcccacggtggcctctccggccttcggtgtcctggacggtcaggcgctggccatggggcgcattcgcggggccaacgcggcgtcggcggcggtgctgcgggtgagcgacgtgcctcggcgcgagcacacggagccccgcgtgacggtgaacgcggtgacggccttcgagccggagtcggagctgaccgaccccttctacaccgtgctggcggagctgcacgcacaggtgcgcgcctgggaggagaaggcgccgcaggggcagacgctggaccccgcgggcatggcccggctgtgggagggcgcgctggcggcgtgtgagaagcgcggcgacaaggtgacggatgcctttggccgccggttgaagctgtcgcggctgcccgtggacctgctggcgctcaccgacccgcgggcggtggtgtccagcggcacgcggctgccggaggacgtggagaactggaacgcttgggttgcccaggaggcgccatgaatcgctcgttcttcgccggggtggggtgctccctggcgagtctggtgggactggtcatgttcgtggcgctcttcggtgacaacgtgcggcgcctgttcggcgcatccgctgacgcactggcgggggcgcccgcgccccaggcatcgaaaagcctccgcacctttggacagaacaactccgagtacgacgaggtgcaagcggtgctggcccccccgccggtcatg

SEQ ID NO: 114 - DNA, 1190 bp, Myxococcus xanthus
  unsure (1)..(1190): unsure at all n locations
ctctacagcatccgggtcggtgacggcggtgccccggtcgtgcgagtccgagcggtcccacgggtccaccgaggccgcgggctcgggagcgggcgccttgcgaggcgcgggccgaggcgccgctgcacgcgccgcacgttgctgcggcgcactgcgggcgacgtcctccatgctccggatgttggtggagtccgagtcgggcggcggcgcggcggcgggccgacttccggacttgcctgcggccggacgtgggcgccgcgggggaggaggctttgcggctcggcgggggtcctccgccgcgtccgtggactcctcagactcttcggccggcggttcccccgagaggaacgagccatcgatgatgtaatcgcagacggaacagatggacgtgttggcggctaccttcgagccgcagccagggcagttcaggaccaacgctcccgcggagagaatccacgtgtcatcttcggagcgccggccttgcgtgtcaaacccctcgcggcctaacccctggattttcgcggggaattgacctaggcccgcgccatgcgccgctcgcactccgtccgtgccctgtcgacatgtgtcgtcgctttctcgctgctgtccggatgcgtccgttccgtgccgccggtgaagccgcctcccgtggacgcgcagacgctcgagcgcatccaggcgtgggaggacgcgcgctcgctgggaaatggggccctggtgtcgctggccgccagtgcaccggatgcccgggtgcgtgctcgggccctgcgggcgctggcgcgaatccaggacccggccaccctggagaccgtcatcgcggggctgaaggatgaggacgcggcggtacgtggcgaggcggccttcgccgcgggcgtgctcgccctgtcctgggagcccctggtggatgccgagctcgcggcgttggagaaggcgctggtggacgccgggcggacggaacgcgacgcggacgtgcggcgggcggtggtggaggccgtgggccggctcggcacatccggggccgtggcgtggctgtccgagcggatgcgggaagtggatggggcggaggcggcccaggccacacaagcgttgggcgtcctcgcgcgcacccgcggngcggcggtggttgcccatgtgcccctggcgccagcggaggcgctgctcgcgggcgagcggccggtggaggcgcgtca

SEQ ID NO: 115 - DNA, 1111 bp, Myxococcus xanthus
cgggacggatgcgcacaacgagcatatcctggcgcccttcgcccggggcgagaagctgggctgcttcggcctcaccgagcccgaggccggcagcgacgccgccgcgcagaatacggtcgccgtgcgcaagggtgacgagtacgtcatcaacggctcgaagaactggatcaccaacggccccaaggccgacgccatcgtcctgatgacgatgaccaacaaggaagcgggccacaagggcatcaccgcgttcatggtccccacggacacgccggggttcatccgcgccgagccggacaagaagatgggcatcagcgccgcctggtcctgctccatgttctttgaggacatgcgcgtgccggccaagtacatgctcggcaaggaaggcgagggcttcaagatcgccatgagcacgctggacggcggccgcatcggcatcgcgtcgcaggcgctgggcatcgcgcgcgcggcgtacgaggaggcggtgcgctactccggtgagcgcaagtccttcggcaagcccatccgcgagcaccaggccatccagttcatgatcgccgacatggccacggagatcgacgcggcccggctgctcgtgtggcgggcggccctgcagaaggacaagggcgtgcgccacagcgcggagagcgccatggccaagctgtacgccagcgagatggccagccgcgtggcgaacaaggccctgcaggtgcacggcggcatgggctacagcaaggagatggacgtggagcgccacgtgcgcgacgcgcgcatcaccgaaatctacgaggggacgagcgaaatccagcgcatcgtcatcgccgccaacctgctgagggagtaaccgtcatgactcgagcgcttctctccgcagtcgtcctggcctcggcggtggcgctcgcgcagggcgccgcccccgcgaaggcgcccaccggcggcaagtccgccgccacgacgccggcccccgccaagcgagacgggccggacgtcgaccggatgcccttcacgcccgactccatccgtcaggtcgtccagtaccaccagcgccgcatccaggagtgctacgaggaccacatggcggagaaggaccggacggtggaggggcggctgatga

SEQ ID NO: 116 - DNA, 374 bp, Myxococcus xanthus
ccacacaacactgggacccgggagaacacccagccggaccaggaccgtaggcacgggctgctgatcggaagagaggacgagccggccaaccgcttcagggacagcaaagagaagaccgagccgatgcctgaggagatggcgccgagaaccagcgatgaccgaccgggagcgcaccaggacacccagacacagcaggagcgacacagtgccaacaaacaccagcccggccatgcagaccgcgttaaccgccctaaaaccaggcgaagggggtagcaccccgccaacggcgatgagacacgcatgcatgaggaggatgaagacccggtctacccggggacccacagaacggcgtagacggacgacgaacatgaaaa

SEQ ID NO: 117 - DNA, 1008 bp, Myxococcus xanthus
cggtgaactcctgggactgagctccgtggcgcccaccgacagcttcttcgaactgggaggccattcgctcctcgccgtcacgctcatctcgcgcatctccgcgaagctggacatcgaggtgcccctcaacgaggtgttcgaccggccctccgtggagtccctggcgcactggattgacgaacactccagcaaggtcaccgcgctgattcgccagcttcccgcctgtgtggtggcgctgaagcccctgggacacaaaccgccgctgttccttgccccgccgtccgctggcagtccggccgtctacgtcaccctggcccgccacctggacgcggagcagcccgtgttcggcttccagatgcctggcgtcatggacgaccaactgccacccgagaccatcgaggacaccgccgcgctgtatgtggcggccctgcggcaggtccagccgcgcgggccgtaccggatcgcgggctggtcctacggaggactcgtcgtctgtgaaatggcgcggcagctcgaagcgctcggggaacaggtggcgctgctcggcttgattgacggcgcggcgttggaccggttgtccgcgcacgacggtaccccgcaggagattcccgcgggctcccagctcatcaaggtgctgggggaagcccagatgccgcgggactatgccagcctgagattgataggcgaatggatgggaatcagcctgcccgaggcatgggcagacctgcttcgtcgggatacagatgggcagtattcatacctgtggcgtttcttgcgagacagcgcgctgacggcccggaatttcctggcaacacgccgctcggagcaactctatacgttctcttcgtatggaggctccgccacacttttcaggacgggtccggtgacgattggaggcgatccgctcgtcgacagtgtgcgcagattcgcgctcgcggggacggaagtgataccggttccgggcaatcacatgacgctcatcatggatgaacggaatctgtagagcac

SEQ ID NO: 118 - DNA, 777 bp, Myxococcus xanthus
tacggggacctggacacgctggtcggcagctccggcgcgggcgtactcaaccagcaagggcacctgctgggcgtccacaccgacggagactgtgaggtcaacggccggggctccaaccggggcgcgcccgcggaagtcatcgtcgaagcctccgcgtatctgcaaatcgaagacatcgccgtgccgtccactgcgactcgcacgaagggggcggacgccccatccgcgcggctcgcgccctgagtgccagaacggtgcgagttgtcaccggtccgcggcaggcgttggagcccccgggtgcgcccatgccgtccgggccgctgtcgaccacctcgtgtcactccactcacgatacggactccacgaggcgaacgagcggccagccgctcgctcgcggcgtctggcgcccaggatgagcccgcgttgccacggcacgccgtgcccctcatccgcacgcctcaccgcgccatcgcgtcgtcgggcagacgagcaaaaggctcctgctgtttgaacgccaatcaagcagcggcgcccacacctcgatgtcactcgacgcgctctgcgcgacatgcgagacgctggcgcgagccgaggcattgccgcgcccgcctctcggagtcgacgcaccatggaagtcgcagcatccccgaatgccgatccacacggcgcaccgtcgctggggctgttccggctcacgtggcccatcttcctggagctgctgatcttcatgatgatgggcacggcggacacgctgatgctcagcggcgtgtcggatga

SEQ ID NO: 119 - DNA, 1082 bp, Myxococcus xanthus
ctttaacgaagtaactaccgtccttctatagaagctttaattcgacggataggaaaacaaacgtatcttccttctatcaattctgctgcggacattaataactttttttcattgcaatatgaagtaccaattggaatttatgattcttctaatttagagggccacgttgaatttactatcggtaaaaaagaagagtcttacgaagctctaaatgaacgtaacatttctttagaaaataaaatcatttcaaaagatgccctaggagctttcggaagcccttatgtggattctaaccgagcgtacgtaactgaaaagacaacacaagctgtacagttcatctatttaaaaccttcactttcagaagaacaggcttataaactaactaaatccttaagtgacatgttcattcaaattcacggcggcgaagcaacctatcaagtcattaactgatgtacgtaaatatagcgtctatcttttcaagatagacgctatatttacgctaaaaataaaaaacgcaacatctcagctttgaaagcgagacactgcgttgtgataacaatatgtatggagcgggtgatgagaatcgaactcacgacatcagcttggaaggctgaggttttaccactaaactacacccgcaaatattatcaaaatttgtcgaccaataagtaaaaataaaaacaggaatcatcctgtcaagtaaagctaaagtaccgatggtcggggtcgaaccgacactcccgaaggaacacgattttgagtcgtgcgcgtctgccaattccgccacatcggcaaaataaaaaaggcaagttaaaattataaatggtgccgagggccggacttgaaccggcacggtagtcacctaccgcaggattttaagtcctgtgtgtctgccaattccaccaccccggcagcttgtaaataaatggaggcggcaaccggatttgaaccggtgataaaggttttgcagacctctgccttaccacttggctatgccgccatttactcaagactaaataaatttattaaaattaaattggagcggaagacgaggttcgaactcgcgacccccaccttggcaa

SEQ ID NO: 120 - DNA, 1013 bp, Myxococcus xanthus
ctgcttgttcacgccccggcgctctgaggctcagggggctccggccgccgcgtcgatggcgttcagggcctcctcccgcaagcgctcctccggggtgaaggagtcgaacagcagccgctgcacggcggcctgacgcgcggcggggttcggctcggactggcccagcgcctcccggcgggaacggaactccgccagccgccgcttccactcggcctcctcgcggtccatggcctccagccgctcagtggcctccgcgcccacggtggccagccggtgctggcgcaggtcctcggccgacgcaccggattccaccagctcgcgctccaccgcctgctgccgcagggggcgcagcgcctcgtcgcggctggcgcggtattccgcggggagttgttcatccagcgcggcgatgcggcgctcgcgcgcctcgggagacagcgtggtgtcctgctggagcttcatccgctccactgacaccgcgtccacccgttcctcgtcaccaaagagtccctccgcccaggggcccaggtgctcgcggcgcagctcgcgcagggactggagccgcgcgcccacgtccagctccgcgccccgttggttcgccgcgaaggtgcgcgccgcgtcgcgatacgccaggtagtcatccagcacgcgcacggtttcctccatcgccgcggctggcagattcttggcccgcagcgaggcgaggatgcgctcgcggatgacgggcagcccttcctcgcccatagcggaaaggtagtagtcgaacaggcgccgcaggtccgccgacaccaccaggtgacccgatgcatccacctgcgccaagccatcctcctccgtgtcctggagcgagcccggcatggggggcagggtgggcgccgcggacgttgtgttagtgggcgacgcggtgggcacggcacgttgcggcgccggtgtacccacgcgcggcgcggagggcattagcggtgaccccaacggtgacagccgggcccccgggcggcggtggggccgtctccccg

SEQ ID NO: 121 - DNA, 1156 bp, Myxococcus xanthus
aatgtggcctcgcgccgcatgcgacgcagggacaatcgaacgtcctgaagaagctgggacatgaaggacagactccactgcaactccaacgccatccaacgtcgcgcctgacagggcccttcgtacacccggccgggacgtgattcgcgttcgcctgtggcacgcgaaatcccatcatcggacaagagcccggtccgcttccaacgcggccaaaagaagcgtggcgccacggtggaacccgatgcgtgacagcccgaccgcgcggccattgcaatatgcgttacccgcaatcccttacttcccttcttgacacccctgacgctgcgtggcacatatctgcgccgactcgataatgaaaatcattctcattatctacttacggacgcaacaagcgggcgcaggcatccagaaggaggagcagggacatgggaacgcccacccgggtggcactcgtcacaggtgccgcacaaggtattggcgcggcagtggcacgtgcgctggcgggcgaagccctcatcgccgcggtcgacaccaacgcggacggcctgagcgccctcgtggccgagctccggcagaagcatcaacacgcggtggcctacccggccagcgtgagtgatgtcgccgcggtcgacgccgtggtggagcgcatcgagcgggagctgggccctatcgaggtgctggccaacgtggcgggcgtcctgcgcacgggccccatcctgtcctacagcgacgaggactgggcgttcaccttctccgtcaacacgctgggcgtgttccaggtgtcccgcgccgtggcccggcgcatggtgccccgccgaagcggtgtcatcgtcaccgtgggctccaacgccgccgccgtgccccgcacgcagatggccgcgtacgccgcctccaaggccgcctccagcatgttcaccaagtgcctgggcctggagctggccccgcacggcatccgctgcaacgtcgtgtcccccggctccacggacaccgccatgcagcgcgcgctctgggcggatgactccggcgcgcaggcggtgattgccggctcgcccgaggcctatcgcctgggcatccccctgcaacgcatcgccacccccgaggacatcgccaacgcggtgcggttcctcgtctcggacgcggcacgccacatcaccct

SEQ ID NO: 122 - DNA, 1119 bp, Myxococcus xanthus
gtgctctaaagccgcaccggtgggggtgcacaacctctacggcccgacggaagcagcggtagacgtcacgtactggccctgcccgcgtggagaggacttccaccgggtgcccattggccggccggtggcgaacacagtgctgtacgtgctggacgtgcacgggcagccggcgccggtgggcattccgggcgagctgcacattggcggcgtgcaggtgggacgcgggtactggcagcggccgcagttgacggcggagcgattcatccccgacgccttcagcggcattccaggcgcgcgcctgtaccgcaccggagacgtggcgcggtggctggcggacggcacgctggagtacctgggccgggccgacttccaggtgaagctgcgcggtttccgcatcgagctgggtgaagtcgaggccgcgctgcgcgcccacctcgatgtgttcgacgccgtcgctgtggttcgcgaagacgccccgggcgatcagcgcctcgtagcctatgtcacgggggagccagccctggacgtggcggcactgcgggcacggctggttgagcagctaccggcccacatggtgcccacggccatcgagacgctgccgtccctgcctctgtctcccaacggcaaggtggatcgtaaggccctgcctcaaccgagggccactcctgcccctggagccgctgcccccctgcccgtgcaagagcgcatgactcccttccaacagcgcgtcgcagccctcttccgtgagctccttcgcgtggagcgcgtgggcctgcacgacgacttcttctcgctgggcggccactcactcctggccacgcagcttatctcccggctgcgtacgaccttcggcgtggagctctccctcaacgcgctcttcgacgcgccgtccgtggccagcgtcaccgagctcgtcgaggaaggcatgctcgttcgtgtcaccgcgccccagattccagtgctccggcccgtggcgcgcgatgggagcctgccgctgtccttcgcacagcagcgactgtggctcatcgaccagctccagcccggcggcagccagtacaacctgccgggcgcggtccggcttgaaggcgcgctggacaccgaggccctgcgccgagcgct

SEQ ID NO: 123 - DNA, 773 bp, Myxococcus xanthus
gcctgctctaagttggggcgctccgcttcggcggtgacgcgttcccgaagccacgcctcatcgtgtccggacgcgtcctcgacccgcagcggcacttccacgggagacatcacttcctgccgcggttgtcccgcttcggaggtgatgcgaatgcgcagtgcggggtgccgctccatcaatgcgtgcagcgcctgtcgcagggcggcgacatccaacgcggagcggacgcgaaccgcgcgcgccacatggtatgcggcgctggtgggcgccagcgcatgcaggaaccacagcgcctgctgaccgtatgagagcggcagggggcccgtgagcggcgcgggtccggggttgggctcggacgcgggcgtggcctccgtgagtctgcgggcgagcgcatcgaggctctcaccctggagcagggctgagagggggaggacgatgcccagctcacgctcgagctccgagtgcagctccaaactctgcagtgaatccagaccgtagcgggtgagtggcgcttgggtgtccagcgacgccgggctcacgcggagcagggccgcgacccgggcccggagccacgcgggcgtgccgggcgggtggggggcctcggcgacctgttcggacggcgcctcctgcgcggctgggttgcgccacgcaccgatcagctcgagcgttccgtccaggaagcccgcgcggcaggcgtggcgctgaatcttgccgctggacgtcttgggaagcgcccccgccttgagcaggagcaccgcgtggacaccgagctg

SEQ ID NO: 124 - DNA, 1267 bp, Myxococcus xanthus
gacacgtaccgcttcaagtggacgtgcaaggactgcttcacgaaggagctggcgaaggcgagccccgccaacgcgagcgcgctggagcggctgcgcacgcgctggtggcgggaggcgaagggcgacgaagatctgggcaagccccgtctggagtcgctgctgggcggcttcgagggcctggaagggctggaggccttgcagtcgctgcccggcatggacctggaggcactccagggcatgcagggcttcgaggccttccaggagatagacgcccagtcgaaggagctgctggagcagctcatccccgggctgatgggggagtgaggcgggtcctcagtcgaagagggcgcggacgaactcgcgcggctcgaagcggcgcaggtcggccaccttctcgcccacgcccacccagacgacggggagcttcagctcgtcgcagatgccgatgacgacgccacccttcgcggtgccgtccagcttcgtcagggcgatggcgctgacgcccacggcctcgtggaactgcttggcctgctgaatcgcgttctggccgttggtggagtccagcaccagcagcacctcgtgcggcgcgccgggcagggccttgtccatgacgcgcttcaccttcttcagctcctccatcagcggagccttggtgtggagccggccggcggtgtccgcgatgatgacgtccgcgccttcctccttcgccttcttgacggcctcgaagatgacggcgctggggtctccgccctcggcgcccttcaccaactgggcctgggcgcgctcggcccacacgtcgagctgctcggtggcggcggcgcggaaggtgtcaccggcggccagcaccaccttcttgccctcgctggtgagcttcgaggccagcttgccgatggtcgtcgtcttccctgcgccgttgacgcccaccaccatgatgacgtgcggcgggccgccgccttccagggagcgcggcacgggcaagtcacagatgcgggcgacctcgtcgcggatgaggcccttgatgcgctcggggtccttcagctcgttgcgcttgagcttctcgcgagccacctccaccaggtggttggcggtgcgcacgccgatgtcggcggtgaagaggatttcctccagctccgccaggacggactcgtccacctgtcgctgctggccgaacaggccgttgagccgggccatgaagccctggttccgggtcttgtccaggccctgggccagggtgcgggcggcttcggcctccaccttggcgcgcgcg

SEQ ID NO: 125 - DNA, 811 bp, Myxococcus xanthus
gtcagccgtttgctctatctctgccgggttgcagggcgtctcgaaacgggaggcattcttgttggccggtattccgacgcgctcgactgcgccttggtgagtgctgcatcaggacctcccccggattcgaagcgggggcctacgtggtttcagcgcggcacccgagggctccaggcgtggctggagcgtcgttgggcgtcacgtggagatcactacctgggggagtggcatttccatccccatgccgagccgacgccaagcgcgacggacctgcggcagcttgatgccatcgcgctgtccacccaataccgctgtccggagcccctgctgctcatcgtgggcggtgaccctcgcgatgcatggtcgctcagtggccacgtcgtgcctcggagcggactgcccatccaactccagcgtgaatccatatgtaatttccagaaccattcccgtttcaagagatgagaccacgaggaggtgatgtcttggaacgtgccgatgacgaggaatcatctgctgcggcaacaggggcaacgcttcctgaccctgcgccgcgacagcggcggtccgtgcgcggccccgacctgactcgtttctccgtgagcttgagaaccgtgacccacagcttggatggcgcggtgacactccgtcaggtggacgtggtggaacctgtgcgcgtgccagcgctgccaggccaactgcctttgtgctggcgtgccttgaatacgcacgcttgcgcatgttccatggaactgggctttcctgagcgggcgctctggggtggcacaagcagaggccgtgccatcattgttcg

SEQ ID NO: 126 - DNA, 1400 bp, Myxococcus xanthus
ctcgacgctaggggttgcccaagtcctggaggatggcgtcgaggaagggctctggcgcgcgctccacgtcgaagacgtcaggtataagcgtccaagtcggagagcagcaaatccgtcacctcctggaggcaggagatgaagcggtgcaggtcgcccgtcacgtcgtcgcggcggttgtggcggggcagcatgtcccagagctggaagctgcgggagggcggccgggcaggacggaagcccgcgaagctggcgcggtggtagggggcgagcaccgggttgtcgtgcgcgtccgtcacgccctccacgagcacctcgtacaccacgtccggcgtcatttccgtgtcgagggcgaggtgaacgaggggcccatccgccgcggcgccaacggaggccaccgggactgcgggggcgtcacgaggcgtgaaggtgaagcgcgccgagggaggcacccgcacgtcctcgtcgaaggcgaggcgcacggacttcggcgccagggcctgggcgcccacgagtcggggcgctgtcctgtcctccacggtgaaggtgtacgtctcgtcgaggaggtgctcgccgccggccgtggccgagacgacgcggacggagacggtggcctggctggccagcggcaccgccgggtggagcaccacgcgcagggtgtccgctgtctgcgtcacctccgccagcggccccgcgaaggcgggttgcacctcgacgctgtccccgcccgcgaaggcgaggacgccgtccacccagacgcgcgtggccgcccgggcaatgccgtctacgccgacgtccaccacctccagctccagcgcggcatcgacggggacgtcctcctcctcggggcccggagcgcggttgaggaggagagggcggcgcgtctcggcgaagagggagacggtgtcgacgtagagggcgggcagctcaaccgtggccatggggcttcctcacggggagacgagctccaagcggacacccaccgtgtggacgccggagagcttcgagacgttggcggccatgtccccgacgaggcgctcgcggccggggcgccccagagtgcgggcgtacttcaccccgtcgacgacgagggacgcttcccaggccaggcccgccgggacgcctgcaggtacacggaggcgcaaggcggtgcggaccaggtgcacgccggtgacgtccactggctgcgtcacctcgacgaagtcgcccggggccaactcgaagcggcgtccaggctcctcgtcgccgaggacgaagaggtactcgcccgaggcaggcgtggcccgctggggccgaatgcgtccctgtccgaggcccaagcgactggtgaaggcggtgagggccatgggcgtcacacctgcccggagagctcgagcgagtcgaaataagcgcggcgagtgacg

SEQ ID NO: 127 - DNA, 1292 bp, Myxococcus xanthus
atggcagccgccgccaatctcgaagccgttgagcaccacgtcgtagcggtggcacttcacccggcccgggtccgtgagcaggtaggccacgtcctcgtcgtgcggacgcgtgaaggcgtggtgcgccgccgcccaggtgttcgtctcgtcgtcgtactcgaacagcggcgggttcacgacccacaggaacttccactggccgccgctgccgtactccggaatcaggcccagcttcttggccacgtgcacgcgcaggttggccatcaccgtgtggaccagcgcctccttgccgaactggaacaggaggaggtcgcccgtcttcgcgcccacggcctggttgatggcctgccgcagcgcggggctgatcgtcttggacagcggggactgcgtccactcacccccgtccgccaccttcgcgcgggccaggcccttggcgcccgcctgcttggcgaactcctccagcttgtcgctctccgcgcggctcatcgccttctccgcggggacgaccatggccttgacgatgcccttgttctgcaccgcctcccaaatcatcgggacgccgccgccctcgccgtgctcacgaatgaggtcggtgagcaccacgtgctccagcccgaagcgcaggtccggcttgtcgttgccgtacttcgccatggactcgtagaagtccatccgcatgaagggcgtggggatgtcgatgcccagcacctcgccccacagcttcttcagcaggccctcaatcatcgtgaagatgtcgtcctgggtgacgaagctcatctccacgtcgatctgcgtgaactccggctgccggtccacgcgcaggtcctcgtcgcggaagcacttgacgatctggaagtaccggtcgaagcccgccaccatgaacaactgcttgtagagctgcgggctctccgccagcgcgtagaacttgcccgcgttgagacggctggggaccaggaagttgcgcgcgccgcccggcgtgtacttgcccatgaagggcgtctccagctccaggaacccgttgcccaccatgtacgagcgcgtcagcgcgttcatcttcgagcgcgtcatcagcgagtgctggagcggcgcgcggcgcaggtccaggaagcggtgggccaggcgcttctcctcggacgtgtcgatgctgtcctcgacggggaacggcgtcggctccgaacggttgaacatggtgaggtcgctggcccggacctcgatttcacccgtcttcatcttcgggttcacgttcttcccgcgcgacacgaccttgccgcgcacgcccacgcagtactcca

SEQ ID NO: 128 - DNA, 1612 bp, Myxococcus xanthus
gcgtgctctaagggccagcatctggtcggacgtgctgcacacgaaccatgctggcatccacgaccacttcttcgacctgggcggccactcgctgctggccacgcgcgtggtgtcgcggattcgcgaggccttcggcgtggagttgcccatcgccgcgctcttcgaggcgcccaccatcgccacgctgtcggagcgcgtccaggtgctccaggcccagcaggccggtgaagcaccacccccgccgctccagccctcctctcgcgacggcgagctgcccctgtccttcgcacagcagcggctctggttcctgtgccagatggagccggacagccccttctacaacatgcccgccgtcatccggctgacgggcgcgttggacccggacaccgtgcagcgctgcctggaggcgctcatccgccgccacgaatcgctgcgcacgacgttccggatgaatggccacacgcccgtccaggtcatccacccgcccgccgaaccgaaggtggagaccgtcgacctgcgcggccttccactggagcgccgtgaagtcaaagcgcgccgcctgtccgacgaaaaggcccgccgtcccttcgatctgactcgcggcccgttctgccggatggggctcatccagttggatgaccaggaacacctgctgctgctgaccctgcaccacatcatcgccgacggttggtcgctgtctgtgctcgtccgcgaggtcgtcgagctctacgccgccctctccgcgggccagccgccgccgctcgccgccctgcccgtccaatacgcggactacgcgcggtggcagcgggagtggctgtccggtcccgtgttggaacggcagctcgactactggaagcagcggctcgccggggctccgcccaacctggacctccccacggaccgtccacggcctccggtgcagagcttccgcggcgccacgcaccagggcgtgctgctgcccgtggacgcggccaaggcgttgcaggcgctctgccggaaggagagcgtcaccccgttcatggcggtgatggcggccttccaggcgctgatgcaccgctacgccggcgagacggacatcgtcgtcggcacggacatcgccaaccgcaaccgctccggcaccgaagggctcattggattcttcgtcaaccagctcgtcattcgcggcgacctgagcggggaccccagcttccgggccctgctggcgcagacgcggcgggtggcgctcgatgcctacgctcaccaggacctccccttcgaggaactggtgaaggcgctcaacccggagcgcgacctcagttactcgccgctgttccaggtgatgttcgacctggtgcgcgcggaccgcacgatggcggacgccttcccggacctgcgcgcccgaccgctccagccggaactgctcaccagtccgttcgacctatcgctgtgggtcgctgaatcccccaccggctacaccctggcgctgcgctacggcaccgagctgttcgagcccaccaccgcacggcgactcatgggacattacgtccggttgctccagcacgcgctggaagcgccggacaccgcagtgtccgcgctggagctgctgcccgcgagtgagcgagagcaccgtaga

SEQ ID NO: 129 - DNA, 878 bp, Myxococcus xanthus
gtgctctaaaggcgctatcagctgtccaccgcgcagcggacctacggcgtcaaccgcctcatcctcatgagcgacggccagcccaccgagggcctcaccgcggacgaagagctgacgcgaatggcgcgggagctgcgcgccaccggcctcaccctgagcgccattggcgtgggcaccgacttcaacgaggacctgatgcaggccttcgccgagtacggcgccggtgcctacggcttcctggaggacgccgcccagctctccaccctcttccagaaggacctgcagcaggccgggacaacggtggcgcgcggcgtgacgatgaccttcaccctgccccccggaacgtcactgggcgaggtgctgggctaccgcgccagccagtccggcaatcaggtccatgtgtcgctgcccgacttctccgcgggccaactggagcgcgtggtggtgcggctcaacgtcaccggggactcggtggggcggacggcgcgcgtgctggacctgaagctggcgtacacggacctcatccgcgacgcggaagtggccaatgaagcctcgctgtccgcggtggtaaccaaccggcgtgaggaagtgctcgcccgccaggaccgcgaggccaccgtctacgccgcccgggcgcgcagtgccgtcaacatgcagaagtcggccgaggccctgagcgagggccgcaaggacgaggcgaagctctatctgcaacgcacccaggcggctcttcgccgaagccagcgcggtgtccggcagcgccgcggtggcggcggaccaggccgaacagcgggcggtgatgtacgagtacgacagcgcggagggccaacaggcccggcgctcgctcgtgaagaagagcaaggtgaaggcgctcaaca

SEQ ID NO: 130 - DNA, 1419 bp, Myxococcus xanthus
tttgctttccgtgctctaagtgcagctccacgacgttgggcggaacgtccagcggggcgtcgtagccgtccagctcctgccgggggaagggcgagccggcggacccctgggggccgtcgaacgggcggtacggcgcggccgtctccgcccatacagtgtaccggtacgtctgctccgcggcgtgggcacgcaggtcattgcggaagaggaccgcgccgtccacggccgagatgacgtaggaggtgtagtctgagtccttgctgctcttggggcccgcgttgacctccacgtaccaggcgggccgcaggccgtcgggcagggtgaagaagaccttcttcgcgcgcgcgggaacgacgagctggccgggcatcacggtgcgcacgccgggctcgaagtcgaacagcgtgtagccgccgcgggagtccacggcgatgaatgcgtgcggccccagcggggtgccgctctggtccgagtacgccgccgccacggcgtccgccgcggagcgctggaaggcgttcgcgccggtgcgctgccgggccgcgagggtgagctcgctcggcgccaggtagccagtgacggccacgggcgagagcgcctgcgtcatcaccaccttcacctcgctgcggaacacctccacgccttccaccgcctggcggaaggtcacgatgacggcgcccttgcccgtctggtgtacggactgcaacggcgcggcggagacgtcttctcgcttcagccggtagaggtccgcgacctggcccaggtaggcgcgcgccgcgtcctcgggacgggtgccagcgcgggccgcggtctgcaggcccgggccggactgcatggaccagaggacggaggggacgccgagccgtgtctccgtgtgctcgactcgcaggccgcgggcatgggcctgctcatcggccacggcgagtggcgtgctgccaggccgcgcgaggaatgcgtcgaagttcgaccgtggagcggccgaagcgctggtgccaagacatgacgccagcaggacatgggtaagccactgcttcctgagatgcatcgttcttccggagaggaggggagagacaacgggggtgccttctacgtcaccgtgtcgttggacaaggacaatccttcgcctccctatgtgctcagccgcctattgcctgtactggagctggtgccgggagtctcgctgaaggacctcaacaccaccatacgagaccgatacttcggcgccgtgtatcgaaaccccgtaaccgtcttcctccgggtgattcagctctccgttcaccacgcctacaaggggggggagaacggccggtggttggagcgtacaatgggggaggagatggctctgctagctcttcaggacccagttccgcctgtgttcgaacctgagcatgaagggctctttcctcggggatactaccacca

SEQ ID NO: 131 - DNA, 1066 bp, Myxococcus xanthus
gcttccacgtgttctaaggggttcatacctgcgtcttgtttcgctgcgagcgcgtgcgtaacaggagatagacacccagttcggacgtcgagcagcacggtggcctctccacaggtgtgaaacgcccggaagctcaccaagatgacgctgacgatgttcagccacttgccggggggcacgctctgcgttgattacaagtacgtcagccggacgtgcgagggcctgccagccacgcgcaagatgatccaggatatgaacccgcccaccgacagtggcaaggacggcggacaccatgggaagcggtgctcatgcggttgcaccgggaagcgcgagaagtcgagcgcgaacaggatgacggtgagcgtctgcaccacgatctgcgtcatggccaggtccggcgcgccgaagaacacgtacagcagcgcctccgccaggcccagcgcgcccagcgcgaggatggacgtcagcgccgagcgcgacaccacggccagcaccgccgccgccaggatgcccaccaggaccaccacttcatgagacagcacgtatttggacacgccccggggccattcccccagccgcaggaagacggccagcgcaagcagtccgccgaacgtggccagggtgacgacgatgtactggtgcagcgagccgttctggagcacccgcgtcatcgacgaggacagcttgagcaggccgctcagggaggcctggtagaagcgctccgggccgtggttggacagattcagggcgcgcaggcccttcagcaccggctggcgcagcgcgaagaggctcccgccgatgacgaggctccccacgctcaaccccagggcgggcgtcacgccgtgccacagcgacagctcgaggccccccgcctggctcccgccaatgtccaccgccgccatggccagcaggggttggatggcccagggcaccaggcccaacatcagccccgccgcgccgagcagcgcgggccccatccacatggacggaggcgcttcgtggaccttcgactccggcttgctcgcgcggaacgtcttgtccgcgaagggctgaacgcccacgcgca

SEQ ID NO: 132 - DNA, 720 bp, Myxococcus xanthus
ggaccgcggcccgtttgttgggggcggatgccccaggactcccaaagctgggccaaggcgaactcgaccgcgaagagggcgggctgggtgaacgcggttcgccgcagcaaggcttcggcctcttcccgccgcgcctcggacgggtggaggagttgccgcacatcgaggtccagatggggaaggagcagccgggcgcagcggtccagggcctggcggaacacgggctcctgttcatggagttcgcgccccatgttcacgtactgcgcgccctggccaggaaagaggaaggccacagcctgctcgccgtcagcggcgctgccggaagacacctcgcgcggccggtgtccgcgcagcgcggcgagcgcgtcgtcccggccgcggcaggtcagggctcggcggtgcgtgaaggcgcgccgtccgacctggagggtgaaggccgcatcggccagtgggagttcggggtgggcctccaggtgccgggccagccggtccgacatcgcgtcgagcgccgaaggcgtgcgcgccgccagcacgaggagctgggtgtctcgcgcggggccgctcggctcgaacggaggtgcttcctccagcaccacgtgcgcgttggttccgccgatgccgaacgagctgacccccgcgcggcgcggagtcttccgcgccggccacttcgtcaaccgggtgttcacatggaacggcgagcgcgagaagtcgagctgggga

SEQ ID NO: 133 - DNA, 1470 bp, Myxococcus xanthus
  unsure (1)..(1470): unsure at all n locations
tgctctaaagggacgtagagcgtgtcgcccaccttgccgaactcgtacttggtatccacgaggatgaggccgcgtgagcgcgcccacttctggccctccgcgaagaggcccagcgcggcctcggagatgcgcgcccagtcaccaggcgtggccaggccccgcgccagaagctccttctccgagatgggctcgtcgtgcaggccgtactccgccttggtggacggggtgatgaggggggcggggaaggcctngtccttgcgcaggccgtccgggaagggcagtccgtaggcggtgtgcgtgcccttctggtagtcgcgccacaggctgccggtgaggtagccgcgcaccactacttccacggcgaagggctgacaggcacgcgccacggtgacgttggcgtcgggcacgtccagcacgtgattggggacgatgtgcttcgtgcgctcgaaccagaatgcggacagccggttgagcacctcgcccttgaaggggatggtggtgaggatgtggtcgaacgcggacagccggtccgtcgtcaccaggatgagctggtcatcctgtcggtacgtctcgcgaaccttgccgcggtagtgctggccgagcgcgggcaggtccgtctgctggagggtgaggggaagctgcgcgtgaagtgcggaggtattcactgtcgcctcgcggcccctctctctcgcgggaagggcgagaggaaacggggcctgacttgaggcgcgcgactctactggagcgaagcgggcagggaagaaggaccgtacgctgctgccaggtagaggaaagctgggttgatgcgcaggattccgtccacgtaagcgaccgcgtaaggcgcgcccgacgcccggtccacctggaccgcgctgttcggcgcgatgccccagtgggcgagcagcgtgcgggccaccagctcggcggcttcgcgctcggagaggccctggaggccctcgcggcggtcatccggccaacgctctccgccggactcgaacaccagctccaggggcgcacccgcgtcgggcgcctggaacaggtccatcttcggatcgaagcccggcgcggcgagcagctcgccctgatggctgaccgggaagaggaccagggcctgggctgcctgcccggcctcaatgacggactgccgggccacctcgcggaagagctccagtcgcgtcgagggagcttcgaactcgaggaactccggcgggttggtgagggcctgccgcgcgctcatcgtggcacggacaggtgcacccgcctcaccacacgcggtgaggaccgtcacgagagagaggagcaacccagggagccagcgacgcatcaaccgggaatataccgatctgcttcgggatcaaccagctaaactcagcgcatgcggccaagggagcagcttaccgttgtccttcatcagacgcgttcaaccgacaacctcggagccgggccagactcaaccaaactcgggtgttt

SEQ ID NO: 134 - DNA, 1269 bp, Myxococcus xanthus
acccgcccaagcaggacggcatggttgcaatcgctttccagcggcaccatcggcccaaaggcaatcaggccgtgtttcccatattttgtttcaaatccgggtgcgggcgcgcgcgctcggtccgcgaagccacagtgcccctgaccgcgaggccgtgcgcgcttccgctttcgagcgcttcagggcgcggaggccaccacgcgccgggctttcgccagcatgcgacgcagaggcacttcgtccgcatgcgtcatggcttcatcccaggtgagccaccgcacgccgaaggactccgccgggtcatgcaccagggcgtcggggttctccgccaccacgaggaagcgcacgtccaggtggtggtgctccggctcgtcgcggcgcgcggggatggtgtggatgtccacgtccagcggctggggcgcggccgggtgcagggacacgcgacatcccgtctcctcacgggcttcacgcagcgccgtggcctccatgtggcccgcgtccgtgacatccgcgtgtcctccgggctgcagccagcgttggagcttgcggtgatgcaacaggacgacgcgcgcgccctctgggtccaccaccaccgcgctgcccgtgaagtgggcctccagttgctcccgggagaagggccgcgccagggaacgggcgaagtggcgcatgcgctccaggtcctctcgctccttcacgtcctcgggaacgtggcgctcgagcagggcctggagggacgtggcggaagaaacttcggattccatgcctccccgtactgcccccggccaggcggcgccagcaccttctcacgcccgtgacatgtgacaacctcctgagccggtggagtgagccggtccggatgtgctctcatccggcggccccgggaggcggccggcctcgggatgcagggagaatcgactcaagccatggcgcgaatcctcgtcatcgacgaccacgacacgctgcgtgaagggatggctgtcaccctcactcgggcaggccacaccgtgtccgcggtgcgcagtggccaggacggattggccgcctaccgcaaggcaccgttcgacctggtcgtcaccgacctgaagatggacggtatggacggcatcgaggtgacgaagtcgctcaaggcgctggatgccggcgccgtcgtcatggtggtgacggccttcggcaccatcgagaccgcggtgcaggcgatgcagcaaggcgcctacgacttcatcaccaagcccttcccgcccgaggtgctgcgcgccaagctttagagca

SEQ ID NO: 135 - DNA, 1585 bp, Myxococcus xanthus
aatagacgccggcccggtgcttgcgaatcatgaactcggtccacacgccgccgagcccgtccgccccgccaatgacgacgtacacgccgccatcccggtagacggagggcgtgctcgcggcgaacgcgtcccagtcgaccggtagcagcttctgccggtgccactgcccctgccggtacacgacggcattgccctgggcatcgaacgggaggtcccagagcgcagcgtcccgccaggcgcccgcatctggcaggtcgacgagccggaccttccaatgcccgtactccttggccatcgagccgatcagcccgtgcaccgcggcatgcgtggggtccacctcatcgcctcggcccgtggactgcgcgcgataggtcaccaccgtccactccaggcgtgagcttccgtgcccagcgctcaggagtgccttcaccaagcggaacagtgacagcacgcccttcgactgccggggagccacctcgttgaacgccaggggttcctcgggcgcgacccacaccacgtggtcgattcgatccagcccgcgcagccggtcgcgaatgcgctcgatgctgtcaccttcgtcgatgaccaggcgttcgacacgtccacaccggattgcgagacctgccgcgatttcatccgtggcgccgacggccaacacgtgctgcgtggcagaaggcgtggccacttccggctcgatgacagcggtctcccataccggggccaccaggacatcaccgaccagggtgtcggcactttcgcgcacgggcgccgtcaacaccggccgagtcgagaacccccgcagcaccaccgcgacgcggccctggtcatcacagaggtccaggtcatagcgctgcgtcatgccttcccgtcgtccggaaggggcttcgttgtcgggactgcggcgaatccaggcccacgtaggtctggcgcacgcggagaagacctggagttccttcagagcgaagggcagctcaccgcggtcaccgccaggatgcaggcacatgatggcctgcagcgccccgtcgagcacactgggatgcaggatgtaggcgtcgctctccgccacgccgtcgggcagcacgacctccgcgagcacctgcccgtcgccgacgtacacctcacgaacgctctgatgcgcgggaccgtactgcaggcccagccgctgatagttcgtgtagagggtgccgcccgcgacgacctcgcggccgcacgccgccctcagggcaccgaggtcgacacgctgtggacgcggcaacgccatgcgctgcgcctgcccctggctgtggagcaccgccctactgccctgtcccgcgccagccgtctgcacctcgaaggagaacgcaccacctccctcactggctccgtcgagcgtgaggtggatctcccggttgacgccgttgacgacgatgggttgtgaccagacgacgttgctcaagcggatgtcgcccgtgctcgtggcgcccgtccggtggacgacggcggcccgggccatctccagataggcgacggcggggagcaccctgttgccgttgacctggtgatcggccaggaacggctcgttcccgttcaacgtggaggcataccc

SEQ ID NO: 136 - DNA, 959 bp, Myxococcus xanthus
cgtgttcgagggcgccacgctgcgtgggcgcttctacctggacatgcacccgcgcgacgacaagtacaagcacgcggcccagttcacgctgaccagcgggaagtcgggacggaggctgccggaaggggtgctggtctgcaacttcccccgtcctggcgcggagcccgcgctgctccagcacagcgacgtggagaccttcttccacgagttcggccacctgctgcaccacatcttcggcggccacacgcgctgggcgggcgtgtccggcgtgcgcacggagtgggacttcgtggaggcgccgtcgcagatgctggaggaatgggcgcgtgacaccgccagcctccagacgttcgcgaagcactaccagacgaacgagcccatccccgcggatgtggtggagcgcatgcgccgcgcggaggagttcggcaagggcctgtgggtgcgccagcagatgttctacgcggcgctcagcctggagctgtaccggcgcaagccggagggcgtggacgcggtgacgctcgtgcgcgagcttcaggggaagttcacgcccttcccgtacgtggagggcacctacttccacctctccttcggccacctcgacgggtactcgtccaactactacacgtacatgtggtcgctcgtcatcgcgaaggacctgttcacggtgttccagcagaaggggatgctgtccccggagcccgcccaggcctaccggcgcgcggtgctggagccgggtggttccgacgacgcggcccggttggtgaatgccttcctggggcgcgactacgacttccgcgcctatgaggagtggctcaatcaggcggcgtgacgtcccgtccgcgtttcagttgcgcccccactgccgggggcgcgtgaagcggaagaggccactggcctcttcctgggcgatgacgtccgcctcggtgccgaagtagcgggcgcgcacctcctggaggcgg

SEQ ID NO: 137 - DNA, 1285 bp, Myxococcus xanthus
tgctctaaagaggccgccgcgaaggcgtctcccaccgtggagctgctctatcagcgtgccttggcgcgaggcggctccggaaaccgcgctgggcagcgcgccgacatgatgacggtggcgctgcgcttccccacccacccctacggcaatgaggccatggcgtggctgacggagggcagcacgccccctgtgaagctgggctacaccgagcgcaccacccgcgcggaccgcttcctggacgcgggcgcgacgcagcgcggactcgacgaactggcgacgctggacaaggtgaagctcgacaaggagcaggcagcccgcgtggcgctgctgcgcgcgagggcctggttcgcgctggggcggacggaggatgcggagaaggcgctcgcgctggcgcgcaagggccccgccgccgtcgccgctcaggcggacctgctggtggctcggcgcgcgctcaagtccgacgacaacgccaaggcccgaacgctgatggcggccctggacaagaagtacccctcgcagcccgcgggtgatgaaggcgccttcttcgcgggctggttggatttgcaggccgggcgcttcgcggacgcggtgcaggccttcacggctttcgaaacgcgttatccgcgctcacgccggcgcgacgagggcatgtggttccgcgcgctggcccacctgcgtcaggaggagtacgcgaaggcccgcgccgcactggacgcgttcctgaccgcctaccccaagagcaacatgggaccgcaggcgcgctactggatggcgcgcagccgcgagctggacggcgcgaaggcagacacgttgggccccgcgtacgaggccgtcatcacctcggcgcccgcgtccttctacgcgctgatggccaacgagcggctcaaggcgctgagcctgaagacgcccgcacacttcccacagccgccgcaggtgctgcagcttccccgccctcccgagctggagctggcggtggagctgacgcgcgcgggcttgttccgtgacgcgacggaggaggtggaagcccacgcggcgcggctgcgctcggcggaccaggccctgcccttcgcgcacgcgctgctgggactgggtgagtacggccacgcccacgcggtggcggcgcgccacctgtggggacgggccttcggcgcgcgcgctccggaggccctggcgcccttctatcctcgcgccttcgccaccgcggtggagggagcggcgacgcagcaccaggtggacccctacctggtgtgggccatcatgcggcgggagagcgcctgccggccgg

SEQ ID NO: 138 - DNA, 1137 bp, Myxococcus xanthus
  unsure (1)..(1137): unsure at all n locations
tgatttttcgtgctctaatgcggaatcatccgcacgatcatcgacgcgacgccctgcgacatctgtcccggcggcaggtacagcaccgggggagcctcgtcattcaggccgtcctcgcgcacgtcccgcaccacgcccaccacgacgcggggcaccacgtcccggagggacggcaccgaatgcgccacccggatgcgctggccgagggggtcctcgcccggccagaacctgcgcgccgccgtctcgttgatgaccaccaccggctccgtgcccgccacgtcgttctccgccagcagccgcccgcggacgaggccgatgcgcatcacaccgaagtagtccggcgtcaccgggcggtactgcccccagcccgcgccggggccgttgtcatcccccgtgtacttgccctcgatggagaacgacatgctggggccccggtccatgggcaacgacgtggcgaacccgaccgcctccacgccaggcaacgaccgcacgcgctccaccacctgcgtctcgaagcgctccagtgcctgcaacgtgccgtagcgtccctccgggagcgacagccgcagcacgtggacgccgtgcgggtcgaagcccggctgcacgcgctggagcgcggagaacccgcggatgagcagcgccgcgcccaccagcagcatcaccgccaacgccacctgacccaccaccaggaacgcgcgcgtgcgcccaccccctgggcccagggtcgcccgctggctgccctcgcggagcgccatctggaggtccgtgcgcgacgcttgccacgcgggcaacagcccgaacaacaggcccgtgaggagcgacgcggccagcgagaagcccaacaccgtgccatcgatgcccacctgcgcgcccgcgagccctccgtccccgggcagcagacccgaggtgtccggcgccagcgacaacaacccgggcatcaccgccatggccaacagcaccccgagccctccgccggccacggagagcaagaggctctccgtgagcatctgccgcgcgagccgccccggngccgngcccaacgccgcgcgcaccaccagttcgcggttgcgcgccgccgcccgcgcgagctggaggtttgccaggttgacacatgcgatgagcaacaccaggctcacc

SEQ ID NO: 139 - DNA, 1037 bp, Myxococcus xanthus
ggacaaggcagaacatccgccagtggctcatccgcgagcggaacttctctggccagggcacgccgccgcccatccctgacgacgtgcgcgtggacctggccgcgaagtacgtggcggcctacgagcacatcaccggcaccacgctgacgctggagccgggcgacgtgaagacccgcatcgagcgcaacctgcgtgagaagggctacctgaagtagccctcctccatcatcggcacagggtgcctacgcgctccggccgaacacgcgctggaagacgtcgtccatgtggcgcgtgtggtagcccgaggagaagcagtcggaaatctcctcgggcgtcatcatcttccgcaggtcctcgtccgcgagcagggcctgccggaagtcgagtccttcctcgtacagcttcatcgcgttgcgctggacgatgacgtacgcggcctgccggtccatgcccttgcgcgccagttccaacaggaggcgctgcgagttcaccacgccgcccagcaggtccaggttcttcttcatctgctccgggtagacgcgcaggtcctccatcagccgcgcgaagcggatgagcatgaagtccgcgaggatggtggcgtccgggccgatgacacgctccaccgaggagtgggagatgtcccgctcatgccacagcgccacgtcctccatggcgctcaccgcgtagccgcgcagcaggcgcgccaggccggtgaggttctccgacagaatcgggttgcgcttgtgcggcatggcgctggagcccttctgtcccgcggtgaagggctcctccgcctcacgcacctcggtacgctggaggtggcgaatctccacggcgaacttctcgatgctcgagcccagcagcgccagcgcggtgaagaactccgcgtgcctgtctcgctgcaccacctggctggaggccggcgcgggcttgaggcccagcttgcggcagacgtgctcaaccaccgcgggcggcaggtgcgcgaaggtgcccaccgcgccggaaatcttccccacggcgatgacgtcccgcgcgtg

SEQ ID NO: 140 - DNA, 1458 bp, Myxococcus xanthus
ccgcgcactatccaacgctggaggaagcctgccacggcccaggacggcaggttcggcccacatacccggccggccaaccggctttccgagctggagcggcggcgcattctcgccgtggccaacagcgaggagttccgcgacgtctcgtccaagcagattgtccccaggctggcggacaggggcgagtacgtggccagcgaggcaagcttctaccgagtactgcgcgaagcggggcaactcgcgcaccgaggctgcgccaaggcgcccagggccagggccagggccagggccagggccagggccagggccagggccagggccgagcacctcgctaccgggccgaatcaggtgtggagttgggacatcacctacctgaagggcccggtgaagggggctttcctctacctgtacctggtggtggacgtcttcagccgccgcatcatgggcttcgaggtgcacgaggaagagtcgtccgagcatgccgcggccctcatccgccgctgctggcaggaggctggctgcccgaagggattgtgctgcattcggacaacggtggcccgatgaagggcgctacgctcttggccaccttgcagtggctgggcgtcaccccatccttcagccggccccgcgtttcggacgacaatgcattctccgaggccctcttccgcacgctgaaataccgccccaccttcccgcagcgccccttcgcgtccgccgaggacgcgcgtgcatgggtgatgcgcttcgtggcttggtacaacagcgagcaccggcactccgccatccacttcgtcacgccagacgacagacattccggccacgaggcaacgctcctcgcccggcgcgaccaggtgtatcagcgtgcccgagtccgtcaccccgagcgctggagaggtggcacccgcaactggacgccagcgggccccgtccgtctcgggccctctccgaacctcaccccggcagtacaggagatgaagcgcatcggctgaaccctctcacgcggtcgggtcgggggccggcgcggtggtgtgcaggctgctcttggccgtatccgccgtttccggcttcgtgcccgtgtagagcgcgccatcactccgtctccggtccccgccacatcgaaccggacaggcgggtttcccgcatccggcgcaccgcgaaggcgtcatctcaccggggttatgcttccgctcggcggggagccagctttcaggatggcgtagtacctcacccggtagtcatcaaagagcccccagcttccgtacacgacgtccttactccaccgcttccaaccgaagccccctcgcttcgctctcttcgccgcgaaccgcctcaccttgagttcgacgtggtgtttcaccctgtcgagcgcctggtacgagttgccccaccgaaagtagttcacccagccgcggacaatggcattcacctccaccacggctgactctttagagcacaggg

SEQ ID NO: 141 - DNA, 794 bp, Myxococcus xanthus
ctgcgccggggtagcggtccaccaggtaacgcgccacgccgtccgacaccgcgcccaccgccatggtgttggtgaggaggatgggcgtctcgatgaggccccactccatgagctgcgtcatgccggcgacctcgcccgcgccgttgagcacgaagccgccccccgtcatgcgctccatgaagatgttcccctggttggggaggatggcggtgacccccgtgcgcaccggaccgtgcccgggacgaagcgggccctcgccacgtatcaacgtgctgtgcccgacgagcaccccctccacgtcggtgatggcgttgaacttgccgggcttgaagcgccccagcggcaggcccagctcacgggcccgaacgcgcggacccgtctcctcggggatgtgcaccatagagggaggacactaaccgaccgatccccacagtcaaccactccaggcagccccgcccgccccctcgaagaggaggcatgggacggggcggccagggcgtcgcgtgggactcaggccttcgcgtccatgcgcggagacggctccggcgctggggatgccggtgcgggggccgtcgcggccacgggctgcgcggcggcgggagtcccctcctccaggggcacgctcttgcgcaacaccgaagcggggtgctcgctggcggcgcggcgcgcctcgcgctccttgtagcgggggatggcgggggccatgatttcgccgatgagcccccggtagtccatgccggcgccctgggcgatgagcaccaggtcgctccagcccggcgtcagctttagagcac

SEQ ID NO: 142 - DNA, 1446 bp, Myxococcus xanthus
gctctcaagcatccccgcacgcatcgcctacttcctgaatctgcagggcccggcgctggccgtggacaccgcctgctccagttctctcatcgccatccacctggcatgccagggcctgtggcggcgggagacgaatatggcgctggccggtggcgtccatctgaactcgacgccgacgttctacgtgctctccagccgaggcggcatgctgtcgcgcaaggggcgctgtggcaccttctccgatgaggccgacggcttcgtgccaggggagggcgtgggcgtggtggtgctgaagcggctgtcggatgccatcgcggatggagaccacgtccgcggcgtgattcgtggcaccggcgtcaaccaggacggcaccaccaatgggctcaccgcgcccagcggcaagtcacaggagcggctggagcgggaggtctacgagcgcttcggggtgaacccggaggacatccagatggtggaggcccatgggacgggcacccggctgggcgaccccatcgagttcgatgcgctgacgaagtccttcggcgcctatacccgcaagcggggctactgcgccttggggtccatcaagacgaacctgggccacaccgcgaccgccgcgggcgtggcgggcatcatcaaggtgctgctgtcgatgcagcaccggaagatccccgcgtcgctgcactgcaatgcgaccaacccggcgatcgacctcgagcgcagtccgttcttcgtcaacacccagacccggggctgggacgtggagccgggaaagccgcgctgcgcggcggtgagctcgttcggattcagcggcaccaacgggcacgtcatcctcgaagaggcgccctttcaggaacgacgcatctcgggacaggcgccgggatacctcatcgccttgtcggcgcacaccgcggcccagctgaaggcgttggtggagcggctcgccgcgcacctcaagctcgagcggatcgactgcgatgacatcagcaagacgctgctgctgggacggcgccacctggcccaccgtctggcgtgtgtggtccgtgacgagcgggagctgtcggccgcgttggagacgtggctggcgaagggaagggcgcccggggtgcacgtctcggaggtcaacgagaacacccggcgggagcaggccgaattccggcggtacggcaatgcatgcatccaacagtgcgcggagggcgctccgaccgctgagtacctggagaagctggccgtcatcgcggacctccatcttcagggttacacgttggagctggaggggttgttccgcgctggccgctcgcggcggattcccctgccgagctaccccttcgcccgggagtcgtactgggtggcgggagaaaccccgctcgccgagcgccagcctccaccggcgccgcagcggctgcatcccatgctccatcggaaaccgggcccggaccggatgggaac

SEQ ID NO: 143 - DNA, 1245 bp, Myxococcus xanthus
  unsure (1)..(1245): unsure at all n locations
ccggccaccgcgcagcccttcgtggaaggccgccgcatccaccacacgaacttcggtgatggcagccactccgaaccgggcaaccccgcgctcacgcagcaccagggcaagctgggcccaaactacgtcgccccgtcctgcgtcgcctgccacgtgcagaatggccgcgccctgcctccgggcaacaacacgacgctgacgaactacgtggtgaaggtggggcaggccaacggcgccgccgacccgttcctcggctaccggctgcagccgcgccgcaccagcggcacgcccgagggcgaggcccgcatcaccgggtggaccgtcagctccggcacctacggggacggcacccggttcgagctgcgccggccccactacggcttcaccaacaacacgcccacgaactactcggcgcgcatcaccccgcagctggtaggcatgggcctgctggaggccatccccgagtcggccatcgccgcgctggcggaccccaatgacagcaacggagacggcatctccggccgcatgcacccggtgcgcgacccgcagacgggcgtgacgcgcctgggccgcttcggctggaaggccagcaccgccacggtccgccaccaggtggccgaggccctcaacagcgacatcggcgtcaccacctccgtgtacccatcgctggactgcggcccatcgcagcagggctgcaccggcaccagcaccgagctggccaacacggagctggacaagctcacgcgctacatctccctgctgggcgtgccggcgcgccgcgacctgagcgacgccacggcgctgcgcggtgagacgctgttcaacaacgcgggctgcgcgcggtgccacgtggccaccctgacgaccagcgagttccacccgaacgcggagctgcgcggncagaccatccggccgtacacggacttgctgctgcactacatgaccgcggggttggggtacaacctgtcggacggccacgcaacggacacggaggggtgaacggactcgctctggggcatagggatgactgcaggcgtcagaggatgtgaggcgtacctgtacgacggacgagcccgcaccatggcctacgtcattctatgcaacggaggggaggaccacgcaccacgcaacaacttggcctacatgaacagtacagaccggaacgcgcagttgaccttcctgctctcgctgttatccgatgaacgcaacgccctggggccgagcgacatggtcggaacccggctg

SEQ ID NO: 144 - DNA, 863 bp, Myxococcus xanthus
aggtgcccccgctgtccgtgaagagcggcgccaacctgggcggcaaggtggagctggtgggggccacggtggagcccgggcggctgacgcccggagaccaggcgaaggtggcgctctacttcaaggtgctccagcccatggacgacgactacctcatcttcgtccacgtggaggacgcggacggccgcgccgagcgcatcaacgtggaccacaagcccgcgggtggcatgctgcccacgtcgcagtggaagcccggtgagacggtgaaggacgagttccccgtctacgtgccgcccggctcgacggcccgcgcgctgaacatctggctggggttctgggagccgcgcacggactctcggctgcgaatcctcaacccgaacgccgtgcgcaacgacggcaaggaccgcatcctgctgggccaggtgcccgtggcgcgttgagccgcggctgagcgggcacctgggcgctgctggctactggcagttcgggggccccatgcaggagtaggttgcggtgaacccggccctcatcgtggtggtgttgacgcgggtgcaggtgccctgcgtcgtgacgacgttgcagagcccccgtggacacgcctgttcggcgaggaccaacgcgttttcctccgccagggaccatgcggccgggcagttgaagccggaggcatagccctgggatgtgcgctgcgtgctctcgcaggtacacggcgtcgtcgtcggacagtaggtccggctcccgttgcactccacccagcctccgttgtcagcgccggaggtacagatgccgctcgcggagccgcaggtgatggacgtgccattcgcgcactgctggctcacctgacaggagagctccgcttcgct

SEQ ID NO: 145 - DNA, 1266 bp, Myxococcus xanthus
cctggggccgccttcgcctgccgagccgtcggctgcgaatgcgctccgccgaagcgcggtgccgccgcctccggggggcgcgcccgcgggtgccgtggcgcttgggacattgcgtccgggcgcggctccgccccccgctgctccgcccgcttatggtggggacgatccgtttgcgtccatcgacatcgatgatgcggcggcgatgccaacgatggccacgggggcgccgccaccggtggagaacgacccgttcgcgtccatcgacatcgacgatgcgacggttccgtcggcggcgcctgggctgcctcggcccgtggggagcgacccgttcgcgtccatcgacatccatgcggcggtgcccgcgaagtccccgagggctgcctcaccttcggtaggaagcgatcctctcgcggcggcagacatccatgcctccgggcctgcgaagtccacgaaggccgcggcaccttcagtaggaagcagtcctctcgctgcggccgacattcatgccgccgggcctgcgaagtccacgtcgccttcatcggggaatggtcctctcgccgcgttcgacctacatgcgtcgtcgccagccgctgcgggcagtaacgaccccttcgccgccatcgacttgcgggcacctgccgcgtcgacccggaaggcagcgccgccgcctgccggaagcaacccgtttgcatccatcgacatccatgctgacgcttccgccgcgtctggcagcgggcctgtgccaggcgggagtgacccgttcgcgtccgtcgacctccacgccgactcctcggccgcgataccgtcttccgtgaatccccgggacttgttcgaccttggctcggacgtgggcgggcacggcgaggattccggcctcctgcccacggacacgggccgcgccgcgctgttcgggacctcggatgcatccgatgcctccctgcttggcgatgtcccccccgccgtggatgacgcggaggcctttggcgtcaccctgggccgggtcggggcacccagcggcgtccagcgcgaggtgctggacatggacgggctgccgtcgaagcccgtggtcaccgtggccaagcccaccgcgcgtcccgaggacgtgggcatcccgcagagccgcccgtcgagccggcttcgcaaggcgttgggcttcaccgtcaacttcgtgttggccgcggccctggtggccgtgctgggcacggtcggccgggtgtacctgaacgagggccgcctcgacgtgtcggccctgtcggtggactccct

SEQ ID NO: 146 - DNA, 719 bp, Myxococcus xanthus
gatcgggcagccggatcgccctgtctgcgccatggccattctctccaggctactccttgcgatgtgcaagtggtagggatagggttttgactgcttgcaaaatgcaagcggtctgcgacaggagtccgccgatgtcactcgtgctctacggtcatcccttttcttcgtacacgcagaaggtcctcatcgcgttgtacgagaatggcacgcccttcgagttccgctgtatcgggccggaaacacctcagcactcggccgagtggtcgcggcgctggccgctgcgcaagttcccgctgctggtggatggcgagcgcgacatcgccgagaccagcatcatcatcgagtacctgcagctcgcgcatcccgggcccgtacgtctgttgcccgcggacccgatggccgcgctcgacgtgcgctttctcgatcgcttcttcgacctgcacgtcatgaacgcggcgcagcacgcggtcgatggcgcgctgacgggggattcggtgaagcgccaggaaggactggccctggccgtgaagaagctggaggtcgcctacgcctggctcgaagggcagctcgccggcaggacctgggccgcccctggcgaggacttcacgctggcggactgcgcggccgcgccctcgctgttctacgcggactggacgcaccggatctccgatgcgtttcccgtgctccgcgcctaccgctcgcggttgcttgcgcgcccg

SEQ ID NO: 147 - DNA, 1209 bp, Myxococcus xanthus
gtgctctaaagacgcgcggccggcttcaacccggccgcgggcgcaagcgcttgtcgaccgcgcaatgcctgcggagcgacgggcctccgcgcaaagcttgcgtgccccaaggcagggaaacaccgttccctggggcagacctgttggccccagagatgcaacgatgaagggactatcgtcgtcttccaactgccaggagtaccgccatgcagattgtcggagagctgatgacccgtgacgtcgtcacgctcaaggaaacgcagaacctggccaaggcggatgagctgctccggctgcaccgcattcgtcacctgccggtggtgcggcaagagaagctggtgggcctcatcacccaccgcgacctgctgcgcgccgccgcaacccacgccacggacccggccgcgcagccgctctgggccgcggacatcatgacgcgcgacgtgcagacggtgcgcccggacacgccgctgcgccgggcggtgacgctgatgctcgagcacaagtacggctgcctgcccgtggtggatgagggcggcgtcctccagggcatcctcaccgaggcggacctggtccgctacgcccagcacctcatcggcgagcaggaccgccgggagctcgccgccgagttcaatgcctgaccccgccgccagcgcgtgaggggcgggcccgtgtcccctctccgcctggcgcgcgctcccccaccccatgtcccccactcccctgacaggagcggcctccgccgaggcccccctctccgcgactccacccggcgtctccgcgccccggcatgcgttcgcgctggccgggctcacgggggtcgcgctggtggcgctcctcggcgtcgagggaccggtggccacgcgcacggtgctcatcggcggtgcctgtctggtgctctggctgacggaggtggtgccctcgttcgtacccacgctgttgctgctgggcgccacgcccgtcctcctggggccgctggaccgtgcctatcagctgccgtcggtgctcgcgtggtgcgcggacccggtgctcgtcctgttcctgggtggcttcacgctggaagtggccgccatgcggcacggactggatgcctcggtggcgcggcacgtgatgcggctgtcgggtggacggcctcggcggctggtgttgctggtgatggcgggcgtcgccttcctctccatgtggatgtccaacgtgaccgcggctttacag

SEQ ID NO: 148 - DNA, 891 bp, Myxococcus xanthus
ggccgtacacggaaggactgcgcctggacgaggcgatgaacccgctcacgctgctggccacggggctctacggccggcaactgcccaaccagaacggcgcgccgctgcggctcgtggctccttggaagtatggattcaagggcatcaagtccattgtccgcatcagcctcacgcgggaggagcccatgacgacgtggcgcctgtccgcgccgcgcgagtatggcttctacgccaacgtgaatccttccgtgccccatccgcgctggagccaggccagcgagcgccgcatcggcgacttcgagcgccgccccacgctgcccttcaatggctacgcggagcaggtggcccacctctacaccggcatggacctgcgccggttctactgagtccccgcgccatggcctcgtctccgtatccctggctcaaccccgcgctcgtcgtgggtggcctgtcgccgctgctgatgctcgccgtccaggggccccggggcgagctggggcccaacgcgattgaagccgcgctccaccagacggggctgctgacgctggtgctgctggtggcctcgctgacgtgcacgccgctgcggctggtggcggggtggacgtggcccgcgcgcgtgcgccgcaccctgggcctcttggccttcacctacgcggtggcgcacttcctcgtgtacgcggtgctggaccaggggctggcgtggggcgcgctgtgggcggacgtcaccgagcgccccttcatcaccgtgggcttcgccgcgctggtgctgctggtgcccctggccgtgacgtcgacgaaccggtgggtgcggcggctgggctttccacgctggcagcgcctgcaccggctggcctatggggccgcggcgctgggcgtggtgcacttcgtgtg

SEQ ID NO: 149 - DNA, 1296 bp, Myxococcus xanthus
gcgtgctctcaaggcgcttcggtggccgcccggacgtggtgggacagacgttgatggtggatgaccagctccacacggtggtgggggtattgcccgcgggtttccgcttcgcaccggacgtggaggcgtggaagccgttggtcctggggacggatgagtcggccggaggggtgtggctgcgcgtggtggggcgcctgcgcgaaggcgtgtccgcggagcaggcacgcacggagatgacggccctgggcgccgcgctggtgcgcgagccgggcttcacggaggagcctgctggggtgcggctggtgcccttgcacacgcaggtggtggagggctcccaggcgcggctgtggctcctggccggcgtcgtggcgttggtgctgctggtggcctgcgccaacgtggccaacctgttgctggcgcgggcttccgcgcgggagcgcgaggtgtcagtgcgcgccgccctgggcgcgggccgagggcggctggtgcggcagttcctggtggagagcgggatgctggcgctcgtgggcggcgccgccggactggtcctggcgatgtggggcatggatctgctgcgcgcgctcatgccgcctcagttcgtggatgccgaggctctccgcctgcagccgcatgtcctgggcatcgcgctggttctctcggtggtgaccagcctgctctttggcctggtccccgcgctgcgggtgtcgcgcgcggatgcgcggggcgcgctgggcgggctgcgaggtggcgcaggggccacgcggggcgaaggcgggcgcgtggtgctggtggtcgcgcaggtggccttggcactgattccgctggtgggcgcgggcctgatgctgcgcaccgtccatgccttgagcgtggtgccgctgggcttcaatccccagggcgtcaccgtggtggacctctccctgccatcggcgaagtaccgggacgagaccgtccaacgggccctcttctccagcgtgttggagcgggtgcgcgcgcttccaggcgtgacgtccgcgggcatgtccagcacggtgcccctgtggggacgcaatggtctggcgccggtgctgctgccgggcgaggcggcatcacaggcggactcccgggagttggtccacttccgcaccaccagcgacggctacttcaacaccctgggcatcccgctgaaggaagggcgcaccatcgaagcctggaatgggccgggcaccgcgccggtggtcgtggtgaacgagacgttcgccccgcgctacttccccgggcggagcgcggtgggacagcgcgtgcaactgggtgctcgac

SEQ ID NO: 150 - DNA, 729 bp, Myxococcus xanthus
acacgcagggctcgcgacgatacggatcgatttcaaagcactccgacccttgtcgccagtggggagtacaaggaagaatgctgcatggagcggtggcgcagatagcgccacacgtcatggcgaacgaaacaggagtcgctcaggaaccaagcccctagcagcggcacagcaatcctgaggcgttcaagttcctcatcactctcgatagccccccacagcagaacccaggtcccccaaggacgcctccgctcatcacgtgacgaccagttggccaccagcatccggaccgcctccgcgatgagccatcgtcctggggtgtcaaagtcagtcatgggagtcagtgaagtcttggctccaggcgtcgagagagcaatctcgtccacggctcgttgtaccgatgacccactccaacaaacagggctcccatccatcctatacttcgcgccagcaagcttcggattaacgggacaatcggcacgaccacgaagagccgtttgctcgccaaccccagactctagacgtgacgcccgacatcgaacagcttcaccagaccatcgcccaaggcgtgtacaacaagctgaagacggctgggttcaggccacctattcgtacctggccatccccctcttctccgaagaaaccggccggtaccgcctcgccgacgggcagcagcgctccttcgccgcgacagacgaagtcacggacgccttcaacgagttgactgtagag

SEQ ID NO: 151 - DNA, 787 bp, Myxococcus xanthus
cctaccgatgtggagagtgaacaccatgccatggaagcagcttgaaatgcgtacacgagcgaaccgctggtgcatcctgctgaccctcggtgggttggcgagcgtgagcggttgccggaccgccgagccctccatggaggccaccgttcccaccgcgcgcgcagccactgagaccttccgggtcgaggcatcccggctggcgtcgaacctgcgactgccggccgagctggtcgcggaccagacggtggacgtgtacgcgaaggtcaacagctacgtgaagcacctccgagtggatatcggcgacgtcgtcaagaagggcgacctgctggtgacgctcgaagcgccggagattgaagcgcagctcgcatccgccagggcgcggtgggccgcgatggaggcgctccatgtcgcgtcgaaggcaagctacgagcgcaccgtgcggaccagcgcgaccgagggtgccgtggcccacgacgcggtcgaccaggcgcgggcgaaggagcaggcggatgccgcgcaggtggtcgccgccaaggcgcactacgacgagctcctggccatgcggagctacctggtgatgcgggcaccattcgacggcgtcgtgacggaacggaacgtggagctcgggacctacgtgggaccctcgggccggggctcgcacaagccgatgctggtggtgcgggccgtccagaagcttcggctccacgtgtcgattccagaggcgtacagcccctatgtccacctggatgagacagtgaagttcaccgtacgctcgctcccggggcgc

SEQ ID NO: 152 - DNA, 1189 bp, Myxococcus xanthus
ggcgttccggcagcgaccccgccacgggcctgcacgaccggcgcgggctgctgctgcggctggagcaggaggtggcgcgcagccggcgttaccaccgcgcgctcagcctcgccgtgctccggcccgaccggccggtggagccggtgccgtccaacatcgccgatgtcatgcgcaagcgggtgcgccacccggatgccatctcccacctgggcggaggtgtgttcgccgtcgtcctgccggagtgccaggcggaggcggcgcgcgccgtcatcagtcgcatgttgccggatgtggagaaggcgacggacacggagtatcggtcggcggtggcggacgtgagccaggacagcgactcggtcgagaagctgctggagaagctgggcgcgccggcccccgaagagacctgaggtgactgcgcgcgggacgggctcacgctagactcatgctcgcgtgcgcccctctcgcctcctcgtgtccgccctgttggccgtcctcgtggcgccgggtgtgtccgcggccgccccgtcacggcggccgcgcgtggacccggaggccatgcgggaggccatcgacgcgggctccacggacgaaggccgctacgcctcctccgccagctacacgaactatctccagtcccggctgaagcaccatgccggggaccaccggggcgcggtggacgcgctgcggctggccctggccacggatgatgggaacccgctgctgctcacccggctgggggaggagtacgcccgtctgggtgatttgacgcgcgcggagcgcgagctgcgccgggccgtgctgcgcgcccccgcctactaccccgcgcacgtgctcctgggccgcgttctcacggagtcgaagcggttcgcgcgggcccgcctgcacctgcggcgcgcggtgaccctcaagcctcgcgagccggaggcgtatctcgtcctgacccagctccacctggagatgggtgccccggacgaagcggtgaaggtggtggacgcgctggcgctggcgctgccgggggaggcctcggggtaccagcgcttggggttggcgctggcggagcggggcgacacggcgcgcgccgagcgcctgctggtagaggccgccacccgggccccgggtgacgtggacgtgctgacggcgctggcgcaactgtacgaagacaccggccggcccgtgcaggcggaggagt

SEQ ID NO: 153 - DNA, 854 bp, Myxococcus xanthus
ctaaagcctgctgcaccacctggaacatcagctcgtcgtgggcgacgcgctcgccgtccggcgcctgcagcgacagcagcgtgggcgtcttgaggtagacctcgtaatcgagctcgcccttgcccacccacttcttcaagagggggttgaagaggggttctgccagttcgagtcgtagtttttcggcgtgactgtaatcgatggacgcgctcatacggccctcctgagtggggggagctcggaaggtgtggaatcgcgggccccgtcccaacgggacccgcgggcatgtcatccggcgttcagctggtgggagcgggcgtcggtgtgggcggccggggcttcaggtggaaggcgcgcaggcgctgtgccagctcctcgccctgcacgcttttagagatatatccgtccgcaccggacgcgagcgccagtgagcgcagcttcgattcgtcggatgctgaatagaggatgaacttcgtcttcggcagcgcgtactggcgcgccaggttgacgaccttgtcacccttgagcgcggggaagttcacgtcgatgaggacgaagtccggctccaccgagcggacgaggttggagacacccagcgcggaggtgtgcgtgagcacctcgaagccgtaggcgctcagcgagcgctgtacgaggtcgagcaggtccgggtcgtcgtccaccaccaggacgcgcgctttttcttcagacatgggttctccctagatgctttcgaatcatctcgagcaactggtcacgatcaaggggcttggtgagatacgcggtgcaaccggccgcgtgtgccttgtcctggtactccccgcccgcgtgtgccgtcaccgcgatgacgggaacat

SEQ ID NO: 154 - DNA, 1549 bp, Myxococcus xanthus
gcgcggctgtcccgcggcgcggtggagcagacgctgctgcgcgccgtggacgccgtcttcgccctgccggacgtgctggtggtgatggtgctccaactcgcggggcagtcgctctccgacgcgggagcgggcggcggcctgggccccttcggcctgatggtcgtctcgctggccctggtgggctgggcggggcccgcgcgcatgttccgcaaccgcctggcgacgctcgaatcccaggagtacgtggccgcgtcccgggcgctcggtggaggcggcctgcatctgctgcgcgtccacctgtggcccgcgcttcggcccttcgcgctcgcggtgttcctgtcgcggcttcccgccgccatcctcaccgagtccaccgtgagcttcttcggcatcgcccggatggagcccatgtccctgggccgctacctgggcaccagctacgcggccctcatctacgagggcggcggccgggtggtgttgcccgcctgggcgctgctcgtgctgctggtgctcggtgcctcgctcgcctcccaggcgctttccgggcccccccgccgggtgacctgacgagcgctggagttggggccccggccccggtgtggcgtggaattcccaacgttgggggaggggttgtccacacacggaaaccttttgcccacattggtgcctccatgtccctgacgcctagcgaagagcttgccaccttcaccgaactcgacacccgcgagcgcgaggagcgcacggacttgctcaagctggagcccgcgcgcgccgcggtgctcgtcgtcgaggatgatccgtcccaccgcgaaatcctcgtggagatgctggcgggctggggctacgagcccctgcccgtgggcagcgccgaggaggctgaattcgccgtgcgcaacaagcgcatggacgccgccatcgtcgacgtcttcctgcccggtcgcagcggcgccacgctgatgtcgcggctgcgcgagcgcttccctcagtccgtcctcatcggcgtcagcgccctgagcgacgcggccatggcgcgcaagtgcaagggcctgggcgcggacctcttcatcggcaaacccctggatcctcagcggctggccgaggccctccagtccaggcacacgagctggcactgatgccccctctggccaggggcgccggggcgggttccggttgcgccatccgcgtgaacggttgatgctcctggggtgaagaacctcgctcccggcttgctgctggccatgccccagctcggcgatccgaatttctatcgctcggtcgtcttgatgctggagcactcggagtcgggctccatggggctcgtcatcaaccggggggcccccctgacgctcggtgagctggcgcgcgggcagaacctgggcatcgccgccgggcggaaggaacattccgtctacctgggcggcccggtggagccccagcggggcttcgtcctccacgacgacacggagcagcgcgagaagcactcggtgctgcctggcctgttcctgagcgtgacgctggacgcgctaggcccgctcctgaccaaatccca

SEQ ID NO: 155 - DNA, 1039 bp, Myxococcus xanthus
ccctgaaccggggcgtcagtctggctgtgcttgcctcagcccggacggaggacgaccaccacgcggacctgggctgtagcattcagggccccaccgcgcgtcctgtccgccgggcctttttcccactgaagcggcacgtcgccacgctggggcgtgagggagcgctgcacgatgcggaggcgctcttgcgttggctggaagacaccccgcgctatgccgcgctgtgcatgggcaagcagcggcgcatgggccgacgcgtgttgcgtcccgacgtgctgttcccggtggccacgcgacaccggccgcgcgtgctgcaccttcgccaggaggaactgggcctggatgtacccgtgcgtgcgtccgagtggcccgccgtggcggacttcttcgcggcgctcgcgcgcggcgccacgcgcgcggagcttcgggccttcgcggcgctgcccgtgctggcggagttggtggcggacctggggcaggcgggctggctcgtgcgccatgaggcgcccgtggaggtgccttcgcccggtgcgctcttcgtggggcacaacacggtgctggtcgcgggccgcgagggacgcgtgctggtggacccgtacttccggcccgagggtgcggtggacgcgccgggctatccgccgatgcagccccgcgacgtgggacgcgtggacgcggtggtcatcacccattcacatggggaccacttccacctgggctcgttgctgcaattgcctcgcgacacgcgcatcttcgtgccggcggtggcgcgtgagagtctcttctccacggactgtgctctgcgactggcgcagctgggcttcacgcgcgtggagcccttgtgctggggcgagtcccggcaggtgggcgacgtcaccgtgcgcgcgctgccgttctacggcgagcagcccacggatggagaaggcccgtacccggacctcttcaatgagggcaacgcgtggcttgtgcgggcgcccggcttctccgcggcgttcttcgcggactcggggcacgacgtgcgcggagacatggcggcggtgtg

SEQ ID NO: 156 - DNA, 1315 bp, Myxococcus xanthus
tctacagcgtcgcgccgccaggtctcccaacacctcgccgaggtactcctcgggcgtggtgacctccacctccatcaccggctccaactgctgcacgcccgccctgtgcgccgccgcctggagcgccagggagcccgccacggcgaaggcctggggcgtggagtcacgcacgtgcgtgtccccatccaagagccgcacctccacgtccaccagcggcacgccgtcccgcacgcctcgggccatggccccggccacgcccttctcgatggcgggcaccagttccttggggatggtgcccccgcgcgtgtcgtccgtgaagacgagccccgcgccacgcggcgccggccccacgtccagcaccacgtacgcgtactgtccaggcccgcccgactggcggacgtggcggtactcctgccgcacctggcgccggagtgtgtcgcgccaggccacctttggctggcccacgcgggcctccacgccgtgctctgtcctcaagcggtccaccaccacctccaggtgcagctcacccatgccggacagcagcacctggccgatctccgggtccacgcccacacgcagcgacgggtcctccgccgccagccggtgcaggccgtcctccagcttcgtcagctccgcgggcgagcgcgcctccacggcgagctgcaccacgggctccatgacgcccagcgactccagcaccacgggctccgccgggtcgcacaacgtgtcgcccgtgcgcacgcctttcaggcccagcgccgcgcagatgtctcccgcatggacctccgccacttcttcgcggcggttggcgtgcatgaacatcaagcgccccacccgctcacgccgcccggtggcggggttgagcaggacggtgcccgcacgcagcgtgcccgagtagacgcggaggaacacgatgccgcccacggccttgtcgctcatgagcttgaaggccagggcgcaaggcggccccgaatcggatacgggccgggacacacgctcctccttgcccggaacaaagccctccacggcgggcatgtccgacggcgcggggaggtagttgacgatggcgtccagcaacatctgcactcccttcttcttgaaggccgacccgcacagcaccggcaccagcgtccgcgcgagagcgcccgagcgcagcgcgcgctccaggtcctccgcggtgatgtcctccaatcgcccgtccacgaacttctccagcacggtggcgtcttcgtccgcgcacgcctcgatgagccgcagccgctgcgcctccacctccgcgcgcacggcctccggaacggcctggccgtcgacgaag

SEQ ID NO: 157 - DNA, 1143 bp, Myxococcus xanthus
gctctacggcgcgttggccaccaggttgcccacggcctgctccaggcggtcgaagtcccacttccccaggccatcgcccttggactccagttccaccacccggccaggatggctggcgcgcagttcgtccacggtgcggcgcaccacctcgaacacgtcgcacgacgagcgcaccaccggaatgccgccgcccagccgcgagcgcgcgaagtccagcagttggcgaatcatccggtccatgcgctcggcgctggtgaggatgcgctcggtgagcatgccctggcgctcgtccagcccacccttgcgccgcaactgctgcgcggacatggacagcgcgttgagcgggttgcgcaggtcatgccccaacatgccgatgaactgctcgcggaactcctccgcgctgcgcgactccgtgacgtcccgcagggaggacatcaccgccagcacctcgccgccggcccccagcgcgggcgacaggacgtagtcgaagtaccgcgggccccggtccgaacccaagaccatggtgcctcgctgcacctgccccgtgcgaagggccacccgcacctgttcgaggtacggcgtcagcgccccatccgcggcctgcatctcatccagtgtcctgcccggtgcatgcacggcgtggctgccgcgtgacgcatacagagactgattggccgacaggactcgcccggcctcgtcgtagagcgcgatggggtccgccgcgcaggagatggccaactccaggagctggcgctggtgcaccacctcgcgggacagcgccttcacctcgcgctcggcctggcgcagccggagcagcgcgtggacctgggccaccagttcctccgggtccaccggcgccaccaggtagccgtccgcgccgtgctccaggccctgcgcccgatcgcccggtcccacggcctgtgcggacaggtggagcaccaggacaccctgcgtgcgaggcgtctccttcaacctccggcacacctccaggccgctggtgtccggcagccgcacgtccaggatgacgaggtccgtgtcctcggtcaccagggcaagcgcctccatcccggaggcggcgtccacgacgcggaagcccgcgagccccagcacgcgggaggtgacatagcgggctggccgcgtcgt

SEQ ID NO: 158 - DNA, 1144 bp, Myxococcus xanthus
gcggctccggcaccccggacgcctgggccacgcccatcagcgcctccaactggaagaagtggttcaggccgctggtgatgaagatggccgaaaagagcagccggccaatcggcgctagcacgcccatgaatcctccctgtcgtccctcctcccagcccctcaacgctggcaggacgtcgtcattctcaaagtgagcatcgattcctgcgtgacaccggccgctcgcctggccgctcgccctgcgccgccagcccttccaggccatggcccgctgcgacaacacgccacacgcgggcctccaggccaccacgtatggtgcccgggccgtgaagaacgccctcaccgtcaccctcctgttgtccagcgccctgctactcgtccccacctcgagcgcctgggcctgcgccacctgtgcctgtggcgaccccacgctcatgtccatgggcaccgagcagccgttctccggccgcctgcgcgtgtcctccaccgtccggggctggggccacacggtcggcgaggaaggggtggacgccctgcgcctgcgcgaggcgcgcatggacctggcggtggcctacgcgccgctcccctggctgttcctctccgccaccctgcccctgcaggcccgcgaggtgcggcacgtcagcctcgcccgggaccgcggctggggcattggcgacgtggaggtcgccgcgaaggtgttcctcttccaggacaaggccttctccgcggaccacctgttcagcgcgttgggcggcgtgaagctccccaccgcgcccgtgctgcgcggtccggacggcgcccaactggccctggacagtcagctcggcagcggctccgtggatccactggccggcctcgcctatcagcacttccgcggcagctggtccttcctggccagcgccaccagcttcttccccacgcgcggcatccaaggcttccgcgcgggtgcctccctccgcaccacgctcgccgcgcaataccagccatcggcccgctgggccctgcgcctgggcttcgacaaccgcctggaagcgccggccgactcgaaaggcgagcaccagggccacacggacagcgagcgccatgagcacacaggcggattcatcggctacgcgtctcccgatgtgatcttcagcccggcatg

SEQ ID NO: 159 - DNA, 1176 bp, Myxococcus xanthus
cctcgggcccggggggccagcaccgcaacaccaccgccagcggcgtgcgcctcacgcatgcccccaccgagttgtccgtcagcgccaccgagcgccgcagccaggtgcagaacaagggcgtggcgctggagcgtctgcgcgagggactcaaggtcctcaccttcgtgcccaaggtgcggcgggccaccaagcccaccgccggctccaagcggcggcgcctggaaggcaagaagcgcacctccgaaaaaaaggccctgagaaacagcaaatccggctggtgacccagggtccatcaggactccagtcaccctgtcgccggacagtcagggtgcgcctaaagtttgcgagctcgcagacgttgcgaggtcatctgctgctcgcagggacctcctcctgggaatttgccatggagtgtcggggacttggcccgccaggcagggaggcacgaggtgtgcaaagacacccgcgtgtctccattgccccagcccccaggggtcattgtgcccgcaggacattcccccatgcccttgctcacagtttttccgacgccttcccagaagtaccgttcccgcgcgccccgctggaagctgtgggcgcccctggcactgacgctggccgcctccgccgcgtgggcccaggacgccgccaccgccgccgcgcctgagccggactacgccgtcgaggcgaagaacgcgcagccgtccggcctggtggtgcaggtggagccccttcatcagacgcagttcatcgtggagaacgccgagcgcgtgagggtccagtcctccgcggtggtcgaggcgtcgctcggtgagccgaatcaaatcatggtccaggggctgagcctgggcgtgtccgaggtgctcgtgtggcgccagggcagcaggcagcccctgagcgtgcgcgtggaggtcgccaagtgagccggcgcgacgcacgcggaatgacgctgctggaggtcagcatcgtcctcgccatcatcgcggtgctggccgcgctggcctacgcgggctacgcgcagctcagcgcgcgggcgggtccgcagaacgcggccgccgacctgtccggcgcgctcgccgaggcccgggcccgcgccgtggaccgtcaggccgacgtgtggctcatcatctacccggacatcaatcacgagggtcagggccgcgcgggccatggcgcctg

SEQ ID NO: 160 - DNA, 1588 bp, Myxococcus xanthus
cttcgtgtgctctaagggcgtcccaggccgcccacgcggcgcggttgtcgcccaggtaggcggtgaaggccttctggccccacggcacctgtgagggggcgacgatgggggagaaggcggacacgctgcggtagcggcccgggtggcgcagggcggtgacgagcgcgccatgaccgcccatcgaatggccgaagatgcctcgcgcgtccgtggccgggaagtgctgctccaccagcgcggggagttcccgggccacgtagtcctgcatgcggaaatgcggcgcccagggagcctgcgtggcgtcgaggtagaagcccgccccctgccccaaatcataggcagcgtcattggcaaccgcgtcgccacgaggactggtgtccggcgcgacgacgatgaatccgtggcgcgccgcgtgctcctgcgcgcccgccttggtgatgaagttctgctcggtgcaggtcaggccggagagccagtacagcactgggcagcgctcgccgcgcagcgcggcctccggcaggtagatgccgaaccgcgtctcgccgcccagcgcggaggaagtgtgcttccacacctcctgccggccgccaaaactcgcgtggtgttcgatgcgttccatgttctcagtcctcccggaaggtgcccttcgacttggcgctgtgcgtggccgatacgcgcatgccctgcgcctcggggaaggggttggcggttgactcagtagcggacgacggtgcggatggacttgccctcgtgcatgaggtcgaaggcctcgttgatgtcggtcagcgaacgcgtgtgggtcacgaacggcgcgagctgaatcttcccggccatcgcgtcctccaccatgccggggagctccgagcggcccttcacgccaccaaaggcggtgcccttccaggtccggcccgtgacgagttggaacggacgggtggagatctcctgtcccgcgccggccacgccgatgatgatggactggccccagccgcggtgcgagcactcgatcgcagcgcgcatcacgcccacgttgccgatgcactcgaaggagtggtccacgccccagcccgtcatctcgacgatgacctgctggatgggacggtcatggtccttggggttgacgaagtcggtggcgccgaaggccttcgccagctcgaacttggcggggttcgtatcgatggcgatgatgcgacccgccttcgccatctgggcgccctggatgaccgccaggccgatgccgcccaggccgaacaccgccaccgaatccccttcctgcacgcgggccgtgttcttcaccgcgcccaggcccgtcgtcacgccgcagcccagcaggcagacctgctcggggttggcgttcgggttgatgcgagccagcgacacctccgccaccacggtgtactcgctgaaggtggagcaccccatgtagtggtagacgggcttgccgttgtacgagaagcgcgtggtgccgtctggcatcacacccttgccctgggtgggacgcaccgccacgcacaggttggtcttgccggacttacagaacagacactggccgcactccgcggtgtagagcggaatgacgtggtcgccgggc

SEQ ID NO: 161 - DNA, 1194 bp, Myxococcus xanthus
ccagtgtgctctaaagaatcgtggacgcccgacctaccgggcttcgtattcctgcaaaatacgcaggacggtgctcgcgagcggatggtccgacggggccagctccaggaagcggtggtagttgcgagccccctcctcgattcgccccagcttcacctccacggcccccagcagcaggtagcactcggcgttgccgggctcgagccgggcgcactcgcgggcggagttccgcgcgtcggtgtacttgccctcacgctggagggcgcgcccggcggtgagcaccctgtgcgcgggccccaccgtcaccggcgacaccgccagggcgttgcccgccgcgcccagcagcgccgcctgggcctgccgcgtctgtcctcgagcgaccttgccagccgccggaacgaccttgccgctccgcactccggagaccggacgcgccacggcggaacgctcggccgcgacctcggctgcgtcatccggcgtgtcggcgtttcccgacacctcgtcgtcatccgcgttctcgaccatggcctccgaggcccgcgaaggcgcctcctccgcggccgggggcttcgagggcgcggccacgggtgggccgggaggcaatgcgggcggaatgatccgctgcgccacgggtggcccgggcgcgcgcacctcttccttggcggcggccagcacgtcggcgcccacccgcgtcaccgccaccacggcgagcaccgcggccatcaccaggccgacaccggccacccactgggagctgcggctgccttcggcgaacaggcccacccgcgtcgcacgcggcgcgggagcctccttctccgcgtcgtccacctcgacgggcccgctctcctcggtgcggtagtccggctccacgtccagcgctggcacaccgtgttgcgtgggcgctggcagcgggggcgcctcgcgccagatggacatctcctccgcgaaggaggccggcaccggggcattcatcccgagcgcctccaggtccgggcggtacagctcccgcagcaggtacgccacggacatgggcgaaaaacgcggggtggacgagtagaggaacccggccagggcatccccgagcgcatgggcggactcgaaacgggaatccttctggagcgcgagcgcccgctggatgatggagtccagcgccaccgggatgtcggaccgtacctgtcgcggcgagggcagcgg

SEQ ID NO: 162 - DNA, 1610 bp, Myxococcus xanthus
ccccatgaacggcgacttttcgagcactgaggggatgatacgggccatcccggtggcccacagcgtgagcttcatggcgttcgaagccagcttgacacgaccaccctgctgggtgcccgctccttcggcgacgacgagctctttcgatgccacgtaggtcgtgcccatgaactcgagctcgactggtgtcttcttctcgaagcgaacctgcagctcggccccgagccccccttgcggcgagctggtgagcgaaaccagtacgcgcgtgaccgcctttttggcgcgaatgagtggcacccgcgcggacaggtcgagtgccgtcagccctcgactcgccgcgatggcgcgcccccactcgttccacaacttcactgcaagcagttctccggtcgccatcgaacctccgagcacgtgaatcgcaggttgcggcggtgcgcgccgtcagccgcataagaggagagtcgccgatttgacgggggcaattctacctcctgcgcacgcagcgttgcggcgtgttgcgagtcgcaggcgacgacgctcgccgcggagccggccgccatccgtgatgtcgcgaaccgcgtcggcgatgagacggagagcgcgttcaccaaggacttcaatcgtcacttcgcgagacgccaggcgcgtagcggcgccgagtctggcgcacgcgcccgtgaatcactgggacaggaccgaactcaggttcaccagcgaatcacggcgcgtgccgtgcttcacgaagtcctgaatggcgcgggccagtgtcgcggagagcagccccagcaaggggagatgtgcgcctccttcgcaggtggcctgaccctgggcgtcctcggcatccggggtgaagcgctcatcccagcgcaccagcccgaaggtgccatccgcgttcaccgctccgtggacaagcggctttcccgtccgacgcgcgtagtcgatgagcacctgccggctgtgctggttgtccatgcagtccaccagcaggcccgcgcccaccgcagagggcctacgcgttgccccgggtgagccgtacgccgtgggactccgccttcaccccgtgcaggttgaggagttggagcttgagcgcctcggccttgttattcccgacggagggcttcacgtaggcctgggcgagcaggatcttggactcgacccggccgaagacgacgaagaccagactggcctccaggttgcaacacagcaccgacgcggtggagccaatggtgcccaccccacagaagaggattctcatggaggtgtctcaccgggccccgaaggggaccttgggacgcacgtagatgcactcctcaccccgcgcgccccggaacctgttgaccacgaagtgggcgaacgcgtacacgctaagctggctcaagtgaatgccgggcacttcgcccgaacgaaccagctccgtcgcgatgtgtcagatgtccgtgttcggcacgggggcgtgcagcttcaccgggacgttcgcggacatgtcgacgtacgtgatgttcagcctggccatcagggtgtgagccttctaacacgcccggcggatctcgagggtgcgcctcgtgggactcaccccgcgacggatataggggcacgatcctgacgatacc

SEQ ID NO: 163 - DNA, 1403 bp, Myxococcus xanthus
ctgtccgctggacgcgcgggcggggctctttgccaaggaggattttctgtaccacgcgctgtccattggcgcggagaacggcggcgtggacatggccaccctgtccgtcgaccggctggccgcatgggcgccgctgctgcgggacgcggcgcctcggacgctgctgctggtggggcgcagccgggggcaggaggccctggctgcggtgggcgtgccggacctcgcctccctgcgtggcaggcgattgggcgtgtacccgtatggctcgtcgcactacttcgcgctgtggttgctgtcgcgcgtggggctgcgcatcacggacgtgcgctgggtggagctacccaccaccttggatgcgggacgggcgttgcgcgagggccgggcggacgccgtggtggggctgtggggtgacgtggagctggcggctcgggaccggggaggcgcggtgctggcgacgacggcggatgcgccgcacctggtggccacggtgctggtcgccaggggggacttcgccgcccgctacccggatgccgtgcggcgggtgctgcgggggctcctggacgcggggcaaagtgtgttgaaggacccgacggcgggggcccggatgctgggtgaggtggcgccatacctgggcgaccccattgaagccatccgcagcgcgccgccggccacgctggcggacaatcgggccttcttcgggctttccggcgaggcgcctgtcacctatgacgagctcttccagagcgccgcggcgctcttccagaagttgaagcaagggcctccggtgcctcccgcggaggacacgaaggatttgggggccttgaagtacgtgtcggaggctcgcggcccctgacgctggaggacggacgtggcgaagtcgccgaactacatcaaggccgccttcatgatgcccgccaacctggtggggctgggcacggcggctgcctcggcggccatgacgggcgagccgctgcccatgctggtggccctgggcctggaaggcctctacctgggcgtcatgtcgtccatgaagcgcttccagcgggcggtgcgggcgaacacgctcgacgacccggaagcggcgcgcaaggcgctggacgcgctccaggcggacctggcgccctctcagcgcgagcactaccagcagctcgtcgggctgaaggagaagatcctcgccaactaccggaagctgccgggcggcaaggtgctggaggcggacagcgagccccggttggatgcgctgctgacgtccttcctgcggctcatctccacgctgaaccagtaccgcacgtacctgaacagctccgaccgcgagcacctgcagcgcgaggtggcggagctggaggtggacgtggcgggggagacgaacccgcggctgaaggacgtgaagcagagcccttaga

SEQ ID NO: 164 - DNA, 1313 bp, Myxococcus xanthus
tgaacggcggcgtcaacctgtccgccggcctgctcggcttccgccaggagctggtggtgcgcggcaccctgcccgtcgcggatgcgccggagtcgatggaagtgctgctgggcgtgcgcgttcccatgcccgcgggcacggaagtctacgccatgggtggccctggcttcggcagcacgccgggcacgccatcgttccgggtgctcgccggcctcaccttcggcacccccgcctccacgcccaacgcatgtgtggagggtcagccgcatgaccccgcccgctgtccggacttcgacctggacggtgacggcatcaagaacgccgccgaccactgccccaccgtcgagggcctgtcggagctgaatggctgcccggacggggacgacgacggcgacggcctgcccaacctggcggaccgctgcccgaaggaggcggagaacttcaacggcttcgaggaccaggacggctgcccggatgacccggacacggacggggacggcatctccgacgccaaggaccagtgcccggaccaggccgaggacaaggacggcttccaggacgaggacggctgccccgacccggacaacgacaacgacggcgtgctcgacaccgccgaccgctgccccaacgaggccggccccaaggagaaccgcggctgcccggacaaggacaccgacggtgacggcatcgtcgaccggctcgacaactgccccaccgagcctggcccggcgaagaaccacggctgcaaggagaagcagctcgcgcagattggcgagaatcgcatccaactgctcgaggccgtctacttcgagaacaacaaggacatcatcatcgcgcgcagcaacaagctgctcgacacggtggccaacatcctcatcgcccacccggaagtggagaaggtgcgtgtcgagggccacaccgacaaccgcggcaaccctgactacaacctggacctgtcccagcgccgcgccgacgccgtcgttcgctacctggtgagcaagggcgtggcccgggagcgcctggatgccaagggcttcggtcccacccagcccatcgcggacaacaacaccacccagggccgcgcgaagaaccgccgcgtggagttcaagatcgtcggcgacgcatagggcgtgcagacgcagcagggcgaaccctctcccgacacccactgagaaccgaggcagacatccccatgaaaacgcgtgtcctcttcaagacggcggcgctctgtctcgcgctgctctcatccctgaccggctgtgattccggcggtgcccggacagccgtgccccccaccgaacccgtgctcgtga

SEQ ID NO: 165 - DNA, 1584 bp, Myxococcus xanthus
tgctctaaggtgggtggtcagcatttcggccagcgcttcgcccggtgagtattgtccggggtgtgcatatgccgcgccgtcaatgagcgtgtaccagtcgaagcggcgggccgttatcgtgcggcctttagagaagcgcaccggacccacggagaggtgcgcggactccaccgtacaccgtccagcctcgctcgatggcgcctgtcatgggcgtggacgtcacctccacgggaaaggtgcgccgcttcgcttcgctgccacagccgctcaggaccgtggcagaggcggccagggccagcgcgccggtgaggatgtgtctgcgattcataggtggacctccagggagagcgaggccatccgaggcgaccccgcggtgaaatgtcttgccgggacgaggctcgccgcggcggcagggtcgaaacgcgagccgtagacgaactcgccatccctccagcgcgcgtcgagcaggttcgagacctccagcctcagccccagctcgccccggcggatggcgacgtgcgcatccgcgaggaacacggtggcgctgcgctcactgaagggcagcgggcgtggaccgatgaaggtgagccccgtgcccagcgacagcgtgctaccgccgaaccccgtccaggtcagcgggccgtcccaacccacgtcggcgcgcgcgacgaagggcgcgaagtagggcagcagcgtgtccgaggctcgcacgtaggcgtgggcgaacgtggcgctgaccgaggtgacgagtccttgcagtggacgggcctggagcgcggcggagacgcccgagcgcaacgtctggcccgtgtacaccgtcgtgcccacggtgtggtcgaagaagaagtcgttgtccacctgcgagccgaagaggctgagctgcagggcccagtgctcgccgtccttgcgcgagcccagctccgcgcctcggatggagacgaagggggcgcgctcgccctccgagaggctgcgtgcctgcggcgagcggaatccgtcaccgtagctggcgaacaggcgccaggcgtccgcgtcatctcccagcgcgtactccacgcccgccttcgcgcccaggtggacgccgaaggcactgcgcgaatagccctgtccgtcgtagtagcgcggatctcggaaggcgagcgcgtcgaagacctccacacccaacgcgtccgcgcgcccccccaaccggaagctccagcggcccagtggcatgcgggcctcggcccagccccagacgtccgtctgggtgaatgccgcgtcaatctcgtccgagaagaaggtgccgtcggattcgcggtagcgccgctgcgtctgctccacgctgtctcgccgtgcgcccaatcccagctccagcgcgaccgggcgaccgaaggccgtcaccgacctccgatgctcggcgcgggcgcccagcgtggtggcgttgttcgtctgctccaggccgtcaccgcgctcgtcgacacggaagcccgtgaagttgttgcgcagccgcaggtgcgagaggatgccgaagacctgcaggttcgtgcgcccgttgcccgtgcgcggcaggtgcacgccgagcagcaattggtgccgcgacaccgagcc

SEQ ID NO: 166 - DNA, 1258 bp, Myxococcus xanthus
gcccctgcgccgcagtgcgccagcatgccgtccgcggggaggaccttagcgccatgccaatctccttactcttcgccgtgtcgatacggccgccggtgaagatgagctacttggcgcgggcgcggcccaccacgcgggtgaggcgctgggtgccgccgaagccggggatgacgcccaggccgacttccggcaggccgagcttggccttctcggaggcgtagatgaagtcacaggccagggccagctcggagccgccgccgagcgcgaagccattcacggccgcgatggtcggaatgggcagcgcctccagcgcggccatgacccggtgccccagggcgccgaactcctgggcctgcgcgtcggtgagcgcggccatctccgcgatgtccgcgcccgcgacgaaggccttctcgccgccgccggtgacgatgaggacgcgcacgtccgcgggaagggacttcagcgcggactcaagctcctgcagcgtcttcgtgttgagggcgttgagcgccttggggcggtcgatgaagagggtcgcgatggcgccctcctgctccagccggatgttctcgtaggccatgttcgaggctcctggggtggaagtgggtaaccgcgaggctcagtacttgtagaagccgcggccgttcttcttgccgtaccagccggcctccacgtactgccgcagcagggggcttgggcggtacttggggtcgcccaggcccttgtggagcacctcggcgatgtagagcacggtgtccaggccgatgaagtccgccaactgcagcgggcccatgggctggttggtgcccagtttcatcgcggtgtcgatgtcctcgacggagcccaggccctccatgacggcgaagcaggcctcgttgagcatggggatgaggatgcggttgacgatgaagcccgggtagtccttggagaccaccgtcgtcttgcccatcttctccgcgaggacccgcgtggtggcgtacgtctcatcggacgtggcggcgccgcggatgatctccacgagctgcatcaccggcaccgggttcatgaagtgcatgccgatgacggactcggggcgcttggtatacgcggcgatccgggtgatggggatggacgacgtgttggtggcgagcacgccgcccgggcgcacgatttcgtccaggtccaggaagatgccgcgcttgaggccctcgctctccgtcacggcctcgacggcgaagtccacgtccttggcgtcggtgaccttcgtcacggtgaggag

SEQ ID NO: 167 - DNA, 1354 bp, Myxococcus xanthus
gcctcacgtcgaaggaatagagggttcgatgcatccagagcttgtccgccgcttccacgagccgattcgcgatgaggctgcgcgccggtatggcctgtcgcccgagcagctcaccgagctcacggccttcgagaacttcgtctacgaggcggagaacgacgacggcgaaggccttatcttgcgcatctcgcacagtacgcggcgaacgatcgactacacgctgggtgaggtcgagttcgttcgctatctggccgccgcgcgcattccaatcgcctcgccgatcctctccgagtcggggcagttcgtggagcggatcgaagaccgcgagcccggcagctacttcgtcgccaccgcgttcgagcgcgcgccgggcatcgtcttcgacgacgcgcctccgctcaaggagcgctactggaagccccccctgttccgcgagctgggccggctgttcgcgcggctccacaaccgcgcccagacctacgcgccttcgagccccaggctcaagcgccaggaatggcatgagtacgacgtggtcgacatcgaccggttcgcgcctcccgaggagaagctcgttcgcgagcgcaccgcggcgatcatcgcgcgattgaaccagctaccgcgaacaccggagagctacgggctgatccacgccgatctccacatgcacaacttctgcttcgccgaagggaagatcaccgcgttcgacttcgacaactgcgagtacgcgtggttcgtcaaggacatcgcggtactcctcttctacatcgcgcgaggcgaggctcgagaggcgcgcgacgaagcggccgcttcgttcctggggccgttcctcgaagggtatcgggagctccgacggatggatcgcgagtggctcgcggccgtgccggacctgctcgcgctccagcgctcgatgaattacgcgctgttccaccagtatcgcgacccggccgtgctcgacgagagcacgctcgaccggtgggggcggttccggcgcgacatcgaagcggacacacccgtcctgcagattgatttcaacgtgtaacgagcacctctccagcctgctgtggaagaaggacctggctgtgactaccggatattcgaggccggcgagaagcgtgcgtcggcgaacgcgtcattgcatgcacagtcctacggatgggtccgaagaatactgggtttgaccgggcgaaagagggtgagtgtgcgcggttccctctgtgatgccatgcagtccgttacggggggcggcagaattctggcgtgctggctacggccggcaagcatggcaggatgagggccttcgtaaaggcgctggctcagacgttgcgctcggccttgcggaagccgttcgggaact

SEQ ID NO: 168 - DNA, 1210 bp, Myxococcus xanthus
aaagggcgggcgcgtggtggccctgggcgagacgggcctgcacacgggcggcgaggaggaagaagaagccttcctggagcagctcgcgctggcccgcagcctcaagctgcgcgtggtggtgcacacccccaccacggacaaggagcgccacacgcggcgcatcctcacgctcctgcggcagtcgggactgctgccctcgcgcgcgctggtggaccacgccaacgcccggacggtgcgcaccatcctggaggtgggccactgggccgggctgacgctgcaccccgaggcgctcaaggccgagcgcgcggtggtgctggtgcggcggttgggcagtgagcggctgatgctcaactccgacgcgggcgacggcgccggggacatcctcggcctggcgcgcgccgccaacctgctgaccaaggccaacctgtccgcgcgcatcgtccgccgcgtcacccacgagaacgccgctcgcttcttccaggtgggcgactgacactcgcgcggcgccgtaccgccaccgtggccggcgcccgttgacccgggtccgccatcctccgtggcggaatcttgcgatgaaacggcgcgctcttcgtcattcccatcaggagcacgcagcggaaataggccggtcccccgcacgttgccccctcacccgcgctgggagtggcatttgcaccgcttggtcgtcttcgtcgtcagcctcgcgctcgcaggctgcgctggctcgtcatccgcccagcgccctgcgtcatccaccgaacatccggtgccgtccacgccgagccccctggagcctgacgcaggacgccaactgaccgccacacccgggcggttcctggcgacctgcctgtgcgacgtgcaacgggcctcggcgcgcatcaacgccctgctgtcactgcccgagccccggaacgtggaggtggccctcaccgcctacgacgacgccatcgcactgctggacgacgccaacggccgcgcgggcatcggtgccaacacccacccggacgccgcgttccgcgcggcggcggcgcgctgcgcccaggcagcggatggcatgcgcacggacgtgtcgctcaacccccacgtctacgcggctctggccgcgctggacctgagcgggcaggacaccgccacccagcgatgggtggacctggtgctgcgaaacttccggcgcgcgggggtgaactggcacgaggccacctttatagca

SEQ ID NO: 169 - DNA, 1049 bp, Myxococcus xanthus
ctcgtcccacttgcgggcgttggggatgagctccttggccgcgaactcgcgggtcatccgctggatttcactctggatgtcggtcaactcgaagttcatggaacctccataatatgaggggcttccctctggaacagcgaagacgcggcgcgtgcgcggaagcgcgccgtggcgtgccggtgagacaccgtccggtcgcctgagacccgggattccccgggagtaccccagaacatattgaggggcaccgtgacgtcgaggctgacgtccagccggttcccctcccccgtccatgcccgccgcacgaccacggacagggtccacggtaccgtgtccgggtgccgctcgatgaagtcataggacaaccccagcccggccacgccccccgaaccgtcccgcccccacagccccgcgccttcggccaacactccgaagcgcgctgcgtcaggaaacgcatacacccgtgcccccgcgagcatccggaaggccgtccgtcccagccggagctgaggctccaggaacggcgacaccaccaacgtgggccctggcacgtccagcggcggcagggcccacgggtggatgggccaggacagcacccaaccctcctgggcacccggcccccactcgtagcggacgtcgggcacgagcggctccaggaagcagcccgtgtagaggcacagcgagcgcttccaggacaccagtacgggggcccgcccgtcgtcgtcctcaccttcgtccgaagcctgggccggcacggcggccaggagacacgccagcagtcccccggccgcgagccccttcaccgcgctacttcccggtgaaggtcgcggggcgcttctccaggaaggccttcatgccttcgcgctggtcctcggagccgaacaggtcgccgaaggccttgcgctcgatgtcgttcgccgcgcgcaggtcctggtcggcgccggcctcgatgacctgcttggccttggagatggccagcgggctgttcttgacgatcttctccgccacggcgcggcagtgcgcgagcaggccgtgcgcggggaggacct

SEQ ID NO: 170 - DNA, 1274 bp, Myxococcus xanthus
tgctctacggcgcccgccccggccagcccgcggccgccgggcgcaatgtgccccccgccgcggcacaggccacgcctcaagccggccagggccaggaaggcgccaccggcggtccggtgacgctgtcgcagatcatcccagacgagcgcaccaacaagctcatcatcgtcgccagccccgcggccttcgagcgcatccaggacatcgtcgggcagattgacatccccaccagcggcggcggacgcatcaacgtctactacctggagaacgccaacgcggaggagctggccagcacgctccagtcgctggcccagggcaccggcaacgcgccccgtggccgcaccccggtgccggcccgtccgcccggcgcccctggcggccccaccacgacgcaggcggcggagctgttcagcggcgaggtgaagatttcggccgacaagggcagcaactcgctggtcatcgtcgccagctcggcggactacaagaacatcgtccaggtcatccagcagctcgacaagccgcgccgccaggtgttcgtggaggccgtcatcatggaggtcaacctggaccgcaacgcgcggctcggcatgaacctccacagcggcttcagcctgagcacgtcgaacggcgatcaggtgcccggcctcatcggcaccaacacctccggccagggcctgccgccgtccctgtcgctcaccagcctggcgtcctacggcggcttcctcgccggcatccagggccccgtcatccccgcgctggagaagctgggcatcccggcctttggcgtggtgctgcacgccatgcagcagagctcggatgtgaacgtgctctccacgccgcacatcctcaccagcgacaacgaggaggcggaaatcacggtgggacagaatgtgcccttccagtccggcttcaacccgacctcgctgggctcgctcggggccggcgtgggcggcggcgcgggagcactgggcggcggcctgctcggcggcctgggtggcctgggttcgctctacgcccccatcacccgtcagaacgtggagttgaagctgacggtgaagccgcagatcaacgagagcgactacatccgcctggtcatcaaccaacagacggaggagatcgcctccaccgacccggtgctcggccccaccacgtcccgccgcagcgcgaagacgacggtcatcgcgcgggaccaggagacgctggtgattggcggcatcatgcaggaccgcacgctggagagcgtgtccaaggtgccgctgctgggtgacatcccc

SEQ ID NO: 171 - DNA, 1356 bp, Myxococcus xanthus
aaactgagccccctctcgccgcgcctccaggaagttcatggacggggagccgaggaaccccgcgacgaactggttggcggggcggttgtagagctccagcggcgggcccacctgctggaggagcccgccattgaagacggccacgcgggtggccagcgtcatggcctccacctggtcgtgggtgacgtagatcatcgtcgcgcccagccggcggtgcagccgcgccagctcgccgcgcatctggacccggagcgcggtgtccaggttggagaggggctcgtcgaagaggaagaccttggggcggcggacgatggctcgccccatggccacgcgctggcgttggccgccggacagggccttgggcttgcgctccaggagctggttcagctccaacattccggccacctcctgcacgcgcgacgcaatctccgcggcggggaacttccggagcgtcaggccgaaggccagattctcccgcaccgtcatgtgcgggtagagcgcataggattggaacaccatcgccacgtcgcggtcacgaggcggaacgtcgttcacccgggcgccgccaatgcgcacctcgcccgcgtccacctgttccaggcctgcgatgagtcgcagcaaggtcgtcttcccgcagccagacgggccgaccatcaccaggaattcaccttcacccacctgaaggtccacgcccttcacgatgaggttctggccaaacgacttcttgatcccgctcagggtgacttcggacaagtcgtgctcggagaaattgatgggaagacggtcgcgcaccttacccggacgcttcttgtttcctcaaacctccttggttgcttgcgctgcatcctcccgtcgcgtgcgccagtgaacgaaggtctgttcccgattggaaacccgggccctgccttgtcaggcatggaaggcgcttgttatggaaacggagtttgattgccgggccgagtcatgtccggacctcgaggtcagcctacctgatgcgcactcacagaatgtcccgcctcgtgggcgcggcgctgtccaccgccctgttcatcactggctgtagcgagagcgactacgtccggctgtaccacagtgctgctcgggccccgagctactcggtggacgacatcgagtcccttcgccagatcggccccacctacgtggacaagggcgtgaacttcgccctgtactcggagaacgccacccggctggagctgctgctcttcgaggacccggagagcaaccgcccggcacgcgcctatgagatgacacgctatggcgacgtgtggagcgtctacgtggaaggcgtaggcgtgggacagcactacggcttccgcgcatgggggcccaactggg

SEQ ID NO: 172 - DNA, 1577 bp, Myxococcus xanthus
acagcgcgttggcggcggccttcttctcgcagtgggcatggtccaccagcacctcgtcgaaccgctcgagcgccaggggcagccagcgcgggtcggtggcggcgtgaagaatgacggggccctctccagagaggggacggcgggaaggcgtgggacggctcatgcgggcgcggactttacgcggccggccgctactccaccaggacgagccgccacgtccgtccggccaggtagccgaccttgcgggcgatgcgggcggtgctctcgtcccgctcgtcgatgcgcagggtcagccgcggcagcgaggacagcaggtggcgggaaatctggcccaggcacagcagggcgtggcccttcttgcgctcggcgggcagcgtgtagaggccctccagttccgcgccgtactgggagcggctgccgatatccaccttgaacaccagcgcgccattctcctccaacacgtaggtgcggcgctggcgcacgcgctggatgacgcgggcctcgtagccgcgcgggtcctcggccaatgggtctcgctcgtgcacctcgcgcacgtagccctgggccaatggcagcagccggggcaggtcctcttccttcgccaggcgcaagagcgggttggtgaaggggcccaggtcatccgccgacacgctgaacagccgctgcgtgcgcgacaggcgtggcttgcctggggccaggctgcgcagcagcgcgtccaccgacgatttgtcgcccacggtggagcgcagcgtcaggcgcgaggacagcgcgtccgcgatgacgctggtggcgcccgcatcgctcgcgctgggcaccaccagcccgccgtcgccacccacgaacacggcggcggtgaggacctggctgtcgaagcgaccgtagaaggcaaagggcaccctgccgcggggggcgatgccgaactcctccagcaaccccagcaggtagaggttgtggaccgggtccttcgacaggagcccccgaagggcttccgcgtcatggggaccaagctgttcgacggtaacgggcatgaagggtcgggggctccggcaccttacgcaaaaccgggccctaccggccagtctccccagggacacggaactcgaaggggtagacgaccgtcgcctttcctccgctaaagggcgccgggaagcggacgtccagtagcgagtccagcgcgcatgcctgcacgaaggggtcggggatggtgctagacaccagctcgaccgcgcccatcaccccgcctttcctgcccgcttacacggtgaagcgcagcttcactgtctgcggacccccgttgcgttgtgccacgccctcgaaacattgctgcacgagcggagtcaccgattgcatggcggcgcggatgacgtccgcgtggatgcggccggtggtggattcgaccaccggctctgcctgcaccacgcgccgagggtgccccgaggccgccggcggtgcgggcacatcggtccgtgaggaccgaaaagccggcggaggctgcacccgtggcggtgtggcgctgggcggagacacgccaggcgtgggggccatgcctgtgccccgcggatgcggagcgcgcagct

SEQ ID NO: 173 - DNA, 1577 bp, Myxococcus xanthus
gtgctctaaggcgagacgtctccggcaggcccgcatgggtcaaggcagaccgggatcgcgtggaccggctgccggccttcctccggttcgacgtgcggctgtccaagtcgtgggtctacgacaccttcagcctggaggcgtatctggacatgctcaacgtcacgctccgtcgggagacgttgggcttcgagtacgagggcggcaacggcttcccgctgcgcaaggacgcggtggggtttcccatcgccctccccatcctgggcgtgaagggccgttactgagcacgcggactgatggatagcgcacgcttggcgccgcgcctccgccttcatctgggcacgatggcgcgccacgcggtgtaatcccgcgccgccagttgttccgggggccagtccgctcctgggggcccggagacgtcgggccgagttcctgaccaccgcacaccaggtgacttcttcatgtcgcaggacgggattccgacgatggtgccgttgcagggcggtggcatccctttcagccggggggccaccgtggccagccgggtggcgctgacgtccccgcggatttcggatgaagccccccatcgccaggcgaaggccgtttcggacacccccgccgtgctgctggtggatgaccatgtgtcgaacctggtgtcgctggaggccatcctcgagccgctgggcatccgcatggacaaggcctgttcgggggagcaggccctgcgcttcctgctgcgcgaggactacgccgtcatcctgctggacgtgcggatggtggggctgagcggcttcgagacggcggcgctcatcaagcagcgtgagcgcacgcgcaacgtccccatcatcttcctcaccgcctacggccgcgatgacgcggagctcgttaccggctacgccaccggcgcggtggacttcctccagaagccctttccgccggaggtgctgcgctcgaaggtgtccgtcttcgtggagctgttccgcgcgcagcagcaggtgcggcgccagtcggagctgctgcggcagaaggaagccgaggcgcgggatgccgcgctgagggccgcgggctacatcgaccggttgcgggatttcaccgcccggctgtcggaggcggccaccgtgccgcaggtgtgccgcgcgctcttcgaacaagggctggtggccgctggcgcgaaggcgggcaccgtcaacctcctggacgcggagggcgaggcgctggaggtggtggatgccattggctacccggagagcgtgctgagccggtggcggcgcatcccgatgacggcggccatgccgctggtggagtcgctgcgggagcagcaggccatctgggtggggtcgccggaggagtggagcgcgcgttatccgctcatggatacgcgaggacttcacgaggcggcgctcgcgctgcccttgctggtgaagggacgggcgctgggcgccattggcctgtccttcgcgcggacccggaccttcacggagatggaccgggccttcttcaccgcgctggcgcatgcgtgtgcccaggcgttggaccgggtgcacctgactgcagaggagcgccgggcccattccgtggcc

SEQ ID NO: 174 - DNA, 1079 bp, Myxococcus xanthus
gaggggtgccggccgcctccgcagcggcgcattccagtccgactcattccacgccatctcagcctcctctcgcccagtcgcgtggctggcgcaacacctccaccagccgtgcctccggcgtgccgggctcggggtggtagtcgtagcgccagcggacctgcggcggcagggacatgaggatggactcggtgcgcccgcgcgtctccaggccgaagacggtgccccggtcatagacgaggttgaactccacgtagcgcccgcgccgcacctcctgccagaagcgctgcccctccgtcgccggcgtgtccttgcgccgctcggcgatgggcaggtacgcgtccaggaaggcccggccgcagtcctggacgaaggcgaactccttctccagctccccgcccatgttctcgaagaagatgccgcctaccccgcgcgtctcctcgcggtggcgcaggtagaagtacttgtcacaggcgctcttgaagcgcgggtagtagcccgcgtcgtgcttgtcacaggcggcctggtgcacgcggtggaagtgcgccgcgtcctcttcatagaggtagtagggcgtcaggtccgcgccgccgccgaaccacgccttcccgccctgctggatgaagcggtagttggcgtgcacggtgggcacatgcgggttgcgcgggtgcagcaccagggagatgccgcccgcccagaagtggcggccctcgccctggagcttctgcgcgaactgctcctccagttcgccgtacaccacggacgtattgacgccggccttctccagcacggcgccgtcctccagcacccggctgcgtccaccgccgccgcccggccgggtccaggagtcctcgcggaaacgcgtcgagccgtccagccgctccaggccgccgcagatgtcgtcctgcagcgaccggatgaagcccgtcatccgctccttgaggctctcaacgtccaccgtcttcattcgctctcccgagggctcggcgcgtggggcgcccgcgtcaggcctacaccaacttcccggccccggggagaactcccgcgccctactgctgcatcgagtattcgtccggggcctc

SEQ ID NO: 175 - DNA, 1289 bp, Myxococcus xanthus
gctacttgggcgtggtgcccggcaccaactacaagacgaaccccaacgcgatggagtccatcgccaaggacaccatcttcaccaacgtggcgctgacggcggacggcgatgtgtggtggcagggcaagcacgctgaggtcccccacgagctcaccgactggcagggccgcccctgtaagaagggcagcgcgcagaaggcggcgcaccccaacagccgcttcaccgcgcccatgtccaacaacccggcgctgagccccaaggccaacgatccgacgggcgtgcccatctccgcggtcatcttcggcggccgccgctccaacacagtcccactggtgctccaggccttcaactggacccacggcgtgttcctgggcgccaccatgggcagcgagacgacggccgcggccaccggcaaggtcggcgtcgtgcgccgcgaccccatggccatgctgcccttctgcggctaccacatgggtgactacctccagcactggctggacatgcagaagcacatcgcccagctgccgaagatcttccaggtcaactggttccgccaggacaagaacggcaagttcatgtggccgggcttcggcgagaacatgcgcgtgctggagtggatcgtgaaccgcgtccacggccgcgtccccacccaggagacgctgctgggctgggtgccccgcgccgaccagggcctcaacctcaatggcctggacctggcctccgacgtggtggcggaagtcacgtccatcaaggaggacgaatggaagtccgagctgaagagccaggaggtcttcttcgagcagctcggcaccaaggcgccggacgcgctgatgctccagcgcaagctgctgatggcgcgcctggaccactgagtccccgccggcctgtagcagcctgaaatcccggggccgcctcccgctcgcaccgagcgcgggggcggcctctccatttttcacaggaagtaaaagtcagctcttcgaccttcccggagctccgcgctaggctctcaggtcatgagactggctttcgtgttgtcggtgattctcgcgctagcgccacctgtggcgttcgcacagcgcgggaaaaatgcagcggccctcatcaaggacggcgagcggctgtaccagggaggcaagtaccgcgaggcggcggatgcgctgaagaaggcgcatgaagcccagccccacccgcggctcatctacaacatcgccatctccctggagaacgcgggagagctgcgcgaggcggtgacctggtaccagcagtacgtcggcgccaccgacggcacg

SEQ ID NO: 176 - DNA, 1398 bp, Myxococcus xanthus
cacgtggctgcatacctcccacgcgttccactccgcgatgatggagcccgcgctcgcgccgttcgccgcccggctcgcggacgtcccgctccgtgccccgaaaacgcccttcgtctccaacctcaccggccgttggatttccgccgccgaggccaccgaccccggctactgggtgcgccatctgcgcgagccggtgcgcttcagcgacggcctgaagtgtctgttcgaaaggcacgctccgcatctgctcgaggccggccctggacgaaccctgaccaccctcgcgctccgccacccggaccgcccggccggaagcgtcgcggtctgctcattgcggccccccaaggaggaaggctccgacacgacgttcgtccagcaggccttgggacgactctgggtcgcgggcgtggaggtgaactgggacggctttcacgccggaggccgccgccaccgcgtgcccctgcccgcctatcccttcgagcgtcagcattacctgctgggcgtccaggccgctgcgcggcaagccaccaccgccgaagcggcctccgttgcgcccctggcgagacacgagcgcccgggcatcgccacgcccttcgtggcaccgggcaccgtgctcgaacgccgggtcgcggggatatgggaggagagcctgggcttctcgcccatcgggcggcacgacagcttcttcgaactgggaggccactccctgctcgcgacgcgcatcgtctcgaggctccaggaggagttcggcgtcacgctcccggtggggaagctgttcgagtcacccacggtggccgacatcgcggcccgcatcgaagcgctggagcccacgacgaaccgcgcggacatcccgcggcgcatgcctcgggagggaatgcgggacctgtcgttcgcgcagcagcggctctggaccctggagcagctcacgccgggaaccagcgcctatcacctgccacaggccctgcgcctgcgtggccccctcgatgtctcggccctccaggagagcttccagcagctggtacggcgccatgaggcgctccggacacgattccccgccaccgagggacgcccctttcaggaggtcctcacgagcgccccggtgacggtgcgcacgctcgcgctcgacacactccccgtgagcgaccgtgaagcggcgctggagcaattgttgtccgaggaagcggagcagccgttcgacctcgcccggggcccgctgatgcgcgttgccctcgcgcggctggcgcccgatgagcacgtgctctcggtgacgctacaccacatcatcgcggacggcggctccctgcgggtgctcacccgggagcttgccgccctctacacggcgctgcggcgcggccacgacgcggacctgccggagctgcccatccagtacgccgacta

SEQ ID NO: 177 - DNA, 1157 bp, Myxococcus xanthus
tgtccgccagcatgcgctcgaagaccgcgccgttctccagcaactccagcgcgtgtccgggaatcagccccacccccgtggactggtacagcgcgaaggagaaggcctccggccccggcggcagcgagaagggcccgtgcatctcatgtcgcgcacgctccacgctgcccgagaagcccagcgccccgggcttgggaatcagcgcctccagctcctgcatttcatccatacgggcaagctagggatgcctccctccgcttggaatgccgcgcctgcccgcctgcctcgggcccgacgcgtgcttcccgttgccgcgcggcggcaggctggccacactgcgctcgtcctcaagcctccaggagcgccaaccatggtggatgacacccgaccgacagcccacgagctgctgtcccttccccgactcgctccgctcgtgcccatgctgtacgtggcctggacggacggggagctcacgccggaggagattcgcgccatgggctccgccgcccgcgcgcagccctggctggacctgcgcgccaacaccgtgctggcacgctggctggacccgctggtgccgcccagccccggtgagctggcccaggtgcgcgagcacatccgccgcaccgcggagcgcctgtcccacagcgaacacaacaacctcgccgagctgggcgcgcggctcgcccaggtgggcaacggcgacgagggccttcccgcgcccatgccggagctgacgcgcgcgctggcgcagttggaggagtccctgggcgtctccggcagcgaggccgtccgcgcgctcgtccccgccgcttcccccagccgcgccgaacagggcacgcccacgtccttcgacccggaggcgctgcgtgccgtgctggaccggacctatccggagacgcgcgcccaggtgcgccagtggctggcggacccggcctaccgatacacggacacgcgcgacacggtgaagtaccgggaccaggtgctcgcctggctcaaggccatggccgaccacggactggggcgcatcgccttcccctcgggcaatgagacgagcgcggacctgggcgccttcgtgaccgccttcgagacgctggcctatttcgacctgagcctcgtcatcaaggccggcgtccacttcggcctcttcggcgccagca

SEQ ID NO: 178 - DNA, 1245 bp, Myxococcus xanthus
acaatggccactacctggcccgcaggagggaggttcctcgggagggggaattaggggcattcattatctgacctggcaacgtgcagggaaaatgacggcccgcggcccatggcgcgccgggctcccgctcatcatcccgctgggcgcccaagcgacgcgccagtgaagacagcgcccgcgaaccaccccgcacgcaggccaaggtggcgcgccggtgaaggcggcccccggaagcccgcagcatccccgagcttggcgcccgggcgtccgcctcccctgccgccgggccccctccccctgcccctctttccacccgcccccttcggaagatatggagcgggggagatgaagctcgccgagactgctccgatccctgctcccgaagcgctgcccgctgcccccctgtccctggacgaggtacgccgcatcacccagctcctggaggccatcagcgaggaccgcttcctgttggccggcctccccgaggaggaccgcatcgccttcctgagcgccgcgggccgcgtgctgcacccggaccgcgacaccaagtcccggatggcgaaggcgctgcgccgagacaggaagaagacgaagcgcgagcacgaccgcgccatccgcgccacgacggagattcgcaccctgcgtcgctccgccatcttcacggtgccggcgctgcccccgccgcctccctcggaacccgggccagagcgcatcctcgagcagccccgccgctgctacgtctgcaaggccgagtaccgcaagctgcactacttctacgacgcgatgtgcatcgagtgcgcggactacaactacgccaagcgcacccagcgcgccgacctgaatgggaaggtcgcgctcatcaccggcgcccgggtgaagattggcttccaggcctcgctgatgctgctgcgctccggcgcgcgcgtcatcgccaccacgcgcttccccaacgacgccgcgaagcgctacgtccaggagccggacttcgcggactgggcgcaccggctgcacatccacgggctcgacctgcggcacgcgcccagcgtggagctcttcgcgaagtacatcgagcagacgcacgagcgcctggacatcctcatcaacaacgccgcgcagacggtgcgccggccgccgggcttctacggccacctgctgccgggagagatgcgccgcgcggacgacctgccggcggcggcgcgcgcgctgctcgcgggccatgacgcctgcgtctccacggtgcaaccg

SEQ ID NO: 179 - DNA, 2039 bp, Myxococcus xanthus
tgtgctctccaggagcgattcatgccgacggacgatttcgtccacggcgcgctgcaaggcggccacgtccaacgcacccgagaggcgcagtgccgtcggcatgttgtaggacgcgttccccggctggagctgatccaggaaccagagccgctgttgggcgaaggagagcggcagtgctccgtccccccgggctcgcgtcagggctggaagccggggaccggatgaggcggaggacaggcgctcggcgagcgcggccacggtgggcgccgcgaagaacgtacgcaggttcaggtccacgtcgaaggtggcgcggatgcgcgccaccaactgggtggccagcagggagtggccgcccagttcgaagaaggtgtcgcgccggcccacggtggggacacgcagcagctccttccagacctccgccagttgagcctcgaggggcgtcgcgggcggctcgacatcgcgtttgacggccaggttcgagacgtccgggacgggcagggccttccggtccaccttgccggtaggggtgaggggcagggtgcccatcagcacgaaggcggacggcaccatgtactccggcagccgctcctgggcgtgctgacgcaacagctccgcggtcaccggggcctcgggcgtcaccacgacgacgacgtaggccacgagccgcttgtcgccgggcacgtcctcacggaccagcaccacggcttcctgcacctggtcatgggtccgcagcacggcttcgatttcacccagctcgatgcggaagccgcgcagcttcacctggaagtcgagccgacccaggtactccagcgtgccgtcatgccgccaccgcgccttgtcccccgtgcgatagaggcgggcccccggggttccactgaacgcgtcggggatgaagcgctccgcggtcaactgcggctgtccctggtacccacgggccaggccgtctcccgacaggtagagctcacccgcgatgcccgcaggggccacccgctgccgcgcatccagcacgtaggctcgcgtgccctggatgggccgcccgatgacgggcacgggcgcggtgctgttccggacgctcgccgtggtggcgcagacggtgctctccgtggggccgtaggcgttgaacgccgtggtgcgctccgtgctggccaactgcttccagagcgacggggccatcgcttctcccgcgcacacgattcgcgagggcacatgcgtctgctccagcagtccagcctggagcaagagcgtgagctgcgcgggcgtgcagtccagcacgtccacgcgctgctgccccacccacgccagcatcgcctccggatccttccgcgtctcctcgggcaccaggcagaggcagtgtccgtccgccagatggaccagcggctccaacgccccatcgaagtggaacggggcgttgaggctgatgcgctggcgggtggctcccgttgcctggaacgcctccgtcgttcccgcgtgcatggcgagcaacgagcggtgctgcaccatgacgcccttgggcgtgcccgtggagccagacgtgtagatgacgtacgcgaggttctccccgaggacgttcaccacggcgttccgcgtcgggagtgacgccagcttcgaggcctcggtatccaggcacagcaagttccggacctggggtttccatgcatcggccaggtgctggagggtgagcagcacggacgcgttgcagtccttcaggacgaaggacttgcgctgcgccggtgcagccgggtcgatggggacgaaggccccaccggccttgagcaccgccagcaccgcgacgatggcatcgggcgtgcgctccaggcacaggcccacgcggacctccgggcccacgcccatcgtacgcagctgcgcggcgagctggttcgccttcgcgttgagctgggcgtacgtgaggacctgggactccagcgacacggcgggggcatcgggcgtccgagccgcctgctcctcgacacgcaggtggaaggtggcctcgcgagccatgtccgctgcgtcgtccggctgcggcgcctctctttagagca

SEQ ID NO: 180 - DNA, 1781 bp, Myxococcus xanthus
agggacgaaagtcgggcttagtgatccggtggttccgcatggaaggcccatcgctcaacgaataaaagctaccccgggaataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgtgggcgtaggaaatttgagaggagctgtccttagtacgagaggaccgggatggacacaccgctggtgtaccagttgtcttgccaaaggcatcgctgggtagctatgtgtggacgggataagtgctgaaagcatctaagcatgaagcccccctcaagatgagatttcccatagcgcaagctagtaagatccctgaaagatgatcaggttgataggtcagaggtggaagcgtggcgacatgtgtagctgactgatactaatcgatcgaggacttaaccaaacttttaaaagcgtaagctttactcagcaaactgttacctagttttgagagaacaatctcttgtctggtggcgatagcgaagaggtcacacccgttcccataccgaacacggaagttaagctctttagcgccaatggtagttgggactttgtccctgtgagagtaggacgttgccaggctgttattattccacagtagctcagtggtagagctatcggctgttaaccgatcggtcgtaggttcgagtcctacctgtggagccatttggagagctgtccgagtggccgaaggagcacgattggaaatcgtgtaggcggttaacgctgtctcaagggttcaaatcccttgctctccgccatttttatttaattagcacagtggcccgttggtcaagcggttaagacaccgccctttcacggcggtaacacgggttcgaatcccgtacgggtcaccatttatttttatctacataatagtggaggattagctcagctgggagagcacctgccttacaagcagggggtcggcggttcgatcccgtcatcctccaccatatattatcatcgcggggtggagcagttcggtagctcgtcgggctcataacccgaaggtcgcaggttcaaatcctgtccccgcaaccaagtggtcccgtggtgtagcggttaacatgcctgcctgtcacgcaggagatcgcgggttcgattcccgtcgggaccgccattttgtttggctcggtagctcagttggtagagcaaaggactgaaaatccttgtgtcggcggttcgattccgtcccgagccaccattttaagacggcgattgtggcgaagtggttaacgcaccggattgtggttccggcattcgtgggttcgattcccatcagtcgccccatcttaagtaacgcgggtgtagtttagtggtaaaacctcagccttccaagctgatgtcgtgagttcgattctcatcacccgctccaaataatgggcctatagctcagctggttagagcgcacgcctgataagcgtgaggtcggtggttcgagtccacttaggcccaccatattccacagtagctcagtggtagagctatcggctgttaaccgatcggtcgtaggttcgagtcctacctgtggagccatacggagaagtactcaagtggctgaagaggcgcccctgctaagggtgtaggtcgtgtaagcggcgcgagggttcaaatccctccttctcccgcagtcgttttaaatttaaatat

SEQ ID NO: 181 - DNA, 955 bp, Myxococcus xanthus
gcatgctcaagctggtggggctggagcaacaagcgggcttcttccccctgctgcttgagtggtttatagcaaaacttcattttcatatcacctggctcttgtaattaccccgccatccttctgggagaccaatccacacatgcatcttgatccaggccttatacaagtgccttgggcccagcacaggagccgggcggatatgctgcggacgaggtctcgccacgcttgctcttccttgcgcgggactcaagtctctcccatatcttatcaaaatcggtctttcgactaccaaatcgtcccctaatgaaggatttgaccttttgttttgtggcgtcaatcggcagtccactctccggaccgacccacttgaggtccgaaatgctgtcacagacgcctttgagcgttggccctgagtgatccgcataggtcttcttcttgccgcacaggcactgaaccacgcccagcatggttgaaaaaggactggggagttcgccgccacgcactttcctcgcaaccctctgagccagccgccccgcgttgaccttcgtcgtaggattctcttcgagcgtgctttcggggccatggcgcttcctgcaaagtgggcatctgtcattcccgttgacagcagtgaccgtgccgctcacctgaagcaagcccatcatcgtcgccgcattggctgggctcccgctcggtccgcagttgttgagcatggggtcgccgagcagttggacgtttttaccctcgatcttcgtgtccatggacccgggcccgacgaaactagtcggaccttccacattggaggaaaccactccgccgccggttcctttgctggccacatcccccatggagccaaacgttgcgccccgaatcgcaaccttcttcccttcaattgtgacgcttttcgagtagttcttttgggctcggtccccgctttttgcccgatatttggggtagc

SEQ ID NO: 182 - DNA, 2002 bp, Myxococcus xanthus
cccaccacggtcgcatcccgagggcccggagcaccgggagccacgcggtctgcgacatcacggtgccgaagcgccctgggcttgcgcccatcagcgagacagcacgacctccaaatacgcgagggatgtccgaagccgggcgcgacagccagtcgatggcgttcttgagaacgcctggaatcgagttgttgtattcgggtgtcacaatgatgagcccggccgactcggcgatcttgtctttcagctcccgcacggcctcggggatcccgcgctccgcctccacgtcgccgtcgtagagcgggactccgcggatcgacaccgattcgattctggctcccggcggcgagagctctatcgccgcccggagcaacgccgcgttgtacgagcccttgcgaacgctccccgcgattccgacgatgaccggcgagccgcccatctatgcggtctccgggagcgacgtacacacaggttcaagcgattgcgtccagctcatgttctgtcgcgtcctttcgctgttcgagactcgccgaaccgtctcgttccacgcggcgacggctcgaagggtcattcgctccagtcgtaggagaactggatacccgcggtgcctccggtctgaatgaagaggtccatgaatgcagggaccgtctctttgcgcgaccaatcgcgctgcagctcacagaagagctgcggcacgctgattatcttgccgccggcctgctcgatgcgacgcagaccggcttcgtgcgccgccacagaggtgccgcccaccgcgtcagcgacgacatagatttcgtagccagccttgagcgcatcgagcgctggaaatgtcaggcaagcctccgtccacagtgccgtcaaaatcagcttcttgcgacccgtggcctcgatggcgctgcggaactccacgtcctcccaggagttgatcgtagtgcgatcgtaggtggggaacttctcaagcaccttgcgcagctgcggaatcgggggcttgttgagcccggtcttcacgttgacggtggaatgaacgatgggcaggccgtacacgacagcggccttggccgctccgacaatgttgttgacgagcagctgacggtccatcgacgcgatggagttcacctgaaccggctgatagtcgatgacgacgaacgccgaattcttgggggtcagcagctgatctttcacggggtcacgaattggttcactggccattgtgattctcctttcgtcgcctacttgcgctgcgagtcgagctgctcgccttccttggcgacctgctgcgctttcgcatagctctcgatcaagagccgatatggcgggaatatcttggtgtagatctcagcccacttttcggcgtccgcgcggttccaggtcctctgcagttccgaggcgacaccggcagtatcgatcggtaccacgccggcctggacgacacgcgcgagcgtgatctcctgggccatcttcgagtacgtgcccgacgcatcgaccaccacgaaaactctgtagccctcgtgaaccgcggcgatggccgggagggccatgcacacgctggtaatcgtgccggcgatgatcagcgtcttcttgcccgtggccttgacggccgcaacgaagtccggattgtcccaggcgctgatttcgccctttcgggcaacgtacttggcgtgtggagcgttctgatgaatttcaggaatcaagggtccgttcggcccttgaggtacggacgctgtcgtgatgacaggcagctccgagaggctcgccatcttggccagcgccgccgcgtttgctcgaagcgacggcatcgccatgtcctgcaccgtctgaaacagtccgctctggtggtcgatgagcagcatcaccgcatctttcaggtcgatggtcggcttctgcccgttgaagtttgctgcgctcatgttcacctttcgtcccccttccagcattcccgatgcaggtgaacgcctacgccccgccggtggggcgtaggcgaggagttgtgcgccgggtggtcgtc

SEQ ID NO: 183 - DNA, 1507 bp, Myxococcus xanthus
acgagctctcaagctgacacgcagccctgtccctttttctgtccaccagacgcagggcagccccgccggccgtggtggctgggcaacgcgcttcctacctgtgcgcgcgctcccgtgaatgccctgctgctcgcagccctcctgtcccacgcccccagcttcctgctggcccaggcgggccccggcaccgatgcgggcgtggagccacccgcggcccgcgctcccgccctctcctcggagacacccgagccaccgcggttcccggtgtccgacccactgctgaaacccattcccccggccgacatgcaagtggcgacctgggacgaggcgctgcaactgctgcgtcaacgctccacccgcctgtacaccgcgctcgcccaggtggaggccgcggcgggcgtgcagcgaatcgccctggccgcgttgctgcccacgctcaccggcaccgtctccgtccagtacaacgtgctcaatcccgacgcgacgccgctcctggggggtggcggcggtggcggcggagtgggtggcggaatcggcggcgacgtcggcggcgcccagtcaccgggcctcacccgcccgcctttcctgggactgctgaacgccacccagcccctgttcaacctcccgtccatcatcgcgctgggcaccgcgcgcgaggcccggcgcaccgccaacctgtcgctggcggagacgcggcgccagctcaccagcgcgctggcccagtcactggtgctcgtcgccgcgcaggagcggatggccgaggtcaaccgcgtcaacctccgcaccgcgctggagcggctggccctcacggagcgtcgcttcgagctgggcgcgggcacgcggctggacgtggtgcgcgtgcagcaggacacggagacggcgcgcaacctcgtcgtcctgggtgacgagaccctgcgcaaggcccgtgagacgctggggctcgtgctgggcattcctcgaggcgtgggcctggtccggggcgtccagttggagaccctgctccagcactcgcggcgggactgccagcaactggagtcgctcgaccggcgcgcggacatcgcggtggcgcgctcgcggcgcacgctggccgaacggcaggtgtcagaagtgaaggcgcgttatgccccgacgctcgcgctgaccagcaccaccctggccctcaccgtggaagagggcttcgtgacggtgccagtgtggaacatcggcgccagcctggtgctgcccttctgggatggcggcgcgcgtgagggccaactgcggcagacccgcgcgggcgtggaggtggcgaagcaggggctggtggagctggagcgcacggcctcggtggaggtgcttcaggcaccgcgcgccgtggaggtcgcggacgcggccgcgcgcatcgcgggccggggacgcgccctggccgaggagaacgaccggctcacccggcgcagcttcgaggtgggaacgggaaccagcctggagctcatccagacggcgtcggacctccgccagcggagctgctgct

SEQ ID NO: 184 - DNA, 1276 bp, Myxococcus xanthus
  unsure (1)..(1276): unsure at all n locations
cgtaaggtgacgctgccggagccgccgcgtcccccggttgtccgcaagcaggtggccgccacgggcgccgccaagggggggcctgagggcgcgcccgtcaccatcgtcgagttcaacgacttccagtgcccgttctgcagccgcgccaacccggcgctggcgcaggtgcagcaggagtacggcgacaaggtccgcatcgtgttccgccacttcccgctcgacttccacaaggaggcgccgaaggcctccgaggcctcgctgtgcgcgggcgatcagggcaagttctgggagatgcacgacctgctcttcgccaaccagcaggcgctgggcgtggactccctgaagaagtacgccgccgacctgcagctggacacggcgaagttcaacgcctgcctggactcgggtgagaagggcgccatcgttcagaaggacctggccgagggcaagcaggcgggcgtgtctggcaccccggccttcttcatcaacggcatcctgctgtccggcgcgcagcccttcgaagagttcaagagcatcatcgacgcggagctgaacgcgccgaagaagtagttcccggcagtcggagaggtgggcagtggcgacacgacccaaagccacgccccgcctcgcgagtgatgcggcatcgctcgacctggagcggccgctcgcccaggggttgtccccctcccgtcccctccaggcctggttccacgggccggaggggatggtcctcctccaggagccgcccggcttcgctggcttccttgccggcagcctgcgcaccctgtcggtggaggaagtcttcgcccacgtcctgtccggcatccgcagcggcctgctggcggtgcagcacgccacggggcgccgcacggtgtccttccgggacgggcaggtggtgttcgccacctccacggagcgctgggagcggctgggtgcggcgctgctccgcctgggcttgctgacgcaggcgcagctgacgcaggccctgtcgcgcgtgacgccgtcgcgccgcatcggccaggtgctgacgtcggaagggctcgtctccgaagccaacctgtacagcgccatgacgtacgtggtgcgtgaggtggtgctcancctcttcgaactggaggacggcagcttcgtcttcgtcgaaggccccgcgccgatggcggacgtggtgaagctgcccgagcgcacgcgggacctggtcctcaccggcatcaaacgggcggagctggtgtctcgcctgcgtcggcgcttcccggacgacacgcgcgtcacgctggggtcc

SEQ ID NO: 185 - DNA, 700 bp, Myxococcus xanthus
ccgtctcgcgggagaggtagaaggcggtgaggagcgaaggcaggttgtcgcggatttcaccacggcggctgcccggtgcgcccgcgggcggcgggtccggcggacggcccggcgtgggcggacgcacctgcgtcgccggcaccttctgcatggggctggccgtgaggttggcgccgcgaatctccgccgtgatgttgccgccgcccgtcaccttgatgcggccggtcagctccatggcgtcctgcgggccttcctcctccacgtcgatgtccagctccacctcgaaggcgtcctggagcgacgcggccgctgcagcgggcttctccggaggcagcaccttcgtcatcgcctcgagcagcttctgagcctcgaagggtttctcgaagtagccggcggcctggtacttggtgcgcgcctcgacggcgtgcttgccacccttgaagacgccggtgatgaagaggagcgggagctgggggttgtccttacgcagcgcgtccgcgaggtggtaccccatcatgtcgggcagcaggatgtcgagcacggccgccgccgggggctgggccttggccagctccaccgcctgcttgccgcggctcgcaccaatgacctcgtagcccgcctcctcgaagagctgcgtgaggagggacaacagctcctgattgtcatcgacgacgaggattcggggctttagagcacacag

SEQ ID NO: 186 - DNA, 1834 bp, Myxococcus xanthus
ccaggttgcgcagccgcccggtgccgtagtggctcaccacggccaccagcaccagtgccaccacggcgatggccaccgcgccccaacccacgctcgcctgccgcatgagtgccgcctgggccacggcggacaacagcgcggtcccgtagacgacggtgcctcgcatgcccagcccgctcagggcgacgacgagcgcgaacaggcccaggctgaagcccgccacacctgcgggaaagggcgagacaagcagggtcgtggactgaatccagtacacgagccccacgtccaccagggactgcaccgcgcccaggccccgggccacgcgccgttggcggagcatgaacagcacgccggcgaccgacgcgtagagccccaacgccggtgggtacacaccccagtcccggcctccggccagccacagcgtggtgctgatggccaggaacagggccgcgccgacgagccgcaccgccgcgcccgcgccgacgacgctcctccgctgggcgtccatggcccgggacatcgtctcttcgagcgggccggacacgggaggcggagacgtcacgaggcgtgggttttccctgcttccttcgtggcttgcaagccctgccgcctgtcgtgcggaagcggacggacgggcgggcgtagcgcgggcgggctccattttccgacgtggaaccgtcacgtcacgcttttggaaacgccgcaatcgccttaggtagaagcgcgtaagcactgagaagacattgggactgtgtctgcttgctcgccccggggatcgtgtaaggtggctgcaagtaggtctggacggaggtagaccgccgatatgtggcaacgattcaagagagcaatgcgtagcttcgccgggttcttcgtctcctccatcgaggacccggagttgattctcgagcagaacgtccgtgacctgaacgaccaggtcccgaagatgaacgagtccatcgccatggtccgggcgaacgtgacgctgctggagaaggagaacgccaagtaccaggacgacgtgcgctcgctgacggccaaggtgaaggccgccatccaggcgggccgtgacgacctggccgcgcagtacgcctccaagctccagattgagaaggacgcgctggcccgcaacgagcaacagctggccacggcccgccaggcgtacgagaaggccctgtcggtgaagaaggcgttcatgcgcgagaaggagcgcaagacgcaggaggccatgaacgccatccgcgaggcgcgccgcgccaagtggcaggccaaggtggccgacacgatggagtccttcaccgtggcgggtatcgactcgacccacgatgagatgctgcgcaaggtgcaggagaagtccgccatcaacgaggcccgcatgcagatggccctcgagtcggtggaccacaccgcggcgtccatcgaggaagaggccgagaagatccaggccaacgagctggtgaagcagttcaagatggagatggggctcgtcagcagcccggcgccggtgtccgaggtgggcagcgggccggagaagaccatcggcaagaaggtcggcgtcgagtagtccgtcttgaatgaggctccaccgcggtccaggtctcttcctcttcctgttcctctgtgtgctcggcgcgagctatgcgctcgcgtcgcgcatggggtacctggatcgcttgcaggagcggtacttcccgtccacgcgtgaggcggtccgcctgtcgccgggagacttcccggccggcgtggcggccccggtggcggacgtggcctccgtgcccctgcggccggtgctcatcggcttcagcccgcgcggtgcctccgcgggcctgctggtggc

SEQ ID NO: 187 - DNA, 2075 bp, Myxococcus xanthus
gtgctctaagtgcgaccgcggagaatctgcggcccacaccactccgtcccgctcaggggtgcgctatctagtccctgtttctgatgggaaatcagggcacctcggttgaggcatcgatgtgacggcatgctgcctcgcgattcgtgaggcgctcagtgggcgtggatctcccggtgatgtctccgaacgcagaacctcatcgatgcgacatctggcgttgcgtacccatgtcgagcggctcgccttcggcacacttggcgggcgcgaaacgagctcaccatggttggcgaagtccgaaggagttcctcgcctgccgtcattggatgcgtgtccctgatgcacatccctgcgacggaaacctcgtgcaggtgtgagtcgccatccgcatcgccgttcgtcgcggtgtgcttcggcgcgaccgctgtccgtcccgagtggtgagtccactgagctggaccgacaagtggactgacctcgtcgatgcgatgctgcggtcgttggcggaagtgagggggatgggccccctcccggagtccgcttcgaccatctgaccttgtcagacgcgtcgcgcgcgattccgagcgggtagggcttcgcggtgggattcctcggccaagggggaaccgatgtgcgtggccatgtggaccgctggcggcgaggcgcatgcggacggctgacatcgaggctcatgtgaaaccaccgtcgccatgcgcaggactcgcgcgcccgttccacgcggaacatccggaggcgtgtcatcgtcacccgaaccgatgattcatcgacgcgtgcaggttgcactcggcaatgcctgggccgcttcaacgcgcgtcgcatggggtggcggcatggctccactactcggcatgggcgcttccagtcgggtgcgtgcgttcgctgcactcatctggcttaccgcgcacatcccgggagcgacgctcagcaacggtgccgcatcgcgcgggcgagatagagcagctgaagtgccaaggcctcgccggaaccggctccgcacgggtctgcgaggcgatacatcggctgctccacgcagatgggcagcgccaagccgtcgggatgcggcactaccggaccgaccactgccaatggcaccgcgtcgtgcccgaggatggcccaccaccaatagcgtgtgatgcgctgaagcaatcagcgcgtgccttccgcgcgccaaccggcaaccccgaccgcagcctcacgcgggcatcgtgcgaaacgcacccgctgcccgcgacagcatcaccgcgtgaggacaggaccctcggacgcacgcggcggcccgaaacgcgcggctgcttccacgttcagccaacccaaaagcccggcctctcgcgagaacgcgacgcgcgttcgtagcctccgctcgaagtccaccgccgccgcccccctgaaaactggctcaaaggtccgcgaaccccgcaaacagacttggcatgttttattccgcgagggcttccttcccgcctgctcactcgctgcacggccgcagggttccacgaggaacgcgccgtctccagcctgggggcgccgtggccacggcggggcggaacaggtgcggcccggtgggggccctacggaccggcggctcggccgcatcattatatagggggctgacacgggccctccgtggccccgttcgactggcaccccggcgcaccgcctccttatataaggaggcacacccggccagcctccaggcctcttccgggcacccgccaccggcctccaggtccgcgcaaacccccgagaagagagcagggaagcaaggctcgccgtgaatttgatccgataccaaaccgcgtgctagcagcgtggatcagcgcgcaaccgtgcactgcatcacgcgcggggccctggcctacggccggggagagagaggatgggccaccgtgggtcgtatcatctgcatctccaaccagaagggcggcgtcacgcacatcacgcccgctcgaacggggaagggtctgggtgtgtggctcgtgggcggcgcgtgtgtcttcacgctcgcgtgcattggcttgagtgtctggtggggttcgaccgacatcaaggtggaagcg

SEQ ID NO: 188 - DNA, 861 bp, Myxococcus xanthus
caggcctcgtcgggcgtgtccttcagcaccttgtcgaaggcgcccttcgcgtcgtcgaagcggcacagctcgaacagggcgatgccccgctccaactgcgcgtccaccgagcgcggcatgtgccccagcgccgcgtccaggctcgccagggccgcgcggcactcgcccacctggttcaggcccatgccctccaggaggaggaactcgtagagcagctccacgtcgccggccttctgcgccaggcgcttgcccttcgcgcagaagcccaggccttcctccacggcctcccggtcctcgcccgcgcggcagatgaggcagtccgcggttcccaggagcacctccaggtcgtccggggacaccctcagcgcggcgccgaaggcccggccggcttcctccaggcggcccagctccaccagggcggcggcgcgcaggtgcagggcgtccaccgagtccggggcctgggccaggccgcggtcggcggcggccagggccgcctcgaagtcgcccgtctcaaaggcctctgctgccgcgtccagcgcctccatcccgctcacccccgttcgcttcgacgtccgcatccccatggggccgcgacatatgaagccgcgcacttcgttgtcaacgccgcgcacggctgctacgttccttggcccgtcctggtgcggcgctcagtcccgtgaacatccttgtcgtcgacgacgatctcgaactctgcacgatgctctctcgcttcttggagatgcatgggttcacggtctactcggcgtccgacgcgctccaggcgctcgacgtgctggagcgcaaccaggtcagcatggtcatcaccgactacgtgatgccccataggaccttagagccgcg

SEQ ID NO: 189 - DNA, 1081 bp, Myxococcus xanthus
  unsure (1)..(1081): unsure at all n locations
ccgcggcatcctcccagccttggatgagccgcaccttgtgggtggcggcctggcgcctcgtgcccagtgcgcgcagcatcgctgcccggcgattgggctcggtgagcatgtcgaatcccaggccctgctgcgtgcgcgcgttcagggggttcagcatgatgatggcggtgtagnccgcgcgtgggcccgggggccacacgggatggcctggctcctgcccgccgcggaccttcgcgtcgtaccgggctacgtcctgcggccgaagccaccgcgcgaagccgatgccctccagctccgggaagctgcggttcagcttcaggctctccaggtaggcgtcgaactcctcctggctcacgaagcggctgccggtgaacagtccatgcaccccctggagcagcgactggttcagctccaggcgctgctggaggcccagcaccccgtcatggaccgcgccgtcgaagcggtgcaggcggcgctcgtggatgctctgctgcacataggtcgccgacacggcggtgaggagcagccccaccaggaccacgcagtaggcggcggcgttgcggcgcaggtgggaggaggaatgcggtggcacggtggccaaggaaggctggaatggcgctcgcccgggggccagtgccggacggtgctcttgtaacgtcctggcgggttcgcgcgttcgccaggtgaatgagtgggtgggattccgttcacccaggtaccggagggccttggcatccggtagggcatggcaagcgagggaggcagcgtgcggcacgtcatcgtcgtgggtgcgggaccggggggcttgtcggccgccatcaacctggcggggcagggcttccgcgtcaccgtggtggagaaggacgcggtgcccggggggcggatgaaggggctgacgctgggcgcgtcgggcgagtacgcggtggacaccgggccctccatcctccaactgccgggcgtgctggagcagatattccggcgcgcgggccggcggctggaggactacgtcaagctgctcccgctggatgtcaacacgcgggtgcacttctgggacggcacgcacctggacaccaccccggca

SEQ ID NO: 190 - DNA, 1100 bp, Myxococcus xanthus
catctccatggacgccgccagcgccacgtcgcgccgcgaagccttgccctttgcttcacgcaggcggtggacgatgttctccgtgacgatgatggccgcgtccaccagcaggcccacggcgatggccagtcctcccagcgtcatcgtgttgatgccgatgccggcgaacttcagcagcacacccgccagcgccagggacaagggcagggtgagcgtgacgatgagcgccgcgcgccagtctcccaggagcaggaagagcacgagcaccaccagcaccgcgcccagcagaatggcccggctgacgccgcccagcgcggagtccaccagcaccgactggtcatacacgatgcgaagctgcacaccgggcggcaggccctgtttcagctcctggatggcgacgcggatgcccgccgtcacctgctgtgtgtccgcgccgaactgcttgatgacacggcagctcaccacctcgcccttcagccggtgggcgatgccccggcgtacggcgggggcctcgcggatgtcggccacgtcacccagcagcacgggcgtgctgtcgcgcacggcgaccacggtgtcgcgcaggtcctccacggactccgcgcgccccaccgcgcgcaccgtccactccatggggccctgcaccacgaagccgcccgaggcgttcaggttcgcgccctccagcgcgtgctccacctggttcagggtgatgccgcgcgccaccatctggtccgggtcgagctgcacctggaactggcgcaggtagccacccaggcgctccacaccggcgacaccgggcacggcgagcagccggttcttcacctcgaactcggccaaatcccgcagcgtcatcagctccgccgcgccgggctccgcttccagggtgaactcgaacacctcgttgagccgcccggtgaggctggagaccagcggcgcgtccgtgccgggtgggagctcgctctgcgcctgggccacgcgctcgacgacgtactgccggctgcggaagtagtcggcgtctggctcgaactccaccgtgagctgggtgacgcccaactgcaaggtggagcggatgcggcgcacctcgggcaggcccgcgagtgcca

SEQ ID NO: 191 - DNA, 1265 bp, Myxococcus xanthus
ggggcagacgcgctgatgtcggacgcgggggacggctcgcttccttttccggtcttcaagccggaagagcgcgtgtgtggcaattgcaagctgttcagcccgcagtcggtggatgagcgccggggctgggtgggcgcgtgccggctgcactcgtggcggggcaactttcccccgtccgcgcccatttgcgacaagtacacgcctcggggaagcgcggccccctcagcggttgcacccgcgcgcgagcggaccgcgcgcagcgtggcgccggtggtggtgcggcgtcgcgcggaccccaacgacgtggtggacctggaagggttgagcatgacgcgtgaagagctgatggacatcttccgggaggcgtccggcttgctggacgcgccgcccctggccaacaagtgggagggcggcacgatgcggctggtgcccgccaacaccgagctgcagcccaaggacctgcccatcgacagcctgttccacaaggtcgtcatggtgcgcgacaggcttcgggtgctggagcagaagctcaacgcgcacccgaagctgtcggacgcggagaaggtggagatgcagagctacatcacccgcgtctacggctcgctcaccagcttcaacgtcctcttcaaggagaaggcggaccagttcgtcggctcgaagagcgaggactgagcccgtccctggccctcagggctgctggccgcgctcttccatcagggagagcgtgcgctggcgggcgcggtggagcgtgctcttcaccgtgccttcggggatgcgcagcagccgggcgatttccgggtagctcaggccgcgcacctcgcgcaggtagagcacctggcgctgctgctcgttgatgtcctccatcgcctcaccgaagtggcgctccatctccgcgcccacggcgagggcttcgggggacaggggctcctggacgtcgtggctcagcctgtctcggcgcttgcgcgcccgcagccagttgatgctgctgttcaccatgacccggtgcagccaggtgctccacgccgcgcggccgccgtagccgggggcgcggcgagcgagccgggcgaagacgtcctgcaccacgtcttcagcgtcggcggtatcaccgacgatgcgtcgggcaatggccaacgcgcgagggcggtgctcggtatacaactcggacagcggcggaagcgcgcatgcgtgcatgacgggtgctctcctgacacgccggggtggacgtacaggacatggaacgaatgagctgcctgaagggtctatcg

SEQ ID NO: 192 - DNA, 1351 bp, Myxococcus xanthus
gctctaaagtcgcgcgcgcctgctgcgcggtggcggtggtgatgtcccgcgcccggagacgaatctcctccacgctcttggccaggccctccatcaccgccgtcgcctccgcgctggcgcgtgccaccacggccacgcccgtggcctggcggctggcggaggccgtgagcgcaccgagcgcctccgtctgctcgtccagcgcgcgcgacgtctgccgcgccacgcgccgcacctcgtccgcctcccgcaccagcccgctgagcgccttcgactgctcctccgcggcccgcgtcaccgacgcggccagcttcgccacctggcggctggccgtttcactctgcttgagggcgcgggcctgctccgtcatgccgcgcgcggactgggccacctgcttgcgcgtctcctccatggcccgcgtcacctcctgggcggcggtggcctgctcggccagccccaccagggtgcgctgggtggacgccgccgcctcctgcaccaacgtgcccacccccgccacgtcacggctctgggtggtcaccaccccgctcacgccctggacgagctggcgcatctgggaggtgcccttggccaggtccgccgccgccaccgcctgctcctgcacggcgcgcgacaccttctgtaccgcctccgcgagctgcccgttggagcgcaccacgtcgcgcagcgcgcgcgcctgctcggaggtggcctgcatcgtctgccgcgacatgcgccgcatctccgcgccgccctgcgccagcgcctgggcggcctgtgcctgctcggccgcggatgtggcgatggcccgtccctgttcgctcaccttcgcggtgccctggaccagcgcctgcgtggcctgcacctgctcgctggaggcgcgcgacacctcgcgcacgttgctccccaggtcctccacccccttgaggatggtggacagcgcgcgctcggcatcccctgccagcgccgcgccctcgtccgccgcccgcacgccttcgcccgaagcggtggccgcctcgcgcgccgtcgtctgcagaccccggacgattttcgccacgtccgcgctggccgccgccgcgcggtccgccagcgctcgaatctcctccgccaccaccgcgaagccccggccgtgctcaccggcgcgcgccgcctcgatactggcgttgagggacaagagattcgtgcggtccgcgatgaggttgatggtctgcacgatgtcgccaatctcctcggcacgccgccccatcttcttcatcaccccggccgacccgacaatggattcgcggataccgccaaagccggcgatggagcgcgccaccgtggcgccaccctcccgcgcggtgctccccacgcgctt

SEQ ID NO: 193 - DNA, 1187 bp, Myxococcus xanthus
cctggcggtgcccgcgggcgcgttcacgccgtagccctgtgcggcgtcctcgacgggggcttcgacggtctcgaagtcgaagtcgcgcgccgttcccgcgggttcattcacgccgtagcccgacgccggagcggagggcggctcgcggtaggcgtcgctcggcagtggaatggagacgacgcgcgtcacctcgcgggtgtcccggaccggctcgccaaagtcgtcgccgaacgcgtccatgccggacgggccatctgcctgcggcatggccgcggcggcctccgcgggcgagctcatgtcgaaggcgaacgggtcggcttccggcaacgggatggcggcggcctgttcgggctcgctcatgtcgaagccgaacgggtcggcttcgggagcgcttcccggtagcgggacgctggcggcctgttcgggctcgctcatgtcgaaggcgaacgggtcggcttccggcaacgggatggcggcggcctgtgcgggctcgcccatgtcgaaggcgaacgggtcggcttcgggagcgcttcccggcaacgggatggcggcggcctgtgcgggctcgcccatgtcgaaggcgaacggatcggcctccggggcgcctcccggcaggggaatggcggcgggctgaggcgcggccgcgccgggaaggggaatcgcggcggcgtggggcgcggcgctgaacgcctcaggagcgcccggcagcggaatggctctcgcgggcgcggcgcctggcaacggaatggcggcggcgtgggccggcgcggcacccggcagcgggatggcgcccgtggacgcgggagcgccagggagcggaatcgcggcggagtgggcggtgcggcgcccggcagcgggatggcacccgtggacgcgggggcgccagggagcggaatggctgcgggctgcgcggacacggcgccgggcaacggaatggcggcgggctgcgcggacgcggcgccgggcaacggaatggctgcgggctgcgcggacgcggcaccgggcaacgggatggcggcggcttgcgcggacgcggcaccgggcagcgggatggcggcggcctgaggcgcggcggacgcagcacccggcagaggaatggcgggctcggcgggagcaggcgccgcgggcgcgctcactgcatcgagcttgatggggaaaggggctggcaccgggcgcacttgagcttc

SEQ ID NO: 194 - DNA, 958 bp, Myxococcus xanthus
agcttgtgctcgcgggcgaagaccttgaggtccggcatccgcatcatggtgccgtcgtccttcaccagctcgcagaggatgccggaggcggacaggccatcgaggcgggacaggtccacggtggcctcggtgtggccggcccggcggaggacgccgccctcgcggtagcggagcgggaagatgtgcccggggcgcaggaagtcgtcggccttgctggaggggtccaccagggcgcggatggtcttcgcgcggtccgccgcggatacgcccgtgtgggtgtcgtggcggtagtccacggagacggtgaaggcggtgcgatgggattcggtgttgtccgacaccatctgcgggaggcggagctcgtccagccgctccgccagcatgggcatgcagacgattccgctggtgtggcgcaccatgaaggccaggtgctcgggcgtcaccttctccgcggccatgatgaggtcgccctcgttctcgcggtcctcgtcgtcggcgacgatgacgaatttgccctcctggatgtctcggatggcgtcgtcgatggaggagatctcgctgtcgtgactcatggaggtttcggtccgggcggagggctgcatgagtcgcgcatgtagcgtgggcgagggtggctcgcaagccaaccggtagccgggcgcatgtagggatgatggcggggatgaggtgggcagggggccgttggagggcctacggccggcgggtgggtaggcgccgactcgacgtgacgggcgcagtgatgtagggtgcttggcgccgtgatgacttccaatacccaggaactccgggctcggctcgaccagctccaggccagtctttccacccgcgagagcacgacacgcttcgcccgagcgggggtgtccaccgtcattgccctcctggtgggtggggcgtcgggcaagctcttctacgattctcttcgcacgcccctgctggcgtg

SEQ ID NO: 195 - DNA, 1187 bp, Myxococcus xanthus
gtgctctaaagtttcagctcctgaagaagacggtggaggctcgctccaccaagtacgaccagacggtcgacgtctccatcaacctgggcgtggacccgaagcacgcggaccagatggtccgtggtgccgtggtgctcccgcacggcaccggcgccaccgtgcgcgtggccgtgttcgccaagggtgagaaggccaccgacgcgaccaacgccggcgcggacgtggtcggcgccgaggacctccagaagcgcatcgaggagggcttcctcgatttcgacaccgtcatcgccaccccggacatgatgggtgtcgtcggtcgcctcggtaaggtgctcggtccccgcggcctgatgccgaacccgaaggtcggcacggtgaccatggatgtcgcgaaggccattcgcgacgccaagggcggtaaggtcgacttccgcgccgagaaggccggtatcgtccacgcgaagctgggcaagtcctccttcgaggtcgagaagctcgaggccaacttcaacgcgctggtggacctggtgatgaagctgaagccggccgccgcgaagggcgtgtacctccagggtatcgccatctcgtcctccatggggccgggcatcaagctcgacaccatggagatcaagacgcgccacggctaatcgccgtccggccgcacgggcagggggacgcagccctgactacgggtcagggctgtcacctgtctgacgtcacaggttcgaaagttctggatctttgctgaagccgggggtataggcccccggcttttgcaattggggcgccacgtcgtgaggcgcggcgtcccgacacctggttcatgacagcagggacctgggcgaagaggatgcatgttccgttggcagccgggcaaccggccggacggcaccttcgacccctggttcaaacgaccgcaaggtcagccctgccgagactggaggtgcggtgtggtgcctctcgaggctcctctcgctctgccactttggcccaggcatcacgcccgtcctgaaaaggcgggcccagtaaggaggtgagtcaaagtgctgaagagcgagaaggaagagatgatcaaggagctccacgagaagttctcgaggacgacctccgccgtcgtcgccgaattcaccaaggtggacgtggagacggtgaccaagctccgcaagaagttccgcgaggggcacgtc

SEQ ID NO: 196 - DNA, 1599 bp, Myxococcus xanthus
tctcctctctggggtatcggcctgacggcgggcgtcagcggcggcgaggcctacctgcacgacggccgcgcccgcaacctggccgaggccatcctctggcacggcggcgagggccaggcggcgcgcaacaacttcgccaacatgaacagcacggaccgcaacgcgctgctgacgttcctgcgctcgctgtaatccgctgaaggcaacgcccgggggccgcgcgtcatgggcggcccccggctgcatcaaggactcaggacgcgttcgccgccttcagctgcttgcgccctccctgcatgatgtccacggtgacggactggttccggccgttgcgcttcgagtggtagaggcactggtcggccaggtcgatgagctgatggttctccatggcactgtcggggaacgtggcgatgcccagcgacatggtgatcctcagcggccccatcttcgtctggaacacctccggcttcacgggctcgcggatgcgctcggagatggtgaaggcgcccttggcgtccgtctccggcatgatgatgacgaactcctcgccgccgtagcgggcgacgatgtccgtatcgcgcgccatcgtcttgatgatgcgggccacgcccttgagcacctggtcgcccgtcgggtggccgtaggtgtcgttgacgctcttgaagtggtccacgtccgtgaggatgagcgagaacttgcgctggtagcgccgggactgggccagcacctcgtccgccttcgcctggaaggtgcggtggttgtacaggccggtgaggccgtccgtggtggccatgcgctccatctgctcgtagagctgcgcgcgcagcaccgcctgcgcggcctggatggcgatgacctcaatcatccgcagcacgtcctgctcgaacgcggccttcttgcgcgagccggccaccagcgtgcccaggatgcggtcccccgccaccagcgggaagatcttcagcgcacccaggccgcgaatctgcgtctcgtcgtcgaagatgatctgccggtccatcgccttgatgtcgcggcccggcagcggcgccccgtagcggaccacgttggccaccagcccgttgttgtcctcgaaactctggccggacagcgcctggccctgcgccgtcacgccggacatgcgcaccacgcggtgcatgcgcttgccgtcgacctcggacaccagcgtcaccgcacagaagtccaggcccgcgagctgccgggtgctctccagcaccgccacgaacacctggtccgggctgcccgcgcggttgagctcctcgatggcgcggaagaaccggtccttctcgtcgcgcgtcttgcggatgtagctcatcacccgctccacctcgatggagcgcagcacctcgccggcaatggtggacagcagcttttcgtcctggtcgctgaagggctcgttcgccagccggtccgccaccagcacgccgcgcaccagtccgctggcctccaggatgggcaccgcgagcagcgcctgcaccgcggggccgctgccctcgtagtgcgtcacgcccttgagcccgttcggcgagttcatccgcaccggggcgcggcgcttgagcacaccgccgatgatgccctcacccg

SEQ ID NO: 197 - DNA, 1254 bp, Myxococcus xanthus
ttccctgtgctctaaagctcggtgacgccggcctgaccgacgatgaccaccggctccaggtggtgtcctagcgcgcgcagatggcggcgttgcttcccagtgagcggcacgttccttctctccttcgtgtcttcgggtaaggggggcgcaccctacttcttctgcgacgcgatgcggacttctcgctgcgcgtcgatgtggtccggttgaagctccacggtgcgcttgaagtgcttgagcgcgccgtggccgtcaccactcagcttggcgatgacgcccaggaagtagtgcgcgggggcgcagcgctcgttgcgtctgatggcgttctggatttcccggaaggcttcgggctgggcggccttcttgtccgccgctgtgaagaagcgcgcgtagccacgccacgcgtagaactccgcttcctccgggttcagcttgatggcctcgtccagcatcttcacggcgtccgggaacttgcgcgccttcaccaggatgcaggacttctggaacagctcctccgccatgaggatgccgttgacgtccaccccgtctccgctgccgccgctcttgagctcctcgatgtagctggcgcggctgctgtcgtcggagagggtgcggtaggcgtcgccgatatacgcgaagacctccgccttcagtttctccagctccggcggcgccccctgcgggagcgtgtccgggtggtagagcttggccaggcggaagtacgcgatcttcaccgcgcttgagttcgtctgctccgtcagcccgagtcgctggaagtggttctgctgcttcatcgccatcgtgagctggcgcagcgcggggatctcttcagcccctggtgcattcgcgggcgtcgccgcggcggcgggcgcggctgggcgttgagcgccctgtgcggacagtgacggcgggggacggggctgggcgctaggcccggcgaccgggggacgtgcggcggtggctccggggccggcggctggggccgtgcctaccggacgtggggcggtggcgccggggcctgccgcgggggccgtgcctgccgggcgtggggcggtggcaccgggaccggcgacgggcgggcgtgcggctgtggcaccggggcctgccatgggaggagtcgctccggggcccgcgatgggaggggccgctcccgggccggcggctggggacacgaccaaggggcgcgtggcaccctgacctgccgcgggcgtcgcgcctgtctcggggcgttggggcgcggcgccggtggattgc

SEQ ID NO: 198 - DNA, 1720 bp, Myxococcus xanthus
ctctaccggaggcggctccagggaccgtttgcccgggggggggaggacgtcgccgcgcggcaagggtgtctccagtgccacaccattgacggtacgccgcacatcggtcccacctggttggggttgtacgggcgcgatgagccgctggcctctggaggcagcgtgcgcgtcgacgtggcgtacctcaccgagtcgatgatggacccactggcgaaggtggtcgcgggctacgcgccggtgatgccgtcgttccacggacgcctgagcgcgggcgaagtgggcgcgctcgtcgagttcatcaagtcgcttcagccggaacttccggagccaccatcctcccaggagcccacgtatggccccctcccacgctgagtcccccgtggcggcgcccagctacctggacgcggagcgagggctctggtcctggctcaccacgcgcgaccacaagcgcattggcgtgatgttcctgggcgtgctgctgctgatgttcctgttgggcggcgtgttcgccctggccctgcgcgtggagttgctgacgcccggtgaaacggtgatggggcggctggcctacaaccgcgccttcaccgtgcacggtgtcgtcatggggtggctcttcctcatcccatccatccccacgggcttcggcaacttcctgctgccgctgatgattggcgcccgggacgtggccttcccccggatcaacctggccagcttgtacctctacgtgctccgggcggagatgacgctgtggggcgtgttccacggcggcgtggacacggggtggacgttctacacgccctacagcaccgccaccgggcgggaggtgatgcccgtgcttctgggcgtcttcgtggtggggttctccaccatcatcaccggcatcaacttcatcaccaccgttcacaccctgcgggcccccggtgtgacgtggatgaaggtgcccctcttcgtgtgggcgatctacggcacgtccatcatccaggtgctcgcgacgccggtgctgggcatggtgctggtgctcgtggcgctggagcgggtggcgggcgcggggctgttcgacccgagccggggaggggacccgctgctcttccagcacctgttctggttctacagccacccggccgtctacatcatggtgctgccgggcatgggcgtcatcagcgagacggtgtgcgccttcagccgcaagcgccccttcagctaccgggtgattgtctggagcacggtgggcatttccttcgtggggttcctcacctggggacaccacatgttcgtctccggccagtccaccttcggggcgggcgcgttcagcgtgctgtccatgctggtggccatcttcacggcgatgaagatcttcacctggctgggcaccatgtaccgagggagcctgtgggtctccacgccgttcacctacgtccttggcttcatcttcctgctcttcttcggaggcatgagcggggtcgccgtggccgtcacgtccgcggacctgcactggcatgacacgtacttcgtggtggcgcacttccacttcatcatggtgggcgcgtcgctgatggccttcctcgcggcgctgcattactggttcccgaagatgtgcggccgcatgtacccggagggcatgggcatcgggacggcggtgctcatcatcttcggcttcatcgccaccttcctgcctcagttcctgctgggcaatctgggcatgccccgccgctttagagct

SEQ ID NO: 199 - DNA, 1236 bp, Myxococcus xanthus
gatgccggccgcatgcctcctctgcgcggagccgacgccagaggttgtcggtacttggacgacgcatcgtgtccgcacgcagcctgcctggccgccgggcaggcgggccaccagggcgcataccgtcaaggcgtacccgggggactgggggcttcctagcttctgaacggacccgttgattgggagattcgcggatgcctcgtccctatagctttgaccactaccaggttccgaagacgctgccggcgccgaagcgaagcctgcgtcggcaggacaaggcgcggctggcccattccaaggcgcatcccgaggccatggagagccacgagggcgttcactacggcaagcgcttcgcggagacggaagaactctacatcgcgcatcagatggaggcgcagatggaggaactggcgcggcccgagcccgacgccaagttctcccacggcccggaattcaaggcggcacgtggcacgtcgaagggcaaggcgcgcacgacctccgcgcccgtcgtgggaggaacggcgccgattggcgcgctgccgcccacgcgcgagcagccaccgcgcgggcggctgccggagattcgcgaggaggcgcagcaccagttccaggccctgcggggtggcctgggcgacgccgtcaaggccgtgtcccggctcatcctgctgcccgtcacgctcgtccgcatggccgcgggccgcatccttcctctgtcctgattgggtgagcgacgcgcgtggagctgaggctcgtttcgtacaacatccatagtggtatcggaacggacggccgcttcgacctggccgcgtgggcgcggtgctccgcgaagtggacgcggacatcgtcgctcttcaggaggtaggcgactttcgcgcgggacgcctgggaggaccagcccgaacacctggcggacatgctcgggctgcacatggcctttggtcccaatgtcgtgcgcaacggccggcgctacggcaacgccatcctgtcgcggatgaccatcgtcaagtcgaggaactacgacttgagcgtgggccgccgcgagcctcgcggcgcgctacgctgcgacttggacatcgggggagggctgcaactccacgtcttctccctccatctgggcctgcgcctgggggagcggcgcatgcaggaggcgctgctgttgtcctcggacatcctccgcgatgccgcgcggaaggacccgttggtggtgtgtggaaaattcaactactgggggccaat

SEQ ID NO: 200 - DNA, 1626 bp, Myxococcus xanthus
tgcttcaccaccaggtacgggcgcccaccgtacgcctccacgcgcagccgcttctcatgcaccagcatgacgaagggcatgcggccggtgtccgtcatgcaggacttgggcacatcgccagggaggcccgcggcgagcgcggtgttcagcgtggcgctggtgccatccgcggcaacgtccgccgtcagccgcccgaggaagtagtcctgaccgcccggacaggcgatgagcatggcctgcccctggcgcagcggctggccgaaggtcgcggcgggctccagctccaactggaagggctccgccccggtgccgtcgagctggccgcggcgcaggaacatcgggtcgcggtagcggaaggccaggtcgtcggtgacgaagttgccccagtcctccacttcctgcgtgtagttgtccttgcgggcctccggcaggcccatcgtgccgaagtcgaaggcgatggcggggtccagcccgtagcccgcgtagcgcagcgtgcggttgaggaagtcggagcccacgcggctgccttcgacggccgtcttggagacggtgttgctctggaagatgttgttgacggcgatgatggtccccgccaccgccagcagcaccaccgaggagacggtgatgccgaccagcaactcgatgagcgtgaagccgcggcgcgcgtgcgtcctgggggcgttcacagctccacccccgcgccgttctccgccgggttgtagagcgcgacgaactgcttgacgtagcggcgctggccggcgctgcggaaggacaccaccaccgcgaccgagtcgatggcctgcgccggcgtccagacgaggacgcggcggtagtgctcgctctcctcccggcgagtagccgggcaccacgcggagcagcgggtctccggccgcggtctcgaaggcgtccaggtccacgacgcaggcgtcgggcagggtcgcgaggccgccggccagctcgagcgtctccgcggcgccggcgcagcgcgcgctggacagcggcccgacgtccgcgaagaggcgggcgcgcccctggagctggatgccggagcgcacctgcgaggcgatggcgctggcctgcgacaggcggttggcggcggcgttctgctggctggcgaagatgagcccgccgaagacgccgctgatgcccatggcgaggatggcggcggccgccatgccttcgatgagcgtggcgccgcgcatgtgggctcggcgggatgcgggattcaggcgcctcatcggttgaccctcatgtcgacgaagccaacgggcgcggagacggcgaagaggtattcgcgctgcccgtcggtggagagaagggccagcgacgcggcccgattcacggcgccgttgccggcggggatgactggctggcccgcgccgtccacgaagcgcgcggagccgtcaccgcggaagacgatggcgccccgccgcggcgcgccgctgcagaagctgcaggccgtgggggccagtccctcgaagatgccggtccacgccaggttgccgctggcgccgaagcgcacggtgcgctgcgagtagcggtccatgtacatggcgtccatcaaccggccctggtccgcggaaagctggatgtccaacgggggcgagaaggtgccgaagctcagct

SEQ ID NO: 201 - DNA, 1411 bp, Myxococcus xanthus
gctgtgcgctctaccgggacggtgaccgcaagtcgaagacgcgcgactacgccatgttgctgctggcgcactcctaccaggaggtcggccagtacgataaggcgctggaagtcgcccgtgacgcggccggcgcctacctcaacagcccgtaccagtcgcagttccggggccgcatcgccacggtgaagcgcctgaagaacccggagagcgcggcgcccccggctccggcccaggcgaccagccagcccggtcagtagctgcccgtggggtccggaaccccactcaccggaaagtcgacacacggaagcgttgccacacggggtccacggtcataagacgtgggccccgtgtccgctcccgacccccggaaagatccccgctaccgccgctttcgtggtgccgcgtatgggatttacatcctcgtcaccacgctgttctcgttgtggctcatctggagtgtcggccactctgtcctggccatgacgccggagaagctgcctcccgcccccgtggcgctcacgttccgcgagtgcctggatggcgcgcgcgccttgtgggcggatctggagagcgggcgcgagaagctggtgaacgtgtctcccgccaagagcgtcgaccaggaatggatgcgcttccgtaccgcgtggctgcagaagctccgcgtgcgtgagtccgaatgcgcgctcgactcgcgtgagcgggcccccctgcgggaggtgttccgccgcctggtgcgcgtgcaggacctctacgccatccatgcggtgcagtacgcgggagaggtgggcggcgaggtggatgcgctgcatgacgccttgaacaccgcgggccgcaaccctggcgccggccggctgccctgagtcagcgcaccggcagcagggcggtgtagcggcccaggtggtccgacaccgtctgcgacagcagcaccggagacgggcgccctcccaggtccgccacccggtagaagcgcacggaggcatagggcgagggcgctccggcctcggtcaccatgccccgcaccgtgcggccgcgctggagggggaaggtggccagcacctgctcggacgcgtcgtcgccggggagcacggtgatgacgcggctgacgcggggtaggttctccgtggggatgaagtccacacggtagatgcccggatccaaccccaggcggaaggcgcccgtgtcgtcggtggtgcccagggactcactgcccgccggtggacgcggccagccgggcacctgtgccaccggatccgccagcaccctgacgcccagcgccggtgaggcgttgtccgtctggagaatcagcccccggatgaagcggcggtccggacacacgacgtgcggcagcaccgcgccggggcgaggcacctgcaccgactgcagccggaggggcccggggtgggagcctgac

SEQ ID NO: 202 - DNA, 1386 bp, Myxococcus xanthus
ctctaaggcgccaccccgacccaggacctgagcgatggcgagctgtactggatcatccagaacggcatccgcctgaccggcatgcccgcctggggacaactccacgagggggcgggcaacaacgatagctgggccctcgtcgaactcatccgcaggctgccgcgtctcggcgaggaagagctcgatgaaatcaaagccgccctgccccaatcccggcatgagcttgaagagcagcgcatcgaggacgcgttcctcgaaggacagtagccgtcacatgtgaaaggagcgcaatgccatgagcccccaacccgttcgtccccgcctcacgagcctcgccgtggtgaccctcgccctgttgactccggcgctggccctcgcccacggcaaggacggggtccacgtcatgggcacggtgaaggaagtgaagcaggccgcgctcgtgctggagacgagcgacaagaagcagcaggaggtgatgacggaccccggcacccgctacgagaagagcggcgtggcggtcaccgcatccgacctcaagcccggcgagcgcgccgtcgtgcacgggatgaagatgaacaacggccaggtgcatgcgcagttggtgaagttcggcaagccgcccgccaagggcacagggaaggaccagggcggcacaggggaaaccgagccggctcccactccaccaacgcaggggaagcgtcacgagcactcgggacactgagcgcttccgtcgctggcgaagacggcatccaaggcaaggcgccgccgggcggggaaaaccgccccagacagttcagcgcttgcgggccagcagcttgcgaatctccaccaacgacgcggccgtcacggcctcgatgccctgttcgccgtcgatgtggacgatgcgctcgtgcttctcccggcggcggatggcggccacgtactgcttcgcaatccgccgctgtgcctcgtccgcctcgaacagctccgccgccccgccgcgtgccttgcggcgccgtgccgccacctctggcgccacgccgacgaacagcgtcaggtccggcgacaccgcgcacgcattcaccgcctccacccattccatgggcagcgacgccccctggtaggcgagggacgacaggacgtagcggtcacacaggacaatctggcccgccgccagcgccgggagcacccgggccgtgaggtggtccgtccggtccgcggcgaacagcaacgccagcgtctccggcgccagcgggcccgccccaccgggcagtcccaaccggcccgtgagcgcctggcgaatcatcgtccccacggggccgtcagacggctcccgcgtggtcagcaccgagtgcccctccgcgcgcagggccgcggcaagccgctccacatgcgtcgtggtaccca

SEQ ID NO: 203 - DNA, 1495 bp, Myxococcus xanthus
ggccgccgcggtgagtcgtgcgtgtggtgtggtttcgtcttttccgccgtcacacggcgacgtccggcgcgaaagaagcgatgactgccacgtaccggctgacgggcaaggtggaaggcggggagctggccgagctgtatcaaggcctcgagcttcccggcatccccgtggtggtgaagctcttccaccccaggacgtccgatccggcctacgcccatgacctggcggagacgacgcggctgctccagcccgtgcggcacccgggcatcctccacgtcgtggacctgggcgtcatccgccagcgcctggccgtggtccgcgaggacgtggacggcttcaccctgggcaccgcgctccagcgcctgcactccaaggacgtggtgctgccgcccaccgtggcgctccacatcatcatccagctcctggaggccctgcatcaggcgcacgaggcgggcgtggtgcacggcgccatcaccccgggcaacgtggtgctgtcgcatgacggcctgcccgcggtgtgcgacttcggcgcgctgcgcgccctcatggccgtgccccaactgcgcaagtcgtttggccaccggggccgcggcacgtaccgcgcgccggaagtcacgcggggcgagccgcactccgcgcagtcggacatctactcgctcggcgccatcgcctacgagctgctcacccagcgtgagcccgtggtgcccggcagcggcggggtgtccacgcggcgcagtgaggcgttgccgccgcccagccgcgtggaccggcgcatcaattcacggctggacccgctcatcctccgcgcactggagcccacgccccagcgccgcttccgctcctgtggcgagttcgccacgtcgcttcgcaatcagctcgcggccagcggcggcatgccctcggcggacgacgttcgccgcttcgtgcgggagctgttccccaacgagatgagcctcgtcagctcggggcctccgccgttcaaggagcccttcacgctggagcccatctccggcgcggagatggacgacctgcgcgcggaggagctcgagaagtccgtggttcagcgagccccatacagccgcgcgctgaccgaggacgaggccaacgcggagacgcagcaggcctccgagcccgcgttcgaggagtaccgcccggagctgtacgagcgggacgtggcggacgcggccacgcgggtgcgggcaccctcgcgcgcgtccgcctccgactccacctccgcgccgggggaggacaccgggcccgctcccgccggaccgctggagcaggggtgggaagcgccgccgggcgccgctccgccgaagcctcgccgccagccgtcgtcggtggggggagggagcggccacacccgcatcgggcgaaatccgcgcctcaaggtcgtggaggacttctccgcgcccgagccggccgcggatgacgagggctcgatctccgtcttcgcgccaggtcgccgcggcgctcggatccgccgcgcccccat

SEQ ID NO: 204 - DNA, 1326 bp, Myxococcus xanthus
  unsure (1)..(1326): unsure at all n locations
cgggggcggtccggcagcagcctccccgtcgagacctcgaggacgtgaatcaatgcgccgtgggcgcttcccacggccttgccgaacgcgacgaatgcgccatccggggaggggaccgcgaagacgagcacctcgttgctcgcccacgtgttggggtcgagcaacgtctccaacggcgccccttcgtggcgccggagcaggagcttgagcttgtcgtcgcgcgcctctgcctgccagaggaactcacgcccccccggaccggcggcaatgggcggggacctgcgtgcgtgccgcgcggagcgggtgaccgcttcgcgcagtgcctcgcgtccagggagggcgtggagcaccgattgcgtgagggcctcctgctcggaaatccacgcctgcgtctccggcgcatcgagctgctccatccacgcgtaggggtcgtcgaagcgctgtccgtgcagcgtgtagccgctccgcgcgtctctgcgtgcggagggggacttgcaggtccggtccacgggcgtcatcggatgttcctccacggggcgtcggtcctggcgcggacgttcatgcaggaaggcgcggcgaggttgtagcccaaccgcgcgggggccaccttcgcgcggcgcggtgtcgaactccggtattacgcgcgtgaatccgatgaattcgaggaggccctggtgctcggcgtggagcgcgtcgcggcaccttgtttgattcgcgtgaaatagaaataatcccacgtcactccatcgggacggtttcaacgttgttgcggattcgcgagtcgcagatgagttcgttgcgcagcgccgcgatggacagccgcgtcgcgcagctcgtcacggcgctcctcgcggagccttcggcggcggagcctggatggacccgcgagcggctcgagccggtggtgcgcagggtggtggaccggggcatcttctcgctcgacgacgtgcgcgtgtacgtgcagctcgccgagtcgctgggggatgacttcgagtcacagcgtcgccacgcgtggatgcgctcgtggctggatgacgcctccgtttcggaccctgtcgcgcgtctgcaccgcgtggtgcgcgagcgccgccgccgcgaggacgtggcggcgcaaaaccagcggaaggaagcgggcttncgncttcgacacgccccgcccggngagggccgctgacttttccactcccaggaatgcctcatgcccccttcctcgacttcacggcaggacccggcggttgctccatgcccattacaggcgggcaaggggcacgtggaggtggtcgtcgtcgatgaccgcgagacgccgctgtcccgcgtggcggtgga

SEQ ID NO: 205 - DNA, 1246 bp, Myxococcus xanthus
tccagtgtgctctaaagagcgccacgtcccgcgcgcccatgcgtcacagctccacttcgcactcagccgtccacaggccatccgcgccctgggacacacgcgtgtccaccagcgacacgccccgcacgtctcgcgcgaaggggtggcgctcccggtccaacggctcaccgaaggcgtggccgaagaggcgcgtgccgtccatgcgcaccgcgaagcaccggaaacacaggcggcgcgccgccatcttgtggacgatggcgcgcagccagtccgccagcagccgctccggcgccgtcgcctcgcacaccagctccacctcctcgcgcacctccaccgaggcggggtccaccaccagcgcgcacaacgccaccgcggcctgctcgaaggcctcttccagcgagcgcccctgtccccgcaccacgcgctgcgagccgcgggtgaggtgctcccaccgaggcatcgcctcgcgcgccgccgacgcctgccccgtctccatgacgcctccttcgttggtgtgtcccgacgccagattcacgcacgcgcctccgcgccgacgccgccgaggaagcggaggaaccacgcggcggcctggcgggccacctgctccagcgcgccgggctcctcgaagaggtgcgtggcccccgggatgatgtggatgcccttcaggccctccatccgcgcgagtgacgcctcgttcagctccagcacgcccacgtcctgcccaccgacgagcagcagtgtgggcgcctgcacgcggggcaacaccggtccggccaggtcgggccgcccgccgcgcgacaccaccgcgtggatgaggtccggatgcagggccgccgcgacgagcgccgccgcggcgccggtgctggagccgaagtagcccatgcgcagcacggccagcgccggctgccgctgcgcccattccgtcaccgccgccaaccgccgggcgaggaacgggatgtcgaagcgcaactccccggtgcgcgcgtccttcacctcctccacttcgctcagcaggtcgaacagcagcgtggccagcccctgcgcgcgcagcgcacgcgccaccgcgcggttgcggggactgaagcggctgctgccgctgccatgggcgaagatgaccagacctcgcgcgccgtccgggatgcccaggctgccccccagcaccacgtcgcccacctggacctgcacctcccggatgtccgggtccgtatttccttcctgccacatgtcgtccgtgcctccttgtctc

SEQ ID NO: 206 - DNA, 1805 bp, Myxococcus xanthus
ctctacaggaagctggggtcgggctgatagtccggccgcgagtccggcccccggccccggaacagccggcccaggggatacgtgacaccgtccttctcgtaaggcgggatgacctccgtattgccgaaggagttcagcgtctgggaggccatggacatgccctgctggtactgctggatggcggcagtgtcggggccgcgaagccagaacgcgatgcggccggccgcgcgcaggggcgcgttcgcgtcggtgttgtagacgtgcggcgcgcggtagttgaccttcatgacgtgctggcggccctccggcgcaggcatcgacatgtacgcgggctcgaagtagtcctgcgcccacaaatcatccaccgcgaactcggagtagaccatccgctctcctgagtccgcgagcacgccgcccagcgcctgccggaactggttggcttcgatgctggcggcgggcttggagacgaagacgttccaggcgggcgtcatgtggtggaagagcaccacgggcgccacgcgcatgcggacggtgtcggtgaacaccgggtcgtgcggattgtttcggccgatggtgagcaccacgtccgcgaagccatcccattcctcggggtcgcgaacgatgtcgcgcccctcgatggcgagcaccacgccgcgccgtatctcagcggtcgacaggaacaccgtgtcgggaaatccgcccgagatgaagttgccccgcacgcgcttgaacaggcgcaccttcttgccagcggccccggacacgatgacggagcccaccgtgcccgcgggcgcctcgggccagggcaccgtgcgcagccgggccaggtcctctaggtccgactcgccattcaccaccgcgtccatggcgtcatggcactgcgccagcgcgtcgtcgctgatgcgatgggggtccatggagaaggggcaggcgtgctcgtcgtcgtccaggttggccaggaagatggcgccgcgctccgccgtccaggtgtcctcgtcctcgtcctccgcggggttgtcgagctcgacgatgccattgcgattcacatccgcgcgcaggtcgaccaccggatggaagggcccctcgagtggatcctcgcttccggggcgtcccccttcgtcatcggccacgggcccgcaggcgctggccaacaggcatgccagcaacagcggcaggagacgtgctcgggcatgcggggacggcggcatggcgttctccgggggcgccgacgggcagccccaatcccggtggaacgacatcgtgcgccctacggcaagtcgcgatgcagtggcccgggagtcctttgcgccaggaaagcgtcatttgacttcgagcccacaactcaccgcgtaacttcaggtaccgtgtggggttcctccatcgtcatgcgacttctgtcagtcggattcctggtggccttcgtgctctcatgtgcgagccggccgcaccccacggccgtggtggcgtccgagcctgtgtcggccggacccgccttcgacgaggcacgtgcggtccacgtcctgcggcgcatggccttcggaccttcgcgacaggcgctggcggacctgcggcgccagggcgtggaggaatggatggcgtcgcagctctcccgtcccggtgcgccgctgccagccggtctggaggcgaagctccaatcgctgcccacgttgacgatgtccatggcggagctggtgcgggagtacccgccgaagcgccagcgggaggaagccttgaaggacgggcgtgagccacagcgccccgcgctcatcggcctggagcaatccgcggcgaagctgcggcgggcg

SEQ ID NO: 207 - DNA, 1771 bp, Myxococcus xanthus
cgctcgccatggccgagtgctaacggcccgtgtcgtactagtaaaatcccccagtgaattcaggaggttgcgatggcagcgaaggaaattttcttccatcagtccgcgcgtgaggccatcctgcgcggcgtccgcaccctgtcggacgcggtcgcggtgaccctcggccccaagggccgtaacgtggtcatcgagaagagcttcggctcccccacgatcaccaaggacggcgtcaccgtcgccaaggagatcgacctcgagaacaagttcgagaacatgggcgcgcagatggtgaaggaggtcgcgtccaagacctccgacaaggccggcgacggcaccaccaccgccacggtgctggcgcgcgccatctatgaggagggcctcaagctggtggccgccggccacagcccgatggacctcaagcgcggcatcgacaaggccgtcgaggtcgtcgtgggcgagctgaagagcctgtccaagcccaccgccgacaagaaggccatcacccaggtggggaccatctccgccaacggggatgagaccatcggcgccatcatcgcggacgcgatggagaaggtcggcaaggagggcgtcatcaccgtcgaggaggcgaagggcctcgagacgacgctcgacgtggtcgagggcatgcagttcgaccgcggctacgtgtccccgtacttcgtgaccaaccgcgagcggatggaggccgtcctggaggacccctacatcctcatcagcgagaagaaggtctcgtcgatgcaggacatgattccgctgctcgagcaggtggcccgctccggcaagccgttgatcatcatcgccgacgacatcgagggcgaggccctggccaccctggtggtcaacaagatccgcggcgtgctgaacgtgtgcgcggtgaaggcccccggctttggtgaccgccgcaaggagatgctgcaggacatcgccgtcctcaccggcggcacggtggtcagcgaggacctgggccacaagttcgagacgctgacgctgaccgacctgggccgcgccaagcgcgtcacggtggacaaggacaacaccaccgtcgtggacggcgtgggcacgaaggcggccatcgagggccgcatcaagctcatccgcacgcagattgactccgtcaccagcgactacgaccgcgagaagctccaggagcgtctggcgaagctggtgggcggcgtggccgtcatcaacgtcggcgcggccaccgagacggagatgaaggagaagaaggcccgcgtcgaggacgcgctgcacgcgacccgcgcggccgtcgaagagggcatcgtccctggcggcggcgtggcctacctccgcgcgctgcccgcgctggagaagctgaagccgggcggtgagcaggacttcggcgtggccatcatccgccgtgcgctccaggagccgctgcggaagatcgccagcaacgccggcgtcgagggcgccgtggtcatcaacaaggtccgcgagggcaccggcgcgttcggctacaacgcccgcacggaggtctacgaggacctggagaaggccggcgtcatcgacccgacgaaggtggagcgcaccgcgctgcagaacgccgcctccgtcgcctcgctgctgctgaccaccgaggccatggtcgccgagcgcccgaagggcaaggccaagggcggcggcgctggtgccggcatgccggactacggcggcgacgacatggactactgagccgctccggagggctcgggacgtgagtcccgggccgtctgggcctcggcagtca

SEQ ID NO: 208 - DNA, 1146 bp, Myxococcus xanthus
  unsure (1)..(1146): unsure at all n locations
gccgggggccgggcagcttcggcgtgttcgggatgcaggagcgggtgcgcgacttgggggggcacttcgaggtgacctcgcgtccgggggaggggacgcgggtggtggccgaagtgagggcggacgagcgggaagacttttccggaggaccacatgcgcgtgttgctgacggatgaccaccagttggtgcgggcgggcctgcgtgcactgctggagtcgctgggtggggtgacggtgctcgccgagtgcggcgatgggcatgaggccctgacactcacggacaagctgcagccggatgtgttgctcctggacctctcgctgccggggctcaatggcatcgaggtcgcccggcgcgtgccaaagctgagcccctccacgcgaatcctgatcctctccatgcacacgtcggccgagtacgtggcccaggccttgcgcgcgggtgtggcgggctatctcgtcaaggactcggcggtggaggagctcaaggtggcgctggagtccgtgtggcagggccgcacctacctgagtcccgccatctcgcagaccgtggtggagggcttcctgcgcatcactgacgacgagaggcccgcggcgaatccgctggaccggcttacctcgcggcagcgggaaatcctccagctcatctccgagggaaacggcacgcgcgccatcgccgagcggttgcaggtgagcgtgaagacggtggaggcgcaccggacgcaattgatggagcggctggccatctatgacgtgccctcgctcgtgcgcctggcggtccggtatgggctcgtccccggagagtcgtcgtgacgtaggggattcctgaggggaggttagggggctccccgatggtggggctcgccgacggggccgtagggtcgtcgtgcgtcccaaaccgtcatggagaccccccgcccatgagactgatgtcacgcccctccttctccagcgccgcgctggtgggcctgctgagcgtcgtgctcaccgcctgcggctcggacccgaagccccccggtgagcccgatgccggaggcggngaagtcccgtcctactccgtgggcggaatgctgtcgggcctgcgtgacggcacccaggtggtgctgcgcaacggcgaagagtccctgcgcgtcaccaccaatgattcct

SEQ ID NO: 209 - DNA, 900 bp, Myxococcus xanthus
ttcaatcgttccacccgctccagcagggactcgctcgacaggctcgcgctgatgcgctcgacgacgagcgggaagcccaggggcgtgggccggcggacatggatgcgctccacgggcgcggcttgaagccgctccaaggtccgctccaggcgcccctcctcgaattgttgctccagcacctcccggcgggcctggacgagcaggaggttgtcggggtcgtatttgatgaagacgtcgtgcagcagcgacgcgctggcctggacctgccgcgaggacttgcgcgcgccgggcaggcccggcagcaccagcccggcgatgcgggcgatgtcgcggaactggcgctttgacagctcgccgacgttgacgctctccaggacgtccgcctccagacgctcgcgggtgaagagcgcggggtgcagcgcctcctcgaaggggaagggcgtgggcgtgagcagctccaggccatagtcattcaccgacagggtgaaggtggccttgcgcaggcgcgtcagccgcagtgccagcagcgccgccagtccttcgtgcaccaaccgtccttcaaagggatagaggaagagatggtgcccgtcgcgcgtctggcacgtctccgccagtaggatgtccgccgcggggatgcgggacaggcgggcctgcgcgtccagcacgggccaggccgcggccagttcgtccgacgtgacgtcgccgtggcgcgcggtgtccagcgtgcgccgaacggccgcggccaatgagccggacaagggcaggcggctgccgccccagcgcggcgtctgggtgactttcgtcttcgcgggccgcacgtaggcggtcatgtcctggatgcggctgaactccagcttcttccccgcgaagatgaaggtgtcgcccggcttgaggcgggtg

SEQ ID NO: 210 - DNA, 1513 bp, Myxococcus xanthus
aaccggctgttcctgcgcgcggaggagttcgccagcagccggcccgaggtgacgcgcgtcttctccgtcgtcggcggtttcggcagcggcgcggtcaacaccggcatgatgttcgtcagcttgaagccgcccgacgagcgcatgccgcaggcggagttccagcagatcctccgcaaggagttcaacagctacccgggcctgcgcgcggtggtgcaggaccagtcccagagcggcttcacggcgcagcgcggcttcccggtggagttcagcgtgcgcggctcggaatgggagcagctggtggaggccagccaggagatgcgggagaagctccaggccagcggcaaggtggtggacgtggacacggactaccagttgggcatgccggagctgcgcatcaccccggaccggggccgcgcggcggacctgggcgtgcccatccagtcggtggccacgaccatcaacgcgctggtgggcggcgtgcgcgtgggcaagtacagcaccggcggccggcgcatcgacgtgcgcatgcggctcctggcggaccagcgctccaggccggaggacctctccacgctgaaggtccggacggccagcggcgcgctggtgccgttgtcgtcgctggtgacgcaggaggagcggcccgcgctgcaggccatcacccggcgggaccgtgagcgcgccatcagcgtctacgcgaacgtggcgccgagttcgaaccaggaagaggccctggcgacggtggagcgactggcgaaggagttgccgggcggtgtgcgtgttgtggcgggtggcgccagcgtggccttccgcgactcgatgagcagcctgttcttcgcgctcttcctcgggattggcgtggcgtacatggtgctgggcgcgcagttcaattcgttcctgcacccggtgacggtgctcacgattctgccgctgtcagtggcgggcgcggccttcgccctgttcgctacgggcaccacgctgaacatcttcagcatgatcggcctgttgctgctgatgggcatcgtgaagaagaactccatcatcctggtggactacgcgctgcaagagcgggagcgcggcgcggacgcgatgcaggccatgctgcgcgcgggaccggtgcggctgcggcccatcctcatgacgtccaccgcgaccatgatggcggcggtgccagcggcgctggcgctgggagcgggctcggagacgcgcgcgcccatgtccatcgcagtgctcggtggactgtccgtgtccacggtgctcagcctgctggtggtgcccgccttctacgtggttgcggaccgcatgaagacgcggctgggcgagcggttcggcaagaaggacgatgagacccacgagtcgccgcagcacccggagcatggcgatgcgccgcgcccggcggcacatgggtgagcggggagtctgaccgcttgggtgagcggggcgtctgaccgcttgggtggagaagccatcgcggacgtcttcgtgacgccgcggtggccttttcttttggagcgcg

SEQ ID NO: 211 - DNA, 1373 bp, Myxococcus xanthus
  unsure (1)..(1373): unsure at all n locations
gtgctctaaagagcaccagcgcacacacgcgggcgtcctgctccggcactcgggccgcagtgaggcctcccaggctggagccgatgagcaccacccgctcctcgggcccgcccatcgaggccagcaccgggtccagcatggagctcaggcgcaattgctccatggaggggacgcggaggttcaaccgctccaccggaatgccctggtccgcgtagtgccgggccacggccacgcccttcttcgaatccggacccgaggcgaagccgtgcaggtacagccagcgaggacccacggcggaaggcgatgtcgtcgaagtgctcatgacaggcccactctaacgggcgcgcggggccgtggcttcagatgcgcaacaccggcccggcaatcaccgactgcatgagcttggcgcactggttgagcgcgttggacgtcagcttcacgtcacagaactggaagcccgtggagacagacacgccccaacggtcgctgaaccagccgtccacgcccacccggaaggccatgctcgtggtgtcgatgttctgccgcagccaggtgcccacgtcgtccggcgtgaaggtgctcccccagctcttcgacagccgcgcgcccacccacggcgtgatgggcttgtcctggaagaagcgcagccgcgcctcgatgcccaccgcccggtagtcgagctgtgagcgctccaaccgcccctgccgcatcgcgtccgggaactgctggccccacgtctcggagatttccgccagcacgccccaccgacaatccgggtggggtctccaggcccaggtatccgtgcagcgccgggcccttcgtgcggaagctgctcaaatggtccagggtgatgccggcgcccagcgatgcatagccattccagcctgtcgccaccgcgtccgttcccacacacaggacgcccaccaccgccacccacatcgactgctttctcatgcgttgcagtctatgcctggaggccgccgtgggggactccgagtgccgctgcgtgtcatgaaatcatgcagacacgcgtgcctcggtgtggccaggcgcatccctgcggacagtccaactactgccgccctgtcngagggaggggtggggtggggacctgcatgcgcttccggagggcaagtctggaagctagggtggtgttccatgtccagcaccttcgaatccgccgccttcgccgttcgtgacgcactctccagtgcgggccggggcctggtcgaacgcgaggcgatggtggagctcgtcgcgctctccgccgtggcgggggagcacctgctcgtcatcggcccgccgggcaccgcgaagagcgaggcggtgcggcgcaccgcacgtgtcctgggcggctcatacttcgatacctc

SEQ ID NO: 212 - DNA, 1561 bp, Myxococcus xanthus
gtgctctaacccgcgtgtagcatttattcgaacccatcaccaacgcctccactggccccgtggccgaggggaacgtgggcggcggcactgttcatggtgacgtgcgacttcaagggcggcatcggcacgtcgtcccgcaagttgccggaggtgctgggcggctacacgctgggtgtgctggtgatgtccaacttcgggaagatgcacaacctgcgggtgggcggcatgcccgtgggtgaggtgctggcggagaagttcaagggcacgcccaagcgcggccagacgtacggctccatcatcgcggtggtggccacggacgcgccgttgctgagccatcaaatcaaccgcctctgcaagcgcgtggcgctgggcattggccgcgtgggcagctacgcggcgcacggctcaggggagattgtcgtcggcttctccacggcgaacatcatcccccggcgcacgcagaagatggtctacaagctgaagctcctcctggatcagcgcctggaccccctctatgaggcggtcatggaggccaccgaggaggccatcctcaacgccatgtgcatggccacgtccatgacgggcgccaacggcaaccactgtccggcgctccccctgggcgaggtccggcgcttcctggacgcctacaagccgattttcgcgtccgtgaagaagcgcccccagcagtcgagcgctccggcggccaaggagcggcccagcaacgaggaccgggagggggacgtgacggtgtccaccgcccggccgacccaggtccggagcgccgagggaatcccgtttcccacccgtccggcaccggacgacaccggcgagccgggggggcccgagggttcctcttccgggagcccgccgggttctgatagttaagcccctcttttcacgtctccgtacggagcacaggagtcaaagatggcccgcagcaagagcaagcaccgtcgcgtgcagatgaagatcaagcaggcctggaagaagcgggccaagaagaacaaggccgaggccaaggccgccgcggagtcgaagaagaagtagtcgttccgaccgcgctcgtgcggcccgtggctcagtcccgggtcgccgagaacggactgttgacgttgcagcgctgcccccccgtgtcggatgcgcgcacgtagctgcccgtgaggacgccgttgatggacgccgtcccgccatccgtcagcggcgccaggtagctgccggtgagcgtcagggtgtccgtccggttcgccgagggcactcccgttcccgtcatcaggaaggtcccctgggtggtgatggtgccccggacggggacgcccgccagccggctggtgaggttttcgcccgagcgggcgatgtccaggacttcacccgtgggaacctccacccccaggagcgcgcactccggaggcacgcccgcgcctgtgtcgaattgcagccggtagcggccttcgaccgcggggcattccgtgcagcggggggcttctccgccacagcctccggtggtgagcaggagcaacccggcgaagaagggggcgaaacgtccagaagtcctgacttgggt

SEQ ID NO: 213 - DNA, 1503 bp, Myxococcus xanthus
caggtatccgccccgggctgatagcgccaccactggaagtagacgtcgtgctgactggatgccgcgagttgtggcccctcgtaggagtagacaagtgccacatccatgccgacggccagcagttccgcccggtccgtgtgcgcggcgttgggctggatgtcccccacccgccgcagtgttcgcagtgcgtcctcggagcggtagagcaccagccccttgccgtccacgcccccgtgctggatggccaccagccacgtcggcggacgactgcttccggtttcgatacgaacaatgtggcgctgggccgggagcgtcagggcattgcccccgctcaccggcaccaacgccgatccactcgccgccgccaccaccacggcgagcaaggcaccagccaatcccgtcatatgtcccctccgtgaacgtctcggcgggaagctgagcgcgggagcgcacgaacggaaggaggcccacgcacttgagacgattccaccggaaggagtgaacggacccctgcccgcggaggcactcgccatccatgcgcaccggcaccaacacgaccgcccatcaccagacagttcgaatcagtaagatgccgtctcggaaccgagcgcggtgacagacgcgatgggcgatggccggtggaaaaccgctggtcgcgaggcagcggcctccgtcactggttggccagcgccgttcgcaggctgtcgagcaggtaggagttgagttcctcgctcgacagcttcggctcctcccggagtcgggcccgggcgaactgctgccactcgtgcagttctcgcggtgtcggatcgcgcttcatgttcgccggcatcccccggtaggcgtggaacatgaattcgtaggcctcccggatgaagcgctcgatgttgagctctgcgggcttgctcatgcccgtcagctcgttacgcaccgcatcccggatggcgtacttgagctcctccggggtgatgtccgggttctcccgccgcttctccgccgagaaggcgcgccaggactgcatctcctcgtccgtgggggcacgggacgcgcccaggtagcacagcgacacccagccgatggcctccatgatgaagccatcgatgttcgcgggagacagggtgtccagccccagcgcctgcgcccggatggcgtcggtgatggcgtgtctgagctcctccggcgtcatcttcgggttctcggcgagcttcgcggtggcgaaggcacgccagtgcgccatctccgccggggaggcatgacgctccttgccctcgtaacacatcgagacccacccgatggcgtcttcgatgaaccgttcgatgttcgcgggcgacgcggagtccgtgcctgtcatcttcgcgcggagggtatcggtgatggcgtacttgagcgccactggagacatctccgggtcctcccgcagcttctccgccgcgaaggcgcgccagtacgtcatctccgcttgggaggcatgacgctccttgcccctgtagcagagcgtgacccact

SEQ ID NO: 214 - DNA, 1517 bp, Myxococcus xanthus
gcgtgtctctaaagggcggcggcggcgcaaatcacccacgccctgtccctggtgggactggaggcgcgcatcctgacgacgacggagctggccgcgctggagccgcccgcgggcgtggtggtgagctgggacttcacgcccgcctacgggcgcaaggcgctggagctgggcaaggcgctggcccagggcgctcccttcgtcgtgctggccgagcacctcaccatggagacggcgctggagtccctccgtgcgggcgccgccgcgtgcctccccaagctgatgtccgacgcctcggcgctcagccgagagttgaaccgcgcattcaaacgagagaccccatgagactcgcgctcctgtccgtcctgctgttgggtgttgcttgctcctccgacaagccgccgatgcaggacgggccggacgcgggccgtggcgacgcgggcaccgggacagacgacgcgggcaccaggacagacgatgcgggcagcggcgacgcgggttgcgagccgctcgcctcgggtccgggcaccccactgctcaccgggttgaacacgccccgcaggctcgcggcggacgaaacggacctctacatcgccgagtcccactccctgaatccgcagcagccccagccgggccccgggcggctcctccggctgccacgcgcgggcggtgacacggtgtccctggccacgggcttccgggcgccggatgccatcgccgtggtgtcggactccgtctacgtgctcgacctggacgggctgtggcgggtggacaaggcgacgggcgcgaaggacgcacggccgctcgatgccacggtgaacaatgtcaccattggcggcacggacgtcctgcccgcgcggatgggtgaccgggacgtggtggtcatcgcgacgtcgcaccgccggctggtgcgcgtggacgcctcgggcggcaaccgccaggagctctacgccggcacgggctacacgcaggtgcggggagcccgcgtggtgggccaggacgtgtggttcctggtcgccgcgggagagagccccggcctctacagcgtgccgctggacggcagtgccccggccacgctgcgcgacggcaccatcaccgccggcacctcgctggaagtcacgcccacgcacttcctcgtcaccgaaggaggcggcggaaacggccgcgtgctgcgcctgccacgcgagggcggcgcggcggaagtcgtcgccacggacctccaggggcccgccttcccggtggaactgaatgggacgctctacttcaaggacgtcagcactggcggcacgggcttcctccgccgcgtgagcacctgcacacccggcgccctggagcccgtgggcccagagggcgtggggcccggtggcctgctggtggacggcgacaccctgctctacacgtcgcaggagagcggcaccggcggcgtcgtgggccgcgtgccctgaccgccaggcagtccccgctgaaacgacaacggccccggcgcctcctgacgaggcatccggggccgttgactgccg

SEQ ID NO: 215 - DNA, 1315 bp, Myxococcus xanthus
gagctctacagcgccgcactggtgccactgctggtcgcccgtggactgcacgcaggtgcgcggcggcacggagcggcccagcgtggcggaggagcaccagccgtaggacgcggtgcagttcgtgggcttggtggtgctgcccgcggtgaaggcgcccgactggcactgccgccacatggcgtccgacgagctctgcacacagccgagctccggcacggtggtgtcggccgtctcggagtagcagccggaggcggagccccacgcataggccgactcgtagcggtggtagacgacggacaccagcgacgagccgcccacgttggtgcggccgcactggagggcatacgcgcccacccagggcgtgtacgtgtagagcgccgccgtcgccttgttcgcgggacgcaccgagcacgggtccgacgtggacttcgtcacgcccacgcgccagccggagatggtggcacggcccgcgtccaggtccgtcaggtagccgcgcagcttcttggcggagcagtcaatctgcttgccgaagcccacgtattgcgcgtcacagccgctggtgtccggacagccacagccggtggccttggccaggttgttggagttgccgctctggatgaggctggactccacctggatgcgggccagcatgtacagcgggctgatgccaaaggccttggagcgctcgacgatgagcgcggcggccgtcttgttgctgaaggccgggtcccggtagttcgccaggaacgagttgttctgctggaggaaggcctgcacctgcgcggtggtaatccactggccaccggtgatgtcggtgtcctccagcagccggtgcatgtcgtacttcgtggtggcctccagcagcacctggccggtcagctcatcgatgacgggctcatctgcctcgtcgatgggaccacagccggccgctaccaacgcgggcaccaggagcaaccacaatcgcgtcttcatcgcgtcctcggggggatgggccgcgaacccggagagcggtgctcaccgtccaccggacacggcctgggggaatccgaggctccagccgcgtgaaacattattcaagaatttcttatctttaatgcctgacggattattggtgtcatgctgaatccgtcacccaggccacacagacagcgcgcggccccggggagtcgcggacccccataaggccgttccccttgccaaaggcggcggaccaccccggaaacggaccagccccgggccttccccccctggggttccttaagcggccctggcccgttcctgggtaggcctgaccgggggcccgcgaagcccggcc

SEQ ID NO: 216 - DNA, 1597 bp, Myxococcus xanthus
acgatccctttgtgctctacagtcaacaacctgtatgagagcctctacctcccgctgtccaccgcgcagttccgcgtcatgggcagcgaccgcatccgctccatcgcggtgcaggccgtgagcgacacggccatggacgacgcgatggcggagatcgaccagaagctccggcgtgagcaccggctgcgcccggagcagcccgcggacttcaacatccgcgaccaggcctcgctgctcaacaccatgcaggagacgacgcagacgttctccctgctgctggccggcatcgccgccatctccctgctggtgggaggcattggcatcatgaacatcatgctggtgtcggtgacggagcgcacgcgcgagattggtctgcgcaaggcgctgggcgccaccggcacggacatcatgctccagttcctcgtggagtccctggtgctgtgcctcgccggaggaacgctgggcctgctgctgggcatgggcggcgcggcgatgctccaacgcatggcgggctggacggtggtggtggcacccgaggccatcatcgtggccatcgccttctcggcgaccgtgggcgtgttcttcggcatctggccggcgcggcgcgcggcgagcctcgcgcccatcgagtcgctccgttacgagtagccggtgtccgtctgcgggcctgactcgaggagggacgacatggcggatgacaagcgaatcgcgtgcatcgtggggagcgggaagcccgcacctgacatggcgtctacttccggccgccgagaatgtgctggaggagctggcgcgagatgcggagcagcttcgcggccccgcgcacgctcccttcggatttcgccagggcctcgtccaccaacgtgtcgcggacgaggctctcgaagccgtgcagaggcacccgtcccgcgctcgcccgcagcgcggtgaccagatcggggggacgcgccagcgtctccagccaaacggactccagccgcgcgaggtccagcggcttgggaaggaaggcacgcacgccctcctgcgcgagttggaaggcctgctccgccgtcgccgtcccgctgatggcgatgacatgcggcagcggctccagctcacacagcggcgccagcagctcgatgctgtccccatctggaaggctgacatccaggatgacggcgtcgggcgcatcacattggaggacctgacgcgccgcggcgagcgaagccgcatgggtgcaccgctcgacgcgagagcgcaacgcctcctcgatcgcacgcgcaagacgcgtggcgtcctcgacgaccaggagatgtcggacccgccccacccatggcaacttaccatgaatgcctgagagtcctcgaccgctggcgctggagcagatggcgcagcgggtgctgtccgacgcttcgaacgagggcgaagcgctggtcagcgggggccggattgtcttctgtgccctcatcctgacgcgcttcctggcgctgggtggcgcccacgccgagggcggtgccgcggcggcatggctccagcttcccctgctgctgggcagcatcgcggcgtcagtgatggcgctgtgggcggctcggcggcggatgttcggcgcgaagctgctcgt

SEQ ID NO: 217 - DNA, 1438 bp, Myxococcus xanthus
  unsure (1)..(1438): unsure at all n locations
gagtcccttctcgagctcgccgagggaaccctgcgcatcaaccgcgtcgtgcgccgagtcgaagacaccagttctggcgccgtgctcgaggagcgcaccatcgccgagaaccggcgccgcctgctgaaccccgaggcgcggaagcggacgtgcctgacgtgcggggagaccgcatgccacgcccgcgtcgaagtcccacggtcggaggtccgggcgccatgaacctggttctcgcaccggagcccgccccctggctctcccatctcgcgtcgctgctcacgcgcgaggcggaggtgctggccccctgggcgctgccgaggctgcccgattggggaccactccccacccgcctgcgtcaggcctggacccgccggacgttgccggtgcccgagggcttccgcgtctggggcctgccaggctggggggccgtggaggccgggatgcgagtcgcggcgcgctcgacggcggcgacactccaggcccgcttcaccctgcgcaagcggtgggcgcaggcagcctcggcgctgcttccggcgtcggtggagacggtgctcgcgccagcgctcggtgcccgggaggtcttcgcgatggcccgccgccggggcgcgcgctgcgtgctggtggaggacctgccctccttgagggcactgcacgcggacctggacgccgcggccgcgagacacccggaggaggccttccttcgcaaccaccgcgcctccgcggaggacgtcgcgcggcaggatgcggagcgcgtcctcgcggatgaaatctgggtgcgaggcgagctcgccctcgagcggctgcggctggccggacacgccccggagaagctccgcaggctgcattttccatcggaccgcgaatcgcccccggcgccccgtttgccccagggccacggcccgcacgtggccctcctcgccgggcccgctctcgcgcgcggcggactgcgagaagccttggcggtgctcgacgagcggccccagtggaacctctgggtgcgccccgcagaaggcacggacccacgacacctgaaccacccgcgagtgcggagggtgacggctcaggtccagcgcacgctccagcaggtggacgtggtgctcgcgccagcatggtgtgagagccatctgggcgagctggcgcaggcgccggagcaaggcatccccatcatcgccacggatcgcgccgcgggcttctggccctgtcgggcgattcctcgcggtgatgtgcccgccctcatcgccgaactggacgcgctgaccgcgcgctgaagcccacgcctgttggcgccaactccctcctgagtgggctgttcgtggccatcgcgaagcaccggccggggcgcggcccctggacggcgtcgagcgcgctaggtgttacgtncccggttcgcgaggacgcggtcaatcatctgctcgtgcagtgcatggagcggttgggc

SEQ ID NO: 218 - DNA, 1406 bp, Myxococcus xanthus
gccgctacgtgtgggcaggtcaccttcaccccatggtgcgactgggcggcaagagcgacacactgcgtctcccctgtttccatgtgggacgcgacgtgggcgtgctcccggccttcagcgccttcaccggtggcgtcaacgtctcccgccgcgccggcgatcgcatcttcgccctcgccggccccgcaatcgtcgaggtgtagggtgagtcaggccaagcgtcggaagatactgggtatcatcgaaacggataataccttcgagcgcgccaaccaccgggaccgcgaggcgtggctcggcaagtgcttgcactgtaacgcacacctatgggtcggcctggatggcgagccgatcagccgcgccaccatcgagcacatcctgccaaagacggccgggggcaccgaggcgctgaccaacctgggtctggcctgcgcccggtgcaatcagggcaagggcacccggcacgacgcccgttatcaccgggacgcacgcgcccgggagctggtggaaaggcttctggcccggcgcctcgcgcactggcggaagccggagaccgacgaagagccgtgaaacacccggagtgatcctccccgacgggtgctttgctcaatcgtccctacctccctccagaagagagattcatcaccgcgcgaccgcgactttccgccctcgcacgaggaagtggtatccccgtgccgccatatcagaatggttgacactgccgtgtcgatgcccgatggtcccgcgccgcattagggcagggagaggaggagggccccgcccacggtattactaatagaggtttcgttggacgtgtccgcttcgccttcagtgcgccaggagctaccgcccacccgccccagtggggccgggaatgcccctccgctccctgtgcccggtaacgcccacgcctcgcctttcgttcccttcacgagtgctgttgtcgaagcccccttgcccatggtccaggtatgagcggccctctcttcccacgttggacgaacacggtgtcgcggctgtccgccgcggcgctccttgccgtgcccgccatcggtatcggcggtctcatggcctacgtgcgctcgccgtacgtcactggccagcagcggcccattgaacagccgatcgagttcgatcaccgccaccacgcgggtgatgagcagattgactgtcggtactgtcactggtcggtcgaggagtcgccctccgcgggcatcccctccaccacggtgtgcatgtcctgccacgcacaggtctggaacaagagcccgtacctcaccgaggtccgcaaggcgttcttctccgaccagcccatcccctgggtccgcgtgcacaacctgccggacttcgtctacttcaaccactccatccacgtggccaagggcgttggctgcgccacctgccac

SEQ ID NO: 219 - DNA, 1272 bp, Myxococcus xanthus
cagcgtggcccgcgcggagggcggcacgctgttcatcgacgaaatcgacaagctgtcgctcaaggcccaggcggggttgctgcacttgctggagtcgcgcagctaccggccgctcggtgagggcaccggtgagcggcaggcggacgtgcgcttcatcatcggcaccaacgcggacctgcacgcggaggtccgcgcgggccgcttccgcgaggacctctactaccgcgtcaacgtgctgccggtgcgcatgccggcccttcaggagcgccaggacgaaatccccctgtgggcgcagtacatggtgaaccgccggcaccgcgagcgctcgccggacggccacgcccggttgatgaaggaggcggagcggctgctggtggggagcccctggccgggcaacctgcggcagctcgacaacatcgtccgccgcgcctacacgctggccatggtggagcacgcggacgcctcgggcgagctggtgctgcacgagaagcatgtcgcgcgggcgctcgactatgagcaggccccgggagcccggccgctgccggaggcgctgcgcgcggccgcgcaggccttcgtcgccgaagcacgccgccgcaatgccccgttggatttggacctggccgatgccttccgcggcatggtgctggggctcgccatccgccaggtggggcgggacgagggcttcaagctgctgggccgcgagagcctggtgaagaaccgcaaccaccacaaggcgctcaagcgcgagttggagaaggtggactcgctctacaaggcactgggcgaggagggctcgcccttctccgacttgctgtcggaggtcgaagccgtctgactcgcggcgcccgggaagctaccgggcgtcggcgtgggggcccgcggcgatgcccgtggcgccccgggccagctcgtcacacacgagcgcgtggagccggaaggccatgcgcgcttcctgcaccacctcgcgcgtctcgtcctcggccagctccagcccgtcgatgcgcgagtggaagcggacgcggaaggccgccagcccggcctcgggcaccgtgccgtagaaggtggtgccctggccttccgccaactcgaaggcgtccgtgattcgccgcgcccggcgatgcccgctgaagacgtccagcacgcagcgtgcgtaggcgtgcgccaccagcaggtgaggggcgtcctcggccacctcccggatgcgctcggcgtgcagccgcgtctccacgcaggcgaaagtgtccgcccgggactcgccgcagaagtacgtca

SEQ ID NO: 220 - DNA, 1476 bp, Myxococcus xanthus
ctcatccagtaccccgggacgaacatcgcgccggtgtactcgacgcccggcgtgccggtcgtgttccggccccaggccatgcaggacatcgaggactggctcgtgacgcatggcgagcgggtgatgttcatctatggcgacctggacccgtggaccgcggcggcgttcccgctcggcaacgcccaggactccttcgtgttcacggctccgggcggcaaccacggaagcaccttcaactggcttcccaccacccttcgggaccaggcccaggacatcgtgcggcgctgggcaggcgtcccgtcactgaagcacgccccggtgccgctcccggaggccgacaccgtcgagttcggcccacacctgccgccccggcggctgcaaccgcccccggccccgtaacccgcggcgaacgccgctcaccggagaagccgttccggtgagcggctgaatccatccaagccacccacggccgcggccccgtatcaagccgtatcgtgggtacgcttccacggggcgccgtccagcttcacggccctgcccgtcacgctcggcgccctcgtgccctgagcgtgacaccggcccggcgctgacgtgtcatccctccaactgacgcgtcagcgccgcgtgatacacggcagctcgctcgccaaacatcgaaaatcacatacatttgagcagcaacaaccgtggcatatatcgtgctcaagccacggagcgatgctgctccacaagcacctcacccccgagctgaaatcccggctcgaacggctcacgacacgcaacggctggacgctccggaagaccatccagagtggcctggaccacggagactcccagatgggtgtctacgcgggtgacagcgagtcctacgcgctcttctccccgctgctgcatcccatcatccgggaccattcgggccatgacctgagcggacacacgagtgacttctcactcgacgggctgccccagggcgacctggaccccacgggcgagttcatcctctccacgcgggtccgcgtgggacggaacctggcccggtatgcctttcctccggccattggcgccagggacagggccgcgctggaagccgaggtcgtccaggtcctctccggcctgaggggccacctcacgggcaaataccatcccctggccagcctctccgaggcggagcggctggagctggtgcaccaccacgtcctgttgcagcagtcggaccgcttcctggacagcgcgggcgtcaaccgcgactggcctcgcaaccgcggcatgttccactccgcggacatgcgcttcatcgtctgggtcggggaggaagacgccctgcgcatcatcagcatgcagcccggctcggggctggcgcagacctacctccggctgcagacggggctcgagcagttcgacgggcaggtcgacttcgcccaggactcacgggtgggcttcctcacggggtgccccaccaacctggggacccgcatg

SEQ ID NO: 221 - DNA, 1254 bp, Myxococcus xanthus
cggcgcttcgccttatcgctatctggacgtgcagggcattccgggtgcgtcggacctccgctatgcggaaggtgcggcgacttcgcaaccgcatcacctggacgtaagccgcattccgggagcgtcggacctgcgctacctggagtcgccgccccgcgcgccgggcgcatcggagcaacgctacctggagtcatctccgcagcgggcaggcgcctcggagcgtcgttacctggatgccccggaacgggtgtcgggcgtatcggagcgccgccacctggattcccctccgcaggggacaggcgcttcgggtcgaggcttcctcggtgctccggctcaaccgtcgggcgctgccgatacgtcagcacgcacagaaaccggaaccaccgcgaaggatgctcacggcgccggtactcatccccccgcggtcgaggagaaccaccgctacttcgaggctccgccacgttcatccggcgccacggttccgagcagcgacgcccaggcgcagggagacgccgacgcggaggaggaccaccgctacttcgaagtgcgtcggtcccgtgcggaaggcgcggcgcatcgtcgcacggcgactccttcctccttcgaggcccgcgaggaccacgccacccacgacgcggcggagccgcctccccggaagccgccttcggacgacggccgctcctgaacccgcacggagacattgaacgaccatgagcctgggctccctcgcgttggtgctccacgcgcaccttcccttcgttcggcaccccgagcatgaggatttcctcgaggaggactggctctacgaggccatctccgagacgtacctcccgctgctccaggtcttcgacggactggcggaggacggcgtcccgttccgcctcgcgatgacgctgtctccaacgctcgtctccatgctgcgcgacgagctgctgatgagccgctacgcacggcggctggacctgctctgcgaactgggcgcgcgagaggtgcatcggacgcgagacgacgccaccttcggccccattgcccgcttctaccgggaccacttcgagtccctgcgccgcgcgttccatgaccgctacaagcgcgacctcgtcgccgcgttccggcggctccaggacgagggctacttggacatcctcacctgcaacgcgacacacggtttcgtgccgttgatgcagcaggtgcccaaaaccgtcaacgcgcaggtgacggtggccgcgaaccactaccgccagcacttcggcaggg

SEQ ID NO: 222 - DNA, 1537 bp, Myxococcus xanthus
taccgggcggcaggaaggacggtgacgactggacgcgggacatggagcgcccccctgcatccctgccgccagtcctcgccccagtcccatcaaccccttggcaaggcccgacgtcccgcttcccgtacgccccatcctccctttcggagcaccctttcgccccgcaaagcagaagggccggccccacactcgcgtgggagtaccggccctctgcgttacttcagcggctcaccgcttccgaactaagactggcggaactcggcgtccaccacgtcgtccttcttggcgctggcctgcgagcccggcgccgcggaaggaccagcacccggagcgccctcggcacccggcgcgccgcccgtggcgcggtacatctcctcggcggccttgtagctggcggcctggagcgcatcgagcgccgtcttgatggcgtccttgtcctggccgtcgcggaccttgttgagctccgccacggcgtcctcgagcgccttcgccgtgtccgcggacagcttgtccttgttctccttcagcagcttctcggccgcgtaggactggctctccgcctggttcttcatctccaccagctcgcggcggcccttgtcggccgcctcgttggagcgggcgtcggcgaccatcttctccacctcgtccttcgccagaccggacgagtgggtgatggtgaccttctgctccttgcccgtggccttgtccttggcgctgacgttgaggatgccgttcgcgtcgatgtcgaacgtcacctcgatctgcggcacgccacgcggcgccggcggcatgcccgtcaggtggaagcggccgaggctgcggttgtcgcccgccatctcacgctcgccctggagcacgtggatctccacctgcgtctggccgtccgcggccgtggagaaggtctccgacttgcgcgtggggatggtggtgttgcgctcgatgagcttcgtcatcaccccgcccagcgtctccacacccaggctcagcggcgtcacgtccagcaggaggatgtccttcacctcgccggagagcacgccggcctgcaccgcggcgcccaccgcaacgacttcgtccgggttcaccgagcggttcggctccttgccgaacaggcgcttcacggcctcctgcaccttcgggatgcgcgtggtgccgccgacgaggacgatctcgttgaggtccttcggctccacgcccgcgtccttgagacacttgcggcagggctccagcgagcgctcgatgaggtcgtcaatcatcgcctcgaacttggcgcgcgtgagcttgacgttgaggtgcttcggacccgtcgcgtccgcggtgaggaacggcaggttgatgtccgtctccatcgcggcggacagctcgatcttcgccttctccgccgcctccttcaggcgctggaggaccatcttgtccttgctgacgtcgagcccggtgtccttcttgaactcggtgatcagccagtccatgatccgcaggtcgatgttgtcaccgcccaggtgcgtgtctccgttggtcgcgagcacgtcggccacgctct

SEQ ID NO: 223 - DNA, 1123 bp, Myxococcus xanthus
gtcatccacgcgccgcaccccgtggctgtggaccgggtggacttctcgggcatccaagacgagtcgcaccgggaagcggaggcgctgaagcgcgtcaccgccgatgcccggcgtcccttcgacctgacgcagggccccctgctgcgcgtcaccctgttgaagctggcgccgtccgagcacgtgttgctgctgtgcatgcaccacatcatctcggatggctggtccatgggcgtgctggtccgtgaggtgacctcgctctacggcgccttccatgccggtcagcccgtgtccctgcccgagcttccagtgcagtacgccgattacgcggtgtggcagcgggggtggctccagggcgacgcgctgaaccagcagttcagcttctggaaggagcagctcgcgggcgctccgcacgcactggagcttccgaccgacaagccgcgcccagcgttcctcagcacccggggcgcatcggtgccggtgcaactctccctggcgcacagccagggcgtggagacactggcccagaaggaaggcgtcacgcccttcatggtgctgctcgcggcgtaccacatgctgctgaaccggtactcggcccaggatgacgtgttggtgggctcgcccatcgcgggccgacaccatgcgcagacggagagcctcatcggcttcttcgtgaacacgctggtgctgcgcgcgcgcttcggccgcgagctgaccttccgccagctcctggcgcaggtgcgggacaccacgctgggggcctacgagtatcaggacctccccgttgagcgattggtggaggaactccaggtggagcgggacccgagccgcaccccgctcttccagacgctgttcactctgcagaacgcacccatccccgagctcgtgttgccgggcctgacggtgcggccggcggacggtgaggacaccggcgtggcgctgttcgagctgagcctggacctgttccgtggcgcggacggcttcagcgggacgctcaactacagcaccgatttgtatgaagaggccacggcccagcggctggcctcgcactaccaacggctcctggaaggcgtcctggcccggccggacgagcgtgtcgccgcgctgccgatgatgccctccctga

SEQ ID NO: 224 - DNA, 1342 bp, Myxococcus xanthus
cccccgtgcgcatgcaccacgaacgcacgctccagcagcgaagccgccacatctggcgccaacgcacagggaagcaacagcgagggcgccgcggcatcccgccccaggtacacggcgccgtcgacccatggcaacgacgccgaggccccgaggaggaccaggagtccccgccccgcgacgccttcccagttggcaaggcgtgcgtcgtcctcggcgagcacccggcgcgcgagcgccaccgccacggggccttctcctgccacggcgagcggctccagcggctcggcgcgcgaacgccaccgcacgggcaggagagcggcgtcttcgccgcgcgtctccagcgcgtcccccgtccgcgagtctcttcccgttgcgctcacagcgcgtcagccaccgcaccccggccccgcggcggcgcctccggaaaccgatgcgcggagccttcagactcgcgggcctgcgtccaggcagtggcggagacagcgcgggaaccctgcgcgctcacaccgccacctccgtttcggacgactcgagccctgaagcgccggaggcgagcacacccgccacctccgcgcgaagcaccttcaagtcatcgggaagcgactcgggagcgaagcccgcgtccatctctcgcgccacgccctccaacttgagccgccacgcggcgagcgcctcgccattgccatccacgggccgctccgccagcagcgcctgccccgcggaagcgatgcgccgcgcacgcgccagggggcccgcgctggcctccagcgccgccgccggcagggccgggttctccgtcccggcgagcacgtcccgcagcacgtcccgagcgagcgcctgggcctccttcgtcggcacggcatacacgagcggccacaggtccgcggtccctggcgtgcgccggcccgcgagcgccgcggcggcggcgatgagcttctggaccttcaccgcgcggcggtcggacaaggccacgcccgcggtgcgcaacgtgcgcagcgcatgcgccagatgagggcgcaccccggagaggtccgcctcacgcgcgacctgggcgaccacgtccagggactccagcgaggtgacttgcgcgtccgcgtccccccacagtgaagcgccgcccgcgagcaattcctccagccgcgggtctggcacgggctcgacgaagatgcgtgcgaggaagcggtccgcgaaggcggccagcgactcgtcttccggcaaggcattggaggcgcccacacagacgcgcagggggcagcgcatccgggtgtggccgcgccggaaggtgcgctcattgaggaggcccagcagcgtatttcaggatggcggtggagccccaggaaca

SEQ ID NO: 225 - DNA, 1398 bp, Myxococcus xanthus
gctctacgtgtcgcgcttcgcggccctggtgccccgcgcctgcgccgtgcgcgtggatgcactcgatgagcacggccagcccgtgacggtccaggcccggggctggtacgcgcgcattctccaacacgagctggaccacctggacggcacgctctacgtggaccggatggagacacggagcttcaccaccgcggagaaccatcgccggtaccaggcggggcgcagcaccgaggagctgcgcgccgagctggggctgccagtgcccgacaaggggtagggcacgacgtctttcgcgtcagccttcgcggccgtgcgccgcggccttcaactgggccgtgtcgacgcggacgaagatggaatcacccaccgcggtcagcgtctcgcccgcgaagacttcgcagaggactcggctcttgcgtccgacttcgccctcgacgcgtgcacggagggtgagcgggacgcccatgggcgtgggtttgatgaacttcacgcccaggcttccggtgacgcattcgatggccggcgagctgccaggtgagcggccctcggcgcggtagtggtacgccatggccgtccagttcgagtgacagtcgaccagcatggcaatcagaccgccgtagacgagctccggccagccgctgtaccgggcatcgggcgtgtggcgtgccaccacgtggatgccgtcctcatcccagtagctttggatgtgcaggccgtgagggttcttggtgccgcagccgtagcagatgccttctggcgcgacgacttcttggagagatgaggtttccatgtggggccctgactgcaagggaggcgcaacgatgcgcacatcctggcccagcaggggcctttcgtcgcgtgtctcgtccatgcccaggatagtgtccgtgtcgatgctcactgaagtccaggcaggtccctacaccgtccgaggcgtgtccgtgggcggcgtgtacacgtcgctccaggtccccgaactggacgtagtgctcgacgtggggctacccattcgctccttctgtggctcggaccgcatcttcttgagccacgcgcacccggaccatgccagcgggctcggctcgctgctcggcatccgtcggctcatcggcaagggggcaccccaggtcttcctgcccgcggagatcgaggagaacgtccaggcgtcgctcgccgtgatgtcgcggctgcaccacacctccatggaggtgcacaccgtgccgatgttgccaggggacgtgcggcccctggggcaaggtctgttcgttcgcgcattccggacgcatcacccggtgccgtcgctcggctaccagttctttcgccgtgtcgcgaagctccggctcgagcaccagtcactcccgcctcaggaaatcgccaggcggcggcaagcaggcgaagcgc

SEQ ID NO: 226 - DNA, 1638 bp, Myxococcus xanthus
agtttcgaccggattcgcgcgttggcgtcccagcgtcagcgtgggcctgaaccccgcggtccttctcacggccggtcgttccagaagccgaagccgcagggcggcccagggccccggttccccgcgcccaagcccgggcgcgagtccgaggacgacagggcattctcgatggagcccccgcgcccgccgcccgaggcgcccgttgaagcgcccccacctgttcccagccgggccgtgacggaaaccccgattcccgtggccccggagcccgtgcgagccgagcccgtgcgagccgagcccgtgagcgtcgagccgcccgtgactcccgcacccgaggcagaggcggctgcgcccaagcggaaggcggcgcggaagaaggccgtggcgaaggcaacgcgcaccccggcgcggaagaagaccgtcgcggctggcagcgccaggcaggcggccgccacgaaggccaagaagcccaccgccaaggcgaagaaggctgcgcctgctcgggccgccgcgaaggccaccaaggtggccgcgacgaagtccaaggcgaaggcgccgtcgaagaaggccgcgaagcccgccgtggcgcgtgccgcgaagccagcgaaggcttcgggagccgcgaagaagaaggcgccttcggggcgaaagaagcgctgagaccgatgcgggcctcctacttcaagggaggcccgtgacttcaggaggcaacgtgagcttcgtccggctgctgggtgtcatgctcgccatcgcgggcgccgtgttgctgtggtccgggctgaaggcccgggactcgctcgcggagcgggccacggagttgatcaccggccggaacaccgaccgcaccacgctgtatctggcgggaggcggcgcggcgttggtgggcggaatcctgatggtgctcgcaggcggaggcagacggcgccgctgagtcgtgggcccgaaatccagatggccgccatcggctgaaacacgaagggcccggaaccggctcgcggttccaggcccttgtgtacggtccggcaggctgcggtgggttactgcgcgggcgccgccgccttcgcggccttctgtgcctcaccgaacttcttcgtcatctccgcgaactgcacctggtactcgtccatgcgcttctggtgctcgtcggcgcgagccgtcgcttcggcgacgacttccttgttcttcgcgttctcggccgcctcggacagcgccatctccttctgctgccgctcgaactccatcagccggcccatcaccacgcgcttgttgaggtaggtgttggcggagttggggttgatggcgatgacctggtcgtaatagctgagcgacttctccagggactccttgatgatgggcgcgcccatggagcgggcgccgtcgcgctgagagtagatctccgcgatccacccgagcgacgcctcgtccttcggctgcagcttgagggcctcactgaagtacttatgagagtcctcagtggtgccgcccgtcatgtacatgctagccaaagggccgtagatctccgccttgttcgcgggagtcgggttgagatatgccatctttaagaccggctcagcgggctcggatatctagcgaatctgcatgtgggaaaaggacttattatctcataccttatgctga

SEQ ID NO: 227 - DNA, 1339 bp, Myxococcus xanthus
gcgttgggtcatgcccaacaccggtgggacggacattctgtcgatggccaccgcgtacaatgggaattccctcggactgccctggaagacaggcctcaaacggtcaatctcggcattcaccggcacggtgcacttcctacatcatggacggcgcgttgtgatgagtgcgcctgacgcaatgagcatcctcgacccgcagacgggcaagcaacctccacaggtggcgctctcagacaagcctcgccacctctgcatcccacagggcgacaccgaccccatctgggtcgatgtttcggatgggcagaacctcctgctcaacacgaaaacggctgccgatctgcccgccatcgagccgcccccctcctgcgcgccgttcaaatggggcccccggatgtgtcccccccagttggtgaggaggagtcccatcccctgtgaacgcccgcgcgacctgccggacgttcccgggttttcggctcagcatgtctacaagctgaatgacctgaacgtcgtcctgggtgagcggagtcctgggagccgcgtgcccatggcggcggtgttccagcagggccagaaggtcccgttgtggcatggcaacgtcgccgacatggaccccaagatggtgaaggagcgcgtggtggaggtcctcgccttctccgaggacgcactcgtcatggtctacgagttgaaggaggggggagcgcagctcattcgcagagacatgcggacggggagcgtcagttgggacgtccctattcccaactccaagagcggctcgggggcgtccgacatcaagctgcacggtgggcgcgtctacgttccgcattgggtgtggctggatgtcttcgacgcgaagacgggcaacctgattggcaccctgggcaagtggtgacgccgacgcagtgtccgcctgcacgcagacatgagcagggctggccggggtgaaatcgcgcggacgcgcggccggtcgtagagttccgggccatggacacccggcatgtcgtagagcgggccctcgttcgcgaggcgcggcccgaggatgacgcggtggtgggggagttgttggtggatgccttcctcacccagtacgcgaagaagctcccggaagtcgtctatggcgaccagcgcaagcgcgagctgcgggacgtcccgtcccggcgcaaggcggccaccgtgctggtggccgagttggacggtcaggtggtggggcaccgctctctcttcaaggcccgtgcccccggctacgaggtctgggttgccaacgccgatgactttggcgggcctgggccaccgcccgggagtttacccatgggcaccgggggttgggccccagccccctttc

SEQ ID NO: 228 - DNA, 1239 bp, Myxococcus xanthus
cttcagcgtgaagaggcggtccggcgacgcattgaaaggcctgcattttacgcggcgccaccagcccccagcaggtggatgaaggccacgatgacgccccccgccagcacggcccgcccagagagcgtccagggcgtgggagcgctgggggcactcgcgggtgcgcgtgccatcagccggcgcgccacgcccgccacggccgcgcccgccgccacgtaggggatggcggagaagagggcttcactcacggctgacctcgcttggtgtgcgcgttgaaggcaacgcccatgaacccgagcaccgcgagcatcccgacgaggcccaggtagaagaagtccctgtccgtgcgaggcttgctgccgtcgcgcgacacgtccgcgaggtacgccttgagggcgtattgctcctcctcctccagcggggccttcgcgtacagcgcggccatcatcggcgtgtccagcttcgccaggagaggccgcatgccgcgctcgcccatgcgcgcgaaggcgaaggtgaggttggggcccagcgtgccgccacccgccacgcccagcccgcgcacgtcatgacagccgaaacaggcgggaccgcccttcgccagggcttccgtgccctcgaagagccggcggccgcgcgcaacctcttccgaggtcgcgtccgtgcccatcttcgccgcgggcgacggcttgcagccgccctcccccttcttcgtgcagtcgcggaagaaggcgtagagggcgccaagctcctcgggagcgagttgctggtccggcatgcggatgccgttgaactgcttcagcagcgcgttggccaccgggtcgccttcgtcaatgacggcgccggggctggtgatgaagcgggtgacccatgcctcgtcgcgccgctccatgacgccgtgcaggtccggccccacgcggtcgccctgcgcccaccgtgtgacaggtggcgcagcgctgcgtgaagagcgtggccccttgcgaggcgctctgcgctccccgcactggcgccgccaccagggccagaagctgaatgacggggacgagcccccgcgccatgcgcggtcgtccttcctgagcgtgtgtccgcatcggcgcgtgcccctcctccaagggaggccgggctcactgtccggcacgcacgacacgaattgcaatgcgagggccagaatgacgatagccaacacccaggcgaacatgcgtgggggttggcctgatgcgcgcagcatttgcgccgcgcgcc

SEQ ID NO: 229 - DNA, 1690 bp, Myxococcus xanthus
ctacgtggcgccctggatgacgagcaggggcctgcgaatcttctccgcatggaacagcggggagatttctcgaagcatcgcttcctgcgtctgggggttgcccagttcctggtagagtgcctcgcgcagggcctccttgtggggcggcagctctcgcagcgcgctcagccagtctgagatgccgaacgcatccacgcccacggcgaagacgtcgggatggaacgccagcgccgcgagcaccatgtatccgccgtagctggggcccaggatgcccacgcgcgcgccatccacgtaggggagggcggccaggtacttcttcgcctcgacgcaatcctggagcggcgccttgccgtgctgctggtcatccgccgcgaagaacgacttgccgtagccctcgctgccccggttgttgacggcgagcaccacgtagccgtggtggacgaggaactggaagaagctgctgtagcccttggaggactgtcctcccggtcccccatggacgaagacgatggcgggggcgcgctgcttcgcggtggcctgatggggcttgtagagcagcgccggaatctccagcccgtcgaaggacttgaagcgcacccgctccgactccaccaggtgctgggtgtccagagcccggcccagcgtgtcggtcagccgggtgagcttcttcgtctcgaagtcgtagacgtacaggttgccgggcgagcggtctccgtcgacgtggaaggccatgcgcttctcaccgcgggacagactcacaccggagatcgccccctctggaatccctggcagggacacgcgcctgccggccttcacgtcgtggacccgaagcgtggtgcggccgtcctcgttgacgcgggtgatgcgccacgcgccgcgtcgcgagaacaccgtggaaagcacgtcccactccacctgctccaccaactctcgcttccgggtagcgagcacgtggcgctccacgcgaatgaactcggagccctcgttggtgagcaggtacagcgcggaggacgccgggtcgaaggtcgccgccttccaactgaccgagccctcgtgcgcggtgaggtgccgacgctgctgggtggcgaactcgtagaggtagacgtcgctgtcggacagcgtccgtgacttctccagcgccagccacttctcgtccggggagagggcgccgggcacatgctcgctatcgcccgcgtagagcagggtgcgggcatacgtcttggcgtcgtagcggtagaggtcctggaagcgtgcgtcgcgctcattggtgaggacgtagaaggcggcgccgtcctggctccagccgaagaaggacgcgcggtgctcgtcgcccggcgtgaggtccttctcctggccgtccagcgtgcggacgtagaggtggacgagttcgttgcctcccgagtctcgcgtgaagaggacgcggtcatcggtggggaagtaggcgacggcgatggaggcgtcctgggtggagcgggtcagttgcgtgggctttccgcccgtcaccgggacggagaagacattgaagacgccggtctcgttcgacgagtacagcacccgcttctcatccgaggagaaggacgcaccgagaacggaggtcgtctccatgaactgctcgacggtgtaacgcttttccgggcctgggggcctggtcgccccggcgcgggagcggacagcgccagtgagggaagga

SEQ ID NO: 230 - DNA, 1770 bp, Myxococcus xanthus
cgtgcttatggggcctccttgatgaaggggcgccctagcggtgtgggcgcttggccgtcccgctccggccgccataggcctgctggcgcacgggtttcgcgcggtacagaatctcgggtccgtcatcttccgccgtgcggtggatgtcggttccgtacaccaccagccggcgcgtgcaggagacctcgtcttcttccgtgagacgtatgaccgcaaccgcgatggccgccgcaatgacggcatgacacacattggcgtggtggaggccgtggatgcgcatggcaccgtcaccttcatccaccggggcggcaagggcgtcgcgcgaaaccggttgaacctgtccttcccgtcaggcaccagttggagcaggggcggcccgtggtcaatgactacatccgccccgccgcgaaaggctcgcgggcctatctcgccggtgagctgttcgcggcgttcgcgtcgcctgagggctgtaactttccatgcctggctcataccctggggctttgaagatgtgccgcgctgatgcgtcatgggtggcatgcgactcgcccttgtcattggctgtctgatgctcgcttcgggttgtgtcctgcacacccgctcaccttctccgcatccaccgcctcctccgcatcgtccggtggcgatgacgtaccgggaagcggtgaacctgggcttcaaccaatgtcgctcgcgtggctatgagtgccgcctgaaggacgcggaccgcaaggggcgggacgtgtggcgggtgaagttccatgcctccacgcggagggcgaagggccacctgcacctggacttcgatgcgtactcgcgcagcctcctgcgggtggatgacaaggtgaaggcccgccgacatgactgggacgacgatgaccggcgcgggcgcgggcgcggcaagaagaaggggcacgcccggcgggatgactgagtcagtcgctcttctgcttgagtgacttgatggcggtcgccgctgcttcgtggccgcagtccttgctgcccaggaggcccttcgccttggggagcgaggtgacgcgctccatcgcggggatggcatccgcgtcacccaggcccgcgagacggttggcggcctgggtgcggatgtcgcagtccggggagttcagcgcctcgctataggcgcgaaccaggttcaccccgtccgcggccttcacaaactccaggtagcgcagcgcgccccactggcgcagggagtacgcctcctcggccaggtcctcgtagtgggcgcgcaagcggtccttcgggaaccgggccagggcattccccaggacggtgagaggctccttgccgtagtcctccgccaggccgtcgaggatgagcggctccacgtcctcgagctcctcctccttcaggtggctgagcgcagtccgttcgctgatgtggtgccccttggcatggttcgccgccacgcgcgcgcgcctcagcgagggcagttccttctcctcgtcggtggcggcgtccatcagcgccagggcttcgttcagcttcccatcctccagcagcgcgaaggcccgggtgccagcgtcgttgcgctggctcagccacgcggcgccagcgcccaggagcaccaccgcgccggcgaccagcgccgcctcgcgcctccgctgacgcagcagctcccccagtccggtgggcagcttcacggcctggagcttcgccagcaggggcgcgagcgcgttgccccggctgccttgcgaggcgaagcggtctccaaagggcgggccctccgcggcgcgctggcagcggtag

SEQ ID NO: 231 - DNA, 1620 bp, Myxococcus xanthus
aaagctccagcgagtagggcgtgtagatggtcttgctgcgggtgatgaaacacgggcacagcgcgacgggagtgccctgctgatacgcaatggcatatcgcagggacagctccccccgggccatggcggacaggtcgaccgcgtccaacatgcggaaccagcgccggccgaagaagacgctcgactcggaggtgagggcatccagctccgcgtcgctcaggtggctgacggagtcgtggaatttcagggtaagcgtcatggccggggggcttcgtcgggcgcggatccgctcagccgttgaggagctggacggcggggtgccgcttggagctggcgaggtgccgcgcgaggttggggcgctgcttcatgcgctcgaagaacccgaacagcccagggtaggtgctctccagaagatcctggaggccgttgtccacgagcagctccaggaagccgaagacgctggtgtccgccaccgtcacggagggaccgacgaagaagccatcaccgctgccgttgctcttcagcaggcgctcgaagtgcgcgagccactgcggcagttcctcgcccaggatgatggggagctgctcggagagctggtctggcgtgagcgaggtcaggctgcgcgcacgcgccgtcacttcctcgacgccgtcgatgatcatgtcgcaggcggtggtctcccgcgcatccttcccatagaggccgcgggtgcgcgcgacgtgacgcaagatggccaggctctgcaccacgcggaagccgtccggctcctcccacagcggcaccttgtcgaaggccagcatgccagccgccttgatggcctcgaaggcgggtgtcttcaccttggcctgcacgtcataggcgcccaggtcgatgtcctcgtactccgttccggactcggcgagcagcagacggatcttctcagcgacgcctcgacccgtgaaatacgacaggcgcggcaatgatgattgagcgttcatacagggttcgtggttggaagggagaggctctatactagagtaaacgtattattcggaaggggcagacttccttgaaccccgaagcacccgcgcttgtctcccttgctccaggaatggccctgtggccgtgggccgcgctgcgtggcgccggctttcccgctcaggatgcgctccgtctcgcggctccgacagcggcctccgccgccgatacatggctcgcgtctggggttgagacacccggtgacgcactgcgcaccgtgttcgactcggacctgctgggtatcagcgcggcgctgcgctcgctggcgggggagtcccacctgagcgaggccctcctgtggcagaaccgccatgcctacaagacgggcgtggagccgctggcggcccttcccgccaccgctcggaacagcaaggcccggcagcgtgagcggctggtggcctcctacgtccagcgctacagcaccaagaacgacaccatcggtttctttggtcccgtgggttgggctcggctcacgccgtcgaatgaagggctgcgctggacgcccggacagcggctcgtctcccggcgcgcggtctatttcgagacatggtgcctggatgcgctcagcgccgccctggcgcgcgacgcgttcctgggtcgctg

SEQ ID NO: 232 - DNA, 1722 bp, Myxococcus xanthus
gacggggtccacccgggcgagctcatgtccttggtggcgaacccgcaaatcgcgccgttggaccaggtggagccgttcacgccacccgcggtgacggcgctggtggccaaggcgctggcggtggacccgtcgcagcgcttccagacggcggaggagtttcgcgggcggctccaggcctgcctgatggagattgactcgagcgcgggcccggagagcgtcagccgcttcatgcgcgagctgttctcggcggacttccagtccgagcggcgtctcctggcgagcctcaaggaggtgccgcgcctgtccacggcagaggtccgtgcgctggcctcgatgccggatgatccgctggcgccgaagatggcgcacgcgatgctgccggcgaagaccatccgactggatggcccggtggagccgctgtcgttcttccccacgccccgcagccgcgagggcggtggtccggtgacggacggtgagacgcgcccgggtgtcccgatggacgagtccacccggcccggggtccccatcgaggcgctggaggacgaggctcggacgcggggtgcgcgccaggacacggcgccctcggtggaggtggggccggaggccttcgttcgcggcggcggggtgagtccttcgtctgctccgattcctcgcgcgcccgcgctgacgcgcgaggtccagatgacgtcgatgccgcccgaggcggtgccgccgggtgtggccgccgcgcgtgcgctgcttccgtcgcacatgcggccgaccgagctggcgatgccgagcctgggcgggccgtcttctcccgaggacgcgtccgttcaggtggagtcgacggccgcgaaggccgagtcgcttcggggcaaggcgttcgaggcgagcccgagcgtgattgcctcggtgggcgcgcccacgcccgcggtgccgctgcgtgggtcgcagggcacggtgaactcgcgacctccgccgccaggggccgagccgcgcgcgcccggagcggtgctgccgcgcagcggcgtggtggtgatgcccgcggtcaacgtgcctgctcccgcgccgatgcctcgcacgtcggcgctggagtcgatgccggccgttgaggtctcggagggggctgccggagacgaggacgccgcctcggagcgcgagggcgcgtttgggagtgcgccgccggccgaggcggcattcagcgagctgcatccttccggcccgatgcctcgaacggcttcgatggtgatggccgccgtccagccgcctccgcctggctcgacgccgtctcgcgcgatgtccgcggtgggttcgccggatgaggccgcggctccacgctccaggtcgtcggcgggcatgcccgctgtgggcgcgcaggcgggagtttcgactcgcgccatctcctccgtggaagtcgctgcgttggatgcgcgggacgaggcctcttcggacccggtgtcttccgtggacatgtcctcggagggcgggacgccgccgcgcagggtgtcctcggcggggatggccgcggtgtcgccagcccaggctggcatgacgccctcgcgggacatgtcttcgctggggacacctgcacctccgaagggggcaacgccctcgcgagccatcccccgttgcccctgcatcgggcgcgacggcttcccgctccgcgcccgtggtggacgagcccgtcgcggacgccacccccgctgatggggggcaggccctctccccggaggatgaagc

SEQ ID NO: 233 - DNA, 952 bp, Myxococcus xanthus
  unsure (1)..(952): unsure at all n locations
gagcttcccggagactgaaagatcaagacggcgctggaggtggagaaggcggcccgggcggaggactcgcgcatcatcgccttcaacggcgtgggcgccggggactacgtgtccgaggtgtacatggcctccaccgagggcgtgacgggcgcgtactccggcacctacgtgtacctgtacgccgcgccggtggcctccgacggcaacgggctccagacgggttactggatggactaccgccgcttcctggatgacctggacgggccggagtccatcggccgggaggccacgcgccgcgcggtgcggatgctgggcgcgaagcgggtgaagacgcagcaggtgcccgtgttgttcgacccgcaggtggccgcctccttcgtgtcggacgtggcgggcgcggcggacggcaacgccgtgtaccagaaggccagcctcctggcctcgctgctgggcaagcggctggcgggcgcgcacgtcacgttggtggatgacggcctcatgccgcgcggactggccaccgcgcccttcgacggcgagggcgtgcccacgcggcgcacccccatcatcgagcagggcgtgctcaagtccttcctctacgacgcgttcaccgctcgcaaggcgaaggcccgcaccaccggcaacgcgtcacgcagctacaacgggctgccctccatcggaaccagcaacctgtacctggaggcgggcacgaagtcgccggaggagctgctgcgcgaggtggacagcggcttctatgtcaccgccctgctcggccacggcaccgacccggtgacgggcgagctgtccgcgggcgccaacggcctgtggattgagaagggcgagctgacgcaccccgtgcaggaggtgacggtggcaggcagcctgctgcagatgctcaaggacctggacggcgtcggcagcgacctccagttccgcancggcgcggtggggcgcg

SEQ ID NO: 234 - DNA, 1421 bp, Myxococcus xanthus
ggggtgacatccacgctcagcttgcccggcgtcagctcctcgatgggcttgctcttcgccttcatgatgcccgggaggctggcgtagcgcggctggttgaggcgcaggtccgtggtgacgacggcgggtagctggcactccaccgtggccagcccgttgtcgacctcgcgaatcacctgcacgctcttcttgtcggcggagacgacgatggcgggaaccttgttcttctcctgctcgctctccatggactccaccttggaagcgaacgtggcctggccccagccgaggaactcggcgaggtactggcccacctggttctggtcatcgtcgatggactgcttgccgaggatgacgaggtccggctgctccttctccacgaccttctggagcagggccgcgatgccgagctggtccaccggaccggtgtggttcacccacacggcgcggtgcgcacccatggccagcgcgtgccggagctgctcctgcacttccttgccaccgatggacaccacgacgacctcgccctggtgcttcgcgacgagccgaagtccttcttcgacgccgatttcatcgaaggggttgatcttgtacttcagcccctcctgaacgatgcccgagccatccggcttgaccttgatcttcgactcggggtcttccacgcgcttggcggtgacgaggatcttcacggcggtgcttctccttacggggaggagtttggaatctggaaaaaactgtctgggttaataggcattggcgcgtcgcagcggcaatgggaaacggccgccggacgcggtgccgcggcgctacttgaacagttcccgcgcgatgacgagccgctggacctggctggtgccctcgtagacctggatgagcttggcgtcgcgcatcagcttctccacggggtactccttgatgtagccgtagccgccgtacacctggacggcgtcggtggcgaccttcatggccatgtccgcggcgaagcacttggcgtagctggactggagggagttgcgcttgccctcatccaagagccacgcgctctcgtaggtgagcatgcgcgccgcgtgggtgttcatggccatgtcggcaatcatgaactggatggcctggtgctcgatgatgggcttgccgaaggtgcggcgctgcgtggagtactccatggagtgctccagcgcggcgcgggcgatgcccacggagaacatggccgtcagcgggcggctgttgtccagcgtggccatggcgatggcgaaaccctgaccctcttcgccaatgcggttggccaccggaacgcgcacgtcctcgaacgtcagcgacactgtctcgctggcgcgctggcccatcttgttctcgtgcttgctgacggagagcccttcggggcggccctccaccacgaagcaggtgatgcccttgtgcttcttgcc

SEQ ID NO: 235 - DNA, 1722 bp, Myxococcus xanthus
ccggccttcccgtggttgatggtggggtttggccggcccgcggcgcgcaagcaattgcgggtgcaccccacccggttggccgcggcgggcctgctggtggcgctcttcagcggcgtcccttcgatgatggaaggccggcccttcctgtccggaatctgggggcggttgcccgtgccggggacggatggattgaaggtgggcaccccgcagctcttcgacctgggcatctatctggtcgtcctggggacggccatgtgcttcatcctgggcatggcccggggcgaggacaccacggcgccggagatggggggctaggcatggaactgttcctcgccatcaccgtgggcggcctcttcgcggcggggttctactgcctgatgctccacagcatcgtccgcatcgcgctggggctggtgctgctgggcagcgccaccaacctcctgatcttcaccatcaacgggctgcagcgcggcttcgcgcccctggtgcccgaaggccaggaggccctcaccccgcccttcgcggacccggtgccccaggccttcatcctcaccgccatcgtcatcaacttcggcctgctcgcgctgctgctggtgctggtgcaccgcgccgcgcaggagacggggaccgatgacacgcgggccctgcgcaccgagctgaaggactcccagcgatgacgccctccacgctgctcagcctgcccatgatcctgtgcctgggcgccgcggccgcggggctgctcgccccgtcacgcgcgtggccgcgccggtggctggcgctgatgaccatggtgtccctcgccgtggtgggcgcgatgctgctggtgacggtgcgccgcgaaggcatccagtccatgcaggtgggcgggtgggcggcgccctttggcatcaccctggtcgcggacctgctgagcgccttgctggtgctcgtcaccggggtgatgggcctgacggtggtctcctactccgcggccacgctcccagcgtcgaaggaggcgggcgcctactacccactggtgctggtgctggtgggcggcgtgtgcggcgcgttcctgaccggagacctcttcaacctcttcgtgtggatcgaggtcatgctcggcgccctcttcgtgctgctcgcgctggaggcccgccaggagcagctcgaagcgcccatcaaatacctgccggtgagcctcatgggctcggtggtgctgctgtgcgcggtgggcctgctgtacggggcggcgggcacgctgaacctggcggacctggccgtcacggtgccgggcctgggcacgccgaacctgatgacggccgtgtccatgttcttcctggtggccttcgcgctgaaggcgggcgcctttcccctcttcttctggctgccggcctcgtaccacacgcccccggcggcggtgacgacgctcttctccgcgctcctcaccaaggtcggcgtctacgccctggcgcgcgtgttcaccctggtcttcacgcaggactctcagctcaccagcaccctcctgctggtgatgggcggcctcaccatggtgacgggcgtgctgggcgcggtggcgcagtacgacatgcgccggctgctgtccttccacatcatcagccagattggctacctaatcgccgccctggggctgctcacccggagcgcgctgacggcgctcatcgccttcctcatccactacatcttcgcgaagtcggcgctcttcctggtgagcggggccaccgc

SEQ ID NO: 236 - DNA, 1244 bp, Myxococcus xanthus
gtgggaagcgctcgtccaggcgcagcgagcggaggtccgtcaccattaagcgcgccctgcgtgagacgtcctcgggttccgagttccgccgctcctcggcggagcgaatcatcacccccgaggggtccacgcccacggcgtcatagccatctcccgccagcgcccacaccacccggccattggcggctcccaacaccagcacgggcccgccatgctcggccgcctggcgtgtgtagaacaggaggtccggctcctgagcgacaagagaaagtggcatccggccccgcgcgtcatgaccacccattcgaggaaggaagtagcacgaatccggcctcgcccgggacaggcacgtacacacgctgggaagcggattacccacatcgtgtccggcgcccgacggacacaccacgctccagggctgctcgtgctggcaccgtccttgcgaacgaacggggattgaacacgacgacccacttcgggccagtcggcttttcagcggggaacggtgacgagatgaagcgcggatggggatgggcgggcgcgctcttcgtggcgggttgggtgtggacgggctgtggctcgggggatggcgcgacgggcaccgagggcatggacgtcccgccctcggaattcccccaagccccggaaggcgatgcaggcacgccggactcgggcacgctggactccgggacaccggacgagcccgacgcgggagaaccggattcgggcacgccggacgacgacggtggcacgccggattcgggtacgccggacgacgacggtggcacgccggacgggggccccgtggaagtgcccctgcccacgccttccgcggcgaactgggagttcttcggccgcgaggcgggcggcccccgcttcatccacggcgtgagcgcggacgcctccggtaacatctgggtggcgggcggcgaagaagcgctcttcctgatgaagaagggtgagcgcaccttccggcgttacacgatggcggaaagcatgcgcccgtacgagtacatgccggacggcagcgcgccgccgggaccgaagtacctcaaggtcatctctgtcgcgggcgcttggaacgacaccgtcttcgtcggctactagggcatgccgggcgacggcgcgctccactgcgagaacaactgggacagcaacgtaccggaccccgagcgatacaagaacggtgacgccgaccgtgtctcactgcgcgcggacggcacgctcgacgtcgtgcaatgccc

SEQ ID NO: 237 - DNA, 1142 bp, Myxococcus xanthus
ctcccgcccacaggtgctcgcgtcccgcctgttcctgcgcgtgctgtacgagggtacgcgcggactgagaggcgtggggctgggggtcctcgggcgcgcactcatgaccttgagtcccaggcagcagacggccgactggatcgacgccatcatcgacaccctggtgcgttgctactcccgggaggcgagcctcccgcgtgctaccgcgcgcggcacctacttcgacctgctgcgctggctgcttcacatgaccagcgacttcgccgtcatcaccgacctggacccagctcccgcctccccggcgcccccgagtccggcccatgccggggatgcagaactcgctgcggaggcggccttcatcgaggagcaccacatccaggtccgctccatcgtaacggtcgcgccccccagcaaggcctggccacccaccttgttcaaggtgctgcacgcgctgactgccttcaatcctccgcaacggctgcggcgcacgcgcgaactccacgaactctggaccagcaagcaccaggtgctgcgtcccaccgacaacgatggcatcgtcaactccgtctcccaggtctggccggacgaggcccgcagctacctgctccagggcgatcatgcggacgtcatcgggcacttcagcgcgcaatgcccaccgtcccaggccagtgtcgcggccaccacgttccgccagtacgacctgctgaactcccccgcgggcttcgatcaacggcggttcatcaggctctggaaggacatcggccgcttcacggccagccagcaacaccgggaagcaacggcgcctcggccgcgcggtggagcgcgcatccaccacatcgggagcgcgccgccgcaccgagcggactcgtgaacccggccgcggagcccccacacagcgtcgtctggagcaccgccccccacacacccggacgattcaatccaccgctgccattcccatgatggcggggccacggcccccggccgaagcggttcgtctgacaggggctgtgacggtcatgggaggggtgatgagtggaaatgatgagaatgaggggaccgtccaacccgtcgcgggcgtgtccactggcgtgccccgtacggtcgccgtgcggggaatcaaaccggtcgcgaagtccacgctc

SEQ ID NO: 238 - DNA, 2125 bp, Myxococcus xanthus
ctctccagcatcgcgcagtgggtgccggaggtggctgcggctccggcgatgacgccgtcgcagggaggcagcaagggagcggtggcgtcgcaggcgaaggcggatgcccggagcgcgtccatggtgtcgccgccggtggattcgacgtcgccgacgacgccgatgccccggtcgctcgttgcacccgtggaggtgccggcggattcgacgtcgccgacgacgcccatgccggttgccatcggtggcgtggttcaggcgttggagccgcgctcctccccgcagcaggacacgcttcagtcgtacccggtggtcgtgaagacgcccgcgcttcgggcggatgcgtcagcgcgtggagcgtcccggcccagggcgcagtcccgggcctcgggggtgaaggtacaggcgccgcaggcgcgtgacgaagacgtggtggcgatggcggctgcttcgtcgccgccatcaggaggcgcttcaccggcgcctacgactcccgaggatgcggacgacgccgtgcatacgcggagcacggagtacgccgcgacggtgccgtcagggcggccaggagggcggattgccggcatcgtcggggccgtggttgcgctgttggtgggcggcgctgtcaccgtgatgcggggtgatgattcagaggtctcgcccgttcgtgtgaatccaccgccgctcacgcacttgccgcgcgagcctgcggtgccgagccaaggcggcaggaacgtgccgcaggagaaaccggccgcgaacgtgaatgcaggtgctcgggattcgaatgatggggcacaagcgaagccgcaggtttcgacggacgtctccgtggtgccgcaggaaccgcacgtcgcacgggatgccaccacgcccgaagcagggcttcccactgtgaaggatgctccgcctgagaacggcggagcggcttcgaaggaggggagcgctgtcgtggcgaagcgtgagcccgcgaaggcgtctggggatccagagccgaatccatcgcgggtccgtgaaagggcaccgactcagaaggtggcggctgttgcaaaggggcgcctggagttccgcatccgtccgtatgccgtggtgtcgttggacgggaaggtactggggcagacgccgttcgccgcagttgaggtacccgagggacgacacaccgtccggctcgtcaacaaggaactgggcaaggacgtgacccggaccgttgatgtgaaggcaggccaggccactgtgttcaagctcaatctcgaagcggagtgagccgtgcccgcaccgaggccacctgatacgtggcctcggtggtggggcttgctattgaggccagtggagaatctgtccgttgcttcctgcgacccagaggtctgcggggctggtgcctgcgatgtcgttgaatcggaggttcgtgttctcgaagatgatttgccactgcgtgccgtcgtaccggtagatgcgaccgttgtaggcggtgacgtagacggactttgcgccgaatgcgacgacggaggtcagtgtctcgttgttcgtgttggggaagggcatcctgctccacgtgctgccgtcccattggaggacagtgttctgcgtgcccatgaactcgcccactgcgaatgcggttcgattgttcaccacccagactccacggaggcggcccaggccagggatgtagtcatgcgcagcttccgtttgccagtccctggtgttttggttgaagcgatagatgcgccccctgctgctcccgatgtcgaagccacccaccgcgaatagcgctgacctggtacggccgtggacgtcgtatagcgccgagacaggggtcgttccaaatcgcagcgcacttgagccaaccgatccggtccagatgaaggtcagcccgtttccggaggtgccagaggttgatgtaacgccatgaatctccaagacaccttcatgtcgaatgccgacgagtccctccacccaccgtcccatggcgtgcgtctcggtgcaggcattttgtggcctgtccaggaaggtgaggcttcctcccgacgagccgaggtagaggcggccctggttggccatgtccgcccagacagcgttccaagcccctgttgcttgtcgcccgcaatttgggtcggcgtttgggtcttgaaaa

SEQ ID NO: 239 - DNA, 1229 bp, Myxococcus xanthus
aagcgctgtgggaggaacgcaggctttggagcaactccaggcgcctgttcacggccgcgccgtgggcctggtgccggtggactcgccagacgtactccgagtggatgtcgcggaggtcgttggcggcgcggtggagctcctctcagtcacgcgccgcttgcgaggagtgcgggtttccctggagcttccagaggatccggtccccgctaatgttagtcaccggcggctgcagcaggtgctgctgctgttgctggcgcacgcggcggatgcatcgaacgggcagggcgttcgtgtgatggtggattccgctgacgacttcggggacctgccgccccgcttccaggtccaggtcgcgggggcgtcgctgtcctcgcgggagctccaggcggtcttcctgtctccgatgttggtggggccgctgcaccgcaagctggcccgggcccgggagctgacggagtccatgggtggcaccttggaggtggccagcagcgcggccgccggcatcaccgtgacggtggagttgcccgcaccggggatgtccagctggtagtccgggcgggccgccatgcccgccgctgagccacgacttgaagaggaagaggagggcgggccgccagtgcctggccctcctttttcgttgagtcgccggggatgccggccgtgtcgtttcgcgctcgcgcggcggccggccgttcttccgcgcccggccattggctccgataagtcgttccgcgtgagcccgtggccaaactccttgacgtcgcggggcgggttctcgactatcccgcgccgattcttacacggtcacaccttctcatgagcacatccatggcgcccccgtcatccggagaaaagatctccctgcagagcggcaagctgtccgtcccggacaacccgatcatccccttcatcaaggtcgatggccccgtcccttacatctggggtgcgtcacagacggtgtttcacccccgggtgcacaaggcctacaagggcaagaacaaattcgcatggtaagaagtcctgtccggcgaaaagtccttcaaggcggtcaacaactgtctgccggagtagacggttgaggcgttccgcacctatctggtgggcatcaagggccccctgataaccctggtgggtgacggcatccggtcgctgaacgtggtcatacgacacatgctggacatgaacatccgcttgcgctccgtgcgatacttaaagggcgtgcccagccc

SEQ ID NO: 240 - DNA, 1542 bp, Myxococcus xanthus
tcgcgccctgcttaagggccgcctcaccggcctccttgcccgccgtcttcagcgcggccttggcggcctggcgcgtgccgctgccagtcaggccctgggccagggtgctggtcgccttcgccgtctcggccgcggcggacttgacggcccggcccacgcctttcgcggtgccaccctcgaagatgcccttggtggcggtgtccttgacggccttgagcacgtcgtcgctggcgttggggagcgccttcttgaaggcgtcgacggccttcttgccagcctccagcttgtccttgaagacggtgccgccgagcacgccgcccatcaccttgccgccgacgatgccgcccgtcgcggcggacaggcccgccttggtcgcgtcgagcgacgagcgcgtggcggtgatgatgtcgtccttgctaccggtgcggatggcctggcggatgtccttgacggccgtggcgcccgacatcaccgcgccagggatgcccgcgtagcgcgcggcggccttcatgccggcgcccaacttggtcaggcccttgaactcgcccgcggcgtaggtggggttgctgacgaacgcccggttggcaccggtcagcaggccctcggcgccgttcttgatgttcttgatctgctggaaggcatccttgccgtacccgaaagccttcgcgctctgggtggcaaccgccgtggcgcccttgatgagccccttgttgtcctcgacggtcttctggacgtccttggctaccttctggacgttggcgcgggcagagttgaaggtcttgcggatatcgaaacccatggtgggcctctcgaatttgaaatggacgaaatcgtagggattatcgcgatcaccccgccggagttgcgtcgggaccgacaatcccgaagatacctcaagggcagcgcccatggcggcgctggggcgcagctgtcccgaagctgaatcatgccctccgggtcctattggagaactccgacgcgcgtccctccgtcccaaggcttcgagccggggaggagaggacatgcgagcaaggagtggatgtgctctggtgtggctgggactggcgggatgtggggggctcccaggcgaaacagtcgaagctcgcgaggtcgccgcgcaggcatgtcccgccggggtggcctcgcgcgtcaaggtcgtcgttcctccggggtctggctcctccgtcaacgggccctacccggagtccctggtcgatgtgcaggggcagctctacttcgccaccaacttcttcgacggaagcgccgtcttgtggcgcagcaatggcacggaggccggcacgacctgggtcaagaagctggatgcgcaggcggttcccatcggacagacaggcttcgccgggaacctgggcctgttcctgttgagagacggccccaacaccgaggtgtggaagacggatggcacgtcggggggcaccgtccgcctggagacgttcggcaagttcgtcaacctgctcggtgcgctgaacacgtctgtctatctgtattcgatgaaccccagcacgaagcggctgcgcatcgaaa

SEQ ID NO: 241 - DNA, 1378 bp, Myxococcus xanthus
gtgctctaagacgttcctggagcaggcggagtcgaagggtgcgctccatcggcgcaggcggacctccgcccgctcgagcagcactttggcgtcaccccggcgttcgacgcgggccgcaacgccctgacgctggacgcggccacgctcgcgctgcgcgtggtggatgcggaccccgtcctcctgtccgtcctggagcgcgccgctggcacccccgccgccgagccaccgtcggtgccccgcacgccccccttcctgcaacaggtccgcgacgccctccgcgcctccctgcggaacggagcgccgcagatgggcgacgtggcccggcagctccacgtcagcccccgcaccctccagcgccggctcgccgagcacgccacgtccttccaggacgaggtcgacgcagtgcgccgtgagctggccttcgactacctgagggacgcgcacctgggggtcagcgaggtggccttcctcctggggtattcggagctgagcaccttcgaccgcgccttcaagcggtggacgggcatgacgccccgcgtctggcgcgaaaggcccgaagcgggctgaacccgggtggcgtgctcggccaggagattggcgtccgcggccaggaaacccggcgccacttcccctacgctgcggagcatccacaccccttcgcttccggaggacgcatgctcaagccccatgtcgtcgccctcttcgacgagtactactcctcgcatcagcacccgacgaaccggctgacgcacaagatcgccatcccgctcatcgtgctccacatcgtcgcgatgctggactgggtgcacttgatggcggtgcccgcgattcccggcggctcgctgacgctgggcatggtggtgttggccctggctgccgtctggtacctgcgcgccgacgtgaagctgggcatcatcgtggtgctcttcatggccgcgtgcttcccggtgggccggatgatgcccacgtggagcgtggtggtcatggccgcgttcgcgtggctggtgcaactggccggacacagcgtgtgggaaaagaagtcgccttccttcctcaccaacctggtgcacgcgctggtgggtccgctcttcttcgtcgcggtgctcctgggggactacgtcctcaagccgcagcagcaggccgccaccacgccggtccgcgcgtagtcccacgccatgacgagcttcgccgacaagctgcgcgtctggttgcccctgcatgagaacggcgtcagccgcgccgtgcacttcgtgggggcctacatgttcatcttcgcgttgctcgtcccgctcagcttcgtccggctgcccgtgggtgacgcggcgctcacggcggcgcacgtgctgctgctcgcggtggtcctctacgccgtctccct

SEQ ID NO: 242 - DNA, 1404 bp, Myxococcus xanthus
ctatgcggccttgttctgttggcggctcgggactttcaccctacgggtccatgagttcctccaggcatcacacaactaccttgacgctcacgcgcttcgtcgagaatgagcgactccccctcgacaacaaccgctcggaatcggcgctgcggaaggcggcgctgggccgcaagaactttctcttcgttggccacgaggccgctggcgaaaacctcgcgggcctctacgcgctggtggccacctgcgaggccaaccaggtcaatcccgaggagtacctggccgacgtgctgctgcgggtgcagacgcatcccaactcccgcatcggtgagctgctaccccacgagtggaaacgtcgacgcgtcgccgagccacccaacgcagccctgcagcccagtccctgaactcctcgctcctcgcggcgctcgccgaacacggcctacggccgcctgcaaccgcgcgcgccacgtccttggccggacggttacgcagagcatgttcaagaagccctcggccgcgactccgctccaggccccacccaagccgcacgccgattcagacactcaacactgacctgaagccacgccgtgggcgcgacaagaccgccaggaacctctggcccatacgagaataaactgcgcgcccgttgacacgtttatcgtcaacccatgatattcttcttgttgtgaaagagcgggtcgcccagacggcacacgttcttgccttcgaacttcacgtcgaaggagtacatcatgaactcccgctgggcccttcgtagagccactcatgatgccgccccccgcggtgccggcctcatctccagtgctcgtcttatactgagcacccttcaccatgggcatcttcccattgacggtgactttcttcggcccattcgaggcgtccgaggacttgcccaggttgggataaggcaagggcactggcccacccgggctcggcgtcttgcagacgtcggggaagacaacgctctgtccaccactgtcctcagcggaaataccgcgcccgttagcaaagactttcgttcccatcatcccctcagtatgcggacggctcttcgagcgacaccacccggactcccaccaacttcgcggcctcgacggcttgcttcacggcctccgacacgagaatgaccagtgagtcctcggcaagccgaaacagcggcagccccagggtcctcgattcgtcgacacggagcttcgtgaacttcatcaggggcggtttgtaaccaggaagatactccgatctgggcaaatccgcacaactcaccagaccaacaatattgactgccttgtagtgtgaataggtcttctctcgctcccgatcaatgacctccgcgtcatacaggtcgagattgcgaactcccgccccctgagcgcccttagagaacgg

SEQ ID NO: 243 - DNA, 870 bp, Myxococcus xanthus
gggacaggtgactctggtcgttcaccacgcccgggtcgtccgacagcgtgcgcaggatgtagaaggacaccaggtccacgttggcgtcctggcgcaagaggccacgcaggtagcgctcgtcccaggagggccgtcccaccaccagcagcacgcgcacgcggtcccgaatcaccttcagcgtgaaggagcgcgtgttgttgtccgccacggcctcgcccgggaaggtgggcaccgtcaccgtgtagacgaagcgccccgtctggtccggggtgaaggtgaaggccacgggcttcacgtcgtccgcggactccatccgcaccaccttgctggcgaccgtcttgccttcctgactcagcaccacggggatgtcctgccccgcgaagccgcggccgtgaatctccacctccacggtcagcgagttgcgcacgaaggcgaagtcatccaccttcagcccctccacggcgacgtccttcagcgtctcctgccccacggtgaaggtggagacggggacgttcaggtccgccagcgccgcgcgcgcccggcccaccacgcccgccttgagctcggtgttgtccgcgccgtcgctgaacagcagcaccccggacagcttgcgcgagccctgccccgcccccgccgcggcgcgcaccgccgagagcaggtccgtggtgcccgcgcgcgcgggcgtcatcagcgtctccggcgtcgccggcgccagctccgggtcgaagccgtacagctccaccgtgaagcggtcctgcagctccgccaggcgcggcgcggcccgttccaggaacgcggccacttcctcggagcgcgagcgtcctcccaccttcgcggggaagctcatggacgcggagcggtccaccagca

SEQ ID NO: 244 - DNA, 1068 bp, Myxococcus xanthus
gacaccgcgccccaggtggcggtgaaggcgctgcacgaactgctggggctcaagcccgaccacctgccttcgctcaaggcgctggcgcgtgcgtccgaccaggcccgcgacagggcgggcgcggtgcgtgcctatcgccggttggcggcgctcgctcgcgacccggccgaggccgccgatgcgcacgtgcacctggcccggctgtgcgcgcagacggaagacgacatcgccggcgcgcgcctgcactgcgaggccgcgctgcggctggcgccggaccatccggacgcgctgctgctgttgggcgagctgtgccatcgcggtggtgagcacctgcgcgcgctgaaggccctggaccgtctgcgtgaggtggccatgggccgccacgaactggaccgggtgggccatgccgacctgatggccggccgcgtgtgggacgaaggcctgaagcagccggagaacgcgctgctgcgcttccgggaggcggtgtcgctgctgcccggtgagccggagccgctgttcgccgccgcccgtgtggcggaagggctgggccggttgcaggaggcgctcgcgggctaccagcaggcgctggagctggcggggccggcgccgcgctcggaaggggtgcggcacgccgcgcacgccagccaccacgccctggcgcggctgtaccgcacgcggctgggtgaccctgcgcgcgcgcgggagcacctggagtccgcgctggcgttggatccgcgcgacgcggtggcgctggaggagctgattccgtacttccgcgccaccggccgctcgcaggagctggcggaggcgttggagaaggccgcggcgctccaggacgcgcccggcaagcgcgcggcggcctgggccgaggcgggcgagctgtaccggggcaagctgcaacagccggagaaggcggagcggctgctcctgctggcgctggaggcggatggcgaccaccggcccgcgctggagtcgttgctggcgctggccgaggcccggcgtgacggcgcgctgctgacgcggtgcctgtcttcgctggcgcggctcgccacggacccttagagaacg

SEQ ID NO: 245 - DNA, 1553 bp, Myxococcus xanthus
cccactcgagccgtgagcacaaattcgtcagacaggagcgctcggtgatgcggccggcgcgccaggcgttcacggtggtctggtgacggccctccacgcactccagcgccatgatgacgcggcggcccgaggcctgcgcccgctccaccagtgcgaggtaagtctcctgcgcgagcgggagcgtgtggtagtcgccgacgtagacgacgtccgccgcctgtacctgctggtacacggcgggcagcgtcgtgacgctccggtaacccgaggtgcgccgccggaagcgggcctcgtaggttcggaaggatgccgtctgtccgtcaaccactcgggcaatctgcgcgcgctggcgtcggaacagggcgaggtgcaaggcgagcgaagcgcgcatggagtgccgcaatccctcgcacgccgccgcaggcccggcaaaaaaacggcgcgtccgtgtgtcgggagcgttccttgactggggcggaaggccaatggaccatggctctcagccttgaagaccgcacacgctcgcgcgaccctcctcagcctggtcctcgtcatggcggtgcccggccgtgccgaggagccggggctcttgcatttcccacctgatcacgccgaccctggcgtagggctaacactacatgtcactcttgtagaaggacgtccactgctagagctgtacgtgcgctaccgaggcccgggcgagccttatgcccgccgccccatggagcgggagtacggcgacctgtaccgggccttgattcccgcggagcacgtcgtcccgcccggcatcgagtactacgtcgagggcctcaccgcggatggccagcgcgtgccgctcttccagtccgcctcgcgccccgcacgcgtgctcgtgggcggcgagacgccggccagtgcgtccatcgtccggcccacgccgccgcccgagcgccggcccccgccaagccggacgccaccgcgcgccgctccgcccgagcctgcgccgcctcccgagcgcacgcctccgcccgagcgctcccgcgcgcaggcatccgcgccgcgaaaggatgcgcccccggcgacgcggcaggacgactccatggccgcgctcacggcggacctgcccgcggatgcgcctacggaggcttcgtcgtcggcacggccgtcccgggcctccgcggcggcaggcagcgcgcccgcgccgcgtgagccggcagccccacggtccgagctggaggaggacctggccctctacagcgccgaggacacgctggccctggccacgcgccacgaggcggcggtgcggacggtgcccgccattggcgcctcgttcagtcagcagcagttgcgttccctgggcgcgcgcaccgtggcggacgtcctggacgtggtgcccggcctgtcggtcagcagggatgtgcagggcttccaccgcaccgccattcgtggcctgcgcaatgacgcggaggtgctcttccttctcaacggccaccgcctcaacagcttcttcgacggcaaggcgctgatgaacctgccggtggagagcctggagcgggtggaagtcataagcggcc

SEQ ID NO: 246 - DNA, 1769 bp, Myxococcus xanthus
ccaggtctctcgccacgggggggctggagctggccaccgcctccaggaagcgcggctcctgccgcagggccctcagcgcgtcctccaccgccagggactcctgcttcatcgccgcatgaaaggtggcctccgcctcctgcgcggcccgggcacggtcgttccattcagcgaacagctcgggagactccattccctcgatgtccaccgggcgcccggccttcagggccgacagcaccgcgcgcgatggccgcttcacccgagggccctgggctttcagcgcctccagctcccgccgcgccgaggccagttggcgcgcggcccgtgcggcctccgggcaccccagccgctccagccaatcgaagggaaaacccgtggtgcgaaccacgaggtgagggaagagggtccagcccttcatgcgtttcgcacccttcgtccgggacgccgctcggcgcccggcagcgcgccgctcagtttcgcggttgcgacttcacttcgatttgctgtccgggcacggccatcacccacagcttgctgacgccgctggggcagcgcaccaggacttccagctcccggcccgcttcgattcgtgccttcaacagcggcgttccacccggcagcaacgcgccaccgacgtggacctcacagccaggggccgcgcccgttacgctcagcaggcccgtggtaccaggctccggcgaggcgtccgccagcgtgcgcacgtcgatgccctcgcgctgctgcgtggttccgaaccgccgcagcttcccctccaccgccgtggagatgagcagcgggccacccgacgggtcatgcacctccgtccccgcctcgtgacgcaggccgccgacgtagacgtgctccccgggccccacgttgacgaagttcgagccgccatcgcgcgtcatcaccaccgccaccacgggcagcaccaagacgccgccaccgacgatgcccagcaacttccaagggggctgtttgtccgccggtttctccgcgggcgcgggcgcgggaacgcggctcgcgggagcaacgggccgcggcggaggcggctgggcgggacgggccgcgctggcgtgagccccgtgccccagccctggcaccggcccggacggacgcggcggcggcgcaggcatggcgggctgtggctgagaggcacgcggcgcgggagcgggccgaggcggcgcttccgtccgaggcggcggcgcgcccaggttgagcggcaccacctcggtgcggtcgttcgcgtcgtcctcggacacggagatgccggggaatgagtcgtcctccggaggcggcgcaggaggccgcacagccgcgctggcgacgcccacgggccgtggcgggggcggcgggggaaccggtgggccagggcgaggaatgccgccactgccgcccatcccaggacggcttccggccatgggcacactgccccggctgggcgtccgtccatccgtgggcgcggccatctccccactgccgatgttgccgctgccactgcccgaaggcaccggacgcgggtggctccccgttccgccgacggcggacggtgcgaactccaccagccggtcgcccagcgtgtcccggaagaattgggccaccgccgcgggcgacgagttgagccggtgatgcgccatcaccgcttcgatttcctcgcgcatcgcggcggcggacggcgtgcggcgcgccgggtccttcaccagcgcgcggaggacgaggtcggagacgtcctgcgggatgttcggcttgagctgcgaaaggactggcgcggg

SEQ ID NO: 247 - DNA, 1778 bp, Myxococcus xanthus
agcgcccgtgtccgacgcgggcacgggcgctgtcgtcgtgcggcggcggtggccgcgggcgggccgggtgccgccgaggatgcatccgcgccgtcctcggtgcgcgccgagaacgacaagtcggagcccgagcgggctcggacgccacgccccgcgtcggtgaagacgtccgcgaagaagccggcggtccccgtcgagcccgccgtcgtctatgccacgccggcgaaggtgctcccgattcagagcgcgaacgggcgctactatgtcgaccggagcatcatcgggcggggcttcctcccgggtgtggagatggacgtgctggggccgttgaagaacggcaagcgcgaggtgctggggcgggctcgggtggtgcggccgggacgcggcgtcgtgatgcggcccacgcgggcgttcatcgaactggatgaccgtgccctggcggcttcgggggacctcttcgtggcggcgcctggacgggatgacgcccccgccgacgcgtcggcgaccgaggagtcccaggcgcaggccgccgagcccgacaagggtgaggaggtggagaccgtcgtggccgcggcccccgcgaagcgcacgctgcgcggccacgcgagcgtgcagggcggggtgggcggcttcctggacccgggtgtggaggtccagaaccgcgagtccatcgactggacggactgctacgtggtgaaggacatccgcaaagcggcgtggctgggcgtcgtgaaggccggggagcggaagacggccagccgtttccgccacaacccgaacttcgacgtgggctccggctacctgggcgtcatctgcaaggaaggcgagctgcgggtgaaggcgcgctgaggcgctccgcgccgtgacggacgcggaaggctcagggccccagccgcgcgccggcgacggggcagtcggcgacgagcgccttcacctcggcgtccccaccccgggcattgcgcaccgcgcggtccagggacgtgcggcactgccacgtcacctcgcgcgtgccgtggcagcagtgccagcccgtcagcgtgcggcccaggtactggagcatctccgccttggtgggggtgacgagcagccacaccgcgcccgccagcaccgccagccagggcaactggagcgccacgcccttgaggcgagggcccgcgccgggagcaacgggctccgcgtggagcccgagcagcgtgtccagggggcggcgcatcagcaccccgttcagcagcaggtccagcggcgtggtgaaggcgcgggccaggccgcggagcaacccgggcgtgtgctccgcgtgcaccagcttcaccccggccacctgtcgccagaaggtccggcccgtcaacccgcccacggcggacgcggtgagccacgccagggccatggccaggggcatcgatagcggggtgcggtcctgctccagcgcgcgtaacgcaccccagcccacgaggacggacgtccccaggtccagcacatccgccacccacaggtgccattggtaccgcgcctgcgtggtcacctggtccgtcgcaaacaacgacccgttgctcatccaccctcttttcggcgcgcggagcatagaccggacgggaggacgtgcgcctcatggctccgctgggttcgaccaggggacaccccgggtgtcgcattcccgcagtggcgcggtgggggcgtggctcgcatcttcaccactgcgcgacgcgtcggaggcctccgccaccaccggggcctcctcgccgggcgcgcaatggccaaggccatggcggagccgggggtgc

SEQ ID NO: 248 - DNA, 1959 bp, Myxococcus xanthus
ctcgcccagcttctgcaagagcccgcgccgcttccacccgctccagtgaatctcccgcgagtggcgtaaatccttctcaaaggatgcggcgagctgcgccgccagcgccacgtcctccaccaccaccgagcactcctccaacgtcgtcaacgccagcgggtccatgttggtggagcccacgacggacagggagtcatccacgagcatcgtcttggaatgcatcatcgacagctcgtactcccagatgcgcacgccgccctccagcaagcgcgcataggacgcccgctgcgccgcgttcacgggcccgacgtcatggtgccgcccgggcaccagcacccgcacgtccacgccttgcttcaccttctccagcagcatgtcactgatggcgtcggagggaatgaagtaggagttcgcaatccagagccgctcctgcgccgccgcgatggtgagcagcgtcatccgccgcgcgtccgacaggaagcggttgtccgtgctggccacgaagccggcgcgcgcatcccccgcgtagcgaggctccgggaagtccgtcgccggcaggaagtctccacccgcctcctgccagttctgcgcgaaggcgacctgcatctctcgcacggccgggccctccacgcggatgttcatgtcgcgccaggactccgcgctctgcgcattccccatccagctcttccagatgccccagccgccggtgatgcccacctcgccatccctcaccaccatcttccggtggttccgcgccctcaggcgaaccgcgtccaaggccacgaagtcaccttggatgggccggaagtagcgcgcgtcacagccgctggccgccagcgcgggaatcaccgcctcgaagttgacgctgcccaatgggtccacgagcacgcggcacgccaccccgggccgccgcgccgccagcgcccgcaccagccggtccgacggctcaccggggcgccagatgtagctgatgatgtggatgctggtgcgcgcggcgagaatctcctcctcgatggcgtcgaagatgaagccgttctccaccaactccacgcggtgccctggcaccagcgccacgcccaatgactggaagaacgcgagcgagcgcgcctccggactggtccccggcaacgcgcgcaggcgcaggtcatgccggtgattgggagcgggacacccggcggcaatcaacaccacgggcacgagccaggcgagcttcaccgccggaaactaagcgcccatggcccgcggcgcacctgccgatgtctcacgcaagacaccccgagacgcgcggggggcacctctccaccgtgagggtggaagcccccgccccgcgtgcgcaccttcgggacacaccgcgtgtcgccatgctcaacgtgccctcacaccgacgtcccatcaccgcgtgcacactgctgctgggctgcctgctgtccggcgcgagtcacgcgggggccacagacgcaccgctgcgcgacacgccacctcctgaaacacgttccaggtacctgtacacgcccgccgctcccgtccccggaaagagcagccgtgcccacgtacatcgaaccggaggacgtcccgctgcccaagggcgcatgggtggcgcacggtgggctctcgctgcttaccgtagccggcgtctggggcgccagccgcgtgggcggggacacccgcgtgggtgccaccgtgggggataccgtggcgggaatgctcctgggcgccatgccctcgaggctcctctatttacgtcccgcggggcccagcccggggcggtggatggaattggagaccgtggccttcggcggcggcttcgtgctgacaccaccgctgacggcgctcggaacgtggggcctgggcgagctcgcctttggcgagagtcaccattcggaccgagcctacctgggcgcgctcggcggcgcggacctgggcacgctgctgggcgtcatcgtgcacgaagccctggtg

SEQ ID NO: 249 - DNA, 1108 bp, Myxococcus xanthus
ggccgaagccggcgtctgagagcacgcgggcgccctccgagaggaacgtccacgcggtgtcgggctcgagcaggagcgcctggggacgtgggctctccagcacgagcgccagcggggggaagagccgggcggcgcggccgagtgcctcgagcagggactcctgcgggtcacggaaggcgcggccgagcttctccaggctgcgcccgcgcgtcttccagacgtccgcggccgggacgagcaggcttgggtcgtccggggactggaggtggaagctcagcacgaagggctcgcgctcctccgtcgggggctccagccggaagcaggcgcgcagcttgtcccgggcgccgagcgcgggttcgctccagcgcgtcagctcatcgacgacggagcgctcggcgaagccctccggcgcgaagtcgcgtcgcgcgccggtgagcgcctcgcgccagcgctcgtcccacgaggccgcgcgccgggccggcaacgaaggcgcaccgcgcgcggcgcgcacgaaggcgtcgacggtggcgtcgaggaaggcgcgcagcaaggcgtccggggcccagacggcgcggcctggcctggcgcctgcggggacggcgtgcgcgccgggcggcatgctccgggcgagcgcggcgacgcggccggcgtcctcggtggcggagagggccgccgcccagcgagcctcgatgcgctcgccccgccgcaggagcgtgggcaccacgcgctcgcgcgccaccaactccagcgcgagcttgctggccagcgtccacagggcgatggagccaggaaaggactcggcctcggaggtttgcaccaccgcgagccgctcgacggtggcggccaggggcagcccgtgcccctcgcattcacgcaatccctcgggcgtcacgagcagcgcggaggcgcggtcccccgtctccggcaggccggcgagctcacgtggcagccggtcgggcccccagaggaacagcgtctcggcgtcgggcaggaacacgaggggcatcgctgcgaatgtaaactccgtccgggcaagcggcacacgcaagcaggcctgcgagcgcccctgcacgggattgccggctccgtgagccgcaggcctgccggg

SEQ ID NO: 250 - DNA, 1591 bp, Myxococcus xanthus
cccggggagcccacccgggaggcctcggtctagcacttcgccagggtccaccagcacgcggacacaggcggctgtagcgaggcacccagcgaacaatgatgacacacctgccgctggaggctgcgcgcgcgcggggctggcgccggtgctggacgtggcggggatgcaggccaatgcgctctacctgtccaacgacagcggcaaggcgctggtggcctacgacgccgtgctggaggtggagcccctgcatgaggaggccctctacgcgcgcgcggcgctgctcttcgagacgaagggcgacgacgtggcggcgctgaagaaggcgggcgagggcttcgaggcggtcgcgaccacgtaccccgattcgttccgcgcgcccatggcgaagcggatggtggcgctggtggaggagacggtgaaagcggggggccgcaagcagctgctcgcctcgcgcgcggaggaccgccgcatccgcctgtcgcaggcgcccgctgccgccgcgccggatgcgccgcggccgctgtcgcaggagatggtggacgcggtgaagggcaccgagcgcacgccggagctggagcagggcctggcgaagctggtggacgagggcgaggaactcctggcgaagggccagtaccaggaagcgctcgccaactacacgcgcgtggttcccttccagccggagaacgggcgcgcgaaggcgggcatggcctgggccctggtgtccctggagcgtcccatggcggtgcgcgtgtggggcgtggccgtgcagaccgacccgctctccgtggagacgctgggcgacacgctcaaggccaagggcgacgacaagggcgcgaaggcgctctgggagaagctcgccaccgacgcgccggattaccccaacaaggcgagcctccaggcgaagctgggcaagtagcgcccgcgcgctagaagtgcttcgcggccggcgggtcctgcgcgttcagcaggaccgcgcggcggccctccgcggcccacgcctcagacgaacttcgcggccagcaggtcctgcacgtcgagcaggcccacggcgcggccctccacgtccaccacggggagctggtccacccgcagctcgcgcatctgcgtggcggcggccagcaccagcgtctccggcgtcacgcagcgcgggttcttccccatcagctcgcgcacgggcacggtgaagtcggtgaggcccgcctccacgcggcggcgcaagtcgccgtcggtgaagatgcccaccagcttccctgccttgtccaccacgcacgcggcgcccggacggcccggcgtcttcgtcatcacccccaccaccgcggacaggggcgaggtgtcgcgcaccagcgggttggcgttgccggtgcgcatcagctcgaagacgcgctgcacggagcgccccagcttcccgcccgggtgcagcagcgcgtagtcctccgtgccgaaggggcgcgagcgcagtaccgtcatcgccagcgcgtcaccaatcgcgtgcagcgcggcggtggaggccgtgggcacgaggcccatggggcaggcctccgcgatggcgccgatgtccagcaccacgtacgcgccgggggccagcgggctc

SEQ ID NO: 251 - DNA, 1265 bp, Myxococcus xanthus
cgcgggaacgtcgaacggccgggacgactccgccggagactccatgaccaccgggggaaactccacccgcaccttgcgcatccacgcgtcatcgaagccgtagaaacgccggttgaactcggcgatgcatggcaggtgccccaccacgaggtccgcatcgagcaaggacttccgctcgatttcgtaccgccccaggttctcgacctcgagcgtgttgggctcgtggtgcatgagggtgccgtagctcgagtgcagccgcaccgagagggtggtctgcgcgaaggccagccccaggtgcttctcctgcagcgcggcgaaggcccagccgcggaaatccgcgaactcgatgacgtcgaagcgcaagccctccgcttcgcgcgccttcaggtaacgcatcacctccaacgactcaccgtgccaacgagaatcccgaaaggcttccgtgggcggatagaagccatgcgcatccgcggtggtctgttgtggctcgcggaagtcgcacagatgcgccttcacccgtcccccgaagaagagctccacctgggccgtctgcacggaaacggtgggcgggaacaggacatggaactccacgttcgcgccgtggcgctgcgagtccatgatgaggttgtgcgcgacgcggccaatgcccccgggggtgaaggggtagagctcatcggtaacgaggcagacgcgggtcatgctcatggctgtgcgaactcaaggtagtggttgatcgcttgggcacagagcgtctgggtgtagtcctccagcatctgcgcgtactcctccggcgaacgctcccggaggccgacgacccgctccaacgccgagcgaatctgtccgagcgagccggtgcccgcgacctgaaccaaccgctgaaaggggtgttcatccagagcccccagggtcaacggccctgtcaggcacgccacaccgtgagtcagcccctccagggcggtcatcggctggcactcggcgagcgtcacgttgaggacgacgtccgtctcccggatgaggttgaacagctccgaacggttcaacggcccgacgttgatgacggaagccttgaggggcagctccgggcgggccgagaaaggactggtgacgaagacgcgctccatccccggcagtgacgcggcgacgaagacgttggaatagaagtcttccaccagctgttgggcgagggaacgaaagcggcccgcgtcggcggagcgcggtgtcgctggtcagccggtcccacccgaggaggaagcctttagagcaca

SEQ ID NO: 252 - DNA, 941 bp, Myxococcus xanthus
  unsure (1)..(941): unsure at all n locations
tgcttgggcacgtagtccaggtcgcagtccggcatcaggcgtcgtctggttgatggtgggcggcaggatgttgcgcgccagcgccagcgcgctgaccacgccctcgaagccgcccgccgcgccgagcatgtggcccgtcatcgacttggtcgacgacacggcgatcttccgcgcgtggtcgccgaacaccgtcttgatggccttcgtctcattcgcgtcgttgaacggcgtcgaggtgccgtgagcgttgatgtagcccacgtcctccgggttcatccccgcggactggagcgccagccgcatgcagcgcgccgcgccctcgccttccggcgccggctgggtgacgtggtacgcgtccgagttggcaccgtaccccaccacctccgcgaggatgttggcgccgcgcttcttcgcggcctccatctcctccagcaccaggatgcccgcgccctcgcccatgacgaagccgtcacggtccttgtcgaagggacggctggccccggccggatcatcattgcgtgtggacagcgccttcatcaccgagaagccacccagccccaacggggtgatggccgcctcggcgccgccggcgatgaccgcgtccgtctcacccaggcggatggacttccaggcctcgccaatggcgtgggcactggtggcacacgcggacaccggcgcccagttcggccccttgcagttgtaccgcatggagatgaggcccggcgccatgttgatgatcatctggatgatgaagaagggcgacaaccggtcgaaccccttctccaaccccttgcggtgctgctcttccagcgaagagataccgccgatgcccgagccgacgatgacgccgaccttctccgggatgtagccgtgcggagcatccgggccaatgggaatgcccgactncgtcacgggcatctgcgcgggggccaacgcgaact

SEQ ID NO: 253 - DNA, 1592 bp, Myxococcus xanthus
gccacccggggaccctgcacgcggcttggccacacccgccaccgggtgagcgccagcgctgcctcgcagcggaagcggccgtcatcctccagacacgtcagcaccgtgtcgagcgcctcgtgcgaaggcgtcccttcgtggacgtccaccaacgcggcgagccaccgcgactccagcgcgggaacggcggtgtgcagcccctcctccggctcggcggcgggctcctcctcgggcacgtgccagggaagccgctgggcccaccggtcctcgacctcctcctcgaagccccggagcaacaacgcctgctcgtagcgccgcacgtcgacgagcaggcgccgcacatgggcccacatccttgcgtagcgcgcctccaactgctccgccatggaggtggggaggagcaacacccggtccgccagcgcataccggtccacccccgcgtgcacgagcatccgcgcggcgccataccgctccggaggaaccgggccgcagtcgcaccgagggcacaggaggcccggcgtgtggaagcgcgtgcaggccgggcagcggacctgggcccctcggcgggcaccattctccagcgggggatgcatgcgtcttctctacaccgactggggccactccgccccactcctcaaccgtcgcgacgtaattgtacggcaaagccacacggcatcctcgagtcattcgcaatgccatggcgcgactgtaacgcaaaatgtttcaattcctctcaacctccgcgcgcacctgagcggcgctcacgccatctgttgcaaccagtagctctcacccaaggagaaccaccccatgaagcagaccattgctgtcctggcggcgctcgccgtatccaccctggtggcctgtggtggcgttgaagccgtggagccgcgggaggaactggggcaggagtcgagcgccctcgtctcctgttcgacggagtgtgcgacgggtccgtcgctctcgtgttggggcacgacctgctccgcatccaacgaccactacgtccagtgtgacggcaactaccagtactgccccaccacgcccccgccgccgctcgactgcagcctgtcgcgagaggcgtgcgtgaacgtcctcggcctcgcatgctcccccagcggctccacgcggaagtgctgcatcgaagacatgcccatcggcaactgccagtgcatgcacaacggtcagtggacgtgcaccgtcccggccgaagacccgtaaacccatcccgcgacccaactgacacgtggaagcccgggtagaggtggcccttgtcggggccgcctgtcgcgatgaagtcgtcgaacaccccgcctgcgtcgagcaggcccttgcgtgcgccctcgttgatggcgagcgtgtatcggaagtgcccccgcagcagtttgtagacggggtgcgggtccggcaggttgcgcatcgtcgccatgacgaacggctccgccacgaagtgtgtgcgcagcgcgtgcgacaccatctggtgcgagttgccctcgctgcaccggaggtagattttcgcggcgagccagtcgtacgcgtcgtcgttcggcgtgaagacagggtccttctgggcgtcccgcccgagctggatg

SEQ ID NO: 254 - DNA, 1952 bp, Myxococcus xanthus
ccccgcatccagggtgacgcgttccagcgcgccgcgaacaccgtcatcgacctggcccaggcgtggaagaagcaccccgcgctggtggaggagtgggtgcgcatccaggacaccgtcttcggcccgtgcgccatcctgccggagcctgacccgcggctggatgaaggcgtgagcgcgcagcagcaggcccgccggcgggacgagcgcgcctaccaggaggcggcctcgcgcttctactgcgacgactatcccggcgccctgtcttcgttccagaagctcgctgcgtcgcaggaatcgccctaccgggcgctcgccgcctacctcgtggcgcgcacccatgtccggcaggcgctgatggagaagaagggtgagtatcacttcgagtcgcgggaagacgccgtcttcctctcgcggctgagcgaggcggaccgggtgctcgatgacgtgctcgcatccccggagctgcggagcgtccatgcgcccgcgcgcggcttgcggagcctggtgcgctaccggctgcgccccaagacctggcactgtgagctgctgtcacacgtgctcgaacccgggacgggcaccgccctcgcctcggagctgggcgacctcgacctgatgttgcgggaagcgagcacctgcgagggcctccccgcgcccgccgaggcgctccaggcgtggctcaacgccatgaaggacacgccctacagcgcggcgcccgatgcggagcgccgcgcgcaatacgacggagccctggcccgctggaagaagacggcgcacttgccgtggctcgtcgccgcgctgagcaaagcgacgccggacgctccgggcgtgccggagctgctcgccgcctccgcgaaggtcgcgcccacgtctcccgccggcctgatggtggcgtaccatgccgcgcggctcttgcatggccgaggcgaggtggaggcggcgcgggcgcggctcgcgacggtgcccgccgagctgacccgggaccttccctccacggacaacctgctgcgcgaggagcggctcgcggtggccagagacctggacgaggccatgcgggaagccttcaacatcatcgccgactatgaaatgaccagcagctactccgagccctacaccacgccgctggccgaacggccccggttcttcagcccgcgtgccgtggccatgctggaaccccggctgacggcgaagcgcatgggtgagctggcggcgggggacatcctgcctcccgcccttcggcggcagctcatgtggaccgccttcgcgcgcgccaccgtcgcgggtgacgacgcgacgattcaggccgtggcgaagcgcctggcggagacggagcccaaggcgaaggcggagctgctggcgctcgtcggcaagcccacgcccgaagagcgtcaattcgaggctcaattgctcctcatgggactgcccgtcgtctccgcgcggctctacccgggcgaggaccggctggcgaacacgcatcccaacctcagcctcaccatggacatctcctaccagcgcaactggtggtgcggcccgaagccagacgcgagcgtgccctccgtacacttcgaggacacgcccgacgcaccggacgcggcgcgggagtggaaggccctccaggacgcgggcaactcggtgccctacttcgcccgcgtcgccatggcctgggcccaggcccacccggaggacccgcgctcgcccatcgccctgttccgcgcggtccgcgccagcaagcgcggctgcggacaggccacgcgcgaggcacgggatgcgttccgctatctccacaagcactacggcaagacgagctgggcgaagcgcacgccctacgtgtattgacgtcccgcctacagcacacgctgggtggcttggcggatgcggtcgggatgtggagtgactgtccggactctcttcccagtcgctgagatgtcgtgcgtttgcgttcgactttagagcac

SEQ ID NO: 255 - DNA, 1363 bp, Myxococcus xanthus
cttgagcggtcctccgcccacccccaacagcgaggacagtccaccggccacaaaggagccggagatgcccagcgggtagttggcgggcgcgtagtcgtccatcgcggcgggctcctggcgcggcgaacgcagcagcaacatctgcagcgccacgtagagcgtgaagagcccgaacaccaccgccaccatcgccggcgccaccatggcggccaccatgccgccagcgatggcgcccatcaccgtcgccagctccagcgacagccccaggcggatgtcactcaggtgtttgtgcacatagcccgcggcggcggagcacgagctggccaccacgcacatgaggctcgcggggatggcttgctccacaggaatgtcgaaccccagcaccagcgcgggcaccaggacgattccgcctccgatgccgagcatcgcacccaaggtacccgcgagtgcgcccaccgcgatgaggagtaggactgtcattcctcttcgaggataggagcggcttcgcgcttcggacagcgccattccccgagggaaaccgggctcgccaggacgcctgctctgcaggtgtcacgccgcccgagcgcccagcgtcccttcggggaaggcctccaggaagcgggctcgcgtacggggcgtgaaggtgcccctcgccatgtagccgtgcaaccgacgcaggacgctacgcgccgtgtccagcgtgccttccacctccgcggcgaagtcgaacgtgtcgttgcggtacagctcctgaaacgacagccgcgcatacgcgggcaacgcgcgcgccctgcccatgggacttgaaaggaagagaccggagacgtacaggccgcgcacccagccatcgacctccgacttgctgggcgcctggcccacacgctcctgtgaggacaaacggaccagctcgtagaggccgccgccaatgccccgccacgggaagcccaggctcttcaccacctgacacttctcccgcacccgcggcgtgccgagcagctccatgccgtgcagctcgcgcagatagaagagcgtctgcgcccattcgatgtcgcggtgcgcctccagggcacgctcaccgcggcggcggtgtcgcaccaccaacctgtccaccaccggatacagacggcggtccaggcacaggtgcgtgaagtaacccgcgagcaccgcgaggccaggctccgtgcccaccaacgcgccggaggccaccagctccgccatcttcagcccgaagcccaccggggcgcgctcatggtacagccgcgcgaagtgcggcagctcccgctcgggcaggaaggcggcgagcccaccccggatgccttcgcacaacgggaggtctggcagcgcggcgccgaagcgcgcatac

SEQ ID NO: 256 - DNA, 1387 bp, Myxococcus xanthus
ctggcggatcagcgaggccaaatcctgaaggtcggcaccgcggacgaggtgcagaagggcctggacacctcggtgcaaatcgtccagctcgcgcccgggcaggtcttgatgccgggcttctttgatccgcacctgcatttcatgcccacgctccttcagagcacgctgggcacccacgacctggcgccctgcctgcctcctccctacagggtggatccgtccgtggactgcaaggcccgtagcgaagtgctgggcgcgctctccgcgatggcgctggagggcacgagtgccgtcggcggcaacgccttcgtcctggggatgaacctggacccgtcgaggcaggtgttcgacaacacgaaggggtgcggggtgggtggaccttcgcccttcacggcgcagccgaagttctacatcgaggcgtgcgtgagcaaggatcgtccggtgatcatcctggatcagtcgggacacctgggctacgtgaaccagaaggccttcgatgtcgtctgtggcgttcagaacgccaacgccaacacctgtacgatccccgattccgtcaagagtggcggcggcgactgggtcacggattcggcgaagaacttcgtgggcctgcttcaggagccttccgcgttcgggccgttcctgacggcgttgcagaagaacctgcccgtggcgcaggtgttctccgatccggtcaagttcgcggagacggggggcgcggacgtcgagcgcgtcattcgggggctgcgcgacgcgggcgtcaccaccatcgcggacggcggcctccaatcggtggcgcagatcaacgcggtgaagcggttcaccgagctgcccggttttcccttccgaatcacgggcgtcgtggtcgccgaggccgcgaagacagcgaagctgaagccgacggctcctgcctgtgagccgaaggcagggaatgactgcgcgctgccgaagtggctgggcgccggtggcatcaaggtctgggtcgacggctcgacgcaaggttgcaccgcgaagctcgaggcgccctaccactacctggccggcgggcactgctcgggtgatggcgagggccgggccgactacgacaacgtgcaggcgctcaccgaggatttgagcgaactctggacccagggcgattggcggttccagctccacgccaacggcaatggggcgaacaactgggcgatcgatgcgctgtctcggctccagcagacgaagacgaacacgcgccccgtcctcctcatccacaacacggtgggccggcccgcgatttccaagcgcatcggtgacctgcgcaatggtgcgggggtgatggatacgaagccggtaccgacgctcgacgtccaggtgacgcacctcattggacacgtggcgtattggggtgatgcct

SEQ ID NO: 257 - DNA, 1665 bp, Myxococcus xanthus
ctctacaggccggtaggggaggggggagcccacctgtcgaccgctgtttcagggcgtgggaagcgacccaatccgttcgtcgatgggcggatggctcatgcccttgaggacgacccagcgggggggctcggggtccatcttgttgacccacgcagccttcaccattatgcgcctgaaggcgtacacgtatttcgtaagccgcagggcataccggtccgcttcacgctcacgttcccgggagaaggcgcccgagatgggcttggccgtcagcacgaggaggaagaagagcagggagatgaggggcaggttgcggatgtccgcgaagtgggtggcgccgaaccagccccgcgacgcggacaggcgcaagaggcggtcgagcgcgaagagcagggccaccagcatcagcgatgaggcgatgcgggcgggccacttcgactcgttcacatggcccgcttcgtgtgccaccgcggccagcacttcgtcctccgagagttccttgaggatgatgtcgttgaggacgatggtgcgcgtggggccctgcccggcgaagtaggcttgcagtcggcgcgaggcgacggaggtctcctccacgaggacgtcggcgaaggtgatgtccgcctgctccatgaggtccacgatgcgggttcgcaggggcccctcgggcagcgctttctggttgaagaagagcctgctgcgatacgggtccagtgccccggagacgaggagcagcagtgccacgggcacgcccagcaccagccaccattggcgcagcttgcgcgccaggccgaacatgccgatgacgagcgcggagagggcgaaggccgccagcaactgggccttgaccatgtcataggcgaaggtggcgggcgtctgcgtggacatgccgtgccggtgctccagcgtgtagctgaaccagacgtccaccggcaggtagacgagcgacacgaacaggtccgtgaagagggcgaagagcaccgccgcgccccagccgggcttgccccacagccggtccatggcgtggaagaaggcgcggctgaccggcgccgtccgaaggaagccgagccgccgctccagccccgcggcggccgccacggccaggcggtggagcggttggacgagtacgcccaacatgagcagcatcagggccaggttggcgaaggggcccactgcggcccggatgtagtagggccgatggaaggcgtgaatctccgccagttgctcgggcgtgaagaggggctccatggaacccccaggctacgccgtgcgcccccggcctgcccagccaggggcgttactgctgcgctcaggtatggggctcgcccccggaggagggcgccgccgacgcgggctcgccctccgcgtccgccagcagcagggccttcaccttggccaggctctcacgcgtgcggtccacgaaggtgctctgcgagccgatgcgctcggccgtctccaacgtgcgctcgtagatgttgatggacttggtgagcagcacccgaatcttcttccgcagctcctgccggtagatttcggcctcgctggcatccagctcagcgggggcgggtgagttcaccatgtgctcgtaaaggttctcgtaaagcgaaccaatctgcgtccccgcggcgggggcccagtagccggtgcccacgccgatggagcgcaagtagt

SEQ ID NO: 258 - DNA, 1149 bp, Myxococcus xanthus
ggtgcgctttcaagtcttcggcttgccaggtctggcgtgcgccactcgttggatgaaagggggcggcggcgcgcgtctcggagggcttgtggttcgcggccggggcgctggcttcactgcgcgagcgcctggttgcccacctgcgcgagaagaaggagattaccacccaggatttcaaggagatggtggggcaaagccgcaagttcgtcatccccctgtccgaatacttcgaccgggagaaggtcacgctccgggtaggagagaagcgggtgctgcgtcgcggatgagtaccaagcgctacagcgaggcggagcttcgcgccctcgtcgacaccttccgcaaccccatgctggcggtggtggagggacgcgtgctcgtggccaatgacgcctatgtcgcgttgctcggcctgcaacgcgcccaggtggagggccgctccgtcatggacttcatccagccggaggaccgcagccgcgtggtcgagcgctactggcgggtggaggccggtgcgccgctccatgagggctcccagctcttccaggtcccctgcgcggatggcgtggcccgtgaggtggcagtcaccgcgtcccgcttcgtgttggagcacgggggcgggggcctgctgctcaattgcgtgcccatggagaaccggccgccggagatgtcggtggccgagcggctggtggagacctccgcggggctggtgtccgcgcactcagagaacgccgtccgccgcgtcgccctgaagggcctggaggccgcgggcttccgggcccggctgttgcgctgggacggcgagggactgctggctcgggatggggagcccctgccggaggatgcgcgcctggggatggagtcgctcgcggacgggcgtcccgtctttggcggctcggaccaggccgcgcccacccacgtctacctgcccgtgggcggcccccaggccgaggtgttgtgggtggagggccactgggtggcgccgcaccatggctcggtgttgatgctcttcgccaaggtggtgggcgccgcgctggcggacgcgcgtgtgcaggcggagagcgcgcgcagccgctgggagatggaggcggtcgagcagatggcgcgcttcgtcgcgcagccgtctccgcccacgcaggagggcttggtggagcg

SEQ ID NO: 259 - DNA, 1268 bp, Myxococcus xanthus
cgctcctgggcgttcattgtgatgtgtgtggccaggcgctcctgtcctgctcggcgcgtgagacggcgctgcacacgctggcgtttttcgagcaacagcagggcttcctgacgccgcgggccacggtcagcacggacgcggaagggcgcttccgcttcgagcaactggctggcgtgtccttctccgtgtgggcccgcgcgccagggctgggcgtcgcgctccgcgaacgggccgcgcctggagacccggtggagctgtacctgccgccgctgcgcaccctggtggggcaggtggtggacgatgccggccggcccttggccggggctcacgtgcacggagtgtcgcggcgggcgccgctggccttcgagtccacgagcggagcggatggccgcttcaccctgacgggcctgggcgaagggcctttctatgtgctggccacggcggaggggtacctgcccgcggtgggggcccaggtggaggcgggaccacagcccgtgcgcctgaagctgacgcccgcgcgcaccctggaggtccgcgtcacccgaaacggttcccccgcggccgcgctggtgcggctgcgcgcggaccacctgtcgcgggagctgcgcacggacggcactccggtgcgcttcaccggcttgtatccggaccaattggtggtgaccgcggaggccaagggcctggcgtccgtgccccgcgtcttgacgctggacgagcgcgtcacccaggtgacgctggcgctggaggaggcggggagcctgctcgtcacggtggtggatgaagatggacagcccgtgccgcaaccggagctactgttgcgcatgccgacgggggaggttgtccggcaggagcgcgggggcaccggcgcgttggtgacgctgggccccctggccgtgggcaactacgtgctgaccgggcaggccgagggcttccgtgatgcgcagctgcccgcgaaggtgacgccaggggagacggcgctcgaactggagatggagcgcgccaccgtcatcagcgggcaggtgctggatgtctatggccggcccgcgccgggcgtgtccgtgttggtgcagcccacgggcgcgtcgacgctggcggacgcggaagggcgcttcatcgcgcaggtgcccacgccggggctctacgagctccatgcgcaccactcggagtggggtggtggccagctgaaggtgactgcgccggccaccgacgtgcaactggcgctggagcctcgcgcgtcgttggaagtgacagtctccgccgatgtgtcg

SEQ ID NO: 260 - DNA, 1491 bp, Myxococcus xanthus
gtgtgctctaaaggcacggtggacgtcttccccggctccgcgctgaaggtgtagctggactgcaccttgaacttgtagccctccaggtagctgaacacgccgtagccattgccccggtacacgaggcgcacggcgagctggtgctgcccggggacgatgcggccgttgaagacctcgaagagctcgcgcttgcccaggtccgtgtggccctcttcatctacctgcgtgtagacgggcgcgccgtcgagcgcgtacgccaccgactccagttcgaaggagccgcccatctcgttcttgtggatgatgacggcgcgagcgcccgtggagacgtcaccgcccagcaccgtctcctgcagcagcagcaggcgcgccttggagcggtagatcttctccttcaggtcgacgacgttctcctccagcgtctttacgcgggtgtcgaacgcctcgtccgcggtcgccgcggtctgtgccgagggaggagcggatgcggcgggctcctgcgcgagcgccggcccacagagggcggcgctcagcagggcgaggagcgggaaggtggcggcgacacgcacggtacgacctcagtgggcagacggtccgacctgacggcaagggaggacatagcacccttgcctgtaggacgtcttgccacgccgtgggcggggaccggggtcgcccgcctgggcgcttgcttcaaccacccttcttgagctcggtgaggacgagcttggccacggccttgagcgtgtcgaagacgcccacgcccgtgggcgccacggcctggtactccgggatgttgcggtggttgagcgccttgcgcatctcctccaccgtcaccgcgttgggcaggtcgcgcttgttgtactggatgacgtacggaatcttgttcaggtcgtagccctgctccgcaaggttgatgcggaggttctcgagcgactccatgttcgcttccatgcgttcgatctggctgtctgccacgaacacgacaccgtccacgcccttgaggatgagcttgcggctggcgtcgtagaagacctgaccgggcaccgtgtacaggtggaagcgcgtcttgaagccgcgaatctcaccgagcgacagcggcaggaagtcgaagaagagcgtgcggtccgtctccgtggagagggagatgagcttgcccttcgtctctgcggcggtcttgttgtagatgtactgaaggttggtcgtcttcccgcagagcccgggcccgtaatagacaatcttgcagttgatttcgcgggatgagtaattgatgaaggacatggcttcccgggttactcgctgaagaggttgtcgatatcgtcgtcggagatctcggcgaagggcgacccagctccaggactgtcagtcttcttcaccaggctctcgaagatcttcgtgagctcgtcgctggccttcttgatgcgaaggcggacgaggccgaggctggtgcggttgtcaaagatgacgaccagcacgacccggctgccgacgatg

SEQ ID NO: 261 - DNA, 1318 bp, Myxococcus xanthus
tggggatgatggcggcgctggcgctcgcgctggccgcagtgggcatctacggcgtgttgtcctatctggtgagccagcggacgcgggagatgggcgtgcgactggcgctcggcgctacgcggggcgatgtggtgaggctggtgctccgacagggcctgggctcggtggcgggcggggtggtgctggggtgcgcgggtgcgctggcgctgacgcgggtggtgtccggcttcgtccacggcgtcagcgccctggacccgctgtccttcgtcgccgcgccgctggtgctgctgggcgtgggactggtggcaacctgggtgcccgcgctgcgtgcctcgcgcgtggaccccatcatcgcgctcaagtacgactgaggaaggcgggcccgcgggctcctagaaccagggataggtccggttggaggggagcaggaatccccagcccgcatcgatgacgaccggcccttcgccaggccttccatagacatccaccggcaccttggagacaccttcgtcgtagggatacgccaggcaattgttcccgtggcgcaggcgcacgtccctcaacaccagatgatgggcgctcaggctgtacagcgtggccacgaagtggacgatttcgtcgcttccactcccgaagaccttgcgctccaccgacatcagcatcggggtccgctcgtccgattccacgcttcgcacgagcctgcgcgttttgcggggcgcgagccaccagcacagcagcccacccatgatggcgggcacccccaagaagacgagcaacacgcgatacgccaactcacgacgcccggcgtcaatcagttgctccatggacgtccagccagccacgacggccaccagcccgaggacaccgaagacggtccccatccggagggtgcccgacaagtcccgctgcaagactgccaccagggcaccacggtttcccggcacgggctttccggtgggactcaccttcctcatcgcgcggcacctccagccaggttgtccccagtcctaagccggctcgcgaatcgccgatagcgtgcatcgaacgtcccggagacttcctcagtcgtccgagcgcagcgcctcgtgcagcggcacgcgggtgacgcggcgcgcgggcagccaactggccagcaacgccactgcggcgagcagcacgggcacggccgcgaaggtgacgatgtcgaacgcgctcacgccatacaggacactggacaggctgcgcgcgaacacggcggcgccgacaagccccaggaggacgccggccacggccatccgaagcccctgccccaccacgcgccacaccagatattgcccgg

SEQ ID NO: 262 - DNA, 1106 bp, Myxococcus xanthus
tggcgcagcagcggagcgcctcgtggtgggagtccgcgtcgcccgccgctggcgcctgagtggggtgcgggcatgcgctgaaggtcgagcgacggacagggcatccgtgtatggagaagcccccatgtccccgcccgactcccctcccctggtcgaactgcgcgacgtcacgaaggcctacgccgaaggcgacaccacgcgcgaggtgctctccggcgtgcggctctccttgcgtcgaggcgagttcgtggtgctgctggggcgcagcggctcgggcaagtccacgctgctcaacctcatcagtggcatcgacctggccagtcagggcgaggtccgcgtggatggccgcgacctgggacggatgaatgagcgcgagcgcacgctgctgcggcgcgagcgcatcggcttcatcttccaggccttcaacctgctccccacgctgacggtggaggagaacgtacggctgccgctggagctcaacggccagggcggcgcggaggccagtgtgcgggcgcgggcgctgctcgatcaggtggggctcggcacccgcgccagcagcttcccggaccggttgtccggcggcgagcagcagcgcgtcgcggtggcccgcgcgctggcccatgaaccaccgttgctgctggcggacgagcccaccggcaacctcgacgaggccacgggacggcaggtgctggacctgctggaggcgctgacccagaagggcaacacctgcgcgctggtcgtcacccacgagcccggcctggtggcccgcgcgcaccgcgtcctgacgatggagggcggccggctggtggaggtggagcacacgcccatccgcgcgatgaaggaggcgctgtgaaggggctgctggtccgctccagcctgcgccacctgggccgccacccgtggctgacggccctgtcgctgctgggcatcgcgctgggcgtggcggtggtggtgtccatcgacctggccagcggcagcgccctgcgcgccttcgagcgctccacggacgcggtggccggacgcgccacgcaccagctcctgggcggctccacgggcgtgccggaggcggtataccaggcgctgcgcgtgcgccccggcgcccccgt

SEQ ID NO: 263 - DNA, 1648 bp, Myxococcus xanthus
gttgatacgaaggcgttggtcgaagtgcgggccgccccggacaggaaggggctggcacggaggagggcgactgtccccggtgggtacgagtcgccccgagcgagatggggggatcggagatgtggggcgacccgcgccctgcgagattcacagggcgaatgagtggatacacgaacagtgtgcactttgcaacacgggtctaaaattatccgtgaactggacgcgcaacctgctggccaacacggcctgaaggaagagggacgccacgtcacccgaggtgggtgcgcagttcctgctccagcttggcgcggggctgggcgcccagcatttgccgcaccaccttgccctccttgaagagcagcagcgccgggacggcgcggacgccatagcgcatggcggactccggattgtcgtccacgttcaggctggtcaccttcagccggccccggaaatcggcggcaatcgcgtcgagcacaagggcgagcgcacggcacggcgggcaccaggtcgcggtgaagtccaccagcacgggctcggatgactccagcacctccctttgaaagtgcgcgtcgtccagcgagatgacgttcgtcgtcatggtgtgtcctcctcgttcggccgggcgcgtgggccctgcctgggtgtggacacaggtgtagtggcctcaacgggaacggacgagcgcccgcgagggaacgctgtgttgcgcgaggtccccttaccggctccgggaggacgggggctcggtggcgtcgtcccaggggagcgcggcgccgcgttcactcaacagcgccaggaaggcgcgcaccttgagcgggagctgccgcctgctggggtagacggcgaagacagggatgcccggcggcgtttcggtttccagcaccggaacgagcagcccgccgcgcacgtcctcggcgacgagcgaggcgggcagccgcaccacgcccagtcccgcgcgcgcggcggcttgtcccgcgcgcacgctgggaacgcgcagccgtcccgtcaccggcaggctcttcgcgccgcggccttcgccgaagaaccagacctcgtcggtgccgggcgcggcgagcacgacgcaggcatgaccttgcagctccgccgaggtccggggtgccccttgcctcgcgagataggcggggctggcgtagtagccggtgcgaaggcgcccgagccttcgggccaccatggcggagtccgcgagcgggccggtccgcagcgccacgtcgtactcctcggagatgaggtccacgtgcgcttcggcgagtgagacttccacgcggagcaggggattgcgcaacagcagctcggcgatgagcggtgtcagcagctcgcccagcagtgagagcgtggcgatgcgcaaggtgccctgcggcgtgacgcgcgactcaccgagcgcgcgattcacctcgcgagcctccgccaccagccgcgcgcagtgggcgtggtagtcgcggcccacctccgtgagccggagcccgcgcgtattgcgctcgatgagccggacgccgagccgctcctccaacgccgcgaggcggcggctcaccgtggacttgcgcagccccagccgctccgcccgggcggggatgccaccggtcggcaccaccttggtgaagaggagcatgtcatccaagaggggcggggc

SEQ ID NO: 264 - DNA, 1432 bp, Myxococcus xanthus
cagcgcttccacgcgcggatgcacatcccgctggtgcgagtggacctcaccggcgcccccgagcaccgcgaagccgaggccatgcagttggctcgcgaggatgccgcgaagccgttcgacctggtgaagggccccgtcgtccggaccacgctggtccggctcgacgagcggctccacatcctgctgggcaacatccaccacatcgtcagcgacacgctgtccatctccatcttcatccacgagctgttccagtgctacgcggccttccagcagggccggccgtctcccctgctcccgctgcccgtgcagtacgcggacttcggcgcctggcagcggaaggtcgtcgccgaagggcgcttgcccgatcaggagtcgtggtggcgtcagcagctcgccgccatgccgaggcagctcggcatcgccacggacaggccgcgtcctccgaccagcccgctcacgtcggtgcgcatgccggtgtccttctccgccgccctgtcccgcgaggtggcggggttcggaaagcgtgagggctacacctcgtacatgatggtgctcgccgcgtggcaggcgctgctgcaccgctacagcgggcagacggacatcatcgtcggtacgcccatcggcaaccgcacccggccagagctgttgccgctcatcgggtacgtggcgcactcggccgcgttccgcaccagcttcgcggacgacccgacgttcctcgagctgctggcccgcgtgcggcaggaggtcaacgacgtccagctccgtccggacgtgcccttcgagcacctcgtggaggccctcatccccggcaaggacattggccggggccggttgacggacaccatcgtcgtcttccacaccaccgcgggcggagccgccgcggcgctggagctgaccggcgttcgggggacgatgatggaagtgccggatgccccggtgcagtggggcgcgacgctgtccgacctgtcgctggtccttggcgatgactccggccgcatcggcggtgcgctggagtacgccaccgagctgttcgacgaagccacggcccggcgcatcgtggagcacctccaggtgttgctgggctcggcgctggcccggccctcggagcgcatctcccggttgcccctggccacggatgcggaccggagcgcctggcccgcccccctgccccggtctgtctcgacgccggttcccacgcgactgtcccaacgcgcggcccgtcagccgggagccaccgccgtccttcagggcgcgacgtcgtggacctggagcgacctggcccagcgtgcgcgcaacgtggccgcacggctgcgcgcgctcggcgtgcaacccggtgagccggtcgcggtctgcctgaagccgtcccccacgaagctcgcagtcctctggggtgtcctggaggcaggtggcgccgtcgtcccgtgggctccac

SEQ ID NO: 265 - DNA, 1483 bp, Myxococcus xanthus
ctccgcggagaggcgccctgcgagacaccgacctccctccggggccactacgtggtcctgctccgccaccgccaccagagtggggcagcgcacgcgggccgcgtgccggatggacagcgtctgcaacgtgcacaggtcccgtaaccgggccaagggaaaggcagggcagcacgggcgcttgcgccagcgcctccgggtcctgagatgtcggtgcccgtcttctccacccacggacgcttccactccaggacgggcgtgcgcgccagttgccggaccaggaacatgcgcggaccccggaagcacacggcgggcgccatcagcgtcagcgcgcgtatctcctccggatgccgcgcggccagctcgagcgccagcagcgcgcccatggacaggcccgccacgaacacactccggtggccccggagcgcgtgcagggcgtgctccgccgccgccaaccagtcacgccaggtgacgtcgagcagggcctgtggggtggtgccatggccgggcaggcgcggcgccaccacgcgcagcccacggaccgccagggcctcgcccagggggcgcacgtcccaggggctccccgtgaagccgtgcaggagcaggcacacctcctcgccccggcccagctcgaagggcgccgtctttcgcgggtccaagggagcggcttctgggaacgggctcacgccgtgacactggccacgcgcgagcgcaggcgctatgccccctgcctcatggcggacactccgaagcccccggacatgcagttgcagattcagatggacgaagacgtggccaatggtcagtacgtcaacatggccctggtgaaccactccgacaccgagttcaccctggacttcatttacgtccagccccagcagcccaaggcccgggtgcgttcgcgcatcatcaccaaccccaagcacatgaagcgcctggtggcggcgatgcaggacaacatccagcgctacgaggcgaagttcggccccatcgcgattccagaggaagacggcggcatgcactgagcgccgttttcgccggggagacccgcacgtcgcgtgtttccatgggcgcttcactggccttcggggccggtgacgcgcagactcggggtcatggtgctgagattcctggtccccttgctcgtatcgctctatgcctcttccgccgcggcccagtgcctgggggatggcgtgcagctcttccccacaccgggctccatcatccccaccaactcccgcttcctgctggaaggcgtcgggacggcgcgcccccaggtggccgcgctggtggggaagaagctgcggctggtgtcggacagccacgtcgtcgaggtggcggtgcagcgcggctgggagagcagcctgggccgcgtcaccgtcatcctcaagccagccggggccatggaggcggacaagcgctacacgctgggcgtggatgaggttctgcccaacgtggcgctcctcaacggccggggcactatgct

SEQ ID NO: 266 - DNA, 1935 bp, Myxococcus xanthus
ggtgctcatcctcgatgacttcggccttgagccgctcggcgctccggagcgcaaggagttgctcgaagtcctggaggaccgctaccagctcgcgagcaccgtggtgacatcccagcttgagccgaaagactggcacgccgtcatcggcgacgcgacgctcgccgacgccatcctcgaccgtctggtccacaacgcccatcgcatcaagctgggcggagagtccatccggtacgtggagacaaatttgacgaagggccgcaagcaggccaagggatgaaccacccagcgtcgctgacgctccgaccgctcgccatcagccggaatcgctgctcggcttgagccggaacgagtgctcaccatgaccggaatacgcactcccacctcctcaggctgggtagcgtcgccagcgcgggcccattcgggtgcgcgccagggtggtgtgacggaggaatggattggcgcgtccgcaggacgtgcaagccggaatggacggtggtgcatacgcaggtggcctcgctgcgctcggctccgcggacacctgcgtggtggcctgggccggcgcgggcggcaccgtcacctccaaggcccctggcgggggagactgatgcgtcactttccgccgccgtccccggtacgcggcctggcgctcggcgtgcgcatgccgtccgtcgcgggtgcgctggtagcgccgcccggccgcgcgcaccgactccgcgcgcgccagcaccccgcacctgcgctcgcagtagcgctgccccctgtcgcaccggctgcacagctggaacagcctccggcactccggccgcccgcacaccaccagacgcaatgactccacgcacaccttcccgtgcgcgccgacttctggcgccgcgccgcggagtgcgctaccccttcctcaccggctcgcccctctcgcacaccagggcgcgcccccaggaaggccctccaggtgtcgctggtgggccttctgacttttcaggacgcgcgcagccccggactccaccggctcgcgctcctctcctcaacttttcggcggcacccagcgctgcccctggcagcggagctctcgaacttctcgccgtccatgaccagaaatccgcgcttcctggtgaccatcaacacccgatgaagggcgctacgctcttggccaccttgcagtggctgggcgtcaccccatccttcagccggccccgcgtttcggacgacaatgcgttctccgaggccctcctccgcacgctgaaataccgccccaccttcccgcagcgccccttcgcgtccgtcgaggacgcgcgtgcatgggtgatgcgcttcatggcttggtacaacagcgagcaccggcactccgccatccgcttcgtcacgccggacgacagacattccggccgcgaggcaacgctcctcgcccggcgcgaccaagtgtatctgcgtgcccgagtccgtcaccccgagcgctggagaggtggcacacgcaactggacgccagcgggccccgtccgtctccggccctctccgaacctctccccggcagaacaggagatgaagcgcatcggctgaaccccctcacgcggtcgggtcgggggccggcgcggtggtgtgcaggctgctcttggccgtatccgccgtttccggcttcgtgcccgtgtagagcgcgccatcactccgtctccggtccccgccacatcgaaccggacaggcgggtttcccgcatccggctcaccgcgaaggcgtcatctcaccggggttatgcttccgctcggcggggagccagctttcaggatggcgtagtacctcacccggtagtcatcaaagagcccccagcttccgtacacgacgtccttactccaccgcttccaaccgaagccccctcggcttcgctctcttcgccgcgaaccgcctcaccttgagttcgacgtggtgtttcaccctgtcgagcgc

SEQ ID NO: 267 - DNA, 1555 bp, Myxococcus xanthus
ctgctcggggggcgcaagcacttcgaggacaagatttcgcggcccatctccgagggccggcagcacgcggccgaggggctcaggcgccgcatccgccccttcgtgctccggcgtctgaagcgggatgtcgcgcccgagctgccgccgcgcatcgagtccgtcatgcacgtgcagatggatgagcgtgagcgctccgtctaccacgcggtgatggcggccacccggaagcaagtggtggcgctgctgaacgagggcggcagcgtgctcaaggcgctggaggccctgctgcggctgcgtcaggccgcgtgtcaccccgcgctcgttccgggccagcgggccaacacgtcatccaaggtggagacgctggtggacgcgctggagacggccgtctcggaaggccacaaggcgctcgtcttctcgcagtggacgtcgctgctggacctcatcgagccgcgcctgaaggcggcgggcatcggcttcggccggctggacggcaccacggccaaccgcggcgaagtcaccgagcgcttccagtcccaggagggcgagccggtgctgctcatgtccctcaaggcgggcggtacgggcctcaacctcacggcggcggaccacgtctttctggtggacccgtggtggaacccggcggcggaggcgcaggccgcggaccgcgcccaccgcattggccaggagcgcacggtgatggtgtaccggctcgtgtcccagggcaccgtggaggagcgcatcctggggctccaggagaagaagcgggccatcttcgaggcggccttgagcgaagccgccgccgcgacggccatcacccgggaagacctgctcgaactcttctcatgacgcgcgcagtccttcttttcgcagtggggttcctcacgatgcttcccgaatccgccgacgcccggccccaggccgccgccacgctgcacgcgctcatccagcaggaatggcagtaccagttggagcacagcccgacgtacgcgtcggtgcagggcgaccggcgctggaacggccgctgggatgacctgagcctcgaggccatcgcggcggaccaccagcacaacctccaggtgctcgcgaagctgaagacggtggaccgcaaggcgctctccgccgcggaccagctcaactacgacctgttccgccgcgactacgagacgtgggtggaggagcaccgcttcaagacgtacctgatgccggtgaaccacatgggcggcatcccggagggcatcaaacagccgccgggcgtgcagacggcctaccagctcgcggacaacctgcgcttcgagacggtgaaggactacgaggactgggtggccaggctccagggcttcgggacctacgtggaccaggtgctggcgctgctgcgcgagggactgcgtgagaagcgcatccacccccaggtcgtcctccagcggattccgccgcaggtggcgaagcagctcgtggcggacccggcggacagcggcttcttcgcgccgttccgccgcttccccaagggcattgcctccgcggagcagcaacgcctgtccgcggcgggccgcgc

SEQ ID NO: 268 - DNA, 1065 bp, Myxococcus xanthus
gagttctccaccaccgtgacgccggcctacaccggcgaccgcgccgtcagcctgcgctacaccacggacggcaccacgtggacgtactgcgacaaggacggcagcaacgtgggtgggtacacgctgggccagcaacacgccctcacggtgggtaaccacgcggagattgagtactgcaagctccagcacccattcgaaatcgcggtggacgccattgacggtgctcggaccgtttacggtcggctgtaccacggaggcgtcacccctggaggtggccaaggcgctggcgtcgtcgcggaactcggctacggccccgcaagcagcgacccgggtatctcgggctggacgtgggtggctgccagctacaacggtgactcgggcggcgatgacgaatacgccgcgaacctgccggagggcgtgcctgttgggacgtcctacacgtaccgatactcctacaacggtggaccgtactgcttcggcgattggcaacctggcggcgaaccaggtggctcagccaacggcgtgtcgccgaacactctaggcacggtcatcccgtagccacatggccagtccactggccgcccggatgcccaccggggcccgggcggccttgcggaatgatcggaccagctgaagcgtatgcttgacagtgtcggatgaggccgataaaagcccgcctcaccgaagcgcggcggacgcctgacgggcggatagctcagcggtagagcggcgcccttacaaggcgatggtcacaggttcaatccctgttccgcccactgatgtaccgatgtggggagttagttcagttggttagaacgccggcctgtcacgccggaggccacgggttcaagtcccgtactcctcgccactaagaagggcccggaatcgcaaggttccgggcccttcgccttttagtgagaggctcgggttttgcccctgccgctcgcagccccatctggggagttagctcagttggttagaacgccggcctgtcacgccggaggccacgggttcaagttcggcactcctcgctagaaagcccagcaatcctgcgggggtgatggg

SEQ ID NO: 269 - DNA, 1415 bp, Myxococcus xanthus
ttcttcgcgctggggggacactccctgctggccacgcaggtggtcgtgcgcgtgcgcgcgcagctcaacacggagatctcgctgcggaccctgttcgacgcacccaccgtggcccgtctggcggagcgcatcgaatcgcaggtccaactggccgacgcaccgggtgtcccggcactggtcccgctggagcgcggtccgtccgctgacgaaggactggcggcgtccttcgcgcagcaacggctctggttcctggagcaactgcaccccgggcaggccgcctacaaccttcccgcggccctgcggctgacgggaccgttggatgtggaggccctgcggcgcactttcctggaagtggtccgccgtcacgaagcggtgcgcaccacctttgtcacgcgcgagggccagcccgcccagcgcatccacccggcgccggctgaatggccgctgcccgaggaggacctgcgcggcctggagcctatcgcccgtgacgcggccgtgcaggcccggatggccgaagaggcccaccgcgccttcgacttggagaagggtccgctgctgcgcacggtgctgctgcgcaccggcgcggacgcgcatgtgctgctgctgtgcatgcaccacatcgtctcggatggctggtccatgggcgtgctcgtgcgggaagtggccgcgctctacgaggcgctgtctcaggggcacgaggccgcgctgcccgcgttgtcggtgcagtacgcggattacgccgcgtggcagcggcgcgtactggaaggcccggcgctggcgccgcaactcgactggtggcgctcacgcctcgaaggcgctcccacgctggagttgcccactgaccacgcgcgtcctgccgtacggacgctgcgaggtgccactcatgcgttcacgatgccaccctccctggtggccgggctggagcgcgtggggcaggaacagggtgccacgctcttcatggtgctgatggcgggctggcaggcgctgctcgcgcgctactccggacagacggacttctgcgtgggcacaccgctggcccatcgcacgcggcccgaactcgaagggctcatcggcttcttcgtcaacaccctggcgctgcgcgcgaacgtggacggcgatcctcgtttcgatgacctggtggcgcgagtccgcgaggagtccctggcggcattcgcgaaccaggacgttcccttcgaccggctggtggaagcgctgggaggccagcgcgacctgtcgcgcacgccgctgttccaggctgccttcgttctccagaacgcccccatgcagccgcccacgttgccgggcatggtcgtcgacgtgctgcgcacgggcacggacacggcccggttcgatgtgacgctgttgctggtggagcgtggcggacggctggagggcgaactcgagtacagcctgga

SEQ ID NO: 270 - DNA, 980 bp, Myxococcus xanthus
aggcgcacgcgaacgtccgtcaagaccatcaccgagcccgtcacgtgaagcatccgcgaggtcgcgcggtggtactcgtccagtcgccccagccgcaccggcgggtacagcggcaccggcaccgcgcccgcgagcaacgtgccgaagaaggcatccatgaaggccggcgacgtgggcagcagcaacgccacccggtcaccctcgctcacgcccagccgggccagccccgcggcggtgcgcttcgcccggcggtacacgtccgcccagggcatggacacctcgcgctcggccgcgtccacgaaggtgagccccagcggcgacgtgcgcccggtgtccgcgagcgccgcgttcaccgtcagatgcctgggcggaggcaacgccgggcccaccagtcgcgaaccagcgcccttcacggcagggcctcctccggcctgggttccaccggagccgcgacccgctgcgccaccagcttcgccaggtctcccaccgtgcgcacgccctgcgcgtcctcttcggacaggcggatgcggaagcggttctccagccccaccgccagcaccgtgaggcccaggctgtccaactggaggtcccgcaccaggtcctgcgagggctccaccgcgcccttccactccagctcctcggtgacgatgcgatgaatctccgtcatgacctccagttcgcgttcagccacgtggcacctccggaatgaaacgagggcgatgggagaacgcctgcgcgtacacctcgcccagcgccgcctcctccgcgcggattcgcacgtagagcagcgccgcattgcccactgagaagaccagcgccgtccaccatgcaccgtggatgagcggcacgcacgccagttccaacaccaccgcgacatagttggggtggcgcaggaagcgatagggcccgcccgtcaccggcgccagccccggcaccacgatgatgcgcgagttccaccggtcgcccaacgtggcgatggc

SEQ ID NO: 271 - DNA, 1501 bp, Myxococcus xanthus
ggtggcggcggcgatgccgctgaggctggtgcccagctcttcttccaggatgacgcgcgggagctggtgagacggcttttttccgccaccgcgacgaagagcagggtgggcacgaggaacgccaccagtagtcgcgcggagagcgagcccagcgcgtcacgccatcgcgaagtgtgtggggcaacgtggggcatgtccggggcgggactctaatcgagcctcgtctccctcgcgggggcgcggctgtgtgctgctgcctgctcggatgggggttgccgagggcgccttcgtgtgcgtactttatatgtggcgcctcacggcgctgtcccatgaccttcgctcgctaacccaggcttccgtgattgcccttgccgctccggccgatgtgccgtggcgttgacgtgggcttctgtccggatgcgtgggtccccgctgtgtttcccagtcgtcttcctgaacctgaatgaccggcgcctttgcgcgcgcggcatggagaacacgtatgcgaaagctcaagtaccacgttgccaccagcgtcgacggtttcatcgcccacgaggacgatacgtacggcgccttcatgcaggaccgcctcatcaaggacagcgagcatgtcgcggactacgtcgcgtcgctggcgacctatgcgacggtgctcatggggcggcgcacctatgacggcggcctcaaggtgggggtgacggacccctatccgaacatggacacctacgtcttcagccgcacgatgaaggagagcccgaatccgcgcgtgaagctggtgtcggacgacgcggtgggcgaggtccggcgtctgaaggcgcaggagggcggtgacatctacctgagcggtggtggcgcgttcgccgggctgctgctcgccgaggggctggtcgacgaggtcctgctcaagatgaacccgctgatactcggctcgggcatcctgctggcgtcctcgctgaagcaggtggtggacctggacctcaagtccaccaaggtctacgccaacggcgtcgtgctgctgcgctacgccgtgatgcctcggccgcaggcttagctcgcggtacctcgggagggagcgtgtccgcgtgacttggacgcgctccctccgggtgtggttactggtggaggaaggcgcccttcaccgcgtccagcagcgggttggcgccggtggtggggttggtgcagccctggttaagggtccagatgatggtgccgccgaagccgttgtcgcgggcgtaggcgcccttggcggcgattgcctccgggctgtcataggagacccatcgcacggtgccgtcctccacgggcgtgttgaacgtgacgtagctggccgccgccaccgcgtcccagcggtacgtgcccgacgaggagagctaaggggatgcccatgtccagctttgccttcgggatgcctgtgcgggcccagccctggaggctggaggacacggacgtcggccggttgccggacgcgccgtagagcgaagacgtgtacagtagagca

SEQ ID NO: 272 - DNA, 1872 bp, Myxococcus xanthus
gaggacgatgttgccgcgcttcttgttgaacttgatgaccttgaactcgaattccttcgagatgtactggtcaaggttccgcacggggcggatgtcaacttgcgagccgggcaggaacgccttcacgccgatgtcgacggacaggccgcccttcacgcgaccgacgatggtgcccttgacgatctcatcgcgctcgcaggcggcgctgatctcgtcccagatgcgcatcttgtcggccttctccttggagaggacgaccatgccggtgtcgttctcgcgactctccaggaggacctcgacggggtcaccggcctgaaccgagacctctccgcgagggttggtgaactcggagatcgggacctgtccctcggacttgtagccgatgtcgacaatcgcgaagtccttcgtcacctggaccacggtgcccttgacgatctccccttccttcaggatgccgtcaccaccgcgctcattgagagaggcctcgaacattgcggcaaagtcttcgtcgccgccgtccatcccgacctgctggttcacgttctgctgcatgaaatggaagtcctttgaaaccggtacaactgccccctgatggtggtttttccgtcgcggcctgcggggagcagcgggcagtgacgttcgtcctcctcattgaggacttgatttgatggaagccgcgcaccctagacaccggtgattccggtagtcaagcgagctcgtgccccctgtgctgttgggtggatgtcctacctcggagctgtcaatgccccggttcggcgtccgcccggctgggatccaggcgggagggcgtgaaccccggccgtgcggaccctggttcctagttaagaacgcctgccctgccgcgcagccccgttccgcaggatgcctgcccccagcctggtgcccgaacaggcagtcaaggccctgaaattccagggccaactccgggccgcactcaaccgccggcggccccggatttcttcccggccgtcagcccaggagcttgaagctctcgcgggcgatcaccatccgctgcacctcgctggtgccttcgtagatggtctgcacgcgggcgtcgcggaagaaccgctccaccgggaactcgtcgatgtagccgtagccgccgtggagctgcacggccttgtcggccaccttgttgctcatctcgctggcgaagagcttcgccatggaggcctcgcgggagaacggctgtcccttctccttcatcgacgccgcacgcagcgtcagcagctccgccgcctccaactgcgtctgcatgtccgcgagcatgaagcgcgggccctggaactcgccaatgggctggccgaacgcctgacggtccttcacgtaggccacggtcgcctcgagcgccgcgcgccccacgccgcaggcctgcgccgcgatgccaatgcgcccaccgtccagcgccaccatggccagcttgaagccctgcccttcggcgcccagcaggttctccgccggaacctcgcagtcctcgaacgtgagcgacaccgtgttcgaggagcgcaggcccatcttgtcctcgtgcttgccgatgatgagccccttcgtcccgccttcgacgatgaagcacgacaagcccttgttgccggcgggggacgtgcgtgcccacaccaccatcacccccgcgtacgcgccggaggtgatccactgcttgctgccgttgaggacccacacgtccccgcgccgcaccgcggtggtgcgcagcgcgccggggtcggagcccgcatgggggctcggacagcgcgaacgagcccgcgatggcctcgccggacgccagccgcgtcacgtacttctcgcgctgcgcgtcggtgccgaacgcgttgatgagctcgccgcacatgttggtga

SEQ ID NO: 273 - DNA, 1652 bp, Myxococcus xanthus
gtgctctaaaggcatccacttcggcaccgcgctgctgtgcgccgcgcccatgttgaccagcggcgtcctgttctcgctcgtccaccggcggcgccgccgcatcgagccctggggctgggggtggctcatcttcggcgtggcgacgatgcacttcttcgtggccgcgctgatggccctgtcggcgccgccaggggccgccgtcatcgcctcgctgttcctcttcaccaccgccttccatggccggctgcaccgggtgacgccgcgccagcccttcctcgccctgggcaccgcgctggccctggcgctggccctgcccctgcgcggcagcgacgaacacctggccctcttcggcgtcatcggacccgcggcgctcaccgcccagctctatctggggaccttcgccgtgcagcatgaccgggcccgcgcggacgcggagcgcctgcgcgccgccgtgcacgcgcaactgctggagcagcaggagcgcgacgtgggccgcctgtcgcaggcgctgtcggaaatcctgggctaccaccacgacatcgacaacgcgctcatggcggcgggcagcgcggcggacatgctggccgtggtgggcgcgcaccgcccgggccccggccgcaccgagttcgacgacctgctccggcagctcaacgacaacctgacgcagatacgggacatgatgatggacgcccgcaacaaggggcggcgccatgccggcatggagccggagcccgtggagctggcgccggtgctggactcggtgcaggccagcgtgggcctgcgcttcccggacgtggacatccaggtggaggtggagcagccctccccgcccctgcgcgccctgatgcgcggcggcgcgcccacgctgcgccgcgtggtggagaacctggtgctcaacgcctgcgagggcaacggcgaggaaggcgccgcgcgggtccacatccatgcgcgcgtggagccgctcagcgggcgcctggaggtcacgattacagatgatggccccggcttcccgcccggccagctcagccgccccgccgaggcgctgtacaccagcaagtcccacgcgacgggcctgggcctctacaccagcgagtgcctcctgcgcgccagcggcggcatgctgcaccggcggaacgcgacagggggcggcgccgtgctccgcatggtccttcccagggagtaccgatgagcggcggagccctgtaccaggagtcgctgcgcgcgcttcgccggctgggcttgccggaggtgtcggagcgggacgtgctcgcggcgctggaggcggcgcagcccggccccctgtccctcttctacgaggcgggcgcggaggccggtctgccgcgcgaggccctgatggcgcgcggcgccgggctcttcctcagcttcagcgcgggcaacctcgccgacgacctcatcgacggtgagtgcacgtaccacgacccacccatccgcgtggggccgtgcgtgcagttcatcctccagaacctggccttcgccacgctgtgcggcgcgccggcgcaactgccgggcacggtgctggaagaggcggtccgcaccctggcggtggccgccggcccgcaggcgctggaggtgcgcgccagcgactggacggcgccgttgttccgccaggtcgcggagggcatctttagagc

SEQ ID NO: 274 - DNA, 1343 bp, Myxococcus xanthus
cagacacagggcgagcagcaacttggggcggttcaaatccggaggctccgtgagggaggggggcgtaactgccaccgggggttcagcgcgactctcggcttccacatcctatcggtcgtattcccaaccatcaaccgcgctgagcaagcgtggttaccgtctatccctccggtattccttcacaattccacccgctgtaccgccgtacggggacgttggtgttccagggggctgtgctaccctcccgaggctcgcgggccccgaggtcccgtgccccatcccccctttgtagaggtcagaggtcccatgaagatgttcgtgcgaaccgccctcatgatgtccgccgcgctcctgttgggtggctgtgaggtggccagcgagattggcaagccgtgcgcgctggtgcgaaaggcgacccccgaggagtcggcggccaacaacaactccgcaaccatgcccatcctggagcgggagatcgcggcccagcaggacttcatctcgttcggatccgtgaactgcgaggatctgatttgcgttcgggaccaggactaccctcgggccctcaatgaggatggatcactgaacgagaatgctccggcgatgggctactgcagcaagccctgcgtcgagggcggctcgtcctgcgaggtgacggacaccgacgacgtcaatccggacctgccccgccggatgtcgtgccgcccgatgctgctggatcaggacacgctggatgctctccgctccgcggacgaggccttctatcggcggacgttcggcgagaacaactcgcccttcttctgcgccggcgcgctcatcccggattgacccacccgacacttttcgcgcggaggggtagacctttccgcgcgactggttcgtaaagggagggcccgcgctgtttccgcaaggagccctgcctcatgaaccgtacggtcgtcttcctcagtctggctggcggtctcgcgctcaccgcattggtgctgggactgccccagatgggcaccccgccggagccgatcgtcgtcgtccaccccactccaccgccgcccgccccgcccccgccgcccgtcgtgcccgccacggtgggctcgctgacgctgacgagccggctgtcccatccgtacgtccccgcgggcacctccgaggtgttcgccaccttcgacctgtcgggcgctcaggtgcccgggtcacaccgaagccctgtcaatctggcgctcgtcatcaaccgttcgggctccatgagcggctacaagctggcccaagccaagcaggcggggcggcacctcatcgggctgctgaatgaccaataccggctggccatcatccactaccgggtcggacgt

SEQ ID NO: 275 - DNA, 1383 bp, Myxococcus xanthus
tgtggcgctacgagcggaccaggctcggtggacttgttgctggggtacgcggtcgaggaccactacccttggaaggttcagtgcatggaggagcttgttaatgataggtctgatggcctcaatgagaacaagattttctttactatctagcagaacatgtcggtggacttgctgatcctggacctgaaacggcctggactcgataggggtgtggccgttcagtctgccggaggatggaggatcaccccctgtacccgcaaggggtgccccgggttccgctcgtctcccgcgagcactttatcttgtgggggacaaggtggcacaaccgatcatcttgaccgtgggcgaccaggtcttgcccggcttatggatgtggacggtggagtgcatccgcgccgtgcacggagacattgacatcaccgtccggggggcgctctacacgcggggcgccctgccaggcacctcggcccctctgggtggcgcacggcggatgaagctgtccacctatctggacgaggtgggggcctcctcgtcgcttccgctcgaaagcgacctggatgaactcgcggacacgatgctggggaagcggccagaggacatcaaccatctggtgggtccatcgctgcttcgggccgtcccctccctgcgagaggacgtccgcttcccggactacgccccccggtggttgaaccgcctcaccgaatcctctgtctggatcgccccgcgcggcaccttcgctcagcttcacagggatcgcgcccacaacctctatgcccagctctccggccagaagcgctggcaactctatgcgccccaccaggcccggcgactccaaccagcaccgctcgactgggccgcggacctgagcggagtggacctcgaggtgggagcggccaggcggatgaccgcgagcgggctccggccggattacgacttcatcctcgaaccgggcgacctgctcttcctgccggtgaactggtggcatcgcgtccacaccgtttccccctccatcgcgttcaacctctggtggtgggacatcccgtcagcggttcgcgtcggtccggtggcggcacgcattgccctggggatgaagctgcaagaggcctattcctccctgcaccgcaggtcccccgcgtctgagcagcgatgagcgagtcagggaccggcgtgctgcgcttcgccatcatctggggcagccagacggtgtcgaagctcggcagcgccctgaccagcttcgccctggggctctgggtgtatggcctcaccagctcggtcacggatttcgcgctgatctccgtgctgaccatcctgcccggggtgctcgtggcacccatcgtgggggtgctggtggatcgctgggatctccggaacgcgatgcgtctg

SEQ ID NO: 276 - DNA, 1667 bp, Myxococcus xanthus
gctcaacctggtgtgcttcccggatgagctcccgctgaaggtgctgtcgaaaatcctggcgggcggccagtccaaggcggacgaggccggcatccccatcctgggcggccacagcatccgtgaccccgagccgaagttcggcatggccgtcaccggcgtggtgcacccgaagaaggtgctcaccaacgcgggcgcgaagccgggggacgtgctctttctcaccaagcccctgggctcgggcatcgcgaccaccgccatcaagcggggcgtggcgtccaagcagttggcgaagcgggccctgggggtgatgacgacgctcaaccgggccgccggcgaggtgttcgcctccgggaagttcaaggtgaacgccctcacggacgtgacgggctacggcttgttggggcacttgctggagatgatgaccgcggcgaaggcgcgcgccacgctggacctggagcgcatcccgctcatcgccgaggtccccgcgctggcggaggacggcgtggtgcccggcggtacgaagtcgaacctcgcccacgtccacaagaaggtccgcttccccgaagcactgcccgagtgcatccagtgggtgctcgcggatgcgcagaccaacggcggcctcctggccagcgtccccgcacgtcaggcgctcaaggcgctcaaggcgctggaggcggccggcgtggacgcggcgctgattggtgaagtccaggcggggaagccgggcatcgacgtggtgggctgaggcccggatttcgctctggcggccgggctccgctagcatgcggccccagcatgccgtcgccgcgccgccccctcctcggcctcctggccctgctctggctggtccccgtcatcgccggggcggcggagcgtcccgcgcgcatcatcatcgacccgggacacggtggtgcgaaggaaggcgccaagggccccggcaagctgcgggagaaggacgtcgcgctccagatttcgctccgcctccgggacaagctcgaggccgcggggggcgacgtgttcctgacgcgcgagcacgacacgctggtgtcgttgacggagcgcgtggcgtggagcaatgaccacgcgcccgacctcttcatctccatccacgccaactccatgcccacgaagcggatgcgcgcgcgcaccgagggcgtggagacgtactttctgtccgccagcgcctcgggtgacgccgcgctcgccgtggcggatcgggagaacgcggaggcgcccatgtcgcgcgccacgcggacggactccacgctggccttcatcctccaggacctggcgcgcacggaggcgcacgcggattcctcgcgcctggcctacgccatccacccgcgcctcgtgcgcggcacccgcgcggtgaaccggggcgtgcagcaggcgcccttcttcgtcctctccggcgtggagtgcccggccgtcctcgtggaggtgggctacatctcccatcccgtggaggggccccggctgggccggccggagtaccaggagaagctggccgaggcgattaccgagggcgtgctggccttcctcaaggagacgcgccgccgggacgccgcccgggggaccgaggtggctggccccgtgtcgccctgagtgcaacggcgccaaggcaatcgacacccgcgcggcgtggctctggtagagaggggacgctc

SEQ ID NO: 277 - DNA, 1610 bp, Myxococcus xanthus
ctaaggcgccctgtgccttcgctggcctcatctccgcgcagcgtctgctgtccacgccggacgcggccaccgacggccaggtccacctgtccggcctgttgatggtggcgggcggcgcggcgctctccggcgagctcgtctacggcctcttcctgattgtcttcggcgtgctggccagcatcgccctggcgctgggcgtggtggagtccgcggtccccgaaggcgaaccggtgccggtgcgcgcggtgatgggcccgctggccacgggcgtgggcttcgccgtggtgggcgcggtggccttcttcatcctcttcccccgcctcaactggaacatgattggccccagcgcctcgcccggcctgggcgtggccaccgcgggattctccaacaccgtgcgcctgggcggcgcgggcaccatcaagggcaacccgcgcatcgtgctgcgcgccaccctgaccccggacccggagaaggaaacgctcgacgcctactgggtgggccgcacctatgacgtcttcgacggcatggagtggtccaacgcgcgcgccaccagcaacggctccgagttcatgacgacgctgcggccgggccaggagaacctggtccaccagcacgtggagctgatgcccgcgtacggcgcgcgcacgctggtggcgctggagacgccctcgcggctgggcaacgccgtggccaacacgcaggtgggctcccggcgcacgcaaatccacgaactgggcggcggcgaggtgcgcttccgcgactccggcatctcctattcatatgaggcctacagcctcccgcccggcgccagcggcgacgacgtccaggacctgcccccggaggagcaggacgccctgctgtcgctgccggaggggcctgggacgtccgcgtcggccagacagccgcgcgggtgctgaatggcgaacgcgacccgctggccgccgcgcggaagctgtccgcgtggctgcaacgcgaatacagctacacgctggagttgagcggcgacgtgccggacccggtcgccgacttcctcttccagcgcaagcagggacactgcgagcacttcgccaccgcgctcacgttgatgctgcgcacccagggcatgcgggcgcggctggccaccggcttcttcggcggcgagcgcgtgacgggtggctacgtggtccgcgcgggtgatgcgcatgcctggacgcacgtgctggtgccagggcgcggcttcatcaccgtggacgcgacgccgccggcccaccgcgcgagccagtcccctcgcctgctggagcagctcatcaacttctatgaaatcgtggagtcgcagtggcgtgacgtcgtcctggactacaacttccgcgatcaactgacggtcgtccgctcgctcactcgctcgcacgaggtcccgaagaaggacgagccggccagccgcgcgccgcccccccgggcctttggtgccgcgctgctcgcggccgccgcggcctataccgcctggcggttgctgacgcagttcctgtcgcgtgagcggcccttggaggccacgcgcttcgtggacgcggtggaggcgcagctcgccttcgcgcgaatacacgcgtcgaggtgaaacattggagcactgacgc

SEQ ID NO: 278 - DNA, 907 bp, Myxococcus xanthus
  unsure (1)..(907): unsure at all n locations
cgcgcaaccgccccatgcctgcccgcctgcccacaacgtctcctcgacttcgtacaggcccccgaccatgattgccgcgcgcgtcaaccgggccacatggattccaccacagctgaacgtcctcgccggcggtgggctcgaatcatcgcgggcgtggtttttacaatcctagtcgtgctccccgcgctggcactggtcgctgccgtggtggtgttgcgcaacctggacagtccctggctgaagcagcccattgtctccgaggtgaaggcggccaccgggctccaggtggactaccaggtcgcccaggtcgagctcctctcggggttgaagttgggtgggctggtggtgctgacacccgctccgttccataccgccgcgcccgagttgctgcgcgtcggcacgttggaggcgcactggtcgccccgtgcgctggtgaccggtcccatccggattgagcgggtggtggtgcgggacgtggcgctcgccctggtcgctgacgattcaggcgccacctccctcacgggactgacgggacctgaagccccagagccgccgcccgttgaagcgccggtgagtgcctcccagcaggtcgccaacctcctgggagcgccgcttcctgtcgggcacgtcgatgtgacgggcgtgtcgctgagctacgtccgcgtccagcgtggcgaagtcgccgagcgctggtccctgggcgggctcgcggcgcgggtcgaagcgaagcaacacgacggggaatggaaggtcttcgcgaacctgggccaggcgggcgccccgctgccgctggaactgcgccacgaaggcgccgccacgcccccggncctcgcggagttggcgttcgccctttcgctggaggctggtgcttcggccgctcgcgcgcaggtggacctcgatgtcaccc

SEQ ID NO: 279 - DNA, 1519 bp, Myxococcus xanthus
gacaggaacctggcggaggggccgacgatggcggatatggacaccaggtccttttgcttttggatggcggcgcgcgccccttcctcggagaggcccacggcggccatctttccctggcccccagccctggcctgcatgcggctgccctcacatatgaccagcatggcctgctccagcgtgaaccggccggcggcataggccgacgcgacctcacccgcgctgtggccaatcaccgccgcgggcgtgatgcccgcgcgccgccacatctccagcaagccaatctggaggaacgtgttcgcgggctgcgcgatgtccgtccgcgccatgttggaggactgctcgtccgcgagcatctgctccagcagcgaccagcccgccagccgctggaagagggcgtcgcagcggtccagggtggcgcggaacagcgcgtcttgcgcgtagagctcccggcccatggcccaccattggggccccatgccggtgaacacgaagacgggccgggcatccgcggcctggagcgtccggccggaagcgcccagctcggcggggttgcccgacgcgaaggactccagccgcgccgtcagatcggccacgtcctccgtcgccagcagcgccagccggtgctcatggtgggcgcggcgcgtggccgcggagaagcagatgtccggcagcgaggccggcgccggcgtggcgagcatctccgcgtaggactgcgccagggcgcgcagcgcctcggggctgcgggcggagagggggaggagcagcggcgccggggttgcatcggcgcgggcttgcgatgcggcggacggggcctgctcgatgacgcagtgggcgttggtgccgccgtagccgaaggagttgacgcccatccgcagcggctcgtccttccggggcgcgagcgtttcaagcgcgcgcgggatgcggatgcccagcgtgtcgaaggggatggcggggttgaggttgcgcaggttggcctgcgggggcaactgccggtgctgcaggcacaggctcgccttgatgagaccggccacgccagccgcggcctccaggtgcccgatgttggccttgagcgagccgacccacggtccctggccgtcctcgcgcttggagacggcgcccaggccacccagctccgccgggtcacccacggcggtgcccgtgccatgggcctcgaaggcatggatttcggtggggtccaacgcggcgctggcgcagacgcggcgaatcagcgcttcctgcgcgcgagagctcggcgccgtcatggactcgctgtggccgtcctggatgacgcccgttcctctaatgacggcgtagacgcggtcctggtcgcggaccgcgtcggagagccgcttgagcaccacgatgccggcgccctcgccacggccgtagccgtccgcgcgggtatcaaagctcttggagtacccgtccgccgacaggaacttgcccttgctcatggccacgaagatctcgggccggaacatgacgttgacgccacccgccagcgccaatgacgtggtgc

SEQ ID NO: 280 - DNA, 2234 bp, Myxococcus xanthus
gtgctctaaagtggacttcagccccccagcacctgcgccaggtccgaggcccgcagcttcgccgcgcagcccgcgcagtggctcagctcggtgaggcgcttcaccttgtccgtcttcttctccgccatgcccgctccccacgcctcgccgtcccggcacgggccccggaaagggcccggcccgttcaccgctcaggccgctcggatgtagtcccgcttgagcagttgcaccacggcctcggcggtgacgacgtcgtccgcgtccgcgtggtccatcaccgcgttcagggtgccgtagttgtgcaccagttgcagcacgtccagcagctctggcgccagctccttgagcggcggcgtcagcggcgaggccagcgccagcgcagtatccgccgtcgggaggctcggctgcaggcgcttgatttcgtccaactggcggagcgcgtccatgaggagcgcctcggtggacgagtccagctccaccatgaactcctggttctccgccgggcgcagctcgaagtcgccctcttcccaggtgatgatgcggttgaagctcttctgcggccccaggttgtggttctcgccgatgacggcgtagtacacgcggccctggcgcaggtagatgcgcccttcctggtcgctgcgctgcaccaccagcacgccgttcttcttggacgtgtggaacatctggagcaggtccgggaggggaatctcatcgatcttccccgtcatggagctggccttgttggtggtccgcgcggcttgggccgcggcggcctcctccagcttcagccgggcggtgccctcgtccacgctggagcattaggcgccctggtgcacgagcttgaggatggaggtgccgattagtatgcggtccccttccttcagacgggactgcttcaccttctcaccgttgacgaaggtgccgttggtggagcccaggtcctcgatggtgatgctcccatcggagaagctgatgcgcgcgtgcttgcgggagaccatgtcctccccgagcaccatgtccagctcactggagcggccgatgacgatctgcttgtccgccttcagcgggaattcgccgccctggtacttccctgagatgaacttgagggcgtaggtcttttgggtgtccatggtcgtcagccagcctgctccgccttgccggggtccttcaccagattgaggtacatctgcgcgctcttgttaccggggctgcgcaccagcacgtcctcccagacatgcaccgcctccgcccgccgcccggccgagtacagcgcgactccatactggatgtgtcccgggatgaaagccgggttctgggcgatgacctgctcgtattcgatgagggccgccgcgttgtcccccgcgtcgcgcagggcgttgcccagcttgaggcggatgtccacgaactgagggcacagcgcgagtgcgcgccggtactcctcaatggccttggcccacacgccgctggaggcgaagacgtcgccaatctcgccgtacatgttggcgatcttcttctccacgtaggggtccagctcgtccgggccggatttctgctgggagagggcggcctggtagacctccttcgcctcggcgtacttccccatgtcgttgtagatgacggccagattgagcgccgcctcggtataggcggggttgagcttcagcgctgattcgaacgcgcgctgcgcccgggcgaactgcccctggtcgtggtagatgatgccgagcatgttgaacacgtccgcgaacgtcggattctgctcgacgatcttcgcgaggtattgctcggcctgcgcgtactgcttcttctcgaagtagccgcgcccgagggtcagtagctgcttgaggggctcgtccatgaatcggcccgccagggccctgcctccgagacgtccagcctacatgaggctgggagaaaacaagaattcatcaccgctgagcgacaacgagagttgccgctggccccgggtatccaccggccgcgccggcagcgccccctgaaggcgccaatgctccgtcaccaccgcatcgtcccgctccagccggacgtaccacgcttccgcctggtaaccccgcgcccgaacctggcgcaattgctcccactccggcccgcccactccgggcgtgcccggtcccgccagccgccccagggactccgcgtccgccgcctgcagcgccctgcggcgggactccagggcccacaccaccgcctggagccggggcgccgccgtcgtc

SEQ ID NO: 281 - DNA, 1800 bp, Myxococcus xanthus
cctattttgcttggggagaccgacgcccgcacgcgcatcaacctgttaaccaaggacccggtgccggacctgtgtccctactgccgctaggatcacccaaactcggaggcggcccatcagtgccgcaatctgcatgcggccaccttcgacgtcgtgggccacctgcgggaggtgagcgccgcccgccctcggaggaacgtgctgcctcgcgacgcggacgacatctgctgctaccccggcccgggcatggagtgcccgcgaccgatccgaccttgcgtcaatccgtagtcttctgatgattctcgcgacccggtgacgggaagcagggaggagcggtccattgggccgctccgtggagagggacattgaaaacgctgcagaagctggccctgaccggcctgatttccctgagtgcgcccgcgtgggccagtgacttcgtggacacccgtctgtcgttcgtcttcgcggacgacaacgtgctcgcgggctctggtgagacgacgccgaacagccccgatgcacggttcggcgccggcaaccagaacacgcagttctacgacaacttcaacacccggttctccggcttcgagtccctgtcgaacgtggtgctctacaagcgggcaccggcgttcttcgagggtttgacgaccgaagcggcgctgacgctgctggtgctcgagcggccgtcgggcggcgtcgacatccgggacaactccagctacatccgcctcaactaccagccgccgggctggagcgagaaggaaggcatctcgctcgtcggcttcccggtgtccgcggaccgtttccgtctgggctatgcgtaccgcatctcctggggtggcagcggcgtgttcaccacccgcgccgccaccaacggcgtgcccggtggcaagctgcagatcacccgcgacaactggtacgcgtacgtcggcggcaagactgcgctcatgcagaacgagctcatccgcgaggaagagaccaagtacggcctcatggccggcgcgggctgggacatcctggagacgctgcgcgtcgaggccggcggcggctacttccagaagggcctggtgcccggcctggcgacgctcggcgtggaagcgccggtgaacgccgcgggcgtgtccggacaaatcgtctaccacgtgggtgtgcccgtcggcaccagcgtggacttccggctctacaagaacgacccggacatctatcagcgcttcttcgcgccggagcagtacccgggcggcctgtcgtacaccgtgtcgctggaaggtagctacctgtcgcagacgctggagaagcccaacgacttcggcgccaccaagccgcagggcgccaccgccgtggccctccaggcgcgcgcgaagtacgacctgctccgcgtcagcctcctcggcctgtaccgcagcctgtccttcatccagttcgaggtgccgggcttcccgccgttccaggacttcccggagggcacggagctgaagccggagatgttcctcgcggtgggcgcggactaccacctgccgaagctgcacttcacgccgggcttcatcatcggtgtgcagcagccggcctcgttccgcagccccacgccggtgctgggcggcaacaacccgccggagaacctcatcggcacgcgcaccgtcgtggtgcgtgacgtgaaccagctcagcatccttccggagacgtgcggccgcggcggcgcggcgtgcaaggcggagcccatctactccgcgaaggccacgttccgctgggacctgtccgactccgtcgccgccgtcggcgaggtctactacacgtacgacacca

SEQ ID NO: 282 - DNA, 1069 bp, Myxococcus xanthus
ccggaccacggagggggtccgccacgaacaaggagttgcccctgaagttaaggctcgccggaggcggaaggtccgtcccgggcacgccgaccgccgggacaaagcggcccgccagtcccggccagggcggcggcggcctgggcatcaagacgggccgctgagcctcgcgcgggaaaatccgcgcgaaatgattttctgagacggtgcgcgcgccgggccctcagggggattggaccccctcacaggcccaggcgccatgactccagaatccctccaccgttccgccgcccccgctccgggccgtcgcgtgcccaaggcgctggcgtggctcgcgagcgcggccttgctcgtgggaggcgtggcgctgctgtcgtcgcgtggcggcgatggcgcgtcgtccgatgccgaagccggcggcaccgccgcggcggcccgcgaggccgcatccggcgggcgaggccacggagggcgcgcgggcgcgggtgggacgcacgacgaagagccgccgccccctcgcttcgacgaggccgtgtgctggcgcgagctcgagcgcttcgacgcggcggtgacgctggagaacttccgcgcgtgggccgcgccgctgctcgcgtcgggggattcactggtcgcggactacctggcggggcgcctgacggagctgattggccaggacccgggccgagcgagcgaggtgttgtcctgggcgcgcaccgcggggcccgacgagttcgacgtcctcctgacggcgctgcgtggctcggaggcggtgcaccacgcccaggtggccacccggctgctggcgcagggcctggacgccacgctcgacggcggacggcgcgcgggcctcctggccgcgctggacacacagaagcgcttcgagccagcggcgctgaacacgctgacgtccttcgcgaaggaccccgtctccggcgaggcgggctgggccgccacgcgcaccatcgcccgcgtcatgaagcgcgacttcgaggcgaagggcaacgccgcgccctacatggacgcgctgctcaccatcggcaccgagtcccccgacgagcagatctgtagagcg

SEQ ID NO: 283 - DNA, 1767 bp, Myxococcus xanthus
agcgcaccgtgtccatggccacccgggcggtggacgggcccgacgcgggagcacgggccccgggcgtctgcccctccttccacgcctcgagccggcggcgcgcctggttggcaatgtcctcgacgaaatggaagaggtcttcggagtcggacatgcccggccccttagcccacttccaggccctcgggaagcgctcgcgggagaagcgcgcatcatcggtgcccctgggtgccaggggggggacggagcggtagagtccgcctcgtgatgtcctttgcccggtggctcgcactcctcgtccttctcctcgcctcggttccgggccaggccctggcccaatccgccggccagccgctcacggtgcatttcttcgacgtgggacagggggacgccgcgctcatcatctcccccaccggcaagacggtgctcatcgacagcggcccgcccgacgcgcggcaccgcctggagcagcggctgcgggagttggtgaaggagccgctggacctcgccatcctcacgcacccccacctggaccacctgggaggcatgtccaccgcgctgcgctcggtgggggcccggcgcttcatggacccggggttcgaccacccgagcgaggcgtaccgcgacctgctcaacgtcgtgggcgacgaagtgggccaggtgatgacgcccgttcccaacccccaggacccgcgctccctggtcaccattggcctgggggatggcgcggcgctcaccgtgctgtggcctcgcgtgccggaagatcccttcctcacgggcacccgctcggacccgaactccaactccatcgtcgccaagctgacctacggcaagacggcgttcctcttcaccggcgacgccgagccggataccgaggccacgctgctacgcaagcccatcgacctcacgtccaccgtgctgaaggtggcccaccacggcgggcggcactcgtccaccgcggacttcctggccgcggtgaagccccaagccgccgtcatctccgtgggcgcgaagaacgactacggccaccccacctccgcggtgctggagcggctgcgcgcggtgaaggccaccgtgttccgcaccgaccaggacggcgaggtggtggcgaccagcgacggcaacgtcgtctccctgcgcgcggagaagcgcggaggggcgtcggagctggttcccggaggcgtgaagcccggctcggtcgcgctcgggcccatcacccggggaacgcgccggaccagcacgccccgtgggcgcggcgccgcgtccgccccggcggaggcccccggcaccgactccacgcaacgcgacacggacgcgccccgatacttcagcctcaagggcagcaaggtgtttcacaaagagagctgccggaccctgaagcgctccaagtcggaccgcaccgcctattcgagccgcgccgaagccatgcgcgagcgccgccccgccgaggactgccacccatgagcttccgcccgcgcgtcctcctccctgtcctgctggcactggccgcctgcaaggaatcaccgccacctcccccgcagccggtagccacgcgaccggcggagccccctcggcgctacttcggtggcaccccggacgggaagctccacgtctacttcttcgacgtcggccagggcgacgccgcgctcatcgtgtcgccggacgggtacaccgcgctggtggacacgggccccgcttccgcggcggagcacctggtcaaccggctgcccgagctgctcacgcagcggctggacctggtggtgctca

SEQ ID NO: 284 - DNA, 936 bp, Myxococcus xanthus
ctctaaaggagaatcccggcctggggttccacaccaccggcgaggagcgggcggaggaattccgcgccatcctcgcggacggccacgtcgccgcctacatccgcaggaaccggggccgggacatcgccggcgcctgcgggcaactcgccaatcgcggcgagacacaagccgggaccgatagtacgacataagttcccgaacttccttgacaatccaacgggtgcagcgttaagagcgccacccctttcctaagacgtttcctgttcgttggagagcattcaatggccgttgtcctccgtcttgcccgcgcgggcgtcaagaagaagccgtactaccacgtggtcgccaccgactcccgtaacccccgggacggcaagttcatcgaggccgtgggcgcgtacgacccgaaccaggagccgccgaaggtggagttcaacgaggagcgcctcaactactggctgaagactggcgcgacgccgtctgagaccgttgcggacctgatcaaggtcgccggcaaggccaagcccgctcccgcggtctgagccacgcccgagtggacgtggagcagcttctcaactatctggcgcgggccctggtcgatcatcctgaccaggtcagcctgcgcatttccgaggcggaaggggcccggctcttcgagctgaaggtctccgccgaggacgtcggcaaggtcatcggccgtgacgggcgcaccgtgaatgccctccggacgctgctcaatgccgccgcacagaagtccgggcagaaggtccgcctggagattctcgacgaccggcgcaatgcagcaggcgctccggtcgcgccggactccgctcagtgacggccaccagtccctatctggagctgggatacgtcgcgcgcgctcacgggctgcgtggcgaggtcgccattcgcgcgctggaaccggcgtcgaagacc

SEQ ID NO: 285 - DNA, 1528 bp, Myxococcus xanthus
gcagggcgccaagacggtcctcgtcagcgggtcgggcaagaacagccccgccgtcatcgcgttggacatcacccatcccgatgacgcgtggtacccgctcccgctgtgggagttcgacctgcggtcctcgaacatcgagcacgccttctccacggccaaggtgacgaccccggaggtgcagttgccagacaactccggcacgaatcacgcaccctccattggccgcttggtgtggggctcggaggcggagggcaagtggacggccgtcgtgggcaccagccaggtgccttcgtcgccgggccgcgctggcgccctctatctcatcgacatgaagacggggcagccgctcaactacggaagctcaccggctggcgccatggcaggcatcatcaccttggacacgggctctggcatcgccgcggagaccgcgctggtggacctggaccgagacggcaactacgacgtcatgtacgtgccgaccaccgcgggcaacgtctaccgcgtcaacctggaccaggtgaacccgaacgcgcccctgggacagaaggtgaaggtctgcaagatcgccagcgcgcccgtcacgctgtcggaccatgacgacgcggccaagggacaggaccccgtctaccagcagattcactccaacctgggcgtgagaatcgtccggaactctggcagccccgtggttcgcttctacttcggcacgggtgacaacccagacgagttctccgacggccccgaaaacaagaacgcctatcgctaccacctgctgggctacgaggacacggacccctccggcacccgcgcgtgcgcgctgctggacccgctctgggtccagcaactggacccggggcaggcggtgtggggcggcgtgacgctcgcggacgacaaggtctacgcgaccacggccgtcggagccgcagcggacgtctgcaacctgagccaggacgagagcggccggttctacgagtccggcctgcttccggatggcaacagcgcccccgcgatgaccagcgcttcgctcggtggccacggcgtgagcgcacctgtggtgcatgacaatcacttgttcatccccacggccacgggagaggtcaaggtgcagggcagcgggaagtggggcaacggcaatgcgaacggcggcgcggcccgctcgaaggtccttatctacgcccccagcccggacgggaggatgccgcagtgacagcgctgaagaggcgccagcaccggggcatcacgctcctggaggtgctggccaccatggccatcctgctgatgggcgtcggagcggcgatgctggtcgtgacccagaccagctactccaaccgccgcagtctcagcgccacccaggcgcaactcatcgccgagcaggcgatggagaacatcacgctgctgggctgctcggtgcagcccccgtgcggcaacctggaaggactggatgagagctacgtcctcttccaaacgagcgcgggcgcgctgagcaacgtgcgtcccgccgacccgaccgtcatcgggcgtgagtaacagg

SEQ ID NO: 286 - DNA, 2070 bp, Myxococcus xanthus
  unsure (1)..(2070): unsure at all n locations
atcaagcaggtccccaagctctttggcgtcaaggaaggcgacggcaacttcttcgagcggctgtggttcctcgtcacgcacctgggcagcacgcacctggtcacgctgctcgtgggggctggcagcctcatcatgttgctggcgttggaccgcgtgtcgaagcggctgcccgcggcgctggtggtgctggcgctgtccatcgtggtgacggcgctgctcggcctggacgcgcgtggggtgagcgtggtgggcaaggtgcaggcggggctcgtcccaccccaggtgccggacgtggggctcggggatttgctgcgcctcctgcccggcgcgagcggaatcgcattggtggccttcgcggaggccattggccccgcgcgcatgctcgccgcgcgtcacggctacgaggtggatgccaaccgtgagctggtcggtctgggcgccgccaacatgggcgccggactcttccagggattctccattggttgcagcctgtccaagtccgcggccaatgacgccgccggggcccgcaccgaggtctcagcgatgctggccgcgggcttcacgctgctggtcgccctgttcctcacgcctctcttccgcctgctgcccgaggccaccctgggcgccatcgtggtggtcgccgtttcggggatgatggacgtgcgggagatgcggcgtctgcaccggatgcggcgggccgacttcctcggggcgctcgtggcgctcgtcggcgtgctcgccctggacgtcctgccgggcctgctggtggcggtgggcgtgtcgctcttcctcacggtgtaccgcgccagcgtgccgcgactgagcgagctgggccgtgtcccgggaacgcttgccttcggcgacgtgcggcacgcgccgcgcccgttgaccgttccgggcatgctcatcctccgccccaacgagggcatcttcttcgccaacgccacggcgctgcgggacgaagtcatgacgcgggtgcggcatgccgggccctccctgcacgcggtgttgttggatatggaggtgacggcggacctggacgtccctggcgcggacatgctcgcggcgctccacgatgacctggcccgtcgacgggtgacgttgatgctgacgcgggtgatggctcccacgggccggatgctggagcgcaccggggtgacggcgaaggtgggcgcggagcatctctacgcgcaggtcctggacgccgtggtggagcatctggcccgcgcctcggcggcgacacccgaggcacaggggttggtgcgcgacggcttgcgacggctgcgcatgctggtggaggaggccagcaccacgctcgatgcggacgagggcgcggaccgcgagcggctccagacgttgggccggcgcctgggccgggccgagtccgcgctgggagaagagaggcctgggccgcactgaggcgtgtacccgagcgcgcggcgcgtcgccgggtggcccctcagaacccaatcgcgggcagcggaggaaggggtttcccctccagcgcctgctccagcgactccgcgtaacggcggatacccgcgagccacgaggcgtccttctgaccctgctccgtggccgcgaggacgcggtgcagggtctcccgagccgtccggcgcgtctctgcctgtcgcgcgtgctggcccacggctcccgccagccgcagcagccggagcacgacagcgggttcggtggcgccgtagcgaagcgtctggtccgtgaccaggtccaggtagtcgcgcagcgacggagcgcgaaggaagacgcgagggcgcccggagctgtctggcaccacgcgggggcccagccgcatctggctcagctcgcacatcaagaaagtgagctggtccaacgcctccaccacggtgtaggggtcgttgatgcccggcgacagcgccttgacgggcacgtccaccaactggcgcacgcccaacgcgacgtccgcgtcctcgtcccgccagcggtccgtgtggatggctcggagcaggagggcctcggccacctcgcacgaagcangggagaggcggtcatccgacgcgaaccagcccacctcgccgccttgaatcaccg

SEQ ID NO: 287 - DNA, 1784 bp, Myxococcus xanthus
cgagcaagccgaagacgcagccgaagaagcccaagaagccggacgccatcgtccagccgaaggagattccgaaggaggtcccgaaggaagtggagccctccgaagagcctcccgctgaagaagaggcgagcgaagaagtcgtcgagggcggcgtggaaggtggcgtggtcggcggcgtcgtcggtggcgtggtcggtggtgtgattggcggcgtggtcggcggccagcttggcgggacgggaaccgacgtgcttccgttcggtgcgggcatgacgcggccggagaagttgtccggtcctcagcccgagtactctcgtgaggcgctcgaggctcgcgtccagggaacgatgatcgtgaagtgcatcgtcaccgtggaaggtcgagtggagaactgccggatcatcaagcccctgccccacatggaccgggccgtcctggacgcgctggcgtcgtcgcgctacaagccggtcacgttccagggccgtcctgtgcaggtggactacaccttcaccctgaacttcaagctgccgcgctgagtccgggcgcgtcgtctagaggcgtattgctgactaccccgcgctcgtgaggaggagcgctcaacccaaccatgcaattcactctcgcagaaatctgggatcacacgggcctcttcgcccgtatgatcatcttcaccctgggcatcatgtccatcgcctcgctggtcgtgttggcggagcgcatgatcgtcttccgcaagacgcggtctgacagccgcaacttcgccgcgaagatgggtgccatcctggccaaaggcgacctgaacacggccgccaacaccaacctgggcaaggatgtgggccacctgggccgggtgatcaactccggactgacggcgtaccggatcagcccgaacaacaaggacgtggcggtggagtcggtggcgcgcgcgctggagcgtcaggcgcagcgtgaggtccagagcatgaagcgcggtctgggcctgctggccacggtcggctccacggcgccgttcgtcggtctgctcggcaccacgatgggtatcgtcaacgccttccagctgatggcgcaggcgggctccggtggtctcggcacgatctccgccggtatcgccgaggcgctcatcaccacggccttcggtctgctcgtggccatccccgcggtgatggcgtacaacttcctgcagggctgggtggacgcgcgctcggtggacatctccgagtcgtccaacgagttcctggacgtggttgcccgccacctgggtggtggcgcgcagtcctcgaacgccgcctgagccgtcccgggcgagtcggggacgacccgatgcccttcacggtgaccctgtctccagctcttcttcggggcgctggaggcccaccgtgaaggcgggcacctccttaccaggaaacaggtaaagacatgggaatgtcagcaggccccaaggggagcgtcaagagcgacatcaacgtcacgccgctggtcgacgtggtgctggtactcctcatcatcttcatggtcgtcaccccgatgctccagcgtggcaagtccgtggagctcccgaaggccaccgagatcgagaaggaaggaaaagggaaggaagccgacccgctcatcctctccatcaccccggacaagaaggtgttcgtggagaacgaccaggtggatgagaaagggctccaggagaagctcaccgcggaaatcgagaaggatccaggcaagaagatcctgctcaagggtgataacgcgctcagcgttggtgacgtgcgcaagggtgctggacgtgggcc

SEQ ID NO: 288 - DNA, 1228 bp, Myxococcus xanthus
taaggacccgtggtggacgttcggcatcgactggtacctggcgggtggtgacgtccaggtactggcgctgcggccggggctggagaagcggttctcgctgacacgaaacgtgacgctcggggtgagcgcgttcggcagcgcggcggaggtctcattgcccacggggcagattggtcaggtgcagccaggggagccgggctacacccccattggcgggaacaacttctacgagggccgcatgcgcaagtgggccttcggcgcgggcggactggctgcgatccaggtcaagctgagtcgctacgtgcatgcgcgcgtccatgggggctatacgcgctacttcgaacaggcggacgggctgcagccggctcctgatgcggccgcattcacggtttcgctcgacggcccgttcgcgggggcgttgcttggactggacctctagaaaccgctcctcgagagccctactcggcgtcgcgcaccaacgctcggacctgccgggcggcgaacccttgaggcacgagttggaagagcgcattacgaatgaagcgccccgctgaactctcccactgggccacgcgccccaggctccatgaacgcgtcacgaagctgttggcacgcccgagccgacgttgctcgtaggccgccagcgccgcgtccacggggccctccccggccagcagctcggccagcaccacggcatcctcgatggcctgacacccgccctgccccatgttgggcgtcatcgggtgcgcggcgtctcccaacaaagtcacccggccccggctccagcggctggcaggcggccggtcgtggatgtccgtgcggatgatgttcgcttcgtccgtcgcggcaatcaggtccgcgatgggcgcgtgccacccgccgaagagggactgcaaccgggcccgtgtctccccgggggcatcctgctctccggccggagcattctgcgtggcgaaccagtacgtttgcccgaagccaatgggcaccacaccgaagcgcgccccacgcccccacgtctctgaaacaagtcccggcgtcgcgctcgggacgtctgggcacacgccccgccagctcgtgtagcccgaatagcgcagcggcgcgtcgcccagcagcgccccacgcaccaccgagcgcagcccgtccgcccccaccagcgcatcgcccgtcaccgagctgccgtccgacaaccgcaccgtcaccgtctggccatcgtcgtgaaacgccgtca

SEQ ID NO: 289 - DNA, 1840 bp, Myxococcus xanthus
cggaatttgtcttctgtcggcggaacgaagctcggcatctcgaaaactggtgtcccccggcacccctcgtccgaaatcaggtcagtccatgctcctcgacattgcgccctcgtccgcgaattccgctgttgcccctgtttctgcctgggcttcgtcggagcagacgctggagacgctgtcggggctggcgccgcacacgctgctgacgcatgcggacctctacccgcgcatctgcgtgcgggacccctactacgccctcaaggacgtgacggtgatgggggagggcgagttgtggcgcgcatcccagtgcagcaggacccggacgcggaagcgggccccattggcctgggtgaggcggggcggcacctggcgattctgggctcgtgcgcgtccgcgctgatgtcgcccaaggacggccagcacttctacctggcgtgcggcgcgcgcgggcagtggctgcgcccggagcccatggcccgcgccacggacctgctgtgggggctggcgaaggcggagttcaccggccgccgctcggccaccgggcacacgctgctgtcgctgccggacggcacgccgttcttccgcctggaggtggactacaacgtgctgtccgccgccgccttcacgcgcctgttcggcgaggcccgggtggacatgcgccgcgagccgcgccgcgacgacggcatgcagcgcacccccgaggagtgggccaagctgcggcagaacccctacagcaagccgctggcgctgcgcgactggcggccggatggtgagagcctgtcggccacgctggggccggtgacggcggagatgtgcaaggggcacttcgcgttgcacccggtgatgccggtggccgtggtggccagtgggatgacgcgcgtggccaccacgctgcttcgccggctggaaggcgcgccgtgggcccgctgcatggcgaaggacgtgcgcctgaaggcggacaccctggcctacgcgggccagacggtgacgttcggcgccgttcgcagcgcgcacgacggtgacgcgcacaccttcacctgccaggcgtcggtgggcgagcgcgtcgtcgccgaactggacgtcacctatatccgcgtggactgagcgtcgcgcctcaagcccactggatgtcgtagtccgcgctgtcgatgcctcgcggcgtcgcgcgcgcggtgccttgcaggcccagcaccttcagcgcgccggtgaggatgccctcgtggtaggcgggcggcagcatgtcccggcgcatgtgcagcgtgccggaggtggggccggtgggcacgtagtcgcggctgccgtagctgacggccgcgccgtagcccatctgcgcgcccgcgaagagcttctgcgggtccccgcgggagatgattccgaagatgagcatgcctggcccggtggagaagcgcgtcacgtccttctctccgcaggcgtggaagacggcgtcctcgggccccagcagcggctccagcgcgtccgccgcgcggtagaggagcgtcaggaagtcccgcgccgggtacgtgagcaggtcggtgtacgccgcgcccagcgccccctggcgcactgtcttcagtgccgccaggcccgcctgctggtggacaaagctgaacaccgacttgaagaacagcccgcgcaccgaatcaccggggtgcaccggcgcgagccgggcctctagctctcccttgttggacacggtggggcgcctcctctcacctcttggagcagaaccggggcgagaacccccgcgtgacacaaggccacaacgtatagtacgccgccgcgctctcccgtgaagaccgcggcaatgtccgccgcgtgcaaatgggcatatacacacacc

SEQ ID NO: 290 - DNA, 1494 bp, Myxococcus xanthus
gtgtcgagaaggctacggggggaacccgcgcccgcgggtgagcagaagcgcgggcatgagcacttgacgggctccgtggaacacctgcaggcggtcgcgctgacttgggcggtgatgaagctcccgcgcgtacgtgaagtgtcgtggctcgcggagctccagcgcggccccacgagggtccccggctccgcggtgcgcccgacggcgatgccccagggcccgtaaccgtcatcaccctctcgcagccaacgcagggagccacgcgtgcggggcacgcatgggtccgagtgtccttctcttgctgactcacttctgaacccgtcccggtggggccactccctggggcgtcgtgcgccgcgcgaggtccgagcgtgagcaagacgccgcagcatggggcctgcgccgccgtgtgtccgtacgtgcccgtgctcctcgttgccgcaatgtcgtcgtgtgtcctcgccctgtcgccctcgaaccgtccaccagatgcggcacgagagccatctcccgcgtccgagcatgccgaggcaggcacgggcacgagcgcacatgacgacgtgccgccattcgtgaacacggagcgccaggccccacccgcagccagcgccatcacgtccgtgaactctccggcggaagcggacgcatccccagccaacgagcccggacagcttcccaaggaagcatccccccctcaccccatcacccaaaccgccgacgtcccctcgtcggaggagacaagctcccatcctctcccctcggagcaggaggcatccctcaccagcgcatccgacttcgaggccaaggagccgccgtcaaagtccacggtggtgcggggcgcgcgtcccgcgcaaagcgcgtccgaggtgacactgggccgggacatcttggacgcggcgccacgcaggaacgcggtggacctcctgcgagccgtccctggcctcgtggcctggcagcacagcggagagggcaaggcccaacagctcttcctccgaggcttggacgcgctgcacggccaggacgtggaactcgacgtcggctgcctggcagtgaacgaggtgagccacatccacgcgctgggctacgcggacatcaacttcgtcatcccagaggtcgtgcacgacgctcgaagtgacggaaggttcgtaccgcgccgcgcagggtgacttccccgtcgcgggaacggatcgcatgaatctgggcgtcgccgagcccggagttcacctgctggggacactcggccagtacggacagcgtgggctcgtggccacggagcggtcagtatacgacacgggaaccttccccgcggtggagctgggcgaaggcagaggcttcggcgctcaacgaggctacggacgtgcctctctgctcggccaggccaaccctacacttggagacgggctgacagtacgcgcactccctggcagctacctgacgcgcttcgacttcccgggcgtggtgcgcgaggacgacctgttttcgggccggagcgac

SEQ ID NO: 291 - DNA, 1720 bp, Myxococcus xanthus
gagcaccacgggcacgcccacgcccttgctggtggactgggtgaggtcttcaatctgcccctggtgcacgcgcacgctgctctggcggcccacctcaaggaaggcctccgcctggcgagcacccttgcgcttggcgcgctggacgattctcttcgcgagctgctggtagtccatggttggtgctctctctcaggcgaccttggttccgccaacggtgatgttgtcgatgcgcacggtgggcagccccacgcccacgggcatggactggccattcttcccgcagatgcccatgcctgggtccggcatggggtcgcagcccactcgtgacacgttcttcagcgcctccggccccacgccgatgagcgtcgcgttcttcacgggacggcccagcttgccgtcctcgatttgataggcctcgctgacctcgaagacgaagttgccgttggtgatgtccacctgcccaccgccgaaggtggcgcagtacaggccgcgcttcacctccttgaggatgtcctcgggggcgtggtcgcccggggccaggaaggtatttgtcatgcggggcatgggcaggtgcttgaaggactcgcgccgcccgctgccggtgctgcgctggcccatgagctgtgcgttcaggctgtcgtagaggtagcccttgaggacgccgttctcgatgaggaccttgcgctcgccggggttgccctcatcgtcgatgttgatggagccgcgcccgctggacacggtgccgtcgtcgatgatggtgaccaggtcggacgccaccttctcacccagcttcccagcgaacagcgaggtgcccttgcggatgaagtccgcctccaggccgtggcccaccgcctcgtgcaggaggatgccgctccagcccggcgccagcaccaccgtctgcgggccggccacgcagtccaccgcgcccagcgtggccaccgcctgacgcgccgcttcccgggccacgtcctccggggagaaggtgtcccagtggctgaagggcacgcgtccgccgccgccgtacatgccggtgcgccgctcgccgcccgtgccctgggccaccaccatcaccgaaatccggcacaggtcctgggtgtcctcggtgtagcgcccgtgggtgttggccacggcgatgcgccgggtctggtccacgtagccgccgttgacctgcttcacccgcgcgtcgaaggcgcgggcggccttgtcggcgcgcatgagcagtcccgtcttcagcgacacctccacgtccatcagcggggggctgacgtggtagtggctggggaccgcggcgcggcgcacggggaagctgcgctcggcgccgccgccctgggcaatcatgaccgccgtggaggccgcgcgcagcagcgcggactcatcccagtcgtcggagaaggcgtagcccaccttgccgccggagatgacgcgcacacccacgccctggaccaggcccgtctgcgcgctcttgatgcgggattcttccagccgcaccgccgtggtgagcgtgcgctcgacgtacacctccgcgaagtcgcccccccgctccatggccacggcgagcaggcgctcgaccagcggctggggcagcagggcgacgggcgtgggccgccgggccaccggtggggcgagcttcaatgagagggcgcgcttcgagggcgcagacgctcggggcatatttcgggactcccgcagtgaagacgatggggtatgtgacagcctacat

SEQ ID NO: 292 - DNA, 1702 bp, Myxococcus xanthus
gctgtcgcgctccctttcccagtgttctaacccaccctcttggtacaaaggcgcatcagggatgggctggaccagcaggcacaccggaaccaacagcaaccgcttccagagcgggaggcccggctgcgtgaactcccaggtcatcgtgagcgggggcgcatcccccgccggctcatcctgggtgttctccgtgcgaggtccagcgcgccctgtcgacagaagcatcaggatgcccaccacggccccctgcatggacgcgaacaacaggacgcccagcagcgcgcgccacgtcaggaaggctccgagcatggcaacgaggtacttgtcccccgcgcccagcgcctctcgctggaacaccttccatccgacgtactccatcatccggaaggacaggaagcccactgccgcacccatcagcgcatcacggaaggcgtccatccccagggggaacgccagggcaatccccgccagcattcccggcaccgtcatggacagcggcagaatccaatggtccaggtcaatgaaggcgagcggcaccagcaaggatacgagcaccagcgccggcaccaattcgtacgtccagccaaaacggcgcaggcacgcgaagaacaggagccctgtcaggagttccaccaacgggtaacgcacggagatgggcacgccgcagccccggcagcgcgcccgaagcgcaagccaggacagcaacgggatgttctcgtaccacgccaggacgtgcccgcaccgagggcatcgcgagcgtggtcgcacgatgctctggtccagcggaacccgcgcgatgacgacgttgagaaagctgcccacgcacaagccgagcacgaacaggaacacggcgaacaggggcccgaagtatcccggcagggaagaatgcgtcacaggggacgcatcctacccgagcttcagcggaagtcgcgccgctcgaacacaatcgcagccagcacgcagaaaagtgctccccaccccagcgcgtagagcgtggccgagcccagctccaccgccgtcacctcgatgccataggtcgcgcgcggccggaagttcagtcgctccaggttgggcagggcgtagtaggtggccttgctgacccattggatgagctccaccttcgacgcggcccccaggttgtagatgtccgagcagaggtgacccgcgaagtacaaccccgttgtcaccagcgcggagacaagctggctggcgaaagtggacatcaggaacccggcgctggtgaggacgaacaactccaggtagagccctccgagcgcggccagctgcggctgggtgatgggtgagcggtgaagggcgagctgcacccagaacagcagcgtcatcgcgaccagcaacacgcccagagtcaacatgttgccagcgagccgggccagcaagaaccgggttcgcgacagcggcttggacaccatcaagaagatggtccttcgctcgatttcccggctgatgagcccggacgacaggtagacggagaggaagacaagcagcaggctcatcaccccaagaccgaagtccgtcaccaccctgtcgaaggtgctgaccgtgacctccgtgacgagcgtcgtggccaggaggagtagcagggcgaacgcggcgaccagcaccgtcacccggttgcgacgcgcctcgcggaacccattccacgccatggcagcgaaggcccccattactgaatctccccgcc

SEQ ID NO: 293 - DNA, 1591 bp, Myxococcus xanthus
  unsure (1)..(1591): unsure at all n locations
accgaagataggtcgcgcgcttgagtggatccgacaccaccgcgtgaacatgtagagccccggcactcgacgcgctctcggttcgcagccctgaccgaacacctgctgagcgcaaggagcgccatggccttcgcggctggcggcggagccctccagcggcgggcctgcgctcaaccgagcacggccaccaactggcggcactgggccagcaactcaccctcctgggtccacagctgctggaagtcctcggagtagccctccgccgcctgccgtgagcgccccgtgcgcaggaagtgggcgtcctcgcgcaggcccgggcgcggcaggtcgtggaagaagtgcacggtgaagtccacgctggccgccgcgtggaaaccatccacgcgcgagagcaccgacggcggataggcgtccatcaaccccacgcacagcggcgcgtccagcaccatgggctcacgcgggcgaagccaaccgcccgtctccgccacgtccgcgccggagtacggcgccgagcccacgcagaagcggtactcgaagaagctgcagaaggtgggcatgggcacgtcgtccggcaccacggggacgtcttccggcggcggcaccaccgggcgcttcacgtcgaagtactccgtcgcgccgccgcgcgaggtgccgaacgtggcggtggccacgcacagcacacccgcggcgctctcgatgcgcgccgtcgcgtgcgtgacgagccgccccgtccgttcgatgcgcgtctggatttccgcctccccctccaccgcgggcgcgcagaagtgcacggtgagcgtgcgcacgggacggcccggctgctgggcctgcgccagggtgtgctccaacgcgcgcagcgtcgaccccgcgacgatgccgccataggcgcccttgccctggtaccagggcgcggtgaagcggatgccgtagcggttgggagagagtggctcgggggtggtggcagcgaggaaggcagcggtcatgtcgcgccgcagcgtatcaacgcggccccggtgtgtccggcccgagtctctcgcggctcgccgccccttcaggcggacaggcgccagtcgatgggcggacggccgtgggactccagcgcctcattcacggcgctgaagggacggctgccgaagaagccattgctggccgacagcggcgaggggtgtgtgccctcgatgacgacgtgccgcttcgaatcgatgagcttcttcttcttctgcgcgtagcggccccacagcaggaacaccaccgggtcgtccttggcgctcaccgcgcgaatgacggcgtccgtgaagtcctcccagccgtgccccgcgtggctgttgggcttcgcctgccgcaccgtcagcaccgcgttgagcagcagcacaccctgccgggcccagggaatcagagagccgtccttcgggcggggcacgcccacgtcgctctccagctccttgaacatgttaaccagcgagggcggcggcgccacccccggcttcaccgagaaggccagcccatgcgcctgtcccggcccgtggtaggggtcctggcccagcagcaacacccgcacgttttcatanggcgtgagcccggaaggcggaaa

SEQ ID NO: 294 - DNA, 1506 bp, Myxococcus xanthus
  unsure (1)..(1506): unsure at all n locations
atgattatcggcatacggtccgatttgttgcttcctgtcgtaattttccgtccgaggggtaaaattggacgcaaatgtggcagggaggcgcagcncagggcacagattcgccattcaacgcaaagagtcaagggcagatatggggtgaagcacacccgccctggctcaggcgttcacggagctacaactccacctgcgcgcccagctccaccacccggttgggcgggatgcggaagtacgcggtggcgctgcgcgcgttgcggctcatccaggcgaacagcgcctcgcgccacacggccatgcccgggcgcttggtgggaatcagcgtctcccgtcccaggaagaagctggtgcccatcagttggaactggagccccttctcgcggcagcgcttcagcacgtcggggatgcccgggttctccatgaagccgtagcgcgccaccacgcgcacgaagccctgctccagcggctccacctccacgcgctcgctgtgcggcacgtgcggcagctcctcggagaggatggtcagcagcaccacctgctcgtgcaacaccttgttgtgcttgaggttgtgcagcagcgcgggcggggtgccttccgcgttgcccgtcatgaagatggccgtgcccggcacccgcaccggagggtggtcgccgaagctgcccagcagcaccttcagggggatgctggacgcgcgcagcttggccgccaggatgtcgcgcccccgcttccacgtcgtcatcagcgtgaagacgacgacagccatcagcagcgggaaccagccgccgtccgccaccttcaccgcgttggcgccaaagaaggccagctccacggacaggaacagacccaccacgggaatggccacccaccgccgcacgccccacagctcccgggccaccacgtaggccatcagggtggtgatgaccatggccgtggacaccgcgatgccgtacgccgacgccagcgcgctggaggagcggaagcccagcaccagcgccaccacgcccaccagcagcgcccagttcagaccgggcaggtagatttgccccatctcctccgccgaggtgtgcaccacctccatgcgcgggctgtagcccagctgcatcgcctggcgcgtcagggagaacacccccgcgatgagcgcctgcgaggcgatgacgcccgccaccgtggccagcgccaccagcgggtacagcagccaggacggcgccagcaggaagaagggattgcgcgcggcgctcgcgtcgcgcagcagcagcgccccctgccccaggtagttgagcatcagcgccggcagcaccatggagaaccacgccagttggatgggcttgcggccgaagtggcccatgtccgcgtagagggcctcacagcccgtcaccaccaggaacacgccgcccagcaccaggaagccatgcaggtggttgtggcggaacagctccaccgcgtgccaggggcgacagcgncccccagccaccgncggggtttgtgcaccagcttcctttcacg

SEQ ID NO: 295 - DNA, 2656 bp, Myxococcus xanthus
  unsure (1)..(2656): unsure at all n locations
catctgctgccgctggtgaagaagttgtgccaccggctgctcgtcatcgcgggcggcaaggccatggcgctgggcagcctggaagacatccgcgcgcgactgagtggcgcggaaggggagcacgcctcgctggaagagctcttcgtccgaatcaccagctcgggaacccaggcgccgtgagcttccctcgcgcggtggccttcctctgggccgcgacctggcgcaatcgcatccggcggcagttggagcggctgcgcaagccgcgctacctcctgggcgtgctggtaggcgcggcgtatctctattccgtcttcttccggcgtttggacttccgtgggtcggcgggcacggtgcccgaaggtgtgcggttgttcgccgagttgtcgctggtcggctccgcgctggggacattgttcgccgcgtgggcgctgggccgggaccggccgtcgctgaccttctcggagacggaggtggtgcaactcttccccgcgcccgtttctcgtagggccctgctgcaatacaagctggtgcgcgggctcctgggcacgtcgctgggcgcgctgttcgccacgctgttccttgggaggaccatcagcccgcatcccgccctcttcttcgtgggggcgtgtctggccctgggcacgctctatctgcactcgacggcggcgtccttcgtgcgcacgcggctgtcggcatggggcctctggggccaggtggtccgctggggcgcggtgggtggtgtcctggcgctcgtggcgctggcggtgttcacctcgctgcgagagcacccggtacccgaggacctgtcgtcaggccgcgcgcttcgcgggtggttgcaggcgctgacggtgtcacccggcgtggcggccgtgttgtggccgggccggctgctggtggcgcccgcgctggcgcagagcgtgggcgacttcctgtgggccctgccaccggcgttggcgctgatggcggcgcactacggctgggtgctctgggccgaagttccgttcgaggagacggcggtggtgcgcgcggagtcccgctcacgggagcgcatgctgcgggcctcggggcggatgacgcgggtgggctcgctcacgttgagccgccctccattccggctgctgcctcgaggccgaccggaggtggcactcatctggaagaacctgattgcgcgcaagcggatggggggcgggttcgcggtgttcctcgccttcatcatcctgggcggtgccatcgcggcgatgatgggcgacacgcgtctgttcacggacacgcggcgggtgctcgggccggtggcgctggcgttgtcggtgatgctgacggtggtggggccgagcgcgttccgcatggacctgcggatggacctgcccaagctggacctgctgcgcgccatgccactgacagggcggcaggtggtgcgcgctcagttggcggcatcctcgctggcactggcctcgttccagctcgcgctgttggccgtggcgctcgtcctggggcccggcgtggaggcctcgcgcctgggcggctggtggtggcccggagggctggcgctggcgttcctgcttccggccgtgtcgctgtcgggcctcttcgtgcagaacgcggcggtggtcctctttccctcgtgggtaccggcagacacaggcgagcgggcacgcggcatcgaggcgatgggccagcgcctgctggccgtcgtgggcacgctggtggtgatgctggtggggttgattcccgcggggctggtggcgctcgtggtgggcctccctgtgtcgacgctgttgggcccctgggccctgcccgtggcgggcttcgtcacggcgggggtgttggtgggaaaggtgtgnctgggcgtcatggcgctgggccacgccttcgagcgtctggatgtctccgaggaccggccagaataggtcgtcccgttcgctcctggacgtgcgcgtgctttgcggtggtggggctcctgggcgcggattatccgggccgtttccgggaggagacgcgcatgaaggtgggattcattggcctgggcaacatgggactgcccatggcggcgagcctagcggccgcggggcacgagctgacggtgtggaaccgcaccgagtccaaggccgcgccgttgaaagagaagggggcgcgggtcgcccgcagccccgcggaggcggctcgaggcgcggaggtcgtcttcagcatgctggcggacgatgcggccgtgacatccgcggtgttcggccaggacggcctcctggcgggactggcgccgggcgcggtgcacgtctcgtcgagcacgctctccgtggcgctttccgaacggttggcggaggcgcatgcgagcgccggccagcggtatctcgccgcgccggtgttcggccgccctaccgccgcggcgtcgaagcagctgtgggtggtggccgccggtccgaagcaggacatggaccgctgccgtccgctgctggagacgctggggcgcggcctcaccgtgctgggtgaccgtgccccggcggccaacgtcgtgaagttgtcgggcaacttcctcatcgcgtcgatgatggaggcgctcgccgagtccttcgccctgacgcgcaagtccggcatcgagccgaaggtgttcctggaggtcttccagtccgtcttcgcgcgcgcacccatcttcgaggggtac

SEQ ID NO: 296 - DNA, 2119 bp, Myxococcus xanthus
  unsure (1)..(2119): unsure at all n locations
cggcttctcggaatctaggagcccccacctttcgtcacgagggagcaccccgtcgcatggcccaggcacccgccgcgcagagcaacaagttcccgccgcaaatccccttcatcatcggtaacgaggcgtgtgagcgcttcagcttctacgggatgcggaacatcctcacggtgttcctcatcgactacctgctgcgcacgcagataccggacaacgcgctgcgggaggccgaagcgaagagcttgatgcacacgttcatggcgggcgtgtacttcttcccgctcatcggcggctacctggcggaccggttcttcgggaagtaccgcatcatcctggggctgagcctggtgtactgcctgggccacgcgtgcctcgccatcttcgagaacaacgtcacggggttcttcacgggcctggcgctcatcgccattggcagtggcggaatcaagccctgcgtggcggccatggtgggggaccagttcaatgagtccaacagccacctggtgaagaaggtcttcgccatcttctactggaccatcaacttcggctcgttcttcgcgtcgttgttcatccccctgctgctcaagcacttcgggccgtcggtggccttcggcatccccggggtgctgatgttcatcgcgacgttcatcttctgggcgggccgtcacaagtacgtccgggtgccggccacgggcgccaacccgcacagcttcttcaaggtggtggccagcgcactgcgcaaccgcggccagggcggcggctggctggacggcgcgaagcgggagcaccccgaggaggccgtggacggcgtgaaggcggtgttccgggtgagcgcgctgctgctccccttcgtgcccttcttctggatgctcttcgaccagaaggcgtccacgtgggtggtgcaggcccggtccatggacccgcaggtggggccgttcaccttccaggccagccagatgcagttcatcaacccgctgctggtgatgattctcatccccttcctgacggccgtcgtctacccagccttccagcgcttcggctgggagctgacgccgctgcggcgcatgcccctgggcctggtggtgggcgcgctgtcgttcatcatcgccggcatcttccaggtcacgatggaaggcggcacgacgctgaacatcgcgtggcagattctgccgtacatcgtgctgacgctgggcgaaatcctgatgtccaccacgggcctggagttcgcgtacacgcaggccccgcgtgagatgaagggcaccatccagagcgtgtggctggtgacgaacacgctggccaacgcggcggtggccatcaccgcgaagctcaacgtcttcacgggctccgggcagttcttcttctacgccggcttcgccctggtggccgcagtgggaatggccctggtggcccgccgctacgtggtgcgtgactactaccagacgtccgcgcccatccccaccgaggagcgctccgctgccggcgtgacgcccggctcggcgaagtccgcgtagccaggcggtcagcccgcgcagtgaacgccggtgcacctgtaaggtgtgccggcgtttgtgtttcaggcgtggcgccagcagtccgcgaacagaaacgccggcgcccccatcgggacgccggcgtctggacttcaatcaggggagtccgcgaccgctcaggccgccgccaccgagccgccctgctgcgcggaggtgggcgcggcgggcttcacctcgtccgtgccgtgcatcatccgcttgaggatgggcgacacgacgagcagcagcacgccggcgatgcccgttcccacggagatgtagaggaacacgctgaactcgcccagcttctccgagtagccaccgaagacaccggccagcttgttggccgccgcgttcgcgaggaaccacacgcccatcatcgcggaaacgatgcgcgccggcgccaccttggtcaccatggacaggcccacgggcgacaggcacagctcacccatggtgtgcagcaggtaggccatcaccacccaccacgccgncggcttgcccgtcgaggcgctctcgctggaggcgcccagcatgaagaggaagccggcggagaggaacagcaggcccatgctcatcttcaccgggat

SEQ ID NO: 297 - DNA, 1479 bp, Myxococcus xanthus
  unsure (1)..(1479): unsure at all n locations
gtcggtaggacagcatccgcaaaagttcaccaaaccctggcagttccttctcgaacagcggacgcaacgtctccaccgtgcagtcgcgccggccaatcccggtgcctccggtgaacaacacggcccgggcccccgcctcgcgcgcggaatccagcgcgccgcgaatggcttccgggtcatccttcaccacgagggtgccagcaatgccgtggcccgccgcctccaggccctcgcgcaggacctggccactctcatcgcgcgccgcgtcgcggctgtccgagcacgtcacgatgaaggtgctgacatgcaccggcgctcgcgccttgtgctcctccgccgggccgtggtcgtggccgtgcgggtgatgatgatggtggtcgtggtgatgatgcgtgtggtcgtggtcatgaccgtggtgcccatgaggcccgtggtcatgatgatggtgcccgtgaggcccatggtcgtggtcgtggtcgtggtcgtgtgccatgacaggtactccggagtgcgagagggacttcagggcgtgtcgggccaatcgatgacgagcgagccgtcttcgaccgcgacctgcaccgtcggctggtcgtcacagacccccggcgaggtcgcgttgcgcccggtgtccatgtcgaaaccgacctcatggcacgggcagacgaccatgttgtcctcgatgcgaccgccggacagcagacacccggcgtggttgcaccagtcatccaggcccttgtagcgcccgtggatcttcgcgatacacacgttgcgcttgccgacctcgtagccccgcatttccctctcggcgaagtccgccggtcccagcttgatcttcgtcatcgcggccccttttcccacaacgcgggactggctgcactcccgatgcccgggcattaccttctccccgtgactcccgacgtgaccatccccaccgttgtcgacaaggccaccgtcgcccaggtcctccgtgacatctccctcctgctccagctccagggagaaagcgggttccgcgtccgcgcctatgacatggcggcggaccgcatcgccgggcttccccaggagctgggccccctggtcgcggaaggccggctggagagcctcccaggcatcggccgcgcgctcgccgagaaaatctccgagctggtgtccaccggccggctcggctacctggaggagctgcgggcttagtttcctcctgggctgctggagctgacgcagttgcccgacgtggggccgaagaaggtggccacgctctggcgtgagctccaggtgagcagcatcgaggagttggagcgggcctgccgtgagggccgcgtgcggcaggtccgcggcttcggcgcgaagagcgaagcgaagatgctggaaggcatccgcctgtaccgncgcgcgcgcggggagcgcaagctgctgggcgaggtactgccggtggccacngcgctgctggagcgggtgaaggccgcgccnggcgtggtgcgc

SEQ ID NO: 298 - DNA, 1155 bp, Myxococcus xanthus
  unsure (1)..(1155): unsure at all n locations
gcaccgaccagccgtccagcttgggcaggtggatgtccagcaggatggcctggggccgcagctcgcgggcccgcttgagggcggcgatgccgtcctcggccaccaccaccttgaagccggcgggctccagttgtccggccaccagctgctggatgagcgggtcgtcgtccaccaccagcaccgtgctgcccggctgggccatggtgcccacgtgctgggccacttccgacacgggcacgccgcgctccaggtgcggcccgccgccgttgtccggcgtctccagcgtggtgggcaggcgcaccgtgaaggtggtgccgcggcccagcgtggacgtcacggtgacattgccacccagcacgcgggacagctcgcggacgatggccagccccaggccggtgccgcccaccttgcgcgtggtggagccgtccacctggcggaacttctcgaagatgaagggcagctcgtcggaggggattccgacgccggtgtcctccaccgtcatgatgacttcgctgcccgcgggcaccaggctcagcgccacctcgcccgcgtcggtgaacttggcggcgttgctgagcaggttgagcatgatctgccgcagcttcagcgcgtccgagcggagcatgcgggcggacgggtcgatgttggtggtgagggccacgtccttgcccttgaggtactccttcaccgtggccaggcactcctcggccagctcctgcacgtccacctgctcggtgacgacctccacgcggccggactcaatcttggacaggtccaggatgtcgttgatgagcgccagcagcgtcttggcgttcgtcttcacgacgttgaggtcgcggcggccgtgcgccgtcagccgttggccctcctcgcgcatcagcaggtcgcagtagccgatgatgccgttgagtggggtgcggatttcgtggctgaagttggccaggaactcgctcttgaggcgggcggcggcttcggcttcccgggcgcgctcctcctcgttgcgcttggccaccgccagctcctgggccagccggtccaggtcctcgttctgctgacggatgatttccatctgcagcgcgcgctgctggtaggacgccagcgagcgggcggacacggngcgggtgcgctagatttcctccaggctggcggcgagct

SEQ ID NO: 299 - DNA, 1807 bp, Myxococcus xanthus
ctctaaagcaagggcgtggacggcctgaacccggtggagcacgccatcctccccgaccgcatcgaggccggcaccctgctggtggcggcggccatctccggcggcgacgtgctggtgaagcgcgtggtgcccgagcacatggacgcgctggtggagaagctgcgcgaggccgggtgcacgattaccaccgagggcagcggcctgcgctgcaaggcgccccagcggctggacgcggtgaacatcaccaccacggagcatccggggttccccacggacatgcaggcccagctgatggccctcatgtcggtcagtcaggggacgtccgtcatcagcgagaacatcttcgagaaccgcttcatgcacgtgccggagctgcaccggctgggcgcggacatcaccatccaggggcccaccgcggtggtgaagggtgtgaagggcctgagcggcgcgcccgtcatggcaacggacttgagggcgagtgcgtcactcatcctggccgggctgcgagcggagggccgcaccgacgtcagtcgcgtctaccacctggaccggggctatgagcgcctggagcgcaagttgagcgccctgggtgcggacatccgccgcgagaaggcgtagggctgaggggccggggggcgacgggacggcgcgttgccaacagaaggcacaaggcgggttgcatccgaaatttcgcgcgacctatcattctcccatcgactggggagaacaccactcccccccaacaggagaatggaaccgccccatggattgccccagctgcaacgtcgagatgtccgatctcgagggggatgatcagacgttgcgaaagtgtggagattgcggcggcctttggattgacgtcgcggacctcaaccgggtcctgctccacaacaacctccccgggctggagagccagggcggcaaggtggatgcggaggcactgaccggtcagtgccccgagtgccaggtcgacctcgtccgcgtggacggtggcgaccgccaacatccgctgcattacgacacctgcgagtcctgcggcggcatcttcctggaatccgaattccaggacgccaccgacgtgaaggtcgcggtcgaggaaatcatcgcgttcttccgccacttcggcgcgaagcggaagatggccgctctgtaggcggagtgcgtcgccccccgggaaaccgggcgggcggcagccagcccgtcagctcaccgctggctgcggaactcctcgccccaggcctcggcgacgggcccgtcgaacgccagtgacgcatccggcgggcgtgtcccctcggagtcccctcgcgggaagcgcaccgtcacccgcccgtgcggggggacgtccagggacagcttctctccggacagcgtgtaggcgccactgactgtcgtggacacctcaccctccaggggctcctcggtgaggctgtaggttccgtccaggtagaaggacaggaagcggtgcggtgcccccttcaggccaccgaaccaggtgccgagcagcggcgccagccggccgttgtagcgcagcttgggcgccagccaggtgccattgagggccttcccgccagcgtagaagacgatgtcggtgacgcacacgggcgcgtcgtccttggcgcccgggaagcgctccgacacctccagcgtgaagcgggcgccccgaagtccgggcttgaggggcaccacctggagcccgcgcttgtcctccacgcggacgctgcgtgcttccttgatgccggtcagggtgagcttccgcgcccgggcggcagccattggtctgggtggagtgcatgccgtacgtggccga

SEQ ID NO: 300 - DNA, 1642 bp, Myxococcus xanthus
ggtctccacacactgacgtaccaggttgctgtcgagagccagcacgtcctgacgatgataggggggcgcctccggtatctgcctgtcgagtcacaggtgctcgtgcacgacaaatcgctcaatgtcctccacatgcgtctcgggtatgatctgttcgcgctcaatatccttgtgggaggcatccatagtgtccacttagcgccgccatgttgtgcgttgagcgcataggggattcccggttagctgtggctcccagccgctgtcgggcacacgaagtcaggtggcctgttagcagggattcacctctcagttgtaagaaatcatgccggcctccaactgggcgtatgcgcagcagttcttcacaaaactgaggcagcccgtaatcggtgcaagtacacgctgttccgaagtcttcgtcagacgccccgggggcatctggcgcagctagtgcttgccggtccacatgtgcttttgcccttaacgcaagttgagccagaccagggagcgcagatcgccccatgtgtcaaggcagccgctgtgccagtgatgcgcgcaggggctccgtctctggcatcgcgtcgtggccggtgacgtagcccaccagccgggggcccggggccgtcctcacggaggaccaccaccgcggaagcgacccccggcagctcgatgagcgcggcttccacctcgcccggctccacgcggtggccacgcaccttcacctggaagtccacgcggcccaggtactccagcacgtccgacggccgcagacgcacccggtcgcccgtgcggtacatccgcgcacccggaacggaggagaatgggtccggcacgaagcgctcggcggtgagctcgggccggcgccaatacccacgcgcaacgccttcgcctccgatgtagagctcgccagggacacccgcgggcaccggcctgagggcggcgtccaggacatagaggcgcgtgttggcgatggggcggccaatgggcaccgcgccttccaccggcgtgtccgcctccacggtgtggacgcagcagcccaccaccgtctccgtggggccgtactcgttgatgagccgcgtgctcggcgcgtgctgccgccagggctccacggtggcggaggtaagcgcctcgccaccgatgacgaaggcgcgggtatggcccgcgcgcgcctcgggcggaagctgcgcggccagcatctgcaagtgggcaggcgtcagcttcaccaggctgaagtccgcgctcgtgcggagcgcggtggccaggccttccacgccgtcctcttccggaacgagcgtcacgggcctgcccgcggtgagcggcagcagcaggctggtgacagtgaggtcgaaggccagtgaggaatgaacgggggcgcccgcgccgtcgtcgacggcatacgccttccgggcccagtgcaggtagttcaccacgccccggtgctccactaggacgcccttggggcgcccggtgctgcctgaggtgtagatgaggtaggcgaggtcctccgccgaagagacggattcgagcggcgcgtccgactcacgcccggcggcgcgctcccattcggagtccaggcacaacacgagcgcctgcgagacgggcagcgtgtccgccaccgcgtcctcggtgacgagcacgggcgtgc

SEQ ID NO: 301 - DNA, 1504 bp, Myxococcus xanthus
caggccgcgcccgaagccaacgcgcccgaggccgccctcccgcccgcggagtccgcggcgggtgcgtccgacgaggagctggccctggctccgctgacgcgccccaccgtgaagccggtgcgcttcctcatcgtcagcgaccccatgggcgcgcgcgtgacgtaccaggggaaggacctgggcgagacgcccctgaacctcgaggtggctccgaatgccagcggcgtcgcggaagcgacgctgaccttcaccctggacggctaccagcgcgcccgcgccgtcgccaggggcgcgggccccgaagagcgcttcacgcagaagctccagcccaagaagaaggcgagcacgcggcctggaaaggccccagactcgtcgccctacaaggacgacccgtacaattgaaaaccctgacagccttcaaacgagcgggcctcctcgcgatgtgtctgtgcgcgggggaagccctggcggacgcccgccttgaggcccggcgccacttccgcagcggcatgagcctcatcgcccagaagcagtacgacgcgggcatcgccgagctcgaagccgcctacgccatcaagccgcaccccaacgtcctcttcaacatcgcccgcgcctaccaggactcgggccggtcgaaggcggcgctggaggtgtaccagcgctacctcgccagcaatccgccggacgcagcctccgtgctgcccatggtggccgcgctggaggaaaagctgaaggccgaggaagcacaggccaccgccgcgcaggacccgtcgtcgctgcccatgccgccgccccccgcgggcacgcagtcgcagcagcaactgagcgcgctgctggagcggctggagaaggccattgaacgggccgaggccatgcccgtggggagcgccaccattcccggcctgacgcccagcggcgtcgcctccgccagctcggacgacgcggtcggcggcgtggacctgggcgcagtgccctacgaagagcgcgtggtgacggcgagccgccgcgcgcagtcctcgctggacgcgcccaacgccaccaccgtcatcaccgccgaggacatccgcctgtcgggcgccacgtcgctgccggagctgctgcggcgcgtgcccggcgcggacgtcatggccctgggcgtgggcagcgccaacgtgtcgctgcgtggcttcaaccaacgcatcgccaacaaggtgctggtgctggtggacggccgcacggagtaccaggacttcctgggcctcaccatctggtcctccatccccatcagcttggaggagattgagcgcatcgaggtcatccgcggcccgggcagcgcgctgtacggcgccaacgccatgctcggcgtggtcaacatcatcacccgcgcgcccggcaccggaccgcgcgcgcagttcaacgtcaccggcggcaccggtcacaccgccgcgggctccttcgtcagccacggcggctcgggcacgatgcgctaccgggcggcggcgggctattcgcagacggacaagtg

SEQ ID NO: 302 - DNA, 1675 bp, Myxococcus xanthus
ccggggcggcccgagcacgcgcagggcctccgactcacgggcgagttgggcgcggcccaaccagttgctcccacgggccaccttgatggccacgcgcaggccgtccgcttcgcgctgggcgcccagcagcacgccgaagcctcctcgcgcgaagacgccgtccacctggtagcccggaacagcgggcacaggggacggcgagggcgtgtctccctgcggaggcggtcctggcgggcacggcgcatgagagccttcccagcgccgtccgcatgtctggcatcgcggcacggaggggactctacgtcaggtgtcctccggtttcagaacccccggggtcgtctacgtaccatcccgggggtccacagtttcccaccaccgtgttcagcgctccgggacttccaccgcgcgcagcagcgtggactccgaccccggcatgcgcacgcgcaggagcagtgcggcgccgggcttcgcggccgtcagcgcctgggcggcgtccgacacgctggcgattttctggtcgcccacctggaccagcaccatgcctggcaccagtcccccgcgctcggcggggctgcccggctccacggcgactacctgcgcgccgccgtcccgcgcgtccgacagttgcacgcccagccgcctcggcgcggaagcggaagcgttgcgcggaagtacctcttgctcgccattctgcgcgggccgcgtgcccagggtgacgtccagcgactgcgccttgccaccgcgcagcaggttcaccttcacgcggctgtcgggctggagcagggccacggcgcgcgtcagtccgcccgcggactccaccggcttgccgttgacggaggtgatgacgtcctcctcgcgcaggccggcgcgctcacccgggctgccgcggttgacgcccgccaccaccgcgcccttcatcgcttccaggcccagcgcccgcgccaggtccggcgtgaggtcctgtacggccaggcccagccagccgcgacgcaccacgcccgtctccttgagctgcggcagcagcgcctggatgagcttgctgggcaccgcgaagccgatgcccgtggcgccgccgacgatggcggtgttcatgcccaccacctcgccctgcatgttgaagagcggcccgccggagttgccggggttgatggcggcgtccgtctggaggaattcgtcataggggcccgcctggatgtcgcgggcccgcgcggagaggatgcccgcgctcacgctggacgccaggccgaagggattgccaatggccatgacggcgtcgcccacgcgcagcgcgtccgagtcccccagcggcaccgccggcaggttgcccggcgcccccttcagcttcagcagggccacgtcggtgagcgggtcgcggcccatcacctccgcgtcgaaggcacgtccgtcatccagcttcacgcgcacctggtcggcgtcctccaccacgtggttgttggtgaggacgatgcccgaggcgtcgatgatgaagccggagcccgcgccctgtcgcgccgggccgttgccttcaccgccgaacccgggcggcaggccgaagcgctccgccatgccgggtggcaggcgctgcatggcggctgacctgcggggccgtgcgcgcaccttcacgttgaccaccgcgcccttcaccgcgtgcaccagcggcgccagcgaggtgatg

SEQ ID NO: 303 - DNA, 2027 bp, Myxococcus xanthus
gcccatgacgctgcgagcccggttgttgttggcgcaggcacccctggccctggcgctgttgttggtgggcgtggtgaccgtggtgacgttgtcccaactggggcgttctgggcctcgggtgcttcaggacaactaccgcagtgtgctggccgcgcaggagatgatggcgcagttggagcgcatggacagcggggcgctcttcatcatcgcgggtgagcggcagcgcgggctgacgcagcaggcggcgcagcgcgcgcgcttggagtcgcagttgcgggtgcaggaaggcaacgtcaccgagcccgccgaggatgcggcgacgctccggttgcgcacgtcctggcggcgttaccaggaggcctatgacgggttcctcgcccagtcgtcgccggagggggcgcgggaggcgtacttcggtgttctcgagccggccttccaggaggtgaccggagcggcccgggccatcctggacctgaaccaggacgccatggtgcgcaagagcgaggcgttgcagcggcagagcgcgcgggtgaacacggtgatggtggcggcggtgatggtggccttcgtggtggggttgttcgcgtcgcagtcgctgacgcaccgggcgctccgtccggtgtcggtgctgtcacaggcggtgcggcgcctgggcgagggcgactacgcggcgcgcgcggtggtggagggacaggacgaaatcgcgcaggtggggcgggacttcaacgccatggcggaggcgcttcagcagtaccggcgcagcagcctgggtgagttgctccaggcgcaggcggcatcacaggcggccatcgacagcctgccggacccggtggtggtgttcggcgcggacggagggctgctcaacgtcaaccgcgcggcggaggacgtgctgcggctgtcgctcgaagcgggcggggacatgctggggcaggtggtgccggaggcgcgcgcggtgctggagcgggtgcgtgagcacgtgttgacggggcgaggggcgtatcagccgcgcgggtacgaagaggcggtgcgggcgccgctcccggacggggaccggtggctgctggctcggggaagtccggtgcatggcgagtcaggggaggtggtgggggccacggtgattctccaggacgtgacgcggctgcggcgcttcgacgagctgaagaacgacctggtggccacggtggcgcacgagttccgcacgccgctcacgtcgctgcgcatggcgctgcacctggtgacggagggcgtggtggggccggtgacggagaagcaggcggacctgttgttcgcggcgcgcgaggactccgagcggctgcagggcatcgtggatgacctgctggacctgtcgcgcatccaggcggggcagcttcagttggagattcgccgggtgccggcggaggaactggtggacgcggcgctggacgctcagcggatggcggcggaggagcgcggggtccaggtgtcgaagcaggtggggctggacgtggagccggtggacgtggacccggagcggctggggttggtgctggggaacctggtgggcaacgcggtgaagcacacgcccccgggaggcgaggtggaggtgcacgtgtggcaggaatcgcacggggtgcgcttcgaggtgcgcgacacgggggaggggattgccttggagcaacaggcgcgcatcttcgagaagttctaccgggcacccggcgcgcctgcgggaggcgcggggctggggctgtccatcgcgaaggacatcgtccaggcacacggcggggacattggcgtggtgagtacccccggccagggaagcacgttcttggtcacgctgccccgcggaaaaggtcggccgcgagcgtgtgacgcgaagtcgtcgtcagcatcgagacacccaaggggagtcagagcctctgtacgtgcggctggcctgaaagcagactcaacgctggaatactggcgctatcgcgtgtctatctgcgccccagtcaaggcgggtccgcgtagggatgaggcgttacagaccctccacgttcaggcctcag

SEQ ID NO: 304 - DNA, 2039 bp, Myxococcus xanthus
taggtgaggctctgccgagtctctacgatctcgtacgcctcgatgatgtcaccgggcttgaggtcgttgaagctctcgatgccgataccgcactcgaagccctgcgcgacttccttgacgtcgtccttgaagcgccgcagcgacgccatcttcccggagaacagctgcttgttctcgcgcatgaggcggacgatggcgccgcgcttcatgacgccatccagcaccgccgcaccggcgatggtgcccacacgcggcacgttgaaggtgttgcgcacctccgcgcgacccagcttgcgctcggtgcggatgggctccagcaggccctccatctccgtacgaaccccgtcgatgagctcgtagatgatggagtagctcttgagcaccacttcctgggccttggccgcggcctccgccccggactccgggttgacgttgaagcccagcacgacgcccttggaggccgccgcccgcatcacgtcgccctcggtgatggcgcccacacggcagtggaccacctccaccttgaccttgtgggtggagagcttctggacggcctgcttgacggcctcggccgagccctgcacgtccgccttgatgacgacgcgcagctccttgggaccaccgcccgccttcgtcttggcgaacagctgctccagggactcgcggctgaccttcgacagctcggtctgccgctccttcatgttgcggtgctcggcgatctgcttggccgccttctcgtccgccaccacgttgatggcgtcacccgcgcccggcacgccggacaggccgacgacctcggcgcagtagcccggcttcacttccttcacctgctcgccgcggctgttcgtcatcgcgcggacgcggccgtagtgcgagccggtgacgacggcgtcacccagcttcagcgtgccttcctgcaccagcaccgtggcgacggggccacggccgcggtccagcttggcctcgatgatggcgcccaccgacggacggagcgggttggaggccagctcgagcacctcggcctggagggccaggttctccagcaggagttccaggttctccttcgtcttcgcggagacgggcaccatgatggtgtccccgccccactcttccggcacgagttcgtgggtggccaggtccttcttcacgcggtccaggttcgcggtcggcaggtccatcttgttgatggcgacgacgatgggcacctccgccgccttcgcgtgcttgatggcctccaccgtctggggcatcacgccgtcgtccgaggccaccaccagcaccacgatgtccgtcacgtcggcgccacgggcgcgcatggacgtgaaggcctcgtggcccggcgtgtcgaggaacgtcacgtcaccgcgcgcggtggtgatgctgtacgcgccgatgtgctgggtgatgccacccgcctcgccctgcgcgacgctggccttccggatggcgtccaggaggctcgtcttgccgtggtcgacgtggcccatgatggcgacgaccggcggacggggacgctcgtcctcgggacgggtctccacctcgggcaggtagtcctccacctcgaagcccacgcggtcgatcttccagccgtagtcgccggcgatcatctccgccgtgtccgcgtccaccaactggttcgcggtggccatcttccccaggcccatcagcttcttgatgagctcggcgctgcgcacacccatgcgctggcccaggtcggacacggagatgccctcctgcagcttgatgaccttcttctcctcggccatctgggtgatctgcgtcttggcgcccttcttcgtgggcttgcgcttcttgccacggatggggatggtgacgcggccccagaccatgtccgtcagttcctgcttggacacgctctgcgtatcaccgctggtgcgcttgcgctggccacgctccttgttcttggagacgtccaccagttcgcggccacggcccaggtggtccgggaccaccttgtactcacgccgctcggggatgcccgtgcggcccggcgccatggggtactgcttggcctgacc

SEQ ID NO: 305 - DNA, 1829 bp, Myxococcus xanthus
ttggtgtgtggaggtgagcgcgatggtctgccccaccgtctggcccagctcgcgcgcctgctcctggatgcgctccttggagacgagcgccgtctcctcgaactgggacttggtggaggccaccgacagcgccgccagcaagcccacgatgagcaccaccaggacgccggtggtgagcagaagaatctggtccagccgcaggcccttgatctgggccacgttgggcagctcgcccgcctccagtggcgcgatgagggtgcgggtgccgccctccgccagccccaacgggcccgtcaggcgcgtggcggtggactcccgcgcactggtgacttcctgggtgcctgtccgctcggacggcgggagcgcggcgtcatccgggaactcgtcggacgcgggcgcggacttcagtcgcgtattcgtactggacaagggcgggccggggtggggacgcgcgggggagcgcggggggaaacaggggtgtttcgagactctatctcacttctcgtgcttcgcgaggccctgtccccacatccacgccgcgccggggaagacgccacggccggcatgtcactgaagccatgtcatgccaatgtcatggcctgcttggagccccgcgtcattcacccgggtccgccgcgcctccccccttcgccgggcgcggtgcgggtgcgcccgttacagtcggatgtccatgcggccccacttccacgtggccggctttcccgtccggctccatccgctcttcttcgtcgtcgcattgatgacgggctggacgctcatctccgagcccgcgcggctcgcgttgtgggtgggcatcgtcttcgtgtcggtgctgctccatgaactggggcatgcgctggccttccgccgctacggctgtcccgctcgaatcgagctgcacggaatgggcggcaccacccagacccacgacgccgcgcacctcactcaccagcagtcggccttcgtgagcttcgccgggccgggcatcggcttcctggcgggagggctcatctggggtctgtcgcagctcgttcccctgggtgagccgggcggactggcggaccagggcgtgcggcagttcctgtgggtcaacatcggctgggggctcttcaacctgctgcccatgcagccgctggacggtggacatctgctggcggacctggtgcgcgcccgcagcggctaccgccacgaacggggggtgctcggcgtgggcatcgccacggcggtggtggtgctggggctggccatctggtcgaagcagctgtggatggggatgctggcgatggtgctgggggtgatgaacctcgagcagctccgccgcacgccgaagcggcgccccgccgagcggcggttcgccctcccccgcctggtccgcaagcccgaggcggcaccggcgggcgccatctccatcgagcagttgatggacgagctgcgcggaacgccccgccccccaggcgcggccgatgcagatgatgacctggagggccctcatgatccggccctggtgggcgagatgctcctggacaacgggctgccggagctggccgtgggctcgctccaatccgccttcacgcaggcgcccctggcgcgcaccggccatgccctggtgctggcgctgctgcacaccgggcggctccaggaactggcctcgctgctggacagctcgcacgcccggcagctgtccgaggacacgctggccctcatctccgaacacgccgggacggtcagtgaggccccactcaccgagcggattaccgcgctgcggcacgggcggactacaggcacggatgagccccgctgattgccgcgccgcgccagaaggtgctctc

SEQ ID NO: 306 - DNA, 1224 bp, Myxococcus xanthus
tcgcgcccgggtgagaaaccgcaaaagagtgagggccaagaaacgatgaagtggtgagcggctgacgcaccacttcgttgctgcactcaaggcccgtggccctgcgccgcgggccttctcatttgccagaaacgtgacgggcgggcccggcccctggaggaagccctcctctggcacagcggcgaaggttcccgggttcgcgctgagggccggggcgcgtcggcgcgccgggcttcggccctgactggaaaattgacggagtgctacctgcctgtagcgtcgaggccatgccccctccggccctgaccctcgtcgcccctacgccgtcgcgccgtgcggacccggtccgggtggcggtggaacagctcgcccgctcactgcctgcgcgcactgacgcggctgtgctcctggacctgctggaggatgacctccgtgagggattggatgcgcttggcgaggtggaggcccatttcacggacctgctcgacacgcttcgcacggaagcggtgacaccggccgcgctggtggaatcgggtgatgacctgcgcgtccttcaacagttggattcactccacgacgccgtcgtgcggctgcgcaagcgcctgtcccaggccgcgagcatgaatcggctggcacatgcgccggtgcgcagccgctgacacgctgctgtgaagcctcgttctaacgcctgccccagccgcaggcagtgccagcgcacggccgcgaacgccgatgcactgcctcgacaatgcccgtttcgggccgagagcaggcgacggcccgcgccaatgcgctaccgctccccgtcatcccggcggccttgtcgttacgaacctccactcaaggacccgccgcggcaggcgcggcgggagcgggagcgggagcgggagcggtcgtcgcgggccccaacacgggagaaggcgtcgcgggcagcgggagcgctggcgcggcgttgagcggcgcgggcgtccccaacaacggcgtcggagtcccggcattcagcggcgccggcgtgctcagcaacgccggcggcggcgtggcaggattcgagttgagcggaggctcggtggcgatgattcccgcgctggactgccccgtgccgataaacgcaccgaacgagcccggcgccagcggctgcaccgtgaacgaaccgaaggtggacatggtgggcggcgtcgcgaacgcccccgtcgtcgtgcctctcccgggcgtcgccgctttaga

SEQ ID NO: 307 - DNA, 1137 bp, Myxococcus xanthus
gtgctctaaagacgactacaagacgcgcttgttggggagtggcacggcgtcgggacgtggcgaggagggccgcatcaccgtgctgcgctccgtcatcatggacccctggattaccgaagacctccagggtcggccgttcctcgacaccatcatcgaggagctgcgagcggccgtgatggacgcgctcaacgagatgcgcggcacctcatcgaagtgctcgcgctgacgcgcttcagggagctctgtcagcgacgaggttgttgagcccgtgaggcattggatttctcaaggcctggcaacctcgtcgtcttcggaaaaccccatctgcatccgtgattgggggcgcaccggcccaggcgggaggtgaccatggcgctcgaggcgctgaccggggagagcaggtgaggggaaaagcgccccgctctcgcggcgcagcataccgccgcgagagacgaggtgctggtgctcagcacgcaccggtttcagtcacggactgcccctaccgcctgatgcgcagcgtgacggaggagaacacctcgatgcgctttccgtcttcctggatgaaatggctggtgtaggccaccggcttgacgaagatgccggtcgcttcgtgttcgttgttcgatttggcgctgaaccgcgccaactgaagcgttcccaggcagatgcccgtgcagcccacggccctggagccgcggtacacgaacaccgtgccgccctcaatctcgttcgagctgttggtccgcgcctttggcacggcgatgaacagccgctgctcggtgtcgggaacttcccagaccgcgcctagagggaggctgctggtgctgtgggcattggcgcccaccggacggagcgtgacgtcaatggaaccaccgttgtcgatggccgagttgaccttgacgagctcctccttctgggtccaccccaaccagtggagctgtgggaggttgtagttgtctgacgcaaacttgcccatgtacgtgctcgagtcggcagacctcacctgcttgcccgtcgtggaatcgcgccggttgccgtgcccgagcccgaggacgtgccccacctcgtgggcgtagtcccggaacaggttgcctttgatgtagacgctgcgccccccgccgttcgaggtatcgcaca

SEQ ID NO: 308 - DNA, 2073 bp, Myxococcus xanthus
tgatgcgaacggccgacgatgatgtgacccacgccgtgcgagcgcgcgaagtccaggatgccctccaccgggtctcgagccctcaggcgcaccacctccgcgcccagctccttcgccttctcgatgttcgtcagcagatgccgctgcgcctccgcgtcgatgaggtgcggcgcctcgcgcggcgtctccacgtacacgacgaaccagtccgtgttcagccggcccgccatccgtgagccccggcgcatcagcgtcgccgcgtgccggggataactggacagcgccaccagcacccggccccaggccgcgctccgctgcgaaccttcatctccctctcccggaggcggcctcgcggtggcgcggtccaggctctccgccacctcacgcagcgccagctcgcgcagcgtggccaggttctcctccgtgaagaagcgctccagcgcccgcggcaccttgtccttcgcgtagatcttccccgtccggagccgctcgtgcaggtcctccaccgccaggtccaggttcaccacctggtcggcggccttgaggaagctgtcgggcagtgtctcccgcacggcgacgccggtggcgcgctccaccaaatcgttgaggctctccaggtgctggacgttgaaggccccgatgacgttgatgcccgcgtccagcaacgcctgcacgtcctgatagcgcttgcggtggcggcacaccggaaggttggtgtgagccagctcgtccaccaccgccacctggggcttgcgcgcgagcaccgcgtccaggtccatctcctccacggtaacgtcgcggtaggagtactgcttgcgcggcaccacctccaggccctccaccagcgcctgcgtgtccgcgcggtcatgcgactccacgaagcccagcaccacgtccacgccgcgccgcttcagcgcgtgtgcctcctccagcatccggtacgtcttccccaccccggccgcgaagccgatgtagagcttgagccggccacgcctgccccgctccaccagctccaggaagtcctccgcgcgtgagcgccgcgtcatcgtcatcctctgcccatctggtgggaggcggggcggaggatgccctcgcgcccggcgaatctcacgtggtgaatgcgcgtgccccccacgtcgctcaaggtgcgccctggcccggcgaggccctgccccccacgcccggcgccgcgtccggaagcggcccgaagcgcctgtccaacgcgaggttcaacagcaggacgttgacgcgcggctcgcccagcacgccgaaggtccgcccctccacccgcgcgtccaccacgtccagcacccgctccagcgccacgccgcgggcccgtgccacccgcgccgcctgccagcgcgccgtctccggcgacaggtgggggtccaacccagacgcggacgtcgtcaccaactcggcgggaacgggccccgctgcatccggattctcccggcgcaggcgctccagctcggccgccgcgcgttccttcagcttcagcgacgtgggccccaggttgctgcccgaggacgccgcgccgtcgtagcccgcgccagcggcggaaggacgcggatggaagtaccccgcccgggtgaagccctggccgatgagcgcgctgcccaccacgcggccccggccgtccttcacccacgagccattggcctcccccggaaagaggagctgcgcaagcccggtgacggccagcgggtacagcagccccgtgagcaccatcgtgacgacgcacgtgcgcagggccgtgaggaatgtggagaacatggggataagtcctttcacgccagacccacggcgccgagcagcacgtcgatgaccttgatgcccacgaagggaacgatgacgccgcccacgccgtacagcagcaggctgcgccgcagcagggcctcggcgcccaacgggcggtagcggacacccttcagcgccagggggatgagcaggatgatgatgagcgcgttgaagatgacggccgacagcaccgcgctgaacggggaggacaaccccatcacgttgagcggcgcaatctgcgggaacacgcccatgaagagcgccgggaggatg

SEQ ID NO: 309 - DNA, 1621 bp, Myxococcus xanthus
cggcagcctactcaacgcagcagcgcttccaaagcatcgcccagggcctggtagtcggcgggggtgttgtagagctgggcggagagacgcacatgccggtgcggcggacggggccagggggtgatttgcgcctcgatgcggtattcgtcgaacaggcgcaggtggagcgggtccacgtagagcgggggctgggggacttcggggaagccgtccggcaacgtcaccgtggccatgctgccgaccatgtcctcggggcaggtgggctgggtgcccagccgcgcgcacagcaggttctgcgccgccagcaccttggcccggttcgaggccatgacctccggccagccgccgggaagcagcccgcccatgaagcgaatcacctcgggcacgcagagcacggccgaagggtcgtgcgtccccgtccagtcgaagtccagccggaagcgggaacggtccgtccgccgggagttgtgcccgtggctcacggacaggggcttgatggcggactggaggtcgcgccggacgtgaaggaacgcggcccccttgggggcgcacatccacttgtggcagttgcccgtgtagtacccggcacccagcgtgcgcagagacagcggcagcatgcccggcccgtgcgcgccatccaccagcgtctccacgccacgctcgcgcaacgcggcgacgagttgctccagcggcatcaccagggccgtctgactggacacgtggtccaccaggaacaggcgcgtgcgcggggtgacatggggtagcacggcgtccaccaccgactgcgcggacggcactggccagggcagcttagccaccaccaccttggcgctctcactgcgacctcacgaagtccagcgcgttgcggctggcgttgtactcgtggtcggtggtgagcagctcgtcgccagggggcgaagcgcagcgagcgcagcaccgtactcacccccgccgtcgcgttggggacgaagcccaggtcgtccgcgtccgcgccgacgaaggtggcgagcgcggcgcgggcgtcatccagcagcggctcgatttcgcggtggaggaagcgcaccggctcggcttccaggcgcgcgcgcagctcggactgtcgctggaggacggctgtcgggcaggcgccgaacgagccgtggttcaggaagacgacttcggggtccaggctccagtggctgcggaagggcgcgctcatgcgggaggactcgacctgagctggttgcgcctgtcaacgcgcggcacgtgtacagggggcctgcgccgcgctcgagcgcggatgcgctcaaatctcgatggagagctttcccgattgggacttcttggggttgtagtgctccaggtcggacttgaggacgtacccgacgacaccgttcgcttcggcctggtctccgccgacgaaggacatgatgacgacgttgccgccggccgcacgggccagttgcttcgcctcctcaaggagtttctctctcggcagggtgccgtgcgacgacgcacgaagtgagagcttcccgagaatctcgtgcggggcgccatcggtcgtgcgaatgcttccggtcacgagctcaacgccttcaaggaaggtatcgacgagcaccttcacatcgctcgaacctgatgc

SEQ ID NO: 310 - DNA, 1678 bp, Myxococcus xanthus
gcccgagtcctccgtcccgctcacgtcaggggagcacggcccagcgacggagaatgctcgcaccggacgaattcgtgaatagagcccggcggtctcagacgtctgtccgcgcgaagacaggcagcgggccggcggcgcgcgtcaggccgaagtctccttcgggcagggactcatggccgccaatcaccagcagcccgccagggaccagccgcgccaccagccgtgacaggacctcgcgttgaagcggaggcgcgaagtaggtgaaggcgacgttgcggcacagcaccaggtggaagggcccgtcgggcatctgggagcgcaagtcctgctggaggaagtccgccgcccgccggaactccggcgcaaggcacggttcgtcgccgggccccggaaaggcacgctccgcccaggcacgcggcagctcacgcaaggccccgcgcggatagcagccccgcgccgcccgcgcgagcagccccgcatccgcatcggaggccaccaacgccaaacgcactcccgggaatcgaggctcgagccccaactggaagagcaccgacagtgtgtagggctcctcgccggaagcacagcccgcgctccacgcccgcagtgtggcctcgccccgggagcgcagggactccagccgggcggggagcaagtcatggcgcagcacctcgaagacgcgcgcgtcccggtagaagcgggagatggtgacgcggcacagcgcgtcgagcacgtcccactccgagggctcggcctccagccgggcgcggtaggcccctgcgtctggaagccccagcgccttcagcctgcggccgatgcgcttgcacacctgcccccggacgcgccggaagccctcccagcgaaggcgcaggcggggcgcggcccactgcaacagctccacgcattcacggtccgtcatcggatcggcctcctcctggatgtcggcacggccgccgcgtccgggcaagggaaggccgcttgcaccgggcggaggcaggcgggatgtggcatgacgctccggcgttgtccttggatcccggaggaacccacccttgaagagactgagcgccctcaccctctccgcggcactggcgtcggccggctgcacgcacacccccgccgcggcccccgagcccaccgcgcagcaggccctggcccccgccgccgcgcccaagcccgtgccgcctcccgaaggcgccagcgtcctctccggcaccctggccgacttcaccgccgcgtgtgacacggacctcgagcgcacccgcgcgcaggtgtccgccatcaaggcgctggacgcgcgcaaggacggccaggccgtgctcgcggcctatgacgaggccctgggctcgctgctcgccgcggccaaccgctccagcctcgcgcgcgaggtccatccggaggcggccttccgcgacgccgcgcgcgagtgcgagcagcgcgtggactccgccaacgtggcgctgtcccaggaccgaggcgtctatgacgtgctggccgcggtggacctgtccagcgcggacgcggcgacccggtactggatggaccgcgcgctgctcgacttccgccgcgccggcgtggaccgcgacgacgccacccgcgccaaggtgaagtcgctcaacgaggagttgctcaagctggggcagcagttcagcaagaacatcgccgaggacgtccgcaaggc

SEQ ID NO: 311 - DNA, 1495 bp, Myxococcus xanthus
cccgggcgcccctgctcgctggcgagcctgtgcggcaacaacgtcgtcgactccggcgaggcctgtgacagcaacgtccccggctccaactgcacggcgacctgtgacctggccctgtgcggcaacggcgtgttcaacaaccgcgcccacccgtcctacgcgcaggaagtctgcgacgacggcaaccgctacgagggcgacggctgcaaccgcctgtgcgaggtggagcctggtttcgcctgcaccggcagccccagccgctgcgtgcgcgcgggcgtgacggtcttcaacaccggcgtggacgaaaacaaccgccggctggaggtcggcccggatccgcactggttctacagcggcaccaccacgggcgcggccaccggtccgcgggccgccagcgactggccccaggaaatccagacggcccgcttcatggaggcgccgctgggcgcccccgtctgcgtgtaccaggacttcatggtgccctcgacgaccaacgtctcgcagttccgtctgcggctggccaccttcaacgacaacgacttcgccagcgcgcgggtgaacgggcagaacttcacgcccaccgtcgtcaaccagccggcgggcatgccctggcagaagaacatcttccgcgagttcggcgccaacgcgccctggcgcacgggcctcaaccgcatcgagctgtgcaacgagaacgcggaaagcgagcccaacgccttccgctacctgttcgtggacgcgtacgacgaccgctgcggcgacggcgccgtgtccctgcgcgaggagtgcgacgacggcaacgtcaccaacggtgacggctgctccgccacctgcggcatcgaggcgggctacggctgcaccggccagcccagcacctgcgcccagacgtgtggcaacggcacgctgaacccgggcgagcagtgcgacgacggcaacgccacgacgggcgacggctgcaacgcgagctgccgcgtggagtccggctacgcctgccccaccccgggcgaggcttgtgtgcccacctgcggcaacggcacgctgaaccccggcgagcagtgtgatgacggcaatgcctacgactcggacggttgctcctcggcgtgccgcatcgagcgcggctacgagtgccagggcgctccgtccacctgcgcccccctgtgcggcaacggccggatggatgcgggtgagctgtgcgacgacggcaacaccaccctgggtgatggctgctccaacgcctgcaccctggagctgggctacgcctgccccgctccgggccaggcctgtgtgttcacctgcggcaacggcaacgtcgacccgggcgagcagtgtgatgacggcaacctgaatccgacggacggatgcagcaccgagtgccgcgtggaggatggctacgcctgcagcacgcccgaaaccggtccttccgtctgtgtcgagagctgtggcaacggcgccctggaagagaacgaggcgtgcgatgacggcaacaccaccgcgggcg

SEQ ID NO: 312 - DNA, 2160 bp, Myxococcus xanthus
  unsure (1)..(2160): unsure at all n locations
gcaggtgcgttccggtggccgtggccccttcgaacaagcggggggctggggcgcggatttcggcggcggcgccatccgacgccacctccgcgaaggaggccgaggtcctgcgccgctacgaagcgggagatttggcggcggcccgggacctggcccaggcggagaagctcaccgcgctgcacgggcagctcatccgtttcgagaccgccgaggcgcaggcgaagaaggccctggcgcagcgggacttcccggaggccattgcccaactgacgctcgccatttccgtggacgatgccctggcacatggctggagcaaacacggaccgcccctgcgcaagcagttgtcgcgactccatgtccaggtcggcacggagcatgccgccgcgggccgggtgagcgaggcgcgcgccgccttcgaacaggccctgaagcacgacactggcaaccgcgaggcccgcgagcaactcggccggctcaccggcgcttcagccccctgaccagcagcatcgcgttgagcaccacgaaggtgaccagcgccaggcacacgagcagcaaccccctgtccgtgccgggccgctcgccttcgatgagcagccacaaccggccgtcccgcggttggagctcgcccatgcgctccatcagggccagcgcatcgcggtagcgacgggcatccgcttgcgccagcagccgtcctcgcacggcgaagggacgctggtcgggctgcggcggcggacggccatccgtccactgctcccccgggagcgctggccggcgcaccacgaagggcgagtcccgcagccccacgaggacatacagcgcgccgtccgcgcgctcataggcgccccggaccgtgggcacgccatgcacctgggcgtatcggttggaaacgagcgcctcgaagcggtacgccccttccgcccccaacgtcagcggcacgcttggggacaggaaatacgacaagtccttccactgcatgccgagcagcaccaggcccacggcgatggccatgaccgcggccatgggacgtacgcccacgcggcggcgtgacaaccggaactcgagctccgcgatgcggcgcgctcgcgcctcttccgagggggactgcggcagctgctcactcatgggcggacatgatgtggcgtggaaagacgaaaccccgagctccctgactggggaacccggggcgacgagtcttggacggcagctggacggctcaggccagattgaagatcttcttcaggtccgactcgatttcgtcctcggagcagtccttggccagcgacagctccttgatgagcagcgagcgcgcggtatccagcatcttccgctcgccgaaggagaggtccttgtcgcccttcaggaggtacaggtcgcggagcacttcggcgatttcgaacaccgagcccgtcttgatcttctccatgtactcccggtaacgacggttccacgtcgtggagtcaacggagatgtccttctccttgaggatggagtagacctgcttgacgtcctcctcgctgatgatctcccggagaccgaccgacccgaccttgttgatcgggatcatgatccgcattccgttctccaggatgcgcagcacgtagaaggactggcgctgcccggccacctcggtgtgttcgatacccatcacttcaccgacgccctggcccgggtagaccgccttgtcaccagtcttgaagctggtctgcactcactgcctccttgaaagactcgttcccggcctttcagccgggcactactaccacaaaccacatccacgggcaacgataacgccttgaccacccaggacgctcccgactacgttgtcggtttctacacgcggtgtcggcagatgtgtgcaccagcgtgacgggcggcgggtgggggtcggaaggtggaacgtcatgcttggcgcgacctgggcgcgcgtnctctcttctttcccgccctgagcctgtcactcggagccctctgcgccccggtaacaagcgcgtacgccgagccatttctcgtttgtgggcttttactgggagcgctcgggctgacgcttgccccgctgcctagtgcgcatctcgccgtgctggcgtccccctcgggcgcgggcgcggggcttggcgcgctgggaaatcccaagtgggatgtgcccggcgggaattttacccc

SEQ ID NO: 313 - DNA, 1959 bp, Myxococcus xanthus
accggctgctgcccaccctcctgccgggttcgctcttcgaggacctggggctgtcagagagccgcacgccgctgacgtccacggacatcgcgtccatggcgctccagcgtttccaccaatcggcgcagaacgtacctccgcgctggaggtaccggatgacccgcgcctcctccagtccctgctggaggaattgggccggccgccgtacctcgtgcggggggagtcactcccggcgtacaccctccaggtcagaaaggactgcgaagggcccgtgcgagatgcccccggcgtgcgtgccgggacgatcctctactgcgtggcgccagcgcggcagggcgcctgggtgacgatggtgggcctccccgcggaggagcgcttcggcccgccggccgtcgtgtccgtcgcgggcgaggcgcgcttcctgctggttcgccccattccacccgatgaagcggagccaggagccgcattccgcgacagccttgctgccccaccgtcacctgccggtgacacggacgcgggttctcctcgggcggggccctgatccgccgcttgcccgcctggtcagtttgggcggggctttcacgaggttgaccccttggagccccggtcgataggctcgccgagaacggaccctcccccacgtgacgaccactcaaccgaagcggcagcccatcccgtttgggaagtacctccttctggaccgcatcaacattggcggcatggcggaggtgtggcgcgggaagcagttcggcgcgagcggctttgagcggctcgtcgccatcaagcgcatcctccccaacatcgcggaggacgacgagttcatctcgatgttcatcgacgaggcgaagatcagcgtccagctgacccacgccaacgtcgcgtccatctacgagctgggcaacatcctcggcagctacttcatctcgatggagtacatccccggcaaggacatgcgggccatcttcgaccggtgccggaagaagggggagcccgctccagtgccgctggtggccttctgcgtgtccaagatgtgcgagggcctggactacgcccaccggaagaaggacgggatggggcgggagatgaacatcgtccaccgcgacatctcgccgcagaacgtcctcatctcctacgagggcgaggtcaaggtcatcgacttcggcatcgcgaaggcggccggtaaggcgaccaagacgcaggccggcatcctcaagggcaagttcggctacatgagcccggagcagatccgcggcctgccgttggaccggcgctcggacgtgttcgccattggcgtgtgcctctacgagatgctgaccggtgagcgcctcttcgtgggtgacagcgacttcagcgtgctggagaaggtgcgcaaggcggaggtgccgtcgcccaccacgtacaaccggcgcatcccggagacgctggagcgaatcgtcctcaaggcgttggccaaggacgtggacgagcgctaccagtacgccagcgagctgggcgacgacctgcagcgcttcctcatcaccagcgacaccatcttcagccgcaaggacctggcgcagtacatgaagtccacgttcgcggaggacgtggagcgagagaagcagcgcctgctggattacgcggacatcaagccgcccgacggcatgcaggccgcgctggaagccgcgtccttcaacagccccatcatgccctccgcgccgccgccggcgcccgtgccggtggtgcagccggtggcgccgcagccccggatgacgggctccatgccgacggtgtctccagggggcgtgcgtcgctcgcccacgctggccgcgctgccgaggctgacggccgccaccgccgcgccccctcccgacgaggacgagggcggggcgacgcagcttgtctccagcgaccacgagttcgcggacacgccagagcccaccacgcagccgggggccgcctcgggcgtgctggagagct

SEQ ID NO: 314 - DNA, 1122 bp, Myxococcus xanthus
taaagggctaagggactcggggccaaggccgaggctcgagtgctttttgcactcgcctggaagactcacactgcgcacagcgagacttcgctcagcaatcaattgaaacttaccctttgtatgcactgtcgcttgttttccggtggctatgtcggaggggtcccacccgttcccatcccgaacacggaagttaagccctccagagccgatggtacttcgcgggaaaccgcgcgggagagtaggtcgctgccggattctttttgagaaacccccggtgtccctcgtggacaccgggggttttccgttttggggcgtattgggtttccgcgcgtcaccgcgggcgctgggcctggcgccgcgtgcgcagtcggcgcacggccccaccgccagcagggccgccgtcgtggccagcaccagcaggtgctcggctcgcgccgccccttcgcaacgccaaccggttccactgccgcagcgcgggcccttgagtcgcgcgccgtgttgcagtgaacgtcctccgtccgctgcgagtcgctgccttccgctgcgactgccttcgacgatttggatctccgtgtgctggcattgccgcgttcggcttggttgagtgtgggctcccccgctgtgttgagaggagcctctcgaatgaagctgcttcgtccttgccttggcgcgctgctcgcggccggcctcttcctcgttcccacgaactcagaggccgcggtccgtgttgggcttggggctgattattggattgatgacagcgcggtcttcaacttcacgctgggcgttgagacgccgctcgcggggccgctgtctgttggggctcggttcggtgcaatgctcatcaccgagggcaacgacatcggtgttccgctggacctggtcctgcgtgcgaacctcgccaagtccggcgtctacatcgaaggcatggtcggaccctggctcgtgtttggccgtggcgacaccttccgagcgcatgctgcgtttggctttggccttcagggcaaggccgcgagcattggtctcgaggtgggttacctggagcccaacccgaccattggtctgcggatcggctacaagttctgagcctcagtaatgcggagggcgccaaccttggcgaac

SEQ ID NO: 315 - DNA, 2127 bp, Myxococcus xanthus
gacgacgagctgagcgagtccatcgacctggccaccgagaagctgatggagcagccccgggcacgctgggccaagcccatgcggaagaacctgctggcgttggaggcagagacggagctgcgctgccgggtgccagcgtcgaagggcgatggcaacggcgcggcccatgatgcgtgacgctgagcaggaaaccatcaggccgtgagggggcgcccccgctacgaaagtggcgggggcgttcctgcttcaacctgctggaaggtgcgcgctcggagggacttgaacccccaacccccgggttcgaagcccggtgctctatccagttgagctacgaacgcaatttcgagggcgggtaaagaagggcggccaaccgggatcgaaccggcaacctccggagtcacagtccggcgctctaaccagttgagctatggccgccgttacagctttaccgcgaacggcgtttgaagcggcggcttccctaccttggaaaccaggcccctgacaaggcccaaatacgacttacggccaggttagcgccccaggcagggctcgaacctgcgacccccggcttagaaggccggtgctctatccagctgagctactggagctggccgggccgcctgcttccgatgctgcacttcaagtcggggcgagaggattcgaacctccgaccccctgcgcccaaggcaggtgcgctaccaggctgcgctacgccccgagaagtccggcattgttgaaccatcccgaacggacgcgcaaggccgacgtgactgacggcctcgcattccggacggctacaagcccagcaggtggggcttcatcttctggaaggccttcccccggtgggaaatggccgacttctcctccggcgtcagctccgccagggcacggtcgccgcccggaaggatgaagacggggtcatagccgaaaccatggcttcccttcggggcgtggccgatacggccgttgcactgccccacctccaccttcgcctcccctcccccgggccccaccagcgccagcgcgcagcggaaggacgcggtgcgctgggcgtcgggcaccccggtcagctcggtcagcagcttctcgtagcgggcccggtcgtcccccggggcataccgcgcggactgcacgccgggccgtccgcccagcgcgtccacgcacaggccggagtcatccgccagggtgagcagcccggtggcgtccgcgtaggcgcgggccttcatcaccgcgttctcctcgaacgtggcgccgtcctccacgggctcggggacaggcggcaggtccgccagggacaccacctccaccgcgtctccgacgaggccacgcagctcgcgcagcttgccctggttggtcgtcgcgaacagcagccggggcttcaccgtcatcccagcacctgcgcctgcgcggccgtcagcttctggatggcggccagcccgccatccaccatggcgtccagggccttgcggtcgaagagctggtgctccgccgtgccctgcagctccaccatgcggccgtccgcggtggccaccaggttcaggtccacatccgcggtggagtcctcgtcgtagtccaggtccacccggacctcgcccttgacgatgcccacggacacggccgccaacggcgtgagcttgggcagcttggagatggttccggccttctgcagcgagcgcagcgccagcaccagcgccacgtaggccccggtgatggaagcggtgcgggtgccaccgtccgcctggagcacgtcacagtccagcgtcagggtgcgaggccccagggtggacaggtccaccgcggcgcgcagggagcggccgatgagccgctggatttccatggtgcggcccgtctgcttgcccttggcggactcacgctggttccgcgagtgcgtggcgcgcggcagcatgccgtactccgccgtcacccagccggagcccttgcccatcaggtgcggcggaacgcgctcctccgtggagcaggtgacgagcaccttggtgtggccgaactccacctgcaccgagccctccgcgtagcgggagacaccgggggtgaggacgacggggcgaaggtctagcgcaccacgttgaaaggaacgcacatcatgctcctgggaaatgaggacgagcg

SEQ ID NO: 316 - DNA, 1807 bp, Myxococcus xanthus
gcaggggctcaccaaggcggacgccgcgaagcgttggggggccgcgcaaatcaaggagtggcgccgctccttcgacgtgccgccccccaacggcgagtccctggagatgacagcggagcgcgtgttgccgttctatgagcgcgccatcgccggagacctgcgcctggggaagaacgtgctggtggtggcccacggcaactccaaccgttccctggtgatgaagctggacaacctcacgggggagcaggtggtggggctggagctggccaccggggtgccgctcatctacgagatgtcgccggacggagaggtgctgtccaagcgcaccgcgtccccctgactcaggtgaaggcacagggggctacccatccccctggagtcatgggatacgcacggcggcgcgaggacggctcaggccgctccagggggaacttccgtggtccggaggcaggctgtacgccctaccgcgtccggttgaatggaaccggccccggcgcgtcagatgcttcgagcacatgaaaggacgctccccatgaaggccctgatcacctccctcgctctcctcttcgcccttccctccctggatgcccacgcccaggcggagatgcgccgtccgcccagcccgccgccggggcagcagatgccgcagccgcaccatccgcaccagcccaactacccgccgcagcactccggcagccaggtggtggtggaccggcgggagttgaacgagcgcctggaccggctggagaagctgctgaaggaagccgagcagcggatgaaccggcaggagcgcaacaagttccgcaacgccaaggagacgctgaactccgtgcaggacctggtgaacagggcgccgctgctggccaccgtcctcccgcctccggcgccgatgccgcccccgcagccggtggtgcggcccatctcggacagcgagctgcgccgcatccactcttccatctccctgcagaccttcgccgaggacaagatgcgcgtgctcgtctcggcggcccagcaccactacttcctggtctcccaggtgggccagctcctgggcaacttccagttcacccaggacaagctggccgtggtgcgcgagctgaagccgtacatccttgacccgcagaacagccacacgctctacagccacttctccttctccagcgacaagaagcggctggacgacattctctcgcagcgctgacccgcgcgggctgacaggcagacagcaggactccgggcgtcgcgggaagtgcttccgcggcgcccgtcgcattctagaacgagcacaccggtccgcgcgggaagagacgtcccgccggggggggcgtgaaggcgcgctccatggcatccgcggcatccgccagcgagccatgcgacgcctcgattcgggcgaagcgcgtccgcatccggtccaggattcccgcgggcagcagccgccgcgccatggggaacacctgcgcctcctccaccgcggtgtgcccccggtacaggcgcaaccagtcatccgccgcgtcgagcatgcgcgcggggtccgtctccccgccacgcagcatcgcctccgccgcgcagagcatggccaccgcgtgctcgctgccggtgccgtgctcgccggacacctgggccagcagcccgggcgccagcggcagccggtgcgccaccatcgtctggaagagcaccatctccttcgcgtggtggctgccgtccacgaaggtgaggaagaagttcgcggcgcgcaggaagagcgaggccgagacgaactccccatcgcggcccttcgccaccgcccgatcctctaaagctttagagc

SEQ ID NO: 317 - DNA, 2659 bp, Myxococcus xanthus
tgatggcgcggatgccgcccggaagcatgacggcggtggcttgcgcggaagagaaggtgcgtccgctgctgacgggggcgttgtcgctggccgcagtgaatgggccggaccggtgcgtggtgtccgggccctcgggggacgtggaggcgctggagcacgagctgagcgcgcggggcgtgggcgtgttgcggctgcctgcgcggcatgcgttccactcggcggcggtggagccggtgatggcggagctgcggcgcgtggttgcgggtctgcgcctgtctgcgccccagcgtccatacatctccagtgtcaccgggacgtggattcgcccggaggaggcgacggacccggattactggctgcgccagatgcgggcaccggtgcgcttcggggacgggctggagacgctgaaggcggacgggtgcgacgtgtttctcgaagtcggcccggaccaggcgctgaccgccctggcgaggctggggctgcgagggcaccgaggacgcgccgtggcgtcgctgcctcgggcgggctcggtcctggatgcacatgccgcgttgatggaggcgcttggaacggtctgggcgcaggggctcgcgattgactggcagcgcgtctacgcgcacgagtcacgccagaaggtggcgctgcccacctatcccttccagcggcagaccttccggaccccgctgcccacctcagtggtggcccggccggagacgtccgcggcggtggcggagcgccccgcggaagccggaggcacgccccacttggaggcgccagcggagcaggccggggcccacacggacgtggagcgcaaggtgctggccatctggcgcgagcggctgggccggaccgacttcggcatccacgacgacttcctggaactgggcggcaactcgctgatggcggcgcagttgttgacccgcctgcgggaggccttccctgtctcactccccttgagtgacgtcttcgacgcgcccacggtggcgggcatttcggctcgcatccaggcgcggctgggcacgcccgggacggcgtccacggagccggtcctgccgccactggtccgcattccgcgtggcggagcgttgccgctgtccgtggtgcaggagcgcatctgcgcgctggagcaggcgctccccggcaacgcggccctgaacatgtatgtggtgctgcggctgcatggcgcgctggacgtggcgctgctggagcggggactggaggcggtggcactgcgccacgaggcgctgcgcacgtcctatccgcgtggcgagggcgctccgagcgtctgcatcgccccggagctgaagttgccgctctccgccgaaccgctggaccccgcggcgtggcagccgcgcgtgcacgacgaggtggcccggccgttcgacctggagcacgggccggtcgcccgcgcccggctctggcgactggctccggaggagcatctgctggccgtcaccgtgcaccacgtggtgtgtgacacgtggtcgctggtggtgctcgcgaaggagctgggggaccactacaccgccttcatgcaggggcggccggtggcgctgtccaccttgcccgtgcagtacgtggactacgcggcctggcagcagcaggcgctgaagagcggcgcgttcgcctcccaggtcgcggcctggcgcgggcgtctggcggcgttcccgcgtccgctcgagctgccggtggaccggccgaagggggacgggcccgcgctccgtggccagtgcttgcgcgtgggcttctcgcgcgcgctgtcggcctcggtccaggcgttcgcgcagcgagagggtgtcacgccgttcatggtgctgttggcatcctggaaggcgctgctgtcgcgctggacgggccgggatgacgtcgtggtggggacgcccattggcaaccggagccggccggagctggagccgttgatcggctacgtggcgcactccgtcccgttgcggacggacctgtccggggacccacccttcaaggagctggtggcgcgcgtgcgcgaggtgatgatggatgcctacgcgcaccccgacgtgccgtatgagtcgctggtgcgggaaatcgagcccgcgaaggacaccggccgcggccgggtcttcgactcgatgttcgtgctgcacagccggttcaatctgaacctggagctgccgggtctgcgcatgagcctggcggagctcgagaacggtccacccgagttcggcaccgtcctgtcggacctgtccgtgggtctgggggagtacgagcacggcttctccggtaccgtcgactacgcggaggagcgcttcgagcgggacaccgtggagcggatggtggcgcactggaccgcgctgctcgaagcggcggtggcggagcccggcctgtccctctccgcgctgccgctggagcacgctcgggccagtcaggcgctggcctcggagcctgaggcatccgcatcggtggtgacgccgatcgcggcgctgcttcgggctcgcgccatggcggacgcgtcccaggtggcgatgacggcgccggacgggcggggcgtgacgtggggcgagttgcaaggggccgtggggcgtctggccgccgtgctgtcggaccgaggcgtaggacccgatgcgctggtggcggtatgcctggagccatcggtggagcgcgtggtcgcgcagtgggcggt

SEQ ID NO: 318 - DNA, 1323 bp, Myxococcus xanthus
gagctctaaaggttgagggaggtccgtgcctcgggcggcatgcgcgtctgggacgcacagcccgcgccaagcacggtcagcagggacagggacaggattcggaatgaggcgagcggcatggcacctccgcggggacagggcgcggcaggtgtcctgattagctcaccgggctggctgcgtcagcggggatggttccatcgcctcgcgcttgccgccgcggcatccgcgctgaggcgggcagatggggccgcggccatgcggatccgcgacgagcaggaaacggccgagcccgcgggtgtccgtcagctctggatggccacacagcgcgcagtgacggggaggacgcttggagggagggaagggcacggggagtgagtgtgcgccgctcccatgcccggagcgaattttcggcgggcccggcccgggtgggcgcgggccggggactacttcttgtcgcccgaggccgccggcgcgggggccggagcgggtgtgctgggagcgctgctggccggcgaggacgcgctcgacgacgaggaggagctgctgctcgaggaagagctgccgccgtccttcttggtggagctgtacaggtcggagtaccaacccccgcccttgaggacgaagctcgagcggctgacgaccttggtcatcgacccctcggcgccgcacgcgccgcacgtggcaggggcggggtcggagatcttctgcagcacgtcgatcatctttccacagctctggcaggagtactcgtagatgggcatggttctcggtgcctcgtcagggtgttgagtcagcgggagccggccagcagctgcttgcgcagtccgtccgccagtcccaatcgctcgaaggcgcggaagacgagctcggagggggcgccgtgcttgcgggcaacggcatccgccagttcgtgcaggtctccggcatcgtgcaggacgtcgccgacgagccgctccagttccttgcggagcgtgtcggcgaacttcttctggatgcccaggtcggtcaggtacttctcgcgcccgagcaggtccagccggtgcgtcaggtggggcgtggccagggcctcgcggcggaagcgctcgcgcagggcctccacgtcctccgtcagcgacagcatggagaccagtcgctgcagctccgacgggctcaggcccagggcccaggccacgcggccggcggcgccccgctgggtggtgaagccgtccagcacctggcggcgctccttctccaccatcgcatccatcaacgcgtggtcccggagcacgttcttccgatccacctgggttagcttttcccgcgcgccattgaagcgcttggaca

SEQ ID NO: 319 - DNA, 1422 bp, Myxococcus xanthus
agctctaaagacatcatcgaacggcacggcggtcacatctgggtggacagcgagctgggccgaggctccacgttccatgtctcgctgcccgtgctgaccgcgacggcgcaatgggaggcccggccctgacgcggctcaccgcaggaccgagccactgctgagccgcgacacggcgccgtgcaacatgcccaactggcggggcacccgttcgagcaacgcgccgaagacggggtcatccgtcttgcacgacaccttcaacggcggcaggggcggcggcacgcgccggtccgtgagcgcgtccgcgagttcgtcgagcgcgcgccccgcctggtgcgccaactgcttcaactggtcgggaacctccgcctccggccgctccatgcccagggccgtcaccacggtggcgaagcggcgcgcataggtgatgacggccatgcctgactcgagctgctggggcgggccatggtactcggcggtgagccgctcgaaggaggcctccgcgtccagcagcgccaggctgaaggtgcgccgcgcggcgcccacctcgggccgggtgccgctgcgtcgggagatgacctcgcgcaggtattcaccatccgcgcgtaacgcggtcgccgcggcttccgggaagcggcggcgctccggcatgggccacagcagccacgcgcccgtcagcgccagcgcgcaggccaccagcactcccagcgcgcgctggccggcgaggctccagtcccccgagctcaacgtggccagcagcaggtagtcgggcgtgagcaggacctggaaggcaccgaagttgatgggcaggagggacaccgacaccgccgtgagcaggacgatgacggcgagcagcgcggagggagaatgcacgcgcgtggcaatcaccgccgccaggcatgcgcccagcagcgtcccgccgacgcgctggagcgcgcgctcctcggtgatggccgaatacggttggaggatggcgatgacggtgaggctcacccagtgggcgtcacggatgcccagcgcccgcgtcaccaccagcgccgccgtcgccaccagccccacgcgcagcgcgtgccggaagacgagcgagtcggagcggaggtggtcgcgaagcggggccagccacgagcgcgtgcgcagcggctcctggcccaccacgctccgcccgcggtcggacaccgggtcgccatggagcaggcccgcggccgtctcgtgcgccactcccgccaactcccgcagcttcccgaagagcgcctccacgtggatggacagcgggtcctcgcggttccggatgtctggagcaggccggtagagccgtctgcgcgagcgaggcaccatccggggcgcgcgcgggacgccttcatttcgctcgcgcaccagcacctgctccacccagctcgccatggccgcgtaggcgtcacacagcga

SEQ ID NO: 320 - DNA, 1340 bp, Myxococcus xanthus
agcattcgcggcagataggcgaagcgctcctggcccggagccgtagtcgcggctgttgatctggttttgattgcaggtcgtcgtctcgaagtagccgcgtgcctgggttttgctgttgcacgggtcatgcgtggagttgcggaattcgcccgcgtcgaaggcgtgcaggtatccattcatggtgcccacgaaggccacggtcggccggtccgccagcggctccaggaagttgcggcgatacaggtcgcgctcgctcgcgcgggcattgttggcccaggtgtcgaggtacggcggcaggctgatggcgaccgtggacatgttgatgccacccagcgcccacggccgacggtcgtcacgggtgcctggggcgtggcggtcctcccagccatacagccactcacgcaggaagttgcggtcgttggtgacgcccgtgatgcgcttctcatcggactcgctggagggcgtgccgcacttcccgtcattgttgaggtcgtagaggtaccggccattccgctcctcgtcgcagagcgcgtccgggaagagcaggctgttactgctggtgtccgacatctcgtcggtgatggtgctgcgtccacccgacgcgcccatcgtgtagagcttgcgctggagcgggtcgtcgcgatgtccgttggtgccgaaggacagggccatcactctgcccgcgtcccaccgctgaacggcccgggtgacgctcggctcctccgggtcatagagcgagcggaagtagagccggccgcggagggtgaagtccttctgtccgtcataggcgcggatgcctggcgcgggcatgccggagcccggccatgccccaccccggccccaggcgctgcccggcgtctcgttcacaccccagacgatgacgttggccagcgcggacggtgaggctcgcgagtagctgccggcgcggatggcctgatagcccacttcgacgtcgtcgatgatggggcggcactgctcgttgggactggtgatgtccaccttccagcagagctgggagccggtgaagcccatggccatgatgtccagctccacctcctgcgtgggcggcgacgtgtcggggaagtggaccgggaaccacgtcggtgaattcggattggccacgcactccatctgcccggtgtccgggtggggacggcagacgcggcaatccaccgccagcgaataggcgatggtgggctcgggcccgtcctccggcgtgcacgcccccgggacgtcctcactgaagcagggggctccgccggcgcaggtgcgaggcgccggcgcgaagtcgtcctgccgcttgaagcgcaccttggtgatgacgaagtcgttggcgatgt

SEQ ID NO: 321 - DNA, 1538 bp, Myxococcus xanthus
  unsure (1)..(1538): unsure at all n locations
tgtgctctaagggagccggccgccgaacccgctgccgccgcgaacgcgggcaaggtccgcttcaagctcatgagccagccctccggcgcccgcgtcttctaccggggcaaggagcgaggcgtcacccccttcaccctggagattccgtcgggacaggatggctccgtcacggtggagctgaccttcgcgctggagggctaccagatggagaccgtcgtcacgggcggtaccggcgaggtggtgctgtcgcagaagctgcagaagcgccggggcggcgccggcggcagccggcacgtcgaggtggcctccgtgagcgcggatgagacggcggaggaagtcgagccggtggccacgccgggcggcatgtccgcgccggtgatgctcgcccccacggcctcgcccgccacggagctccctgtcgcggcggccgtcggtggcgccacggccgcggcagccgacgcggctccggccaagggctcggcgaccgggctcgcgctgccggtccttcccaccgcggcggtggcctccgcgcgtggcgacgtgctcccctacaacgaggacatgcctcgcccggagatggtcgaccagggcaaggacatcatctacacgcgcgaagcgatggccgcgaagtcgagcggcgtgatgattgtccgctgcaccatcacccagcagggccgcgtggagaagtgccggatcatcaagtccgtggcccacatggagcgcgcggtgctcgatgccctcacgtcccggacctacaagcccatcgtctacaagggctacccggtgaacgtggactacaccttcagcatgcgcctggtggcaccgcgccgctgaggatgcattgctgacggcccccgccggacccagcgcacatcagggtccggtagagggcaccacgggaggcgcgggaggaacggccggcacatcgccgccgggcggcacgccccagtccaccaccggccagccccgcttccgggcgtggcgccgcagccggtggtccgggtggacggncacgggccgccccaccacctccatcaccgacaggtccgaatacgaatcggtgtagaaggcgcatgccgaaagtgccacgcccgcctcgcgcacataggcctcggcacagacgcgcttgccctcgccgaagcagatggtgcccagggcgcgtccggtgtggaggcccgcgccatcgacctcgaagcggttgcacagcaccgcgtccagtcccagctcccgcgccaccagctccgacaggtagcccgtggacgacgtcagcaggacgagccgctccccggcacgccggtgcgcgtccagcacggcccaggccccgggccgatagagcggccgcacctgttcctcgtagaacacggcggtgcgctcctggagcggcctcgcgggcgtaccggcgagctgggcaatcgcgcgcgcgacggcgtcctgcatggacacgaagcccaggtggtagcgcgcaatccagaggctggcgcgcagcgccctggaagcgggagatgtgccccagctcgagctcgcggcgaatccacagc

SEQ ID NO: 322 - DNA, 1166 bp, Myxococcus xanthus
ctctaacggctatgcgcgttcgcggcacggcgcgcaacgcggagggcgtcgagcggcgcttcgacgcgctgacgagcctgcccaagcccattcagggcgtgcgcttcgagaagtcgctggggatggaggcgggccgtgtgcgcatcgccgtgaagctggggacgtggctgggccgcattgacttcgccaccgcgaccgatttggacgcggatggcgtctacaccttccccgccgacagccaggcgcagaacgcgctggtgcgcggcgtggaagacaccactgcctacgtcgtgacgtgggtggaaggagctgcgcaatgaagaagtggatgctggggctttcctgtctgggactgatggcgtgcagcgacggcgcgggcacggtgacgttcaccacctatggcgaggactacatcgagaaggagattcccgcggccgtgggtggcgaggacggcatcgtggacggctggacggtgcgcttcagcaagttcctcgtggtgctcggcgaggtgaaagtcggcaaccacgacgagaccgccatcgagatgatgcaggcgcgggtattcgacgtgcacaagcccggcccggtggtggtggagacgttccgcgacgtaccggcccaggagtgggaccacgtcagcttcgccatcgcgcccaacaccaacgcggttgcgggcaacgcggacgccgcggacgtcacgcggatgaaggacggcggctactccgtctacatggagggcagggcgaccaagggtgagcagaccaagcgcttcgcctggggcttcaccaccaacaccgtctacgagcactgcgagagcccgggcctgggcgcgggcgtaacggtgcccaaggacggcgaggagacagtgcagctcaccatccacggcgaccacctcttcttcgacgacctgcagtcgccggacgcgcagatgcgcttcgacgcgctggccgccgcggacagcatgggcatcgcgggtcccgacggagaggtgacgcttgaggagctggcggcggtggacctgacggagctgccggcagggcagtacggcacgggtggcgtgggcaacgtgcagacgctgcgcgacttcgtcacggcgctgacgcgcaacctggggcactaccgcggcgaaggtgagtgcgagccccgggcacgctgaccacgcggag

SEQ ID NO: 323 - DNA, 1191 bp, Myxococcus xanthus
ggtggtggtggcggcgccgagcgatggcccgggagcgaatcctctcggcttcgctcgccgggtcgtctccgttaccgaggtggatgacaccctcgtcgtcgagacagaagccgtggctctccaggacatcgtcacgggggagatgcagttcacgttcgactactcggaagtgcagaccgtcgacatctcgaagctcgacctcgattgggccgccaggcacctgtatgtcgacgcgaacatcatgtctcccagggcggagggcaatcccgacgacgagccgctgcccgaagccgaggaggaaggggacccggcgctccccggagaccccttcctgggctctatctggaacgcgatcaccgcggtgggagatgcactgggcggcgcggccaaggcggtggctgccgcggcggtggatgtctggaaggcggtgacggtcgaggggattaccacgggcgtggagatcaaacccgaaatcaagaacaactactcgagcgccttgttcaagctcgagtatgagaagagcttcaacgaggcggggaagaccccaatcaagctctccctgaagggcacggggaactcgtcggtggactattccttcaacccgggtgtgcaggtgggtgtgaaggtgcctcccatcctgggagggagccaatcgacctccatgtggctgaacgtggatagcaagtccaggctcaaactcgatgtcgaggccatcctgaacgccaagattgaatccgcggacggcctgacgggcaagaagctccaggacaagctcgcggagagaacgaagttcgccgaggacgtcctcgcccaggcgaaacagaagtatctgggccatccggacatgcggcccgcgggtggatggaagcgcaacatcctcgtcacgaagccggcggtgcagaccatcttcgccgggcccgtgccggtcgtcctgacccagaccctccaggttgatctcgagtgtggattcgaggcgaaggcgggcgtcaaggcgaacgtgagcttcgagcacaacaccaccttcaagttcgaggctcgctatgagaacggagaggtgacgacgacgccggcccagttcgagaagaagaagaacaccgacatcacggtgaccggcgaaggcagcctcgtggttgtctgcgggctcattccccgcatcaacgtgtacgtgtacgacgcgctcggaatgaacgc

SEQ ID NO: 324 - DNA, 1904 bp, Myxococcus xanthus
cgcgccagacacctacgtggcctcggccgaaacctacggcgccccctcgcggacctggacaccggtcatcgcgcccgacgtgcggggtggggccgtcgccgttgccttgcccacgggcgaggtcctgctcgcgggaggcacggccgccaccacggccgagcgctacgaggacgtcctcgcgcctcccgcctggcgtccggtcgtctccgcgccggagacgctctaccagacctgccccaccgtcatcgaaggccagggcttccggggcatctcgggcgcgtccagcggcagctacctggactcgccaacggacttccccctggtgcgcctgcgcgccgccgagggcgggcggctctggacgcttcccgccacggacatgtccaccacgcgcgcgacggtgcgggtgcccgcggaggcgccgccgggcccgtatgccctgtccgtcttcgccaacgccattccgggtggacgcatggtgacggtgcgcgccaacaccgcgcccaccgcggacgccgtgcgcatcgccacgatgaccggcgtcccgcaggacatcacgctcaccgcgaccgatccggacgcggaccagacgttgacgtggaccatcgtcacgcctccccagcatggaacactgagcggcacgccgccgaacctccggtacacgcccaacccgggttacgtgggcgccgacagcttcacctaccgagtcagtgactgcggcctggacagcaacgagccctcggtggacatcgaggtggaggccacccaacccctggccatcacctgccccgaggacaccaccatcgaggcaacagggcctgacggcgctccaggcaactggccccccgccaccgtgacgcccggagcgggcggacccgccacgctcacctattcaccggcggagggcagcacgctgccgctggggaccacgaccgtcaccgccaccgcggaggacgcatccggcacgcaagtcacatgcaccttccaggtcgaggtgcgggataccaccccgcccgcgctgacgtgccccgccgacatccggacgacctccgatgatgcgtcgggcacgacggtgaccttcgagctgcccgaggccacggacggcgtctcgacgccctccgtcacgtcctcgccggcatcggggagcaccttccggcacggcaacaacaccgtcactgtcaccgctacggacgccgcgggaaatgaagcccgctgcacgttccaggtcacggtccaggcaacggtcatctccatcgccggaggcggctgccaggcctctggcggtggcgctgcctcgtcgctggccatcctggtggttctggcatcgtggagcggactgcgtcgccgctcgcgtcacgcctcgcactgacccatgcgtcaccctctttcgcgaatggacttcaccttgcgtacacaggctcggagctgggcgctggccgcgctcatctcctcaatcgcgcccaatgccctggcacaaagcaccacgggcgcggtcgtccccatcgacctggagcggcttcgcttcacccccgccgcaacggactcgatgctcgtggacacaggccacgtgctcccccagggcgcctaccggctgatgctcatggccgggtatgagcgcggcatcctcctgctcaagggcagtgatggccaggagcgctccatcctcgactaccgcgtctccggctggctcgcgggcgcctggtctcccaccgaccggctggagctgtccgcgcggctgcccgtcatcatccaccagggcgggaatggcgcggacacgctggtcggcgtctccgcgccggacgccttcggcctcgggaccccggagctgggcgcccgctacgcgctgctgcggcgcgaggacagcgcccccctctttctcagcctgggcctggacgtgggcacgcccg

SEQ ID NO: 325 - DNA, 1491 bp, Myxococcus xanthus
ctggggggatgtccccgccaccggcggcggacggaccgaaaagcaggctcgcttgctgcacgaatccggacatgtgcacgtccttgtagcatgatgcggccggtgcccctccggccggggaacatctgcaccgtgtcggcgatgcggccaccgcatgaatgcaccaggtgtaacagcgggcaacgcaggtctcggcccgtctcctgtatgcggaggatcttctacaccgtgcggactccccagctatcggccttcaccgtggagtcgttggccctgatggccacggtgcgtccggacaccttgcccacgccgatgacgacaccatccgagggcaggtccgggtccaggttgttggcgagcttcgcgtcctccacgaaggagccttcatccaccagcagacggatgcgctcgcgggcgaagagcttgcccgcctccgcgttcttggcgtggtacttctgcgcgccacccttctccacctgggcgatcttctccagcagtctcgagtcttgggacatggcccgtggcacatagcagaaagggctacggctggctgccctctcgctgagggaccggcgcggcgtgacaggcagacgacgcaccgcgcagaacggtccccgcaggggatgccgctccaggctcccctgcctaccttggtgctcaacgggggcgtgctcgcgattgatgcgcacccggcaaccatcgggcccaggagggacgcatgttcgcagcgaagaaaggcaagtggatggccaagggaatcgcccggagcgagctgtaccgcaagtggctggcccataagctcatcaatgacctgccgcgcgtggcgcggaaccgctgggatgacttcgagccggatgacgtgctgcggcatgtcggattgaccacctacaagccggcgcgcgcgggcctgggcggcctgggcatcttcctcctcggcgtggccgcgggtggcgtggcggccctgctgctggccccgaagacgggcaccgagctgcggaccaccgtgaaggacaaggccacggcctacatgaacaaacagaacgtcaacatgggccaggagcgcaccgcgaacgcctgaccggcgcgcgtggccttcgcgccatgtgacgtgacgcacttcggggacggggcaccggtgagtaccgggccttccgtccccgatttcgtccgtgcgggctagcggcccttgtagacgggcgcgcgcttctccgcgaaggcgcgcaggccctccaggcggtcctccgtcttgagaatctcctcgtacttgcgcagctccagcgccagcgcatcgtccagctccaggcccgtgccctcgtcgatggcgtgcttggccgtggccacggcgatgggcgcgttctccaccaccgactccgccaacccgtacgccacgggcagcaggtgcccctccggcgccaatcggttcgccaggcccacgctgaaggcctctgcggcgttgatgcggccggcggtgaggatgaggtccttcgcgcg

SEQ ID NO: 326 - DNA, 1631 bp, Myxococcus xanthus
agcctgctcgccgcgtgtggccggctcgcgctcgacgaagccgtggacatcgtcctccaggtggcggacgtgctcgcctatgcccacgcgcgccaggtcatccaccgcgacctcaagccggagaacatcatggtccggcagggcatgcgcggctggcacgtgaaggtcctggacttcggcatcgcccgaatcaccgacggcgcgacacggctcaccgtccagggcgcggtggccggcacgccgcgttacatgtcccccgagcaggccatgggcctggacgtggacgcccgcgcggacgtgtacgcggtgggcatcgtcctcttcgagctgctcaccggtcagcagcccttcgacggcaacagcgtctccgaaatcatgcagaagcaggtccaccagcccatgccacgactggcgcaggtggcggcggacctccaatatccaaccgtcgacgccgtcatccagaaggccaccgcgaagcgccgcgaggagcgctacgccaccatggaggccttcgcgtcggacctggtcaacgcgttgcctaccctcaccagccggcgcgccgtcagcggcatcaaccccgccatcaccggcggtggcctcgaaccggcgcgaccggccacgctcctctttggcacggagggctccgaggccaccctggtgcgcgccgccccggcggaggccgcgccggtgacgggctccgcgcccattccgctgacccagcccgccgcgccctccgggctccgggtgggctcagagggcttcaacaagacggcgcacgcggcctccccctacgcggcgccgaagcgctcgaagtccagcgcggtggtggggctgggcatcgcgggcgtcctgctcctgggcggcgtgggcctcgtggccctccggggcggcagccgcgacgacgtcaaggagggaaccctggttccagtcggttccccggcgcaaccggcgtctcccgtggcgccccccgccaaagaggccggcgcgtcacctcacgccaccagcgggacggtggagacggcgcccgacgatgtcgcgacccggcagctcaaggtgctcgcggcgggacaggccatcgacatcggcaatgacttcaacgaaggccggctggacagcgcgatgaaacggctggcccaggcacggagcctgggattggacgccgtcgagcccgagctggcggcgctcgcgggcaaggtggaggacgcctcgaagcgcatggcccgcgcccgagccctggagaacgacggcaactgcgagacggccatcaccctctatcgcgccctgaagcgcgaccatccgcagctcgtggaggcccagcggggcatccggcgctgccaggatatgctgcctccggaggtgtccgactaggcggtaaagccccggccggcgtgggccggggcttgtgctccaggcgcgcggaggaagccgctctcgacgaagtacttgaagtaggtgcggaaaagggactcgtccacccgcgggcattcgatgccactgccctccaatcccgcgcgcgtgttccggtgatccacgcgcccccaggatgaaaacagttgcaggggccccgcgccgcccggcgcctcccgcgctccaatcagcggagcgagcgcgaagagcgcgttgtggtcccg

SEQ ID NO: 327 - DNA, 1583 bp, Myxococcus xanthus
ggcaacctgatggagcaggtgcggcagggggcgctcacggccgctcaatccgaagccgcggctgccagccggttgatgggggatagcgccgctgtggatggctatgcgcgcatccacctggagcatctgaagcccagtccgcccatccccggcgcgcccacgtccttgacggactacaccagcagcatgccggacgtggcgcccgcccaagcctacgcctacttcgtccgtcacccatcggcggtgttcgaggccgccggcatccgcgtccgcccggcgacggcggcgctggtggatggcgcgaagttgttcctggaggaaaagggttttccgcccgtgtgggcgcccatcaccgtgcgcctggagccgggcgcgaacacgctgcacatcaccacgttggatgggcacccgctgcgcggcacgaatcgcttcgtcttcgccgaggacggcgcggggggcacgcaggtgcgtcagtactcggccttccagggcagctcgcccgcgacgtcggtgggcatgacgctgatggaccccatcgagcggcagcacgacatctggcgcgcggtgcatgcgcacctgcatgacacgctgaggcctcgctgatggcgcccgtgctgcggacgacgcctcccgggcatgacgtgattctctatgacgggcactgtcgcctgtgcggtggggcggcccggcagctccagcggctgctgggcgggacggggacgcgcctgcgctcgtttcgggaggacggggtgctggcagccttcccgggtgtcacggcggaccgctgtgagcgggccctgcaactggtcctcccggatggggccgtggtggaggggctagaggccattgtcctggcgctgggccgacggccgctgggacggctgctccgcgtgtactacgtgccgggcctgcggcagctcctggatgcgctctaccgcgtcgtggcccgccatcgcttccgcatcgcgggacgtcaatgcccagacggggcgtgcgtggtccacttcaaataggacacgcgtggcggatagcatggcgtttccccgccacctcgggttcgtccgtgcaatctccgccgtccacatacctccaggccgcgcgcgccttccggcacttcttcaccgagctccgggatgcctacctggagcgagagacgctcttcacgcaactggagctggcgctcctggggcgcgagcacgtgctggtggtgggcccccccggaacggccaagagcgccatcgcgagcgccgtcctggggcgcatcatcgacgagcgcacgggcttgccgtcgctcttctccaagcagatggccgagtccaccgtgcagacggacctcatcggcccggtggacttcaaggtgctcacggagacgggacgcaccgagtacctcaccgacgaaggcatgctgggctccgagcacgccttcctggacgaggtcttcgacggccgggacatgctgctgcgctccatcctcaacgtgctgcatgagcgggagctgaagcacggccgccgggtgacgacggggcgcatcgagtgcgtcgtcatgacgagcaaccggtatctctccgaggtgctggcgcgct

SEQ ID NO: 328 - DNA, 1310 bp, Myxococcus xanthus
  unsure (1)..(1310): unsure at all n locations
gctctcaggacgcaccgtctggggaaccgccgccctgtcctcgcagggcggcggcgaacctgcggctacttcgcgttggtgaccatgtcggcgcgcaccttgccgacgatgccttcccacttcccgttggcgccatggccgtgggattcgccgtcgtcgcggaacttcacgaagtggttggtccacttggcacggcccccctcacaggcggtggtgccagtggtcaggtcgttgcagaaccagtcggacgggttgcagtaggccccgcccgcgctgcccgacacgccgcccgtggagtggtacgacaccgcgtcgtcgtcctgccccgggaggagccccgagtacaccgtccccttggcgcccgcgaacatgttgaagcggatgccgcgcgtggtgttgtggttgtacatggcgcgcgcggtggtcgtcacaaggtcgctgacgatggggtccttcaccgcccactcccccatgtccgccagctcgctacctccagcggcacccgatgccacgttcacccacttgatgttccagcccgtctgcgtcttcccatcggtgttgccacacacaccgctggaattcggtatcgcgttcttcttgtagcgcgccgagccgccatacagcgccagcgcgtaaccaatctggaggttccccgcgctgtgcaccgcgatgtaacaccagttgtctccggtgcagtagcagtcgagcgcatcccggatgtacgcattctgcccgccaatccgctgccgcccgtcccagttgacggccttcttgttcaccccggccgccgtggacgcgggcccccaggcggagaagtcggcgtagttgccctgcttcgtgcctccggagttcttcccgtgaatccacagggtgtagttggtggccaacgcctggggcgcgaacagcagcgccgcgcctgccagcgccgcgcgaacgggaaaccgcatggggactccgggggaattgcgagggggcgccacgctaacagcaggcaagtgtttcagcccagggctccattcagatacatggagcggccccaggtatcgtgagacccagtgtctccaccgtgtctcacgacacgccgcgtcgcaatggctctcaggtccgcatcttcagtcgtgtttcatgcaccgcgtcccccacggcgccaggcttctcgcgctcggcggcgcgcagcaagcggaggatgccgggaccgaacacgtcgattttcgtggaggcataagcctccgtgccgaagcggcggatggtctccgtctgctgccggaggatgcgcgcgtnctgcccgaagatgtggagcgccacgggca

SEQ ID NO: 329 - DNA, 1208 bp, Myxococcus xanthus
accccgaccttgagcgtgcccgtctcgccggtgctctcttcccggagcgtgaggtgcctcacggcggcctggtccttgccgggcgtccagctcagggtgcccgtggccgcatagaaccgggcgccgggcggcaggttgtccacgacgaagcgcgtgtccggcgcggcatggccggtggtgcacgtcacggtggcggagacgggctcgccttcgagcacccagcgtggctcgcccgcggtgggctcacagaggttggactgcggcggtgggccgccgtcgggctcgccgccgtcagggggacctgggccggttcccgcgtagggtgacgtccctccgtccgtgccgttcgtgggcaggcctgcgtccggaagcgacccgttgtcagggggctcgctggcggggtccggaaggccacggtttccggagtcgccaccacacgccaccatcagccccgcgactcccgccaggaacatccttggaaagcgtttcccgcccacctgagccctcccccctcgaacaacgccccgtcacggctcgcaggattaaccattccgtgacgcgcctggcaccccccgcggtgccggcgttgtcggttcgtggacgccgccggagggagggcgcccggcgaggtcaggacgggacacgcggtgtccggtgggcaacctccctgggccagcagcttctggatggcgcgcgtcgatggcctggagcttcgccgccgcgaaggtctccaactcggagggggaggggatgcgcccgtcctccatcgcgaggaaggcggcgacctcccgcagcgtgaagcccagcccctgcgtccgccggacgaagcgcacgcgcatcacatcctccggggggactcgcggtaggcgctctgcgtccggcggggcgggggcagtcgcttgcgccgttcgtcgaaccggcgcgtgggaatgcccacatccgcggcccgggccagctcgcttccaggggactatccggctttgagtcgcacggaatcagaggcgtgcttcgcgagcgcctcggcgatctggtccgacttccacagcgggtccaggcaggggcagaagtagccggggcccgccttctcgcgcacggcccaggtgaagaactcgcgggcggtgtcgtggagctcctcgggcaggaagagggcggcgacgtcgtactcggtgaagcggagcaggcccggcacgcgccactcgcgctgccag

SEQ ID NO: 330 - DNA, 1315 bp, Myxococcus xanthus
acgcaggtcgtcgtcacgggagggcgtctccacgtggccctccggatagcacgctcccccgaggcagaagttgaaatcctcttctcggatgaatcgcaccatctccgacgcgtagcggaaacccccgggcgcgggctcgaagaccgtctggcccttgggtgggtctccgcgcagcaccaggacgttgtccaccttcgcggccgacaggcgctccagcacggtgcgcagctccgccggggagtgccccccgcatgtcaggtgcgccatcgcctcgatacccgcctcctgcttgatgcgcagcaccaactccaccgtcttcgcccgagtgctgcctcccgcgccttccgtcacggagacgaaacccggctgcagggtcgccaggtcttccagcgccttgagcaggttcgcctcgccctcgtccgtccggggcgggaagaactcgaaggagaagcacgggtcggaaggattcaaccgattacgaatcttcatgtcgcccccagtgtagacgctccgcgtcgtccttgatcgggcaagtctcgcggctatagtccgcgccgttttccacacccctccaggagaatgaagatggcccggcaaacgcccctcaacgcggcacaccgcaagctgggggcccggatggtcgacttcgctggctgggacatgcccgtccagtacagctccgtcatcggcgagcatgaggccgtgcgcaccggcgtcggcctgttcgacgtctcccacatgggcgaggtggagttctccggtcccggcgccctggacacggtcaacgcgctcatctccaacgacctggcccgcgtcgcggacgggcaggcggtgtatgcgggcttgctcgacgagcgaggcaccttcgtggacgacgtggtcgcctaccgcttcagccccgagcgcatcttcatctgcgtcaactccagcaaccgcgagaaggacgtcgcgtggatgaaggcgcacgccaagggtgtggcacccgtggaccggagcgacgactacgcgcagattgccgtgcagggccccaaggccaccggcctggtccagcgcctgacgaagacggacctgtcgaagattggcacctaccgcttcgccgagggcgaggtcgccggggcgaagtgcctcatctcccgcaccggctacaccggcgaggacggcttcgagctgtacagcgcggccggggacgcagtggcgctgtgggacgcgctgctcaccgagggccagcaggacggcgtgaagccgtgtggcctgggcgcccgtgacagcctccgcacggagatgaagtacgcgctctacggcaacgacatcgatg

SEQ ID NO: 331 - DNA, 1619 bp, Myxococcus xanthus
cccctgcagagccgtcgcgatcttcgggtcgtccaggaaggccagcagcagctgcttcacgaaggtgtcgccgatgcgctcggtgaccatctcccggatgaggccggcggcgcgcgcgccacccgggccctcgttgccgcgggcctcgcccttgtcggccttctcgggcttctcagccttggcttccggggcggccttggcctccggggcggccttggtctccggcgcgggcttcgcctcggcggcgggcggggccgggggcggctcgaactccttggggtccaggggctctgggtccaggcgctccagggtctcgacgacgacctgggtgcggccgtggaactggatgacgttgccctggacgagcacgaagtcgcccggctggaagacgggctcgagcgcgtcgacctggtcgaagatgcgcgcgtccacctcgccactcttgtcgacgagcgtggcggcgacgaacaccttgccactgcgggcggtcaccttctccttcttggtgacgcggaagacggtatggacgcggtccttctcccgcaggtcggccgcatacaccttgcggacggtctccacggaaccttccggggcggggggcgcggactcgggcacgttttcgttggtcattgcggcggcggacactagcactccatcggccgcgcgggtggatggcttcagctgacttccaacgccattgcgtggaggtgctcggccccatgggatccggccagggtcgggtggtctggcggcaggccagggcgggccagccgggtggcgatccgggcctcgccctcgcaggcggtggccaccaggtcgtcaaagccgtcctgggggaggggtggatggtacccggtgaccatcaaccatccaccgtggcgcgtcctgcgaagcgcgtgacgcagcaactccacgaattcctcgccggtcgccacggccggtgtgtccagcaggaccaggtcgaaggtgtctcgcaccgcacggaggacctggaggggtttgcccgtctccaccatcacccggcccagcaggccgttggcctccgcgttctcacgcgccaggtccgcggcgtccgcgtcggcgtcgaacgcgagtatgtgccgggccccgtgcacccccgcgtggacgaagagccctcccacgttgcaactggcgtccagcacgcgcgagccctgggccatgcgcgccacgaagcggcggacctcgcgctggtcatacgcgtagcccgtgccctggccgtatgtgaggtccacggtgaagcgggcccccatctccagcagccggcaccaacggggtggggtgccgtacaggacatgggggcgctgtgtgggcaggcccagcgctttgcggcgaagggtgtcgttgcgcagcagcaccgcgcccgcgcccgccacctccaccagcgcgcgcgtcagttcctcatggcgcgcgtccatggcacgggtgagcgtctgcaccacgaagtgcgtgtcgtagcggtccacgatgaggccgggcagaccgtccccgtcatcgttgacgacgcggcagaagcgcgggtcgtccaccagccgggcccgccgttcgaaggcgtggcggaaatggcgtgggatgagtccctccaccgcctcgtccggctg

SEQ ID NO: 332 - DNA, 1169 bp, Myxococcus xanthus
gcacgcattcgcacccgtgcccccggggagagggctgcgtgtctccgttgttccgctgtcagagaggtgacccatggtcttggagctctcccatcagcagatccacgtcctccacgcgtgcctgtctgaaagcatcgcggagttgcatgacgaggtccttcacaccgacgagcgcgacctgcgcgaatcactgaagctcaggctcgaccacctgcagggcatccagcggcaggtggaagccttgatgcaagccgaggaagcggcatctcctgactgaatgccgcttccctgctgctcgagaatgcagccgggccccgagcgagagacagaggtgctccaggtcgatgtcgccggcaacggaccggtcgccacgctgacctcgagcaccgcgaaggcgtacgtcgtcgctcgcgggccaggctcagccggtcacggtccccacaccggcccgcttggggtgaccgtcatcgcttgcacccccgcgcgcagcggcgccggagtaaccgcgccgctggcggcgtagccgaagctgccgcccgtgctctcaatccccttctcgaagcggaccaccgcgcttccgcgggttgggtgactcaacgtcacgctgtacgcggtcgccgtctcgtcgagcgtgagctgcagcgccgagctgtcggccacatccttggcctgcacgacgttcaggaagtgactcaccacctgcccgtgggtctcaatctctccacggaactggcccaccgggtacgggtaggtgccatcgccgcgcaccgggccgcgctcgtcgacgattcgccggaccggattggcaggaaccagggtgctgacccgcagctgctgcccgccactgttcgcggaccaggtgttgcccatgagcaccggctgctccgggaaatgaatcaagaaggtcttggccaccgaggcgtcatcccgtgcgctttcgagccggtcgaacacaatcagggtgtcgagcggacgcacgaacaaggtctcacgcaccacccgtcccgcgtgcgggttgccgacctcggcctctcggtgggcccactcggcgttcaagtcatacacgccggtgaggtcgaccgcggcgtagctcgccacggacgacgactccaggcgcagcatttgcggcgcgtggtggtagtagccgaccgtgcccagcctgtagagcg

SEQ ID NO: 333 - DNA, 1633 bp, Myxococcus xanthus
gtcgccacgcccgcacagccccagctcagctcctcggcgacgatggtctggtccagatgggacaggcccacgccgccgtactcggcgggtatcgccatgttgagcagccccagctcccacgcggtcgtcagcaaatcgagtgggaaggtggccgtctcgtcgtagtgggcggccttcggacgcaccacttcgcgggcgaacttgcgtgccgcgtcctgcagcgcgcgctgggcgtcggtgagctggaattccatggggacctcgtgacgggttcggctcgttgactcgggagtcaacgaatacatgccgcggcgcgaaatcgccagtgcaacccgccgggaaccggaggaggacgggctccatttttctcaaaaaaacaggccccaaccccgcagagggattggagccatggaaaccgccgttagcctgtatttcccgagggttatttggccgcgggcggcttggcggccttggggaccttctcccagtcggccaggaacttcttgatgccggcgtcggtgagcgggtggttcgccagctgggtgatgacgttgtagggcagcgtggccacgtccgcgcccaggcgggcggcctggagcacgtgcacggggttgcgcacgctggccaccagcacctgcgtgttgaagtgctcgtagttccggtagatttccaggatgtgggagatgagctccatgccgtcctgggagatgtcatccaaccggcccacgaagggcgacacgtaggtggcgccggccttggcgcacagcagggcctggttggcggagaaacacagcgtgacgttggtgcggatgccctcggcggtcagcgccttggtggccttcatgccctccacgcccatgggaatcttcaccacgacgttgtcgtggatcttcgccagggagcggccctccttgatgagctcgtccgcttccatggacacacattcggcgctgatggggccatccacgatggagcagatttcgcggatggtctcctccaggccccggcccaccttggcgagcaaggacgggttggtcgtcactccgtccacgcagcccatggcgtgggccttgcgaatctcctccacgtcggcgctgtcgatgaagaacttcatctcgtccctctcttgaaggtggaatgtgccccggccaatggaggccgggcgagcaggcgcgtaaccgatgcccccccatgcgtcaagggtggccaccgcggaggggcggaggtagaaggccggacactgaacatggcccgcccttcccgctccgccgccaagaagccccgcctgcgcgccctccccggccgtcccgcacagccacctgccgtcctccccgacgcggaggccacgctcgcctacgcgcggagcgtgctggaggccgaggcccgcgccattctcggcgtgacggaacgtctgggagacgacttcctgcgcgccgtgcagttggtgcgcgactgccggggccaggtcatcgtcactggcatgggcaaggcgggccacatcggccagaagctgtccgccacgctggcctccacgggcatccgctccgtgtacctccaccccgccgaggccgtgcacggagacctgggccgcgtgggccggggcgacgtcatcctcgcgctgttcaacagcggg

SEQ ID NO: 334 - DNA, 2402 bp, Myxococcus xanthus
gcgtcgaagacggcgaccgcgccgtccagcacgcgcagcgagcgctccacttcgatggtgaagtccacgtgccctggggtgtccaggacgttgatgcggtggggcacacccgcgcccatcccctgccggggttgccagaacgcggtggtggccgcggaggtgatggtgatgccgcgctgcttctcctgcggcagccagtccatctccgtggctccgtcgtgcacctctcccacggagtggatgcgaccggtgaagaagaggacgcgctcggtgagcgtcgtcttccccgcgtcgatgtgcgccatgatgccgatgttgcggtaccgctcgatgcgtgtgtggcgagacatgaaggactcccgttcccgtcgagcagcgaggcccgcgggttgaattgaggcgccggttgaaatgaagggatgacgccgcgaacgcctcagcggcacacacgcgcgactcgccggaggggcacgtcaggcccgctcagggacgcgtgaggacacacgaggacgcggcaagagagagggcggagccggggctcacggcacacgggaaccagccaacccgcgcgccggagacaccggtccgccaactcaaatgtcgagcagaacctcgtgacggggggcgaggcacacgtccgccgccggcgcgaacgtgcgcgcacacagcagggcgttgaagaagacgggcctcatgatgcgtttgaattaaagcacagacgccgtgttgtcaatccgggcacgggtgcgaacacgcgagcccggaatcacagacatgcgcgccgtcaggtgctgagcgcccgcacgcgcgccgcgaggttgtgcgtgaagaggcggaagatgcgcagcgccgccgcgtcatgcgtgtccaggtagtgctggaaacccgcgcgggtgacgcgcagggcgcggaccgccgtgcgcgcgcggacgtgtgcggacaccggggcatcctgcaccagggagatttctcccaggtaggcgccaggccccagcgtgttgagccggcgcgcatccgtctccggcccgctgaacacgtccacctcgccctccaggagcacgaagaggccgctgcccggcgagcccttctccagcagcaccccgcccgccgggatgagcacctgccgcgccacgcggtacaggtccttcatgtcatcgagcgacagctctccgaagatggggatggccttcaagtagtggtagccattggcctccggcgccgccgcgttcgagggcaggcgcgcaatgacggcctcggcctccgcgtccatgcccaggcggcgcagcagccgggccttctccgccgccagcgccgggtctccccgtgccgactccgtgccgcgcaccgtgtcggccaggagcgccagcgcacgccgcgtgaagccctcgccatccagcagcttgcacatgcgcagcacggactccaggtgacgcgggtcaccggagggaacgctcgcgagcgcttccacctccgcgtgcggctggcccagctcgcggtagagctgcgccgcctcgtacggacgccccaggcgcaccaggcagtgcgccatggcctcacgcgcgcccaggccgcggtaggcctccagcgcgcgctccatggcgccgccccgctcgaaggcggctgcggcgcgctccacctcacccgcgcgcaggtacgcctccgccgcgtccacgtaacgcccgccctggacgtacagctccgccaccaggcccgcggcgccgcagccatccagcaggcgcgcggcgcccgagaagtcacgggcctggcgcaggacttccgccagacgctggcgctccgccaccgcggcctgcgcggcctccttctggagccgctcgcgttgggagctccccagctcctcgtagagctgcgccgccacctcggacgacggctgcgtgagcagcccgtggaacgcgccctcccccgggactgctgctcgggggccttccaaactcatctccgcctcggaccgcgacatcgctcgcctcccccattccgggtcaccacgaacatccaggccggtccacgccgacccgaacttcccggaagacaaggaaatcctatagcacgtcggcgagcggagttcctcgcctccgtcagcggacggacacgagctcggtgtcgaagatgaggaccgtgtacggcggaatccgtctgcccgagccggtggcgccataacccagggacgacgggatgatgaggcgacgacggctccccacgcgcatgccggcgatgccttcatcccagcccgcgatgacctgccccacgcccagggtgaagccgatggcgggcccgttgccggtggcgtcgaagctgcggccgtccggcaggtagcccgtgtagcgcacctgcacgcgcttgcccgcctcggcctgcgcgccatcctccacgacgaaggtggccct

SEQ ID NO: 335 - DNA, 2189 bp, Myxococcus xanthus
ggtccgggttgtacaggcctcgcagaaccagcgttgcccctaggtcatccttgaggagcgccggttggccctggtggagccccaccagccgcaccgagaagcccacgccatccggcgtcacgtgcaccgcgagctgccccggcacgagcgggtctggcaccgcgctctcggagagcagccaggcgacctggggatgtacggggaggaaggcgcgcgtgtacacccgcacctcgctggcgccggacttctggagcgcggcgcgccacgcgtcctgcgaccgaggcgtctctccatgtgactggagctcgtgcaccatcagcaggtggacgcgccgggccacgcgaagcagctccaggttggccgccacgtcggagcgggactgctccagcccttgcggacgaccgccggcgagcgtggccatgactccgaggaggatgacgccggaggcccacaacggcgcggaccggcctcgcaccagctcccagcccaggcgtgccgtgcccaccgccgccagcaacgaaccggccagcaccagccagcgcggcacctcgcccgcgtggaagggctgactcaaggcctgcgtcaggtgcgtccactcgggcacggacgccacgcccacgcccacggcgaaggcgacgaacaagacggcgtgcaccagccgcagccccagcggggacggctgccccacctcactgcttgccgtcacgggaacggcaggttcagcacgaagtagaaggagtcgtaataaatctggtacgcctccatgaacaggtcgatgacgttggactgccggtcctccgaccaacggaccttcaccgacgcgccgatgatgagcgcgacgacgagaatccagttcaacagcgagtactccagcatggcctgcccgcgacggttacgggcgcgggaacgcagcgtcttcgggtggttcacggcgtgtcctcagaggtgtcgtgtccatgcccgtcgtccgcgtcgccgggcaggtcatcgagtatagcatccgcgtactccagcttgatcttcggtgcgtctggagcggggatgcgcatgcggggtttggcgtcgattccgtactccgccacttccatggcgtgaccgatgccgggaatctcaatcttggccaggttcagcagcggaatctcacggctgagccacatccgcttgatgacggtgttcttcatgacgacttcgacggggacggccgccacggtgcctgccagcgtcatcaaccgggactccttgcccgagcgcgtcgtgggcttcacgcccttgggcagcggcgcttgcttctccggcggcgcggactgagccttcttcgcgtccgcctcctgctgcttgagcacgtgctggagcgcctcgtccgaatactcctggggttggccgaagcccgtgccgatgtagagacgggagatggcgtcatagcgaatctcatcgccctcccgggccaccagcatgcgcatctgcgcgagcggcgacttcatggccggatgggtccccgcctccatctccacccacaccgcgtcccggccctccttgtctttctcctcccccaccaccgccaggcgccagtagtagacgcgcaggccgcccgccgttgaagcggtacgtcacccagtcgcccagccgggccggacgggcgccgcgggacatgtgctgcaccagctcccgcgcgggattcgcctccactcggaccggaaacgccagcacgactgcggccaccacgagcagggccctcacttcgcgccctccttcttctgggcctggtcccgctcgtaggcctcgcggctctggcgcacggcatcatcgttgggcaccgcgtccgggcggtccgagccaatccacatctggaccaccgcggtgaccccctcatccgtgggcgacagcgtcgtcaccacctgctcacccttgcgggcgtgctccatggtcagctgcgtgccgccgcccatcttgagcgcggactgccgcacgggcgcgtagccgcggcgctccagctccgcgttcacctgctgctgcaccttcgtcagttctcccgtgacgagcgtggtgcggctctgcgagccacccgggtcatcccgcgtggccaggtcctggctgtagagcgcaccttccagcgccaccagcccaggcgccggcttcttgggcggacgcacccacaagtcccgcagcgcggtgaagcccacccttagagc

SEQ ID NO: 336 - DNA, 1571 bp, Myxococcus xanthus
cacgtccagcgagctccaccgagtgaagaggtatggctgctcatcgagtggccccaggaggagaaggcgccgacgaagtattcgctttgctcactgcccgcgaatacgccgctcaaggagttggtgcgcttgtccaagctgcgctggagagtggagcgggactaccaagaactcaaaggcgaggtggggcttgaccacttcgaggggcgagggtggcgaggcttccaccaccatgccaccctctgcatggtcgctcacggattccttgcgctccgccgggcgcttttccccccggaggagagcacgctggacactgcccgaagtgcgccgccgccttcagcacctgctgctgcgccgcattggccactgcccactttgcctgcgccacatcggcgcccgcgcacctcctcgggggccgtcacgcatgtgaccgggtagtactaagcaactctgcgaaagtccacacgcggcgtcctctccctcatccgcttcttcctggtcgctgcctcaagcccatcgctcgcctcctcctcacctgcttgagggaactggctcactcaccttggcggagagagcgcgggcgctttcccgcaaagggctctgctggggacatatgaaccggtcattaagaaagtcttgacggagacaccctcgctgcgtagacattttaaacgaccggttccaaagtagagggtggacatgatggcgttcagtggcaaggcggcgttggtgacaggtggcacgcgtggcatcggcgccgccatcgttcggcatctggcaaagggaggggcggacgtagccttcacctatgcgaactctggcgacaaagcggccacgctggtcggtgaactcaaggcactcggccgacgggccgtggccatccaggcggacaacggagaccccgacgccgtccgtggcgcagtcgaccgcgcggcgtccgagttgggccgcctggacatcctggtcaacaacgccggcatcttcccttccggaccgttcgaaaaggtcacactcgaggaactcgacaggacgctggcaatccacgttcgaggcgtgttcgtcgcgtctcaagccgcgctcgcgcacatgccgcagggtggccgcatcatctcgattggttcctgcttcgcgcagcgcgtgccctatggcggagtcacgctctactcgatgagcaagtccgccttgatcggcctgacgaagggcctggcacgggaagtcggcgagcgcggcatcacagtgaacgtgatcgaccccgggtcgacggataccgacatgaatccggcgaccgggcccgccgtcgcggccgagttggcgctcatgtcccttaagcactacgcgcagcccgaggacatcgccgccaccgtcgggcacctggcgagtgccagcgggcgattcatcacaggcacctctatcgcggtcgatggtggcttttcggcttgaagccgcgacatcaagaggcgttcatggcatggattgtgttgatattggccgggtgtctggagatcgcctgggcgctcgcgctcaagcgagccgacggcctgacccggttctggcccagtgtcatcggcatc

SEQ ID NO: 337 - DNA, 1138 bp, Myxococcus xanthus
cgcaccgtgaagaagcgcgtcgacatcgcgcgcagtgagccgcgcacctggacgtggtccatgttcaccaacatgtggccagtgagctgcttcgtcacggccttcgccatggacaccatctgctccttcgggcacgtggggcacaggacctggagcgtggagcgcatcgtgtccaccgtctggaacacccccatgggagagatggacgcccgcgaggagagcagtccctccgaattcatcgccgcgtaagggctggtgcctcgcgcctggaagactggcaactgcaacttcgtcgtcacgccatccacctgcagcgcgttggccgttccgtccaggcccaccaccgtgttgcccgacacgacgaatgccacgcccggtaccttgcccagccgggcatctcgcgcgggcgccttgcccaccagccggacggactccttgagcaggtccgcgccgccgcgctcgatggcgccgaaggcgcagacctccttgcccttcagcgcgtagcccatgctgccgcccatgtcgcggtcgacatgcaccgtcgtcacccctccacgcgtggtgggcttcgcttcggcgccgcccgcggcggtgatggcttcggcggccttcgcctggaacaccttggcgtcggccactcgcatgcaggacacgcgcccgtctttgcgcatggacacggtggctggaccggccggatccaggccgagctcggacagggactggggccgcgtggggtcgacggcgaggaaggggtgcagctccgtccgccacgccgagggacgcagcagcgcggcgtgctggcccgcgcgctccaggaacgcagccagacccgtcagcgcatccaccttcggcacatggacgagcgtctgcgccgaagcggcggcacggggagcgggggccgttgccagggtggcggccaggacgagcgaggagagcatgtctccgtgagagcagccgggctcccacgctgtcaaggagggactcgcaggggctctggccctcaccgtggcccaggcgccgcgccgcatcgccgcccagcgtgcgacctccggcgagtcacgccacgataccgggccgatgtccgtgcctgctgtgccgcatccggcctacaggcgggcggggttggcccactcaatca

SEQ ID NO: 338 - DNA, 1665 bp, Myxococcus xanthus
  unsure (1)..(1665): unsure at all n locations
gctcttgccgtgcttgtagaaaagcacgagagtggagcaggggaattcgctgtcggatgactgacacacgacccggtccacaatctccaggtcggagttgctcttcagccagcgggtgacgttctcacccagctcctcgcgctccttcgccttggtggcggacaagaccttcacgcccgtgaacatcgcctgccactccttgtgcggggctgattcacgacaataggaagttatcgcacgcgtcgttccggggtgtcaaaaacccggcttccctgccatggggatgttgatcgtccatgcctgggggtttgcagtctgccgcccgtgcctatgttgctcgagtcgcaccggattgcgcggggcgctcgtggcagggggccgcgagcggtggcggagtggggaagggggaaggcccgtggacatgaagaccaagaaggacctggccgtagacttcatcaacaccatccggacgatggagccctccgcgctgaatgcgctcatcgtcaaggaggcaggtgaagagctggcccagttcttcctcaattacagtgcgaatctcatctccaaggacccgtcccgggtgctggagaacacgtcctcgctgatgctgatggggtacctcatccggacctacgaggagaaaaacacccagtccacccagggcaccttccagtcctacgcgttcgcctgagccgccggcagggcgttgcaggctcgacagggctcgggggagcctgttagggagcagcgcccatgctcatcgacatgcacgcccattcccacctgtccaagggttgcgagctggaccctcgcgccgtgttggagcgggccgccttgtttggcctggacggtgtggccttcaccgagacgaacacccaggacggctgtgacgagctcttcgagattggcgcgaagtcgaagctcaaggtcttcgtcgggctggagctggtgacggatcgtggacagtacctgtgcttcttcccgaagccggagctggccccggagccggtgcagatgtggggcagcaaccgcgagaagccgtggagcgccgccgagtgtcttcccaaggtgaaggccctgggcgccgccatcgtcgccgcgcggccctatgaccgggactcgcagaatccggccatggacttcatccgctccctcggcgtgctgagcgccgtggagggctacaacgcccgggtgaagcagacgtccaatgacctggccgtggaggccgccgcggcgctgaagcttccctgtgtggggggcagtgacgcccggggttcgcttgacgaggtcggccggggcgccacgctcttcaagcggccggtgcagacgcaagccgaactggtggccgagctgcagaagggtgatttctggccggtgatggccggcgaccttccccggcttacgcgcccgggagaggcccaggccgcgcgcaagtccggtggtggcggccggggtggtggtggcaagcgccgccgtcgttagccggcgctcaccgaagtccgctcagggggcgaccgggttgccgccttcctcggcgcgtgcgaggcgtaggttggtgaagaaggngnggcggcggcccccggggtagatcccctcctcgtgcctggcngtgcnttaaagggagcgcaaacaccgtctccggcgggccccaggccatcggcccgc

SEQ ID NO: 339 - DNA, 1803 bp, Myxococcus xanthus
  unsure (1)..(1803): unsure at all n locations
cgggtgatgatttcacggctcaaatacaatcccacgcccaggccctccacgcggctgatggtggacagcgtgctgccgcgaagcgcccggctgaagagctcctcgcccccgcgcggccccagtcccacgccccggtccttcacctccagcagcgcgtcattgccctcccgccggagcaccacctccaccggtccgccctccgggctgtagcggatggcattgtccaccaggttgtagacgacctgctccagccggggctcgtcccaccaaccgtccacgcgctccaggctcagcttcagtgggtgctggggcgcggacgccgcgcgccgctccgacacccgccgcaccagcgcggacagctccaggggcacctgcgccagtgacagccggccgctggccagctcggacacatccagcagttggttgaccagccgcgccagccggtccacctgccggtccatgaggaccaggtcctgctggcgcacggtgtccggacgcagccgctgcaagcgcagcttgagggtggccaggggcgtcttcaactcatggctggcgatggagaagaaggccgccttggcctggctgacgcgctccacttcctccaggtgccgctggagccgggccgccatctcgtcgaaggccaggcccagcttctccacctcgatggcgcctgcgcggtggcgcgttccaaaggcgcgcacgtcgcgttcgcccgcggccatgcggccggcggcctgggacacggcttccaccggcctggagagcatgcgcgtcagcaggcgggtgatgggaatggccagcaccagcgtcagtgccagcgtggccatcagcgcgctgtaggtgccgatgacgctgaagtccatgtcgcgcatcggatgttccaccaggacgcgccaacccggttggagcagcggcgcggtggccaggtgccgcgcctccagggtccgccgcaacgggggggcctggggctccgtgtcgtaggtgcgggtgcccgtggcgggcagcgtcgacagcagctcccccagcgcggtgcccttcagggactgtggctccggcccgggcgtggcgccggtgtcaaaggccacgttgccgtccgggtccaccagcagcgcgcgctgaccgggagccaggcgctcctgcgccaccggtcgcatccgaggcaggttgatggccaccaacgtgaagccttcgaagcgctgttgccgcagcaacggcgagacggcgaccatgacgggacccgtcaccgagccccggcccgcgaacacgccactcaccacgggcttgcgcttgctgcggacgtcccggaagtaggagcggtcggcgaagttggcgcccgccatcggttgggccgccacgcccagcggcggccagatggccaccaggctgccgtcgctgtccccgatgccgaagttgagcgcgaacgcggagtgatacacccagtcccgcagcaactcctccatctgcggctggggtggacgctccccttcgcgctcccaccaattcgtgacgatgctcgccagcaaggcggtctgggattggagcgggacaactncgcgtccaccgtctccgccagcagatgggcggtggagaggccctggtcgtccatccgccgccgctcggaggcatagcgggcccggccctccagcgttcccaccatcagcaacggcagcaccagcgccagcagcagcgccgagcccaccgtcgacgacagggtgaaggtgcgcagcgcgggcgtcagcatgggccacagccgcgcgcgcgccatgggcgtcatcagcaccacctgcgtcagcagcggcggca

SEQ ID NO: 340 - DNA, 1854 bp, Myxococcus xanthus
cgggcgtccgggtagtccgccgcataggccgcgtaggttggatacaggcggagaaataccttgtcccagtagtccagccccgcccgcttgagctgccggtcgtcaatggagaagcccaggggctccaccaggatgagccgacagcccgtcacggcgcacaggcgggcgacgttgccggtgttggggggaatctggggagaaacgaggaccaggtggagaggacgcgccaggggctcgagcatggggtagaaggcgctacatgcgctggaaggtgaacaacgagacgcggcaacggctgctggcggaccgggccgacaaggccacctcgttcctccaacggttcaagggactcatggggcgccgctcgctggaggtgggccaggggctccatatcgtcccctgtaactccatccacactttcttcatgcgcatccccattgacgtgctgttcctggacgcccagggccgcatcgtcaagcagatgcccgccttgccgccctggcgtgcgacatccgtgtatttccagtcacgctcggtcctggagcttcccgcgggtgtcctcgcggccagcggcacccaggaaggcgacgtgctgagcttcgagccggttccttgaggccctgcccgaagtgcccctgcctgtcaggccgggatgcacgagctttgaccgatttccgagcgctttgttaacctccggcgccacgttttctcgcccctttagaagagttctcgcgcatgcgcatcgaggtagctggcagcacccacgttgggatgaagcggaatcacaacgaggacaacttcctgatgctcccggaagagtttctcttctgcgtggcggatggcatgggcggccactcgtctggcgaaatcgccagccgcatcgcggtggacgagctcggcgaattctacaagctcacgtccaaggaccaggactgcacctggcccttcaagatggacaagacgcgcaactatgacgagaaccggctcgccaccggcgtcaagctcgccaacgcgcgcatcttcgagaaggcctgctccgagtccaagtacaagggcatgggcaccaccatcgtcacggtgcacttctcccagagcgccgtctacgtgggccacgtcggcgacagccgcgtctactacttccgcggcggcgccctgaagcaggtgacggaggaccactccctcctcaacgactacctcaaggcgaagaagctctcgcccgaggagattgagaacttcccccacaagaacgtcatcgtccgcgcgctgggcatgaaggagaacgtccaggtggatgtctcccgcgtggagccgcaggaggatgatgtcttcctgctctgctcggacggcctgagcggcatggtgacggacgcgcagatgcaggaaatcctgcagcgcacgccggagctggagaaggcctgctcgcagctcatcgacatggccaacgccgcaggtggcaacgacaacgtcacctgcgtgctggcccgctaccacgccgcctgagcggcggcgctcagcgccccttcagcggcgcggcaatccggtgcgcgccccaggcgagcacctcggagagcgactccccggaggacacctcggtgtcctcgaagacggtggctcgcgagagccgcgcccccgcagccaccttcgcgcccggctccagcgacacgcccggccccacggcggctccggcggccaccgcgctggcccgtcccaggtacaccgggccctccgccgtgccgtccaggcgggcctccgcgtgcgcccaggtgccactcgcgccgcgcacggtccccgccaacggtgagtacgtgcccagccactccagccgcacgtgcccggcgagcacgtgctgcacgg

SEQ ID NO: 341 - DNA, 1634 bp, Myxococcus xanthus
ttcagctcgacggtgtggatcttctccacgccgcccgcgccgatctgcacggggacgccgaagaagtagccgttgatcccgtactggccctccaggagggcggcggccggcagcacgcgcttgcggtcctgcaggaagctctccgccatggcgatggcgcacgccgcggggccgaagtaggcgctgcccgtcttgtacagaccgaccagctccgggccgccctcacgggtgcgcttgatgatggcgtccagcttgtccttggcgatcagctccgtcaggggcacgccgcccaccgtcctgtggcggacgagcgggaccatgtcgtccccgtggccgcccagcaccagggcctccacgtcgcggatggagcagcccagcgcctcggcgacgaagcacttgaagcggctggtgtccagcacgcccgccatgcccgcgaccatgtgcttgggcagaccggcgatcttgtggagcgcgaacaccatcgcgtccagcgggttggccacgttgatgacgaaggcgttgggggcgtgctgcttgatgttgcccgccacgtccgtcatgatcttcaggttgatctcgagcaggtcctcgcgggacatgcccggcttgcggggcatgccggccgtgatgatgatcacgtccgagccagccacgtccttccagtccgtggtgcccttcacgcggcagtcgtaaccgtcgaccgcggccagctggttgatgtccagcgccttgcccttgaccagaccctcggccgccgggatgtcgtacagcaccacgtcaccgagcgacttctgcacggcgagcagcgccaggttgccgccgatctgaccgccgccgatgaggccgatcttcttcttgccattctgagccatggattcgcctcttccagatccccgaccggggactacatgttcttgatgatggcctgcccgaactcggagcacttgacctcggagacgccgctctgcccttcctgcttcatcaggcgggcgaagtcgtaggtcaccgtcttgctggcgatggcgcggtccatgccctggatcatcaggtcggccgcctcgtaccagcccaggtgccggaacatcatctcaccggagaggatgaccgagcccgggttcaccttgtcctggtcggcgtacttgggcgccgtgccgtgcgtggcctcgaacaccgcgtggcccgtgacgtagttgatgttgccgcccggcgcgatgccgatgccgcccacctgcgccgccagcgcgtccgacaggtagtcaccgttgaggttcagcgtggcgatgacgtcgaactcatccggacgggtgaggacctgctgcagggtgatgtccgcgatggagtccttgatcaggatcttcccggcggccagcgcggccttctgctccgcgttggcggcgtcctcgcccttggcggccttggtggcctcccactggtcccaggtgtagaccttgtcaccgaactcccgggcggccagctcgtagccccacttgcggaaggcgccctcggtgaacttcatgatgttgcccttgtggaccagcgtgacgctcttgcgcttgtggtccacggcgtactggatggcggcgcggatcagccggtcgctgccctcgtgggacaccggcttgatctttagagca

SEQ ID NO: 342 - DNA, 1480 bp, Myxococcus xanthus
  unsure (1)..(1480): unsure at all n locations
aagactccacgctgttgcagcgacgcgagcacctcggccagtgcgtccacatcccccgacaacaccgtcgaacccgcgcccgagtcgatggcgcggaacaaccgcccctcgtagcccacgagcagttcggccgcctccgcccacgggacgcccacgaccgccaggctgcccttgcccgcctgcgtgtgcatcaggcggctctcggcgcagacgacgcggatggtgtcctcgatgtccagaactcccgccgcatacgccgccgacacctcgccgatgctgtgccccaccacggcgccgggctcgatgccccacgagcgccagaggtccgtcagggccatctccaccgacacaatcgcgggcagcccgatgtcgagccggctcagccgcgccgccgcgtcgtcagcggccagcacttccagcagcgaccaaccttcgtactcccggatgagcgcatcgcagcgcagcagcgtcgcccggaacacgggctcggtgtccagcaacggcaggcccatgcggggccactggcagccgtgtcccgaatagacgaataccggcttacggaccgcgtcctccgccaccgtccccacggacacgcccgggcgcggcactcccgccaggaagttctccaggcccgcacgaaggtccttccgggtccggaccgtcaccgtcaggcggtgcgcatgcgtgcccgcgtccgcttcggccgcgcggagcagctcggccagtggcaggtgctcccgggccgtcacgcggtcgagcagcccctgcgcggcgccccgcagcgcctccgtcgtctcacccgacaggtggaggagccgtgcctcggggagacgcgcctcttccatcacgacgtggcagttcgcgcccccgaagccgaaggaactgacgcccgcgatgagcttccggtcgggctccggccaatctcccagggtgtggtggaccgccaggcccagcgcctcgaaggggatgagcggattgggcttctcgtagtggaggctggccggaagcacgcggtgcttgatgcacagcgcggtcttgatgagcccggtgatgcccgccgcggcctccaggtgcccgatgttcgtcttgcaggagccgatgagcaggggcttgcccccgggccgtcccgcgccaagcacctcgcccagagcctgtgcctccagcgggtctcccaactgcgtgccggtgccatgcgcctcgacgtactgcacctccgccggctcaacccccgcgttggcgcaggcctggcggatgacctccgcctgcgccttcnggttgggcgcggtgaggccgttgctgccaccattgttgttgatggcactgccgcggatgacgcantagatggcgtcgccgtccgcgagcgccagggagagcggcttgaggaccgtcacccccgcgccctcgccgggcacgaagccgttggcgcgggcatcgaacgtgtaacagtgcccgtctggagagagggcccccagcttggaca

SEQ ID NO: 343 - DNA, 1501 bp, Myxococcus xanthus
gtccgaggctcgatgacggaggtccccgagaccacgcccgccggccccgagacgccgcctcccctcctgggcatgcgggtgaagggacctccccacgtggagctgctccggctgaaggacggcgcggtgaatcccctgctccaggagggcgacgaagttgcgctccgactcaggagcggaggccagcgctatgcgctggtcgtcgtcatggacagcgagaaactggtggaggcactctggccacaagcgggcctgcagagcggcgagttggccaccgcgcagcccgccccgttgttccaggtcacccagggggatttcgtggtgcacgcgctgtattcggagacaccgctgcggctcgacacggttcgggactggttgagcacgctgcgtccggagtgccgcgccgcgccgatgcccgcggcctgtctgtcgctcgccagcaccccgccgggcgtggcgcatgcggccgtgtcgctccaggtcgaggcccgtccatgacgctcgcactgctcctggcggcggtggtggcggcacaacccacggcgacggacgcggatggaaatccgcgccggttcgccctggcggtgggcaacaaccgaggctccagcgcggacgcggtgctgcgttacgcggagcgcgacgcgcacaatgtgatggacgtgttgtacgaggtgggcggcgtgcggcgggacgacgcagtgctcgtcctgggccatgacgcggacacggtgcgccaggcggtggcccgcttcgagcgccacctccagacgcaggcacggaagggcgaccagctcttcgtctacgtctccagccacgcggacgcgggcgagctgcacctgtccggcacgaacctgcccctgcacgagctggtgcgcttcatcgagcgcgcgccggtgagcgtcgcgctcctcgtggtggactcgtgtcagtccggtgaggcggtgcgactcaaggggctgaagcccatccccagcgtcctggtcagcgtggagcggccggagctggcgggacgggtcatcatcaccgcctccgctgcggatgaagccgcgcaggagtcggacgcgctcggaggctccgtcttcacgcaccacctggtcgcggcgctgcgaggagcagcggacgtctccggggatggtcgcgtcacgctcgcggaggcctatacttactcctacgcgcggacggtggagtcctcgctgatgtcccgcgcgggcgcgcagcaccccagcttccacttcgacctccagggaaagggagacctggtcctctcctcccccgccctggccacgtcgctgttgacgctcgccatcgacgagcccggagattggactgtgttcacgctggcgggagagcccttcctgggcaacctgcgcaagggcgcgggcgcggccacgctcgcactcccggcgggcggctacatcgtcaccacccgcggcgaacactccgcgatgacggcgcgcgtgcagggtgcccgacgccggggcgcgcccagctcacacgggcc

SEQ ID NO: 344 - DNA, 2351 bp, Myxococcus xanthus
gtgctctcagggcatgccttgttgggaggggcgcccaaccccgtgacgtccatccagggcgtggccgtccaggccgtgttggaggcgggcatccgggcgcaagagcgtggcggcgcacatggcctggacctatcggaggcggagcgtgccggcttcgacgcaggcgctgcttgattcccgcccggtgggatgcctactcctagccccgtcgtggactctccttgtcgcctgcgcgaccccctgaggacctcttgagctcgaagaagcccggccgaaacgacccgtgtccctgtggcagtggcaagaagtacaaggtctgccatggcgccgaggaccgggcccgcgccgcgccgcccgccgcccccgcctggtccgccagggccgacctcgaggcggcgatggaagtgctgggcgaccccgatgtgtccaatctgtccggtgctctggagcggctggcggagttgctgacggactggggcccggcgccgggcctgcgcttcgacgtgaaggccttctccgagcacgtggggaatgaactggctcggctgtcggagaacacggagcaggacgccgccagcgcccgtcgcgagctgctggtgggaacggtgcgcgcgctcggcacgcctgcgttcctggaggcgctcggcgccgcgctgatgtccaagatgtccacgcctggactgtccgccgaggaccggcgggccatcggcgtgggcacactgctggcctccgcgtccaagcggatgggcaaggcccggccggaggacatccccgtcctggacgtcgtcttcgacgtgcagttccgcgagtggagcgccaggcacaaggagctgtcccagaagtaccaggcgctggtgaaggggctcgaggaggagtccctctccgacgaggcgaaggccgcgctccaacaggctcgtggcggcgacgtgggcgcgctgctcaagtacgtgcaagaggacccggagctggccgagcgcatcgctcgcgaggccaaggagcgcgccgcccgcgtggaggcgtggctacgggcctcgacgacgccggccgtcttctcgcccgaagaggagctgtggctcacgtgcgcgctctgggacccgatgcaggcgctgaaggccttgcccacgggcacggagccctcggtgcgccgggacgcggtgacggcgctgatgcgggcggtgaagggcgcgctcgacgaggacttcctcgtggggctgctcgaccggctgcgggagaaggcgaaggatgcggccgcggatgacgccacccacacggcgtacatggacgccgccatcgccttcgaggcggagcccgcgcggatgacgctcgccgcgctgctcacggcacggaaggaagcagaggggcgctcgcccgaggagatggtggcgctggccgacctcaaggcgctcaccgcgtggacgccggaggccttcgagccctaccgcgagctgctgctgagcatgggcctgcctgccgccgccgcgcgcatcgagcgctgccagtcatggctcaaggagcatccggtgacgctgcgcaccgagcaggcctgagccgggactgcgtcaggacgcctcgggccgacgacggcgcggggcgtccacggggcgcacgttgttcaggtcgagcatgttgtatgcgccccagcgcatggccgccgcacgggtgggcgacgacgaagggcggccaatgcctcggtagtcgaaggtcaaggtctcgaagccgcgccgggccggtcgcgcccgggacgaggaggcatccacgaggggcgctgtggcggcaaagcggctcgcgccgagcgagaatccgtcggacgcgcggagcgaggtgggctccccgtgatggggctctggatgcgctggcatgccccggcctcctgagcctgtcatcggccgcggaaggtcgcgggccggcgttcgaagtgggcggagagcgcctcctgcacatcctcggtcgtcgcgagctgctggatggccggcaggagcttcgccgccgcggcgcgctccccttcgaggacggccgtccgcgcactctcgatggtcgccttgatggcgaggggcggcttcgacgcgatgcgggccgcgaggcccatcgccgtctccatcagggcctcgcgcgagacgacacgctgcacgagccccaaccgatgcgcctcacgcacgtcgagcgcatcacccgtcagcaggtactgcatcgcgttgccccaacccatggtccgcacccagcgggccgtgcccccgccgaaggggaagatgccgcggtcgatttcaatctgctcgaaggtggcgtcctcggaagccaccgtgatgtcggcagcgagcatcagttcgataccgagcgtgaggcacttgccatgc

SEQ ID NO: 345 - DNA, 1770 bp, Myxococcus xanthus
cccgatgaagtacctcgtctacgtcaaggatcgcatttcgggcccccagccacaggaccccatcgccctcaaccgcgctgtccgtgactgggtgggcgctcgcctccaggacggcaccttcgactgtgcctactacgtcctcccgaagatgggcctctgtatcctcaacgccgactcgcatgagtcgctgctgacgctgctgcgcgcctggccgtccttcgcgttccaggagttcgaaatccacatgctggcggacgtgcgccacggcatcgacaacaacttcgagcgcctgcagaaggctcagggccagagcgagagcgcggcctgacgcaccacccgggagagctgccatgagcaccgccaccgcccataagggcgcagaacccctggttcctgagcgcatgccgctcgacaaccgccgggccttctacgagcgcatcgaagcgaacaataaacccgtcatcctcaccgacgccatgaagggctggcccgcggccgagcggtggaccttcgactacttcgccacgaagtaccgcgacgtgagcgtccccgtggagtggctgcaatacaacgccaaggacacgggcggcgtggagcgcgtgggccgcgtgcggaagatgagcatgcaggagtacgtcgacacgctgaaggcgaagggcggcgaaacgccgggctacctcatcggcaatgacctgttccgcaccctgccggagctgcaccaggacgtccgcttcgacgactacgccgtccagcgcaagctcaccgagcagctcttcttcatgggcccgcgcggcaccttcacccagctccacctggaccgcgcccacaacctgcacgccgtcatggtgggccgcaagcagtggcagttgtattcgcccaagcgggacgcggagctgagcccggcgaagctcagccacccgtggtccgtcgtgagcgcccacgacctgacgccccacgggggcaaggcggaccagctccccggcggccttgtccccgactacgacttcgtcctggaggccggggagattctctacctgccctacggctggtggcaccgcgtgtacacggtggaggacgccatcgccaccaactactggtggtggacctggtcgatgctggccaggctgggcccgaagctcatcccctccattgccctgagcgcggtgggccgcatccgcaagcagcagaagctgggccgcgagtaccgcgagcagtaacgcggccccgaggcctcactccagttcgatgagggcgcccacgatggcgccctgcgcgacgttcaccacgccagtgccccgccgcatggggcacatgcggaggaagtgcccgccgtaggtctctccgagcacgaagagcccccagacggcgatgtagggcaccaccgtgccttccggtcccagcgtatggaggggcgtcgggtgcacgcgctcctgcgccacccagccgcccacgtcgagcgccttgcgcacggccgtgtcccagtccgcggcggaggtcgtcccacccaccagaacggactcgccgccgtagtcccggcccggcttgaggaccagggactcgcgttgcgaggccagcagctccggaatcaggtaccgcgccccgtcccgctcgacgtgcgtccgttcgacccggcatgaccagggcacgttccggcgcaccaactcctgttccgcctcggacagcgcgggcgacgtcacgtgctcccagagcagcgcgaggttgcgcttgtcgtcgagcacatcatgcgccggagccgttgaggagtgctga

SEQ ID NO: 346 - DNA, 1842 bp, Myxococcus xanthus
ctccccatgaccagggggctcccagggactggagggctggccggcctgctccgttcggatggaggcgggccagcctccggggggcccgttcccgggcttggataccgaggaagcccggtcgcacttatggttgaataccggacatgcggcgattggtgttcctggcggtgatggctcctctcctggtggcgtgtgccacgacccaccaggtggtgccccgaagcacctcctgtgagaagggcagtctgtgggcgtgcaacgaatggggagagcagctcctccaggacggagaccggagccaggcggagacggccttctccaaggcgtgtgacggtggctcgacgcgggggtgcctggccctggggcgcctgcgcatggcggacggcaacctcgcgggcgccgaggcgccattcgtcacggtgtacgagacggacagtgaggagggcgccctggcgctcgcggacctctacgacgcgcgcggtggcgaggcccacgctcgggcagcggccaggctccggagggaggcaccggcgctggacaaaccggccttcgacttcgccatgcagtaccgggtgggagcctggcggccgacggcggacctcgccctcaacatccagcccatggccttcctggaacggcgactcaacatcggctcgaacctggcctacacgagccggggcatctccgagttcaacggcttcgtcggctaccagcacttcgtcaatgcctgggtggtgccctacggtcggttgatgatgggcacggcgacacgcgcatcacgcgacccgggcttcaacgtcggcgcggaggtgggcacgcgactggccctggggtacttcggccacgtcaacgtggcggctggcatgtaccgggcgagcggcaactacatgtccgtgggcgtgggcctcaacggcctcttcgtgctgctgatgctgctgcacgcaccttgacgcttcagcgtgtgggccgcccaagcacgtacgtgatggcggccttgcccggggccttcgcctcgcccacctcccaggtgtagccctcgcgcgccagggcctccgtcatccgccggagttcgtcgggctgatgcgtcctcagcgcggacaccagcccgtcccagaagatgacgagcggcgccaccggcaccacgtaggtgagcagcagccgcagcggcgtcagcggcttcaccatgggcgtgaacagcagcaccagcaggggcaccagcaacatggacaggatggccgggggcgtccggcgtaccgtctcgaacgcggcgatgggaacgccgcgggcctgggcgtcctcgagcaccgcgcgggcctcgtctggccggaagtggtgcagggcgttgaagagggtccgcatgccccgcaggcccgccggaacctggagcgcgtccactgagcgttccaggtactgcacgccctctgcccgcgcccgctcggcggcctgggcgttggggaacttgtcggtgagcaccacgcgcgcgtcgatgccgtgcttctccgcgagcagttggcgcaggcggggcagggggcctcggccgccggagcccaggtccaccagctccgggccctgcgccgcgttcagcccgcgcgccaggatttccgtcgccgcgtcgaagatgcccaggcgcgtgctgatggtgtggaggtagtcggtcaccaagtctctcagcgcgtcggggacccaggtctggtccgtgaactcgaagaggtgcagccgggggagcagcgaaggtgtgtcgtccatggtccaagcgtgcaggccccccgccgcccgcgcactgacggatggcgacagaacggcttgctggccgcgccaacgcgccattagcgtcccgttcgt

SEQ ID NO: 347 - DNA, 1486 bp, Myxococcus xanthus
ccacttcgacgaggccttgcgcatccgccacgtgcgcctcgccctccaccatgacccgcgctccgggcagcggcgcgcccgtccgcccgtccagcacatgaaaccgcacgctcccgggcaccaccaccggcacgggcacctgccgcgtcgtccggacaccgccatgccacgccagctccagcgccgcgcccatccgccgcagccgctgccgggactgcgtcccatcctccagcgtcaccgtgtcctgcacgtgctcgaagtccagcaccagcgtgcccgtccagcgctccgctcgccgcagcggcaccagcagcgcgccaccggcggagaaccccgtcgcctccgcccgggcgcccgtggcgtcgcgcaccgacagcgagaccggcaactcaccgcgcgcctccaactgcagcccctgcatcagcggaaagcgcaccaggccgcctaccaccgccgcatgccgcacgccccgaaggagcacgggctcggccgagtcactgaagtggggaagctgcgagaagccatagcccgcgcccagctccgcgcgcaccgggcccaggaaggcgcgcgcccgggggcccaccgaggcccgccacaggctgccaccggtgatccgcagcgcgccctcccgcaggtcgaaggcctcccgctgcaacccggcccacgcgcccagccaggacgtgcccagccacgcagtgcccacggccgcgacgtcgttcggcgtgaagccctcataggtgagcccgggccctacatccgcctgacggccgtcacggagggacagcccgtagcgaaggcgcgacgaggcgtgctcggccacttcctccgcgtgggcgggggacgtggcaagcaggacgaggagcaccagcgccaggcgcgccacgaagcaacgcgggaaaagcgggagcggcaaaacgcagcggagtatagagaaagccgggaaggcccccaaccccgtgggaagggctctttcaggccccacgcgcccagggtgcggatccgtggcctccaccccacagtgcgtccggagggcatgggaacgggcacggaacctcctccaggaagcggaaggcttcttgctggagtggatacgctttgctaagcatcctgacggtcggtagcgcctcgtctaacctcgtggattcactctagaaacatcggagcgtcgccatgagcgggacgagcgaacgctgaggagcgcatacgcccatgggcacgcaactggtgatgtacgaagaggagttcaccaagatcaacgccgtttgcgaccggcttaccaaggacgcgaacgcgaaggtggtcttcctcgtcgacaagaacgggcagctcatctcctccgcgggtcagacgcagaacatcgacaccacgtcactggcctcgctgacggccggtaacgtggccgcgatgggtggcctgaaccaagctgattggggagaacgagttccccaaccagttccacgagggggccaaggactcgctgtacatg

SEQ ID NO: 348 - DNA, 1477 bp, Myxococcus xanthus
gtctgcaccggcgccttctacacgggcctggccgcaggggccggcttggccgcgtcaccagcgcgagtggactgcgacacgggcgacttcggcttgcgagagatttccatggtggggggagctccgcggggggcagaaaaaaacgccgataaatgattgtcgcattgtgtcggacaaagtttccagcgatcagcccgaggcggcgtcagcgcctcccccggccgacatgctacatgccgcgacgcggcccgacgccccagggacggcgccaggagagaggacgggaggtcaggaatgccaaggacggtcaccgccacgcgctacgtgacgccactgcgggagggcggctcgctgccggccatcatcgaggcggacgacgcagggctctacgtcgtgaagttccggggcgccggacagggcgccaaggcgctcgtcgccgagctcatcgccggagagctggcccgggagctgggcctgcgggtgccggagctcgtcctggttgagttggacccggccctgggacgcaacgagccggactccgagattcgtgagctgctcaaggccagcgcgggcctcaacctggcactggactaccttccggcgtcggtaacgttcgacccggtggcggaccccgcgcccaccgcggcggaggcgtccggcatcgtcgccttcgacgcgtacatcaccaacgtggaccggaccccacgcaaccccaacatgctgacctggcaccggaacctgtggctcatcgaccacggggcctcgctgtacttccaccattcgtgggacgactgggaggcgcgcagccagggccgcttcgcgcccatcaaggaccacgtgctgctgccgtgggccacggcgctgacggaggccggcaagcacctgggcgcgcgcatcacccgggaggtggtggagcgcattgtcggggccattccggaggcgtggctcacgagcaccgagtctcccttccccaccgccgaggcgcaccgcgccgcatacaccacctggctgctgcgccggctggaagccgtgcccgcgttcatcgaggaggcggaccgtgcccgcgcccagctcgtttgattacgccatcatccgcgtcgtcccgcgcgtggagcgcgaggagttcatcaacgcgggcgtcgtcctcttctgcgccacccagcgcttcctgggcgtgcgcgtggagccggacgaagcgcggttgaaggcgctgtggcccgacgtggacgtggacatgattcgcggccacctggagagcttccgtcgcgtgtgtgagggcgggaagggctcggggcccattggccagctatcccagaaggagcgctggcactgggtggtggcgcctcgcagcaccatcatccagacggggccggtgcactccggcctgtgtaccgagccccaggcggcgctggagcacctgctggacacggtggtgcggatgaagcgcgctactccgtcacccggcggccggtaagcg

SEQ ID NO: 349 - DNA, 1638 bp, Myxococcus xanthus
cctgcacagccagattggccgtgccttccgccagcagcacggacaggggcgccggggtggcggcctggggctgctgcggggacgcagggagctggggctccaccagccgcttcacacgcgcggacacatccgtccgcggcagccgcaacgtgccggtggcgctcactgcttccacccgccaccggccagcgtgctcatcgcgaggggcccggcgtcctcgttcgacagggcctccagcggtgtccccagttgctggagcgcctccgccagcgtcatcccgatggcgcggaggacctcctcctccacgcgaattgtcaccggccccatggccaggtggatgtgcccgcacgagcactgcgtcacttccgcgcatggacctcgcgccagtaccgtcttgccgcatccctgaccgggcatcgttgctatccttgattttgattttgagtatcgaaatcaaaatgaatgatgcgccaaaggccggcggagagcaagccccggccttttctcgacttgctccgagtgtggggaaggagaacggcgtgggacagcggggcgtcagcggcccaggggctggcgctgtgcgtccctcaggcccaccagcacgctggagccgctgtccgccacgcgcagctcgccgtagcgtgcgccctcgtagcggtcggcgtgaccttcctggaagaagaaggcctctgcgcccaggcggaagcgctccttgcgcaggcggtaccggagcttgagctcgccgggcgccagcggggtgtcgggcgtgtcgaagcgcacgaaggagcccacgccattcgcgtccagccgcagcaccatgtttccgtccttggcggtggtgacgggattcgcgtcccgctcgcggctgatggcgtagtccagcaccatgtagtcgccctgaatcagcgagcgcgggtcgacgggggccagctccagcagcaccggcgtacccgagcgcagcacgtgctccttctggacgacgagccccgcggggacgagcagcgcgaaggccagcccgccgaagatgaccgccgtgcgcaccatcaccgcacctccgacgccggggcggggaagcgccgcagcaggaacgaacgcaggcccaggaacaccaggccgctgcccatcaacgccagcgacttggccagcagcgtgaggcccaggtcgtagtagtaccaactgccggacgcgagcaggtacgccaccgccagccccagcagcacgttgctgcgccggtggaagccgagcaccagcatgcccacggcggtgatgaccgccggtgtatggggcgtgagcacggccaccagcgtcagcgccgcgaacaccgccgcgcccgccacgccggtgggctccagcgccagctcacgcagcacccgccacgccgtgtacagcgtcaggaccgtcagccccagtgtcagcaccgcatccgggagcgcggagacggtgtcgaagaggtgccgggccacgtcccgcatgccgcgcgccagcagcacgccggggatggcgcacgcgagcgcgaaggccaccggccccaccagctcgcccggggttccccgtcgcagccgggcctgctccaggaagaggaagtacatcagcgccgcgcagcccagaatcagcaggtccagcgcgaagccgcccacc

SEQ ID NO: 350 - DNA, 1164 bp, Myxococcus xanthus
gactctctagcgtgctctaaggctggaactcgtcgctggagtccgtgtcggaggaggacccgcacgaatgcatggccatgtggcggttgcagagcggctggccgcaattacgacagatgctcccgtcggcgacatgggtcttgcagagagcacagcgggccatggcgcgtctccgattacgacaggtgcagtgccttcagcagctcgcggctggcgccatccagcttcccggtgggcttcaggccatacgccagctgcagccgctccagggcctggcgagtcaccgggtggtgctcactgtcctgctcgcagcagctgaagtagcccaggttcgccagccggtcctggagcccggggaaggtgccgagcgggtccacgtggccgagctcgagttgataggtctcgcggtcgggccccgtcccgaggatgagctcccccaggtccgcatcgggagggatggtcgcctggacatagccgtccccgtccagctcgccccggacgtcccggacgctctcccccgagaaggtcctgagcctgaggaggaaggggagccccacccggggctcttcgtcgacgtcgaggaagcgcagccgcagcatgtcgggaatgcccttgcggcgcacccggtacaagcgtccggcccgtgcctcctcgtctcgcgcccgccggggcggcagggtgatggtgtctccggggtacagcacgtggcgctggcgctgcttcgcgtgcagcacggcattctccggcaggttccacagcgtctccggcaggaagccgtgctggtgggcgatgctgctcatgcagtctccctggtcgacaacatgggcctcggggacgcgcggcggctgtgcggacggtgcctgctgccacgcggccggaacgtcactcacggcccgctccgccggcaggggctcctcggcgaggagctcccaggccgccgcgtccaggtctggcaggcccagcgtgtagcgcgcgtccgcttccagcccctcgaagcgggcacggccctcacggttggtccgggcccgcaggagctggcccggtgccagccgcagctccacctggacgtccatcaggccctggtcatcctcgcccaccacgcacacctccagggcccggaggcttcgcaagccacatggcatgcacaccccgtccgggggcgtg

SEQ ID NO: 351 - DNA, 1304 bp, Myxococcus xanthus
ccgtggatggcgtggagtccaagggcatccacgtcaccgcgggcgcggacatctccgtgtatgggctcaaccggctcctgcaaacgacggatgcgttcctgggcttgcccaccgcgagcctgggcacggactacgtggtgcaggcctatccgaacgtcaacgtcgtcaacggctcgcagttctccgtcgtggccacggaggacgcgacggaggtgaccatcacccccgcgagtgtggtgggcaaccacgccgcgggagtgcccttccacgtggcgctgaacaaggggcaggcgtatcagcttcgcagcacgggggccgcgccctcggacgtctccggaacgctcgttcatgccacgcgcccggtggcggtcttcggcgggcatcagtgcgccaacatcccggatggcaccacgatcgcctgtgactacctggtggagcagctccccccgacctcgacgtgggggcggcgcttcgtgaccgtgccgctggccacacgcctcggcggggacaccttccgcttcgcggccgccagggacggcacgcaggtgagcctcaacggcgcggtggtggcgcagctccagcgcggccaggtgttccagacgaacatccagggctcggcgagcatcaccgccaacgagcccatcctcgtgacgcagtactccaatggctctggcttcgatggcatcccgtccgacccgttcatgatgttggtgccgcccttcgagcagttcgccgcccagtacaccgtcaccactccgagctcggggttccgcagcaacttcgccaacatcgtggtccccaacgacgtcgtggccgaggtgatgctggacggagcgctcatcccggcgagccagttccaggccatcgggaccagcggcttctccggggcccagctccccgtcgcgctgggggcgcaccgcctgtccgcgccgcagcccttcggcgtcatgctctatgggttcgatgcctacgactcctatggctacccgggaggaatggccctggcgcccgtggcggaggtgagcaagctcacgctgtcgcccagagagggcgtcgccgtcgtgggggacctctactgcgtgacggccacggtccaggacgccgcggaccggccgctcgcgggcgtgcgagtggacttcgcttcgtccggagtgaactccgccttggcctccgtgaacaccaccgccgacgggcaggccgagttctgcttcgagggcaccgcccccggcgaggatgcggtgaccgcgagcatcggctcggtgaccgaccaggtgcgggtgacctggacgaagcccaacgccccg

SEQ ID NO: 352 - DNA, 1292 bp, Myxococcus xanthus
aacggagcgcgccgcgagcgtcggggaagacgcccgcgcgctccagtccgcgcaggtacgccacgcccgtgtcgatggcccaggacagctcgtgcaccgatgtggcgcccgcgtccgcgtaggcgcgcgtggacacgagcagcacccggaggccgggcgcggcttcacgcagcgaggtgaccaggggcgcggcctgggaaagcgtcgcgtccagccccatgggcagcgagcccgtacgggccaggatgccgagcggatccacgccgaggctgcccttcagcgccgcgcgggacacgcccgtctgctccgcgacgtggagcaggcgctgggcggcggccagcgggtcggactcgggctccaggtggacgggcgtcgtgtccagtggcgcatgggcgagcagccgccgcagcgcctcggcatccggtacgcgaacgccgtgcgtgtcgcccaggtggagccacacgccccagccgccccggtccaggtccgtgcggatggcctcggcggcctgcgtcacgtctggctcgctgtactcctggcacaccagccatccaccctcggtgaggcccagggcctgggtgccgcgcacgtagggggccacgccgggcggcgcgacggcggcatcctgctgcgtgtagagcggctggagcgataggccgccttccaactgcgactggagcgcggtgaagggcttgcccttcaggtccttgtccacgagccggcgccagtcttccaccgacggggccgggaactccgaggcgatatggagaggctcttgagccatgctgcgtcctcgcgggatgggagtggcaccgacccataggcgcaatggaccggcggggcaatgggcttggaggggctgcctcagtcttccgacgggacgtcctgtcccttgaagccccagtcctccagcactttggcttcatccaacgcgctctttgtcttcttgaaacgggcgccggacacaccttttacccggcgctcacacgcggcccaggaggcgtggcgcttcacggagctgcccacctggctcaggtaggagtaggccttggccgctgcctcccgctgttccttgggcttctctggaggcagtgacatgtcctccggcaggtcgtgcaccgccacgccgtagccgtggagcgggccggtgtagagccccgcgtcacgccccttggaataggccacggcgatggcgtccacacgctcgttgccgggaacgcccacgtggccccggatgtagaaccacgcgacggcggcggcctcggcggcatggctctccttgcgctgcgcca

SEQ ID NO: 353 - DNA, 2264 bp, Myxococcus xanthus
tggggttcctggcaatcgctgtggccgtaatcttgatgcgactgcgcacattcggcgcgcgttgccggcgcggttgggcttgcaggaatcgcaggcccctcacgcgggggccgcgcaggtggaccagcctccggcagcgacggcgggttccgcgaatggcatggtcccctcccccgctccgtcaccggccacaccggggaaggtgcccggcacgacagccgccgcaccaggaacgagccctgctggggccgcagcaagcgcggcggctggggcgaatcccacgagagccgcggccccaaccacggcgaatagaaccggccctggtggccccaccaccatgggttccgccgggacgcccccgagcggagccgacgcggggacacaggcaacaaccggaacggccgaacctgccaagccccccgcaacgagcccagccacacccgacggcaaggccggtcaggaagcggccaccgctgctacccatgcaacaactccaggagccgacgcaggtgcaggctcggcgtccaccggagcggcggcaggcgccgcaccttcgacaggcccgacaccgagcgaagccccctcggcgcccaccccccatccatcgccccctggtgccgtggcccctccgccctgacgcctcgaaccgagcgtctgtcctgttcgaggcataggcgccacacgtcacgtcaggaaaactcgacgtccacgtcgcaacccgccacagccgggtgatggcctcgccccaccgtgattgccagcccctgccccaaccttcgagcgcagacgcgccgcctgggagaccacgaattggaaggcactgtatccgcagatgagtgagccgcggcgacacgtcaaccgttgccgcggccatctgccccagctcatcccggtacccgtggagaggcagagcgccgccagatgttcctcatttgtgcggatgcaatcgtgcctgacttcaaatccccgtcgtggaatcacgctgtgccagcagcgctgttgctgatggcgcccttcgacctcctggcctcactggccatggacatctacctgccagtcgttccggcgatgcccggaatcctcaacacctctcccgccatcgtccagctcaccttgagcctgtacatggcggtgcttgggctcggccagatggtgtttggcccggtctccgaccgcatcggccggcgccgagtgctgctgacaggcgccctcctgttcgcggtcacgtccttcctgctcgcgggggcctcggatgccgcgatgttcgtcggccttcggctcgtccaagccatgggggcatccgcggccctcgtcgccacgttcgcgacggtccgcgatgtctacgcggagcgccccgagagcgcgaccctctacagcctgttcagcgccatgctggccttcgtccccgcgctcgggcccatcgcgggggcgctgctcatgcagcgctggggatggcgagccatcttcatcacactcggagtcctggccacggcggcgctgctccaagccttgccgcggtggcacgagacgcgcccggcgcagggccttcagtcacgtcccgcgttccggcacatcctgcgcagcgccacgttctggacgtacaccctgggcttcagcgcggccatgggctccttcttcgtgttcttctccacggcgccccgggtgctcatcggtcaggccggcttctccgagctcgggttcagcctggcgttcgctaccgccgcgctcgcgatgattctgacgacccgcttcgcgaagcgcttcgtggggagttgggggctggcgggtagcctcacgcggggcatgggcatgttgctgctcggggcggggctcctgacggccggacagctcctggcaacgcggtcgttctggacgttagtcgcgccgatgtggctcatcgcggccggcatcgtgttctccgtttccgtcaccgcgaatggcgcactccaggcctttggcgatgtggcgggaacggcggtcgcgctctacttctgcatccagagcctcatcgtcggcgtcctcggcacgctgatggtcgtcctgctggacggcgacagggagtggcccctggtaggatacgcgtccctgatggcaggggtgacgttgacggcgcttcagcgcctccagcgccgacaacgcgtcctgacgaaacccgcgatggcggaaagccccgacgccccctagcaaacgtccccaaaccgcgccgcgggggcctgctcccgcggcgcggcggtggtttccaccttccccgctgggacggaacc

SEQ ID NO: 354 - DNA, 2415 bp, Myxococcus xanthus
gcccttacctccctcatcttcgacaccatcgacacggtgctgacccgcgcgaaggaatccggcctgcgccccgagcaggtggcggaccggatggtcgaggagcggctggccggctgagcgctcacgcacgcagtgcgtgtgttgccgcgatacaaaggcgacgtctggggtgtggccggatgtggccaccgtgcggccctcggagtatgacggggccgcacacaccccagccggagttcagcgccgtggcgaccaaacggcagagcaagtccaccgagaaggcctcttcgaagaagtcccctgcggtccaggcggagaagctcgtctccattcccgcggacgtcgtgttggcgccgcaggtggaggccccgcgccagccgacggggaaggaccagtcccgaggccggtccgcgtccagcggcgtgaaggagctgtcctggaaggagttcgaccgcgcggtccagcagctcgcgggttccattcaggagacgttcgaaccccaggtggtggtcggtgtggcccacggcggcgtcttcgtgggcggcgcgctggcgggggcgctcggctgtccgttcttccccgtgcgcatcagccgccgaagcagggaccggggcagcgccgcgcctcgcacgtcgaaatcgccgcagctcgccggggagatgcccgcggagctgaaaggccgtcgcgtgttgattgtggatgacgtggcctccagcggtgacacgttggagctggccaccgccctggcgcgcgaggcgggcgcgaagaaggtggccaccgcgtgcctgatgacgaagcccggtggcttctcgccggactactcggcgctctccaccgcctcgctcatggtcttcccctgggactacgagccgtccaccggcgacgcgcgcttcgacgaggacccggacaaggctggcgcatgagccttggcgcggtgacgccatgattgtcgggacggcgggccacatcgaccatggcaagacgtccctggtgaaggtgctcaccggcatcgacaccgacccgctgaaggaagagaagcgcccgcgcatcaccctgcagctgggattcgcccacctgacgctggatgacggccccgtggccggcgtggtggacgttccgggccacgagcgcttcgtgaagcccatgtccgctgactcagacggcgtggacctggtgatgatggtggtgaccgcggacgagggcgtgatgccccagacgcgcgagcacctggacatctgccggctgctgggcgtgagggccggcgtcatcgccctcaccaagtcggacacgctgtcggagctgggcccggagtggctcgcactggtggaggccgacctgtccgcgctcaccgtggggaccttcctggagtcggcgcccgtggtggcctgctccgccagaacgggtgcgggattggacgcgctgcgcgccgcgctcacccgggccgcggcggcgctgcccgagcggccttcggagggccccgccttcttgccggtcgaccgcgtgttcaccatcaagggctttggcacggtggtgacgggcacgctgctgtcgggagcgctggcggtgggtgacgcggtgtcgctcctgcctgggctgcccggtccgctgcgcgtgcgcggggtgcagcgtcatggcgacgccgtatccgtcgtggaggcggggcagcgcgcggcggtgaacctcactggcgtggagccggaggcgttgcgccgggggatggtgctggtgcgcgcgggcgagctgccggaggcgcgcatgctcgatgtcgagttgacgttgctgcccgcggctccgtcgccgttgcctcgtcgctcgaagctgctgctgcacctgggcaccgcgcaggtggaggccacggtggcgctgttggatgtggagcggctggagcccggcgagacgacgctggcgcagttgcggctgggcgcgtccgtgggtgcgttggtgggccagcgcttcatcctgcgcggcgcgcgagcccttccggggagaggcgccacggtggcgggaggccgcatcctgtccatctccccgccgaagcggcgcaagggcggcgcgtcggcggtagcgcccctgctggaggcggacccggcggggcaggtggcctggctgctgcggcaggcgggctatcgcgggctgacgcagccggagctgttcggccgctcggcgctggggccccgggtcctcacgcgcgcgctggagttgctgggggcgcggggcggtgcgctcctcatcgaccgggagcggcggctgtacctctccggcgaggtcttcgaggcgttgcagggccgcgccctggcgctgctggccaccttccatgagcgcgaacccttgcgcgaaggcctgtcacgcgaggagctgcggcagcggctgtcgtgcgagtgcatgttacgccctgtaaaacgccccgggagagca

SEQ ID NO: 355 - DNA, 1603 bp, Myxococcus xanthus
  unsure (1)..(1603): unsure at all n locations
cgtgctctaaagcttaccctcgtcaccgccgaaggaacggcgcgcgggcctgccctcgtcactgccgaaggaacggccacgcggcgagcctgccttgtcaccgccgaaggaacgacgcgcgggcctgccctcgtcactgccgaaggagcggcgcgcgggcttgccctcgtcaccgccgaaggaacgacgcgcgggcctgccctcgtcactgccgaaggagcggcgcgcgggcttgccctcgtcactgccgaaggaacggcgcgcgggcctgccctcgtcaccaccgaaggaacggccacgcggagcgccagccttgtcaccgccgaaggagcggccacgcggcgcgccctcgtcaccaccgaaggagcggccacgcggagcgccagccttgtcaccgccgaaggaacggccacgcggcgcgccctcatcgccaccgaacgaacggcgcgcgggcttgccctcggccgaagcccccttgggccgaccgaaacgcgccaggctcgaaccacccacggtcgcggttttggccgcacgggccggcgccttgcgcgcgggcttggcggccacgggcgcatcatcatccatggacagctccgcctcatcgtcagagtcgaagcccggagccgcccggccatgccggcgcggaggcagcctcagctcccccgtcggcggcgcggccttgccatccgacaccgcgttcagcagctccacctcgctcgtcttgagcgggcgcagctcgccggggcgcaggccttccacgcccacgccggcgtaggacggacggaacagacgcaccaccgggtgccccaccgccgcgcacagccgcttaatgaggtgcggacgtccttccgccacgacaatcttcagccaggtgttccgctccgccgcctcgaatacgctcaccgacaccggcgtggccatgccgtcttcgagccgcacgccgccgcgcaacttgtccagcgtggccgtgtccggagcgcccttcaccttcgccaggtaggtgcgcggcacctggaagctggggtgcgtcagcttgtgcgccagcgccccatcatccgtgaacagcagcgcgccctcggcgtcgtagtccagacggccgaccgggaacaggcgcttgcccgtctcttccacgtagttggccaccgtgggccggccctgcggatccgacagcgtcgtcacgacgcccacgggcttgtagagcaggaagtaggaggattcatccggaggcgtgaccagcgtcccgtccaccgtcaccaggtcggtgccgggctccacccggctgcccagctccgtcaccgtcttgttgttcaccgcgacgcggcccgcggtaatcagctcttctgcatgccggcgcgaagcaactcccgcgcgggccaggtacttctgtagtcgttcggccgccataccatccttcttccatgctgcccgtcactcgggcttgggccccgtcgtatcacccgtctcgggttccgggggcgtcgtgtccaggacgctggagctgaccttttgtgtccagtccgcggccgccatggcctcttgcaggtcctgcagcgcggcttcactggccgncgngctcttctccatccgcttcgtgaatgccggg

SEQ ID NO: 356 - DNA, 2051 bp, Myxococcus xanthus
ccgcaccggcacctccaccgtggccgtttcgtacagccccatggcggggaagctcgccgccccaccattggccagttgcacggcctggctgttcgacgagacggtgatgctcgtcgcctgcaacggggcggtgcccgtggagcgcagcgtgacgcgcagcacgccgctctcgccgttgtccagatacccgtccgcgtcgcaggtgttctcgctaccgtcctcggtgagctccgccgagacgaacaccacgtccgcgcccgtgcggaagctctccaccacgcccgcatggctcgtggagacccggtccggcgccaccgcgccgattcccgcgccacgccgagcgaacgcctccgcgaagatttggtagtccgccgggtctcccgcataggccgccgcgagcagcgcgtcgcgagcctccaggaacgtcggcgaggccggggtcagcgtgtacgcggtgacgaggtagctcatcatccgccgctggacttcgttgaacgagagccgcgaggagtcacgcagcagcccgacgtagcactcccacagcatggtcgcccagacttcgccggcattgtggtactcggcgttgctgctcccatccgctccgaaggcatagggcacgccgctgggaagacggactccgttggagatgtgcttgaaggtcagcgggttcttgcggaagtccaccgagtagggcacgcggcgaatcccgaagtaggcggcgtccgcgctcatgttccgcgtcgcgaagtcgcccaccgggaagacgcccgtccagttcggattcgaggcgacctgcgcatcctcctcgcgcaccgagagcagcagggcatggaagtccgcccacccctctcccatgctgcgcgcctggttggtgcccaggcccgctccgtcatggacgagccggttgctgatgtagtgcccccactcgtgcgccacgatgctcgtgtcgatggtgccgtccaggtcaccctcggggcgatgaatcatcgagagctgcaccccctccgtgagcgtcccccggatgcggtccgcgtcccccttcggaatcatcaccgcgccaatgcgcgacggcgagagcccgttctcgatgcccatcccctcgggcatggccatgccatcgatattggcgatgacgaccccgatggccccagccgcctgggccgtgagtgccttccgatggaagctgcaggtgcctcggtcgaagagggcgatgttcccctccacctccgcggcgttggtgagcgccgtacagccatccgtggtggaaggcccgtcggcgttctccgcatccagcccttcgaccacgcggccggacaccgagaacacgcggggggcgaactgcgaggagacgaacgtatacggtcccgcgatgctcgcgggggccgtcacttcgacggaactctgtgcggtgcctccgggaaagatgaacatctgcatccgcgggcgggcaccatcggccggggtggacatgttggcgttgttcacgccaccgaagtcctgcgcctccgcccggatgctgtcacccccaagccctccgcgcccgtagttgtcatgctgggcgttgcccgccgcttcgttgaagcccgcgtcgtagtacgcgtcgtgcagccagttgttcacatagaacaactgcgtgacggaggactggatctgctggggtgtctcgtacggcagcaggttgaagctgtgcggatagtcgaacgtcgcgggccccgagagggccgcgcgcatgtccccttcgctgaacccgtccggcgcggccaggtccgcgtacgcgtccacgttgttgcccaccgactccctggcgtccacgggcagccacgggtcattgcggctgaatggcgcattgtcgagcgtcaccaggttgcgctcgacgaagagcggcacttcgccatccggcgtccccgtcgggtgcgggatgtgcgagttgcccgacggtccggcgaacggagtgaacggagacgtggcatccgcccagacgcggtagctgtgcgccgcgtcctccgtgaggttcttgcggaacagcacccggccgtcctccgcggcgatga

SEQ ID NO: 357 - DNA, 2066 bp, Myxococcus xanthus
acttttggggggtccaggacgcgcggccgctccagcgactggagctccagtactccaccgacaacgggacgctgaacgtgagcttcgacctcgacccgggggccgagccgggacgtggcgacccaatgactcatttcggcttcgcggagctcctcgtcccgcgctgggccgacgtgaaggaccacaagccgtccctggtgggcctcgatggcgcgaagctcgcggcccgcgaggatgggacctggggcacgcccgaggcgcacgcgaaactcgaggagcacttggggaagatgctcgtcgcgacgctgctcgagctgcgggacagcagccagttcgaggccctgcgcgcctcggccaccgcggagctgggtgtcgaggagtacgaaggccacttcggctggcccgactacgaagagcgcgggcgcgagaacaggattgcgtcgtccccgtagcgccgcgcatggaggcacggctggaggccccgccctctgggcgatggagggggactccacgccgccggtccgtgggcccggagcgccccggctaccgcgacgcgaggggtgatgacgcggccccgcagcggccgcggcatcgcagcgtgcgggtcgggcgcagaggccgccgaggcgccgccgcacgcctcagcgcgtgccggtcgccgcgtggccgcccacaccccagaagaacaggtcgatcttgcccttccccgcatcgtggcgcgccatgtacttgaggtcggcatcgagctggacggcgaaatagcgctcgccgggttgcgcaaaccaggggcggatctccgtcagccggcccgccgtcccgccccagttgtaggtgccgttggcgcggatggtcaggctgttcatggcggctccttgcgtatagttgcgatagatgcggctgccgtcggtgctgtaccagatgccgcccggcacccacagattccagcgccccaccatgccggccgggaccttgccctgcggctggacgacctccggattgtccatcgcccggggatcgacctgctgggtggtggtggggctggacgcgaggcccggctgggactggccgggcccgcccttgcccggcgtgggcggcgtctgggcaggcgattgcgcctgcgtgcgcggctgggcctgcggctgctgttgcgacggttgcgaccattgctcggtctttgccggctgcgaccactgccccgtctgcgcggtcgccggcgcgcaggccaagacgacaaacgacactgccagcaacgaccgtccagacatgttcgacctcatccgttccatcgcgtgtcaagcattgtgacaaggaaaggccatgggttcgccgggcgcgtcgtgagccgcgcctttgacgtccccgcaggcgggccatggccgcaaaatcctgaaattcgacaacctgaaatgtcgcgattttcactctcgcaggcgatgtgaaaaaaatcagcgggaaatgcgcgcctccgcccagagggggcggggcccctgcggcacgtggacggacacaccgctgccgtgcgcggtccaggccccccgccgcgctcagcggcgcttcgtcccctgcctcggcggctccctcaaccgggctgccgcctcaaacggctcctgcccccaggaggcttccctgcctggcaatcgggagcaacgcattgcgccggcagccctcgtccccctgaatacaagacaggcaggcgcggcgtgccacgcgtcgttcgagttgcatccccccgctctgtccgagacattgcctgcggagtagggatgatgctcggctaccagacgaatccacagtggcgagacatgtctgacttcgtggttcacttcacgaagccgggaccaccctatcgtgacgcctaccagaacatgatgagcatcctcggcgcccggacgctcatccccggcgccgagggcttcggcatcgcccgccgagagcccgccgtcgccgagcgccaccgctccgtgtgcttcagcgagattcccctggaccagctcgcccggctcgtccagcgccgcagcctgtatggcattggtttcagcaagacctacatcctctcccagggcggc

SEQ ID NO: 358 - DNA, 1457 bp, Myxococcus xanthus
accgattccagcccgagcctgcacttgtggctgtggaatgcggactggggcccgtgcaaactggagagcgagattgccgccggctcctggctcttcaccgaggccaccgcggaggcggtgcttggccacgagccgtcgaaattgtgggatacgacgctgcgtggcatgggggtggaccccgccatgctggtgatgggaaggggaatgaactgatgctcgacgccgaattcatccgggcccgcatcctggaggccctgccgggctccgaggtagaggtgcgggactacaccgggacgggagaccactacgaggcccgggtggtgagccccgacttcgctgggaaagccatggtgcagcagcaccagctcgtatacgcgccgctccagcagtggctgaagagcggcgagctgcatgcgctcgcgctaaagacctattctcccgagcagtggaagaagctcgggactcgctagaaggagcggtacccatgacgcctgaactcaaggcccggttggagcaggagacccggtcgcacaagattgtgctcttcatgaagggcaacgccctcttcccccagtgcggcttctccgcgcgggcgctgcagctgctgcagcccctggggcaggtccacacggtggacgtgctcgcggatccggagattcgccagggcatcaaggacttcaccaactggcccaccattccccagattttcatcaacgggcagttcgtcggcggctccgacatcctgatggagctggccgagcgcggtgagctggccgacctggtcgcgggcaagagtccggcctagcggaggacggggcctcggggagtgacgggcgaggggagaccgattcccctcgctgcggctaggatggaaggccgccgccccgaggaacctccgtggtcaccgctacccgtcacaacgcccccgagaatccggacgaagcctccgccgaggtgcccaacgcgggccccgccgtcgaggcgagcgtccccgtcgcagagaaccacgcagccgtcgccctgacggacgccgtgttgccggcccaggcgccgggcgtggtggtggacccggacgacctggtcgacacggcgaagacgcccaccctcatggacaaggtgcagcagttccgcgcccgccatgagaagtgggagatggccgtcttcttcttcggcggcttcatctacgacgtcctcaccatcagccgcatcgatgacacgctgacgctggcgcagaacttcggctacctgctggtcctcacgggactgctgctgctggagcagcgctacccggacggcgtcgagccgccgaagttcctgcagaaggtctggcgctggcgcgaggacggcatccacttcctcttcggaagcctgctcagcgcgttcatgctgctgctcttcaagagcacgtcgggcgcgctgccctacctgttcgtggtgggcctcttcgccctttagag

SEQ ID NO: 359 - DNA, 2196 bp, Myxococcus xanthus
tctttccaggggttgcgcttctggacggggtgggccagcaccgccgtgcctcccgccgccgccacggcgcgcaccgcgtcgcccggcggcatccacgcgcgcatgccctccagcgggcgcgacatgccgaaggccacgaggtgcccgtccgacgtcgaaatctccacgccgggcaccaacagcacgccctggacgtaagcgggcgctcggagcgcgaagtcgttgtggtcggtgagcaccacgaagtccaggcccgccgccttcgccgccgccgccaccgcgtccggcgtgcctcgcccatccgaacgcgtggtgtggacgtggaaggcccctctcgcccaccggggtgcttcgtccttcgggaccaccacggggtaccgcgccatggacgccgagagcgcgaagaagcccacgtaccccaggaccagcagcgccaaccccagaacggcccggagccccttccccaccgctaccgtcaatccgctcacgccgcgcctcgctccgaggagccctccgtctgcatcctccacagcgccgcataccgcccgcctcgctggagcaactccgcgtgcgagccactctcgacgacgcgccccgcctccatcacgttgaggacgtccgcgttcaccaccgtggacagccggtgcgcaatcaccagcgccgtgcggcctggaaggaccgccgccagcgccgcctgcacttcgcgctcgctctccgggtcgaggctgctggtcgcttcgtccagcaccagcacgggcgcctgcgccagcaccgcgcgggcgatgcacaaccgctggcgctggcctccactgagcgccacgccccgctcgccgatgcgcgtgtcatagccttcgggtagtgcgcggatgaagccgtccgcgtgcgccaccttcgccgcggcctccacctcttcccgcgtggcgtccggcctcgcgtagcgcaggttgtccagcaccgtgccgtggaacagcagcggctcctgcgtcaccagcgcgaactgggcccggacgctcgtggccgtgtaccggtccgcgtccacaccatccaggaggagctggcccttctgtggccgctcgaagcgcagcagcagcgatgtcaccgtgctcttgcctccgacgctgccacccaccagcgccgtcacctgccccgccttcagctccagcgtcaggccgtccagcgcgggccgctctccataggcgaatcgcacgccctcgaactggatgctccgcgacagggtcggcgcgggcaccgcgtccggcgcgtcctccactgggtgcttcatgtcgagcagcgagaaaagtcgctcacccgccgcgcccgcctgcaccgcgaactgcgtcacccggcccaggtccttcaccggctggtacaccaggatgaccgccgtcagcagcgagagcagcgcctccggctccatcagccgcgcgctcgccgcatacgccagtgcgcccgccagtgccgccgcggccagcacctccatcagccctggcaccgcgccacgcgcccacgccgcgctcaccaccgccttctcgtgcgcctgcgcgaaggcggagaagcgagccagctccgccgcctgcccgttgaaggcctggatggtgcgcagaccgcccagcccttcgtggagctgccccgccaggttgccgagctgcgtctggccttcccgcgtgcgcttgagcaccttgcgcgtcagcttcgaggccggcagcgccgccagcggaatcaccagcaacatgaggccgcccaacatcgggctcatcgccagcgccacgcccgccaggatgatgacctggagggtgtcgcgcaggtacgagcccaccgtgtacatggccgccgcttccacggcgctgacgtccgaggagaagcggctgagcaggtcccccatccgctcgcgcgcgagctgggcgggcgacagcgcggtgaggcgctggaacaggtcgcgccgcaggtccttcaccacgcgctgcgcgaacaggcccatgaaatagaactgcgccaggtaccccacgcccttcgcagcgccaacgatgaccatcaccagcgggaagccccacagggccgcctcgcggggcaggttcgccaaccaaggcacgcgctgcgcgctggcgaaaccttcttcaccgcccgacagcacgaagcgcagcgccgggcccgtgagatacgcgtacgcgcccgttgacagacccaccgccgccatgc

SEQ ID NO: 360 - DNA, 1362 bp, Myxococcus xanthus
gaggcgttcctcacctcgtcgcaggagcgcgtgacgggtgacgtgcggctggtgctgcacccgcgcacgcaggtggtggaaggcgtgcgttcgccgcactcgctgatggacgcgaaggtggcgacgtacggagaggccaacgtgttgtggaacggctcggaagccgcgggcttcgccaagctgtacggcgtcgcgcagatgctctcgcatcgcgcgaagtgagggtgccatgaaggttttcgtcgacaaggtaggcagtgtcacccgcaacctcggcctgggccgtaccgtccacctcgcgtccgaggtgaaggccgaggagggcgcggtggtggccgtgcgcatccacggagagaagagcacgtacaaccagctcgaggacgtgcacgggcgcctggtgacgctgcacgccggtgacatcgtcgtgggcgcgctgggccaccgcaacgcgcttcacggctatgagggcgtggtgcccgcgtccgtcaccgtgggcgagcggctgcacatgctcaacatgggcggcgtcatcggcaagtgcacctcgcacaaccacggcgtgggcctgcccttcgaggcggaggtgctgggccaggtgctggagttcccggagctgatgtcgcgcaccgggcagccagcgcacgtgtcctccggcgctctgaagggcacgtcgtcgccggtgaagtgccccgtcgtctacgtggtgggcacctgcatgaactcgggcaagacgttcgcctcggcggccatggtgcgcaagctggcacaggcgggcttccgcgtgggcggcgccaagctgacgggggtgtcgctgatgcgcgacacgctgagcatgcaggactccggcgcggacgtggtgatggacttcacggacgcgggcatcgtctgcacgggccctcgcacgggcgcgcgcgtggcgcgggtgctcttctccgagctggcggcggagaacgtggacgtcatcgtcgcggagacgggcgacggcatcatgggcgagtacggcgtacagggcatcctcgcggacccggagctcaagagcctggcgggggcgtgggtgctgtgcgccaacgacccggtgggcgcatccggcggcgtgcggcacctgcgcgaggcgtacggcatcgaagtggacgtggtggccggaccggccacggacaacgccgtgggcgtgcgcttcgtggagcaggtggtgggcatccccgctcgcaacgcccgcgcggacgcggcggcgctgggcggactcatcctggaaaaaatcgcccccaagctgggcgcggggaggaagtcatgacgcaggtcaacatctacatcctgggtgcctccggcttcggcggcggcgagctcttgcgcatccgtaccgca

SEQ ID NO: 361 - DNA, 1267 bp, Myxococcus xanthus
  unsure (1)..(1267): unsure at all n locations
ctctcaagagttgccttcgtcggaggacagagcgctattggcgacaccagcggctggagcccgcgcgagccgatgcgcatgcgtgcgggcgcattcgttgccagaacccacagagaagactgggagggatagtcgatgaatccaggtcaggagtgtttggcgcgggaagaggacacgcgcggagccgcgccattcgctgacacgacgaccggcgtgacgacatgcccatgccggtgtgcggagcgggaggacgaggcacaccacccgaatggctacctcgtaacggccgaggagtaccccgaacaccccgctgcccaggccggctacgagggatgggtgttctgcgtccactgcggagcgtggcgcgccgacgacgatgatgcgcccgacgcggactgggtaccctgacgcgcgctgcgcccgctcgatgagcggagcgcacgacccctgctcctcatggcaggagcaggtcggtcgcgccgtccatggtgaacacgctggagcccctcttcagcgtggaggagacgccatggacaccacctaccgtgtcgcgaggctgcccgcgcgcctgcgtgccttcgcgctaccggacacgagcacgccacccgaaggctacgtcgaggcgggtgactacctcgtgctcgaggagaaggcccgataccccacgcccgacaccgactactcccggctggtggtgccgcagttgggtgtgctcggcatgtgggtttgcacgcgctggcgcacccagcgctacgcgacgctcgcctcccgggagcgcgcgcctgccatggcccggctgtcgttcgacgacgagcggctggccgtcccggaggagcggctcaccacgctcctgggggcgttcctcgactacaggtatgacgggagccgggcgtactacccgtgggcgctgccgggcgttcgtgtccagctcgcgccgcctcggctgaacaactgctgcaccttcgtcgaggccctgctggtgaaggccttctccgaggtgcatggcgcggccttctcgtgggacgcgcgtcgccaccggcagatgatgattgcctccacccaggactacttctcccctgtgacggctgccgtcgagtccggcatggcccctgccggcgccgtcggcggacgtgcctccccacccctggacactcatccaggggtggcgcagccagtggggctcggggcacaccttccttgccgtggaccaccaccccggagacggacaaggtgctggtgctggagtncaacgctgncttcgggctcg

SEQ ID NO: 362 - DNA, 1250 bp, Myxococcus xanthus
ggttccccgtggcgacgattacccacgtccggatttccggcgtcatcgacgaaacatttccactgacgtccgccagcccggagatgagcgggctgctggtggtggacctggggcaggtggagcgcatcagctccttcggcgtgcggcggtggattgagttcgccgccaagctgccccagggggccctgggcctctacgtggtccacgcgccgcccgtcatcgtggaccagctcaacatggtggagggcttcgccggcgtcgcccgtgtcctctccatgttggcgccctatacctgccgcgcctgcaacgaggaccggctgcggctggtgaacctgctggacgaggcgcaggtcatctccgaggaacgtgcacccgaccattcctgccccgtgtgtcaggagccgctggagttcgcggacctgccgggcgagttcttcgactacgcgcggcggcagcagttcggtcaggtggacccggtcgtcatgcgctacctgcgcgccagcatgccggcggagcagccggagctgtcgcagcacctgaagatcatccaggacgacatcacgtacatcaccctggccagcgcgctgaagggtgacctcaacgtgcgccggctggcgtcgggcctggagggccgcgtcggcttcgacttcagccacgtcagcaaggtggagccggaggccctgccgaagctggagcaggtgctggagacggcggcgcagggcgcgcacgtggtgttgtgccgggtgccgccgcccgcgttggcggtgctggcgcgctcggccaaggtgttgccggtgcggctggccacgctgtggctgccgtgtgactgccgcaactgcgggcaggtgagccaccagcgcctccaagccgcggactacctggccaggctgcgggcgcaggcgtccggcgtggaggtgccgtgccccatctgcggcggcaacgcgcgcgtcccccacatgccccagctccaggggctgctggcgcgggtgcagctgacggaccggccgctggaggacctggaggcgctggagactcgcgccctcagtcagtacctcttcggcgccacgaacatcgacccggcggcccgtcagggcgcgtccacggacatctccaactcgctgggcagcaccaagctgaacatcatccggcggctgggacagggcggcatggcggaggtcttcctcgccaagcaggtgggcgtgaagggcttcgagaagttcgtggtgatgaagaagattctcccgcagttc

SEQ ID NO: 363 - DNA, 1270 bp, Myxococcus xanthus
cgcagttccccatggcgagcgccggggcaatcttccacgtcagcaggtacagcggcaggttccacggggagatgcagcccaccacgcccagcggcgcgcgcagggtgtagttgagggccacgtcgtccgtctggtgcgcctcgctggagaactgcgtcaccgcgtccgcgaagaactcgaagttgaggatgctgcgcgggatgtccaccgtggaggcgaccgacagcggcttgccggtgtcgatggactccgcgcgggcgaaggcgtccaggcggctccggatgccgtccgcgatacggcgcagcatgcgtgagcgctcggtggccggggtggcggcccaggcggggaaggcccgcgcggcggcctccaccgcgtgctggacgtcggacgcgtcggagtccggcacgtgggcatacgtctcggccgtcgcgggctcgggcttgtccagccacccgcctccgcgtgcgggcagcagctcaccaccgatgtagttgagaaccttctccatggccgagccctccggtagcgcctgcccatggcccggcgacggtgaaccccgccagccctgtgggagggcgcgcaatgtacgccgcccctccgtacctcaccagcgccacgcgcgcccgcagtccactgtcatggaatcggggtcgcccgcctggacggctcgaggaatgccgcactgcgcgaacgcgcgcggggtcgcgagctgcgccatgcggtgcagccgctgtcagtgcgcggggtggggcacgcgcagtccgcccggggggggccgggtcctcacggcccgcgcggcccaacgcccagcagcagtcccgcgagcacgagcgggccgcgattccgggcactcatcgggagcgctcccgcccctgtttccgtgcgcgctgcttcaccggcacggggggaggaatttctcgcgcgacgaagaaccgcgcgcccaggacgatcacaaggatgaggaagggcagggcggtgagggacaaccggccccagaagtgctcatcgaggatggtggccaccacgtcggggcggcaggtggggcatgcggagcccgcggtgcccatcagcagcccggtggtgaagcccgtgagaatgccccgcttcatagatcgcccctccctgggtggacgggaagctcaccaccccgccggggcgcggcaagcgggtgggcgttccctgaaaccacgagaccgcccgtcagtcccacctgccggggtggatgaatgttggcgggaccgccacgctcgagccgctcggctatagcgca

SEQ ID NO: 364 - DNA, 1484 bp, Myxococcus xanthus
cgggcacggagcgtgaaggcccacagctcgcgcgtggcctcattctcgcgttgacggttgacgggcgtctggatgcccatcagcgccgcggcgagcaggatggaggcgatggccaccgtgaccatcatctccagcaatgtgattccgcgtgtgtgcctcatgctcaattttccgtcaggaggggctgaagtccacccgccgcgaagttccggagcatcacccggaacgtgaaggtgcgccgcttgaagccatcaatcgggaaccgctcccgatccacaccaatgggctggtccgggtcaaaggcttcacggtcctgccgtggcgtgcggacgaccagggtgacctccacctcgcggacgcgctggaacagccgctggcgcagctcctcgtccgtcgcgggcgcgacaagttcattggggtgctgttcaatggggcaggtggtgatggtgcaggcatccagcccgttcggtcgcccgttggccacatccgggaaccagcgcatgcctccgaatggctgtgcgatggccgcgacccccagccgcaccgagagacgttcgacatcccggctcaggaccacccagttcgccgcgcccggccccaggtactccagcgtcggtgttccactggcccagttcacgcggtaggtcgcgctctgggccggcatgatgcgccaggattcccggtcgggctcggtgttccagaagttcggctccgaggcgaagtcaccacagcggtctgtcgtcgtggtctcgatgccagtgcccggaacgacgttgattcgccgccccgcggcgtccacgttggtgacttcaacatggcaggccagattcctggcgggattcacgagcagggccggagtcgtcggcgcggtggtgggctggagcctgggcgagggattctcaaccgtgcagaacgtccgtgtgtctgcgcgcacgttggttccagcgcagggactcagcgtcaccatgcctcgcgtgtccccccagtgaatccgcaggacgtccgacacttcttcttcaaggtgccccgcgggcggcagcgagaaggcggggtcctcggggaagggacgcgtcaagtccggcatggacaggtcgggctccgtccacatctggatggctggatgggtgcgcgtgtcactgaagacgatgggggcattccccatgcctgagccggcccgctgcaggtcggcggcaatcaactccttcaccgtgcgcccggtgacctgcgccagcatcgtctgttcttcgaagagggcacgccgctgcatctgcatggccgcgaccagtcccgctcccaacacgatgaggccaatggcagtggcaatcatcacctcgagcagcgtgaagccatggagcgaccggcggcgatggcgcgtcaaagtcgtcttcacggggccatcctcgtctggagcaccaccacctgccggtcgctgcgctccttgctcctgccagctcacgacgacccgtacgttggcgatgtttccc

SEQ ID NO: 365 - DNA, 1394 bp, Myxococcus xanthus
tctcagcgaggttactggcggcgaggacggagggcaggaacatggcgggatgtccagcgtgagggagggatgctgcgaagacttcggtttccgcggcaggagcggccggcgcccgcggtggaattccctacgggcaccggcgaccgtccagcgatgactcgacctgcgctcgccttaagccttggtggcgagcaggatgcaaacgaccagcgcgaacagcgtggcgccttcgataagggccgccgcgatgatcatcgtggtgcggatgtcgccgcccgcggccggctgacggcccgtggcgtccatggcggcggcggccagcttaccaatgccgagcgcggcaccgatgatggagagaccggcacccagaccggcggcgaggaaggcaagagcgaggttggtcatggtgacacttgttctttcgtagcgtggacccgcttgtgggggggtcgtgatgtcccttgaggactacctccggcggcctttcgaaccgccgggtcttcgaccggggcaccggacttcagcgccccgctaactcgtcagaacgacctaggcgtggtgcgccttgccctggtcgtggctggggcccgcttccgggtggtcgtggccgtggtcgtcatggtggtgacccatggccacgctcatgccgatgaacagcgccgacaacatcgcgaagacgtacgcctgcacgaaggcaacgaacagctcgagcaggaagatggcgaaggcgaagggcacactcaccgccgccaccgcagggtggccgaggaggaagatgaggcccaggaggaagaagtagacgatgtggcccgccagcatgttggcgaacagacgcatcgtgagggcgaagggcttggtgaacagacccagcacctccaccggaaccatgatgggccacaaccagggggccacgccacccgtcaggtgcttcaggtagccgcccagacccgccgcgcgaatacccgccacctgggtgatgacgaaggtgcacagcgccagcgccatggtcacggccaggttgccggtggcggtcgccatccagggaaccatgcccagcatgttcatgaagaggatgaagaagaacacggtgagcaggaagggcacgtagcgggggccctcctccttgccgatgttcttgatggccagctcgtcacgaacgaacagcaccagcatctcgaggatgttggcgcccgcgccgcgcggcaccagcttcgtcttgtcgcggttgccccagatgaacagggtggccatcagcagcagagcggccagccacatcatcacggtgtgcttcgtgatggacaggtccaggcagccgtccatccaagccggaatttccttcccgtgctccgtcatccggggcgcgcacgcgccggccttcagcgggacgtgccact

SEQ ID NO: 366 - DNA, 2686 bp, Myxococcus xanthus
ctaccgtgtcgcggccgacgcgctcggcccgtatcacgaagccgccggtgccgttgaccgtccctcctgtcacccggctgccaggtgtcttctcggagggaatcggctcacctgtcaccatggactcgtccacggcgctctcgccctccaggaccacgccatccacgggcaccttctcgcccggtcggacgcggaggcggtcacccacgtggaccccgtccagcgccacgtcctcttcgcgcccgtcctcgcgcagcagtcgcgccgtcttcggggccagcccgagcagcgccttcaaggctcccgaggtggcatggcgggcccggagttccagcacctgccccagcagcaccagggtggtgatgaccgccgcggcctcgaagtacaagggcacgtggccgccgtggccggtgaaggcgtggggcaggaggccggggaagaaggtggcgaagacgctgaagccgtaggcggcgcccgtcccaagggcaatcagcgtgaacatgttgaggtgccggttgcgcaccgacgtccagccccgctggaagaagggccagcccccccacagcaccacgggcgtcgccagggcgaactgcacccaggccatgagcggccctgggatgaggcgcctggatgggctggcccggaatcatctcggacatgcccagaccgaacacagggagcgagaggacgacgctcacccagaatcgccgccgcatgtcgaggtactccgggtcgggcgcgtcctcaagggtgacggtccgtggctccagggccatgccgcagatggggcacgctcccggctcgggccgcacgatctccgggtgcatcgggcagacgtactcggtgcgcgtctggaggaccggctgctcgggctcgagggccatgccgcacttggggcaggtgccgggatggtcctgccgcacttccgggtccatcgggcagatgtacatggtgcccgcgggggcaggctccggcggctggggctcgggcgcgaggtacttccgcggctccgccgtgaacttctcgcggcacttcgggttgcagaagaagtacgtgtgcccctcgtgcacatggctgccgcccttcggtgcctggggatccacgaacatgccgcagacggggtccttcgtcttgccctccggcaggtgcggagggtggtgcccggtgtgagcttctggggggagatgagtcgtcatagtacgcgcttccttttgccgggatcacgaagcaccccgttccttcttacagttccgagcgaagcggcctgtcgcccgaagcgggcccatggctgccttccaggaatgctctcagggcgaacccgtgcggcttgtcagctcgggtaacaagcaaccccgaggccagccgtgccaacgggcaagttccgagattgactcgggcgtgcctccctctggcgtaacccgcgctgttacacccggatgaggtagtcacacttttctgcgccccacgccggggctgcttcgctcaggggctcaaggcggtggaggcggtggctcgccgcctccagtcgtgaatgcgccgatgcccgctacggttgactgccgtaccaggacttgcgccactcaatcatctgaccgatctccttcgtctgtgcgtcgatgattccgcgggcaagtgcgcgaatctccgcgttgctggtccgccgaagcgcgacgctcgccatcagaatggcgcttgagtggtgcggcatcatcgaatcgatgaacgccttgtcgacgtccggttgtcgcgcgagctcggcggtcatcagcatgccgctgttttgcatctcggactcgctcatcatcgtcggcacatccgaggagccgaagttggcctgcttgagggccttcagttcctcgatttcttgacgctggtcctgaatcattttcgtggccagcgcccggagctcctgacgcgtgccgcgttgctcctcgaccatggccatctcggtggccatttggtggtgcgcggccatcatgtcgataaaccgctcgtcggaatagttgccgtccacgacgagccgctcgggggcaacgtcactgtccatggacatgcccccgtgcgactcgtcatctccacaccccgctactgctgcgaggaagacgaccaccagggcgctgcatagcattgaggatttcatacgttcacagcctccaggtcggacgcctggcatccgcggtgtgccgaattgccagaggcgtccgccgcgccggatgctgtgcatggaggtggcccgtggcatctgtgagcggcggagttacaggccacctcacagggggggagccacgccaatcacctcgtacctcgagatgggtcagttcttgcggaagacaagtccgttgggctgagtgcccacggtgagcgtcttccgaacggtgcgcgaggcgacgtcgacgatgctgagcgtccccgcggtctggttggtgatgaatgaggtggcgccatcagcggagaacgcgatgccatgggctccggcgccagtggccagttccccctgacgtgtcgtcgtacctgcggcgaagaagatgaccttgccgttgtcggtgtccgtcacccagaggtccccattgggggcggtggcggccatggccggcgtgaagcccagcggataggtgcgcgccacatcgagggtgctggcatcaatgccggtgaggctcttgccgtcctcgttgtccacgtacatgag

SEQ ID NO: 367 - DNA, 1399 bp, Myxococcus xanthus
ccgttggatgtggccaccgtgcaccagctggcgcgcaggcaactggtggcgagggccatcgcagcacacctgtggcggctcgcggccgctcagcccctggttttgctggtcgatgacgcgcacacgctggaccccacggccctggatgcattggaactggcgacgctctctggcgagggggcccccctgtgcgtggtgctcgccggccggcaccggctgctgggcctgcgcccctacctgggggaacgcgcacgagacgccgaacagcgagagcttcctccccttccggaacacgatgcgcgcgagctgcttcgccagtggctgcgccccgtagacctgattgccgaaggcgtgttgagggagctggtggaccgctgcggtggctcaccgctgcgcatgctggagacggtgcgtgccctccgaggcgcgggcgccatccgtacccgtccggatgggggtggctacctcgccgcggacgccctgaacgggctggccccggaccgcccgggcgcggatgaacggctcgccgaacgaagcctgtcgggcctgccccctggcatgcgcgcccctctccagatcgcggcactcctgggagacgacgtgcggctggaggagctcaccgccacgctcgcccacctggagacagacgcggacctggacctgtcgctggacccgggcgtcgcgatggagcggctggcacgagcgggcatgctggaaccccgaggtccgcgacgctggctcttcgaacacaccaccctgcgcgaagccttcaccgccctgctccctccgccactgaagcggcgcatctgcacggccgccttgcgcgccctgcccgcgacgcccaccgcccgaagggcccgtctggccgagtccgccggagattccctccaagccacggccctccactggaacctggccgaatccgctcgccacgcgcaccggctcctggaggcggaacggcactactcggccgccctgtcgctggtgccacgcaccgaagaggccgtccggctggagctgctgtcgggacgaggacgcgtgcgctaccgcctccagcgcatcgacgacgccgtggaagacctgcgcgccgcccgcctgctggccgaggcccaccgcgatggggtgcgcgaagcggacttgctgctggaagaagccaccgccctcgactggcaggacgacgcgatgggctccaccgcgctgttggagcaggccctgcactgcctgaaggacgccgtccctccggagctggccgcgcgccatgccctggcccaggcgcgcgtcttcgtgcggcgggaggacatcacgggggccgtgcccgccctggagcgcgccgtggagtccgcacggtccggagatccatcgccatcgagccgcgcatgtaccagcgcgaagcagctcc

SEQ ID NO: 368 - DNA, 1413 bp, Myxococcus xanthus
gctctccagagcgttctcggcgaggcctgcgtcgttggcgggtgccacggagggggcgctgggcggcgcctggtagctgagtgagaaccgggtcggcggcggcgtcgcgggaacctgagggatctcggcgacccctgagtccggggtggcggccggcttgtccgggcagcccgagaggacgagagcgccacagcatgtggcggcgacgagtccgaatcgaagaagacgcatgtggcggccacggtatgcgcctggatggacgccggaaagcaccgagtgccgggcagccagccgggccgtgggttggcggcaatgggctcgcggataaccgtccaggacgtgacctctccctctgaaagaaggtccgataacatgcgttatgtaaactaagcgggcgcgaaacctggggtcgattcaggccgttccccgccctggtttctgggccgtccgggccggtttcgggtccgtcgattgcagtcgaatccggcaagatctccactcccgacgcccgccatgaccttcttcgattcgctcgccgcggatgttcgcttcgcgctccgcaccttccgccgctcacccggcttcgtcgccgccgccgtgatgtgcctggcgctgggtattggcgccaacgccgtcatcttcagcgtggttcacggggtcctcctccggccgctgccgtacgcggaacccgagcggctggttagtctcgtcgaggtgcgcccccagggctatggcggcccggtgtcctggcccacgttctgggcctggcgccaacacagcccggccttcgaacagatggcggcattcacaggcggcggcgtcaccctccaggcccaggatgcgcctgaacgcctccaggctcttcgcgggacggctgacttcttcacggttcatggcgtgccgcccttgctgggccggactttcgcgctcgacgaggacctgcccggccaggccccggtcgcggtcctcagcgagcgcctctggcgcgcccgttttggcgccgacccagccgtcctcggccgttccgtgagcctggatggcctggcccacaccgtcattggcgtgatgcccgcgtctttcgatgcgtccaccgacgtgtggctgcccctggtggctccgccggacgccgccgctcggacccggtccacggtgctgaccctccgggcccggctggcgccaggcgtttcgctggcctccgccgaggcccagttgaagcaagtcgccgcgaactccgcggcggcccaggcggaatcccaccgggaccggagcgcccgggtcattccgctcgatgaaagccagacgcagtcctggcgggcgccgctccaggtcctgctgggcgccgtcgccctggtgctcctcatcgcgtgtacgaacgtcgcgaatctgctgctggcccgcgcgggcacccggcgg

SEQ ID NO: 369 - DNA, 1421 bp, Myxococcus xanthus
gtgctctatagtcccgctcgacgtgctcgttgcggacccagacagtgccctggatggtgtcatccaggtccttgttgtggatggcgatgcggaaggcgtgctcgttgcccagggcggacagcttgtgctcctcatccaggcgcgtctggatgtggatgaactggtagccgccgtccgcgcccaccgagcccatgagcacgtccggctcgccgtcgccgttgatgacgtaggcgttgttcggcgtctggaagtcgatgtcggggacctcgaggaacatcgagtccatctccccgcggcgaatcgtccagcgctgctgcgcgtccaggccgaccgcggggccctgggcaggttcgaccaactcgctgcactccgtcggcacctgggcaagcgtctccgcgtccagcgtcacgtcgtaggtgtacgtgtcgtcctcgccgcatcccgtgagcgccatcaccacggcggccatggcgccccactggtctccacgcatcggtctccgctccttccgtcacagggctcgcgcccccgtggcgcgagcggcggagcctactccttcacgcgcttgcccgtgaaagggatggtcacgacgcattccgcctcatcccaatccgctaccggaggcgcgaccaggtgctcacttcggaaccacagatggccgtggatggtgtcgtccaggtgcttgttcgtgatgacgatgctgaacgcctggtaagccccccattcaaacccgaagttcgtcaccttggtttgcacgaactgaaaaccaccgtccgcgccgactgaaccgtggaagatgtccggctcgtcgtccgcgtccacgttgtacccagtgatacccggagcccgaatgttgagatcgggcatctcaagcgtcatcgaatccatctccccgcgctgaaggcgccactgttgctgggcctcgattccagtcgccgggccgtctccttcaaattgtgctttgagctggcccgagcactcgttcggaacgttgctcagcgccgccgcatccagcgacatgtcatacacatacgtgtcgtcctcgccgcacccgatgagccccatcatggatgcgattgctaccccccgcatgtatccccgcatgaacagccctccctcggttacaccactgatgacccgtcaccagtcgccgagcgccgtcccccctcgcgggcccggaaccctcagcagaaaaccatagggtggctggaacccggctccagtcgttgccagatgaagagcatctcggcgcggtgacctcgtctccccgcacgagcagtacggccgtgcaggcaggcccgaggagtgtcaggtgcccgacgccatcccaaaccggagcgcctgggggttagtagatttcctccccaggccccacttggaagaggccaagcgccccttgccccatggatccccattccccc

SEQ ID NO: 370 - DNA, 1310 bp, Myxococcus xanthus
gaaagtggaccccggagattgcccgccgttcctcccgcgaggaggacccagcgccaggaggaagggctggagctcatcgcttcggagaacttcgtctctccggcggtgatggaggcggtgggctcggtgctcaccaacaagtacgcggaaggctaccccggcaagcgctactacggcggctgcgaggtggtggacgtcgcggagaacctggccatcgcccgcgccaaggacctgttcggcgcggacgcggtcaacgtgcaggcgcactccggcagccaggccaacatgggcgccttcatggcgctgatgaagccgggcgacaccatgctgtcgctggacctcaactccggcggccacctcacccacggcgccacgttcaacttctccggcaagctctacaaggtcgtccactacggcctgacgcgtgacacggagaccatcgacttcgcgcaggtggagtcgctggccaaggagcacaagccgaaggtcatcgtcgtgggcgccagtgcgtacccgcgcacgctggacttcgcgaagttccgcgagatcgccgacgcggtgggcgcggcgatgctggtggacatggcgcacatcgccggcctggtggcggcgggcgtgcacccttcgccggtgccggtggcggacatcgtcaccagcaccacgcacaagacgctgcgcggtccgcgtggcggcctggtgctgagccgcgagccctacgccaaggccatcaacagtcagatcttccccggcatccagggcggcccgctgatgcacgtcatcgccggcaaggcggtggccttcaaggaggcgctgtcgccggagttcaaggcgtaccagcggcagattgtcgccaacgcgaaggcgctggcggaggcgctccagcgcgcgggcctgcggctgacgtccggcggcacggacaaccacctgatgctggtggacctgcgccccaagaagctcacgggcaaggtggccgaagaggtgctggacaaggccggaatcaccgtgaacaagaacatgattccgtttgacccggagaagccgatgaccacgtccggtgtccgggtgggcacgccggccatcaccacgcgcggcatgcgcgaggcggagatggcggtggtggggcggctcatcggcgaggcgctggacgccgcgcaggacgacgccgcgctggcccgcatcaaggggcaggtgaaggagctttcgcaggggttcccgctctacgcctcgcggttgaagtagattggcgagccgtacccttccatgcgctgccccttctgtcaagacgccgagaacaaggtcatcgactcccg

SEQ ID NO: 371 - DNA, 1644 bp, Myxococcus xanthus
ctcttgctgacgcggaggttcggcaccgggccccggcatcccatccacgcggtgcgccaccagacctccgggtccatcgccgtaggtgacacgaacctcgtctccctcgtgatactcccgcaggcccgtgacgagctcgcccttcatgaagaggcgggtctgctcatccactccgacgtcgtactccacgccgtcagcgccgcggatgagcagctcgttgtcgcccacccactccacgcggccatggagctgctccgtgggcgctggtcgccctgaacctccctgccccgccccctgcgtgcccacgggaagtgagccggagccaggcgccccggattccgggggccgctcgcgtgaggccacgaggccgcgaaggacatccgagcggccttctcgctcactcgcggatggaggcccccggctctcgttccgctggccgcaaccgagccacacggcgaacagcccgaatgccatcagcctccaaccgcgcgttgccctcatgcgctcgtatcccccgcgtgtggaagttcatcgcgacggccggcccgcgccggcccgctcctgtctcttcctcaacatgcggatggccctggcggccgagaacctggtgcttcccaaggtgcaccttgatggcgaccgggagggcggtaaagcgctccaccgcacggcccctcggcctgcgtggatgccccgacctcgaacgcaccagtcggccttcatcctcgtaaagcctgcccgaggagtacctcccgcgcgggtgtctcagcgcaacaaagccctctcggagcggctgcgcgccagtgaggaggagcaggccatgctgctcgacgcatcatcgccctggtctcgttcgtcagcgcggacgagcgctacggccgcgtcaacaaagcgcatgaggacgggttcgggctttcgcaggagaaactcggaggggctgcctacggcgtgccgagccccttcgtgaagcggagggagcggagttcgaacagcagcgcatcggcatccatgcgctcgtccggaccgccgtgaaggaaggggaagaagccgcacgtcgtcccaccactcgacgcgcgcactcccgtcgggggcaccggtcagcccccgacggccctcggaactactcgatggcgaagatgagcgtcaccttcgcctgcaccgtctgctcctcgggctggatgggcgtcgccatcgcgcgggcatccgcgacctcggccatcgcgaagcgcgccgggtagagctgcggcggctccgtcaccgtgctcgcgtcgagcaccgcgcccagcttcacgttcagcgacgcggccagcacctccgccgacttgcgcgcccgcgccaccgtctgccgcagggcctcgccctgcaccgcctcctggcggctcagcccgaagcgcaccgagtccacccggttcgcgcccgccgccagggcctggtccagcaggttccccacccgcgacaggtccttcacgtggacgctcaccaggttgctcacccggtagcccttcagcttcggctccgtctggttcggcagcggcggcgcgtactccgggtacaccgagtagttacgcgtctggatgtcccgccgcgcgatacccgcggacgtcagcgccgcaatcaccttctccatccgcttcgcgttctgctcgc

SEQ ID NO: 372 - DNA, 1327 bp, Myxococcus xanthus
gatgccctgcgtgatttcggacagcgtccagtcgtagttacccgagttcaccaccgcgccgcagaacttttatctattgtccgcgccaccgttgaacggcgcgccgcagttggggcacttgccctggaacaggtccgcgccgatgcgcgtctgcgcccccggcttgcgcacgaaggtccagacctccgtgaaggcctcgctggggaccttgcgcgcggcctcggtggcctgcgcgtcgctgaaggacacgggcacgtcggtgtctcgcatccgcgcgtggacacggacgtggatgctgtcgaaccactggctctggtccaggccgatgagctggaggtccagcacctcgaagtcggtgatggcgtcccgcacgccctgcgcgcgcatgagctccagttgcacgccgaagcgctggaaggtggcgtccgacaggaagggccgcaccggcgtcatgtcccggaggaaccacgcctgctgcagctccatgaacagccacttcgtcttgtcgagcatcggctccagctcgaaagcggggtccttcagcttcagggcgttcacccagccttgcacgtcacgctgggacacctgggtgcgctgatacgcctcgcgctgctccagggccttccgggtggtggcgtccgggtgcaggttgcggcggtacagccagtatacgatgccgccaatgcagagcagcggcagcatgaccttggggtagcggaagaccaggctgaagagctggtagacgacccagagcgcgacgccgtccccgtcgccgccgccgcggccaccaccgttgccggacgaggggcgggagtagtgctcgccgccacctccgcgtcccaaggcttcgagcggaagcaggagcgccacgtaggcgatggcgggcagccagggggcccaccgggagagtcggtgcgagatggagcgcagaggcgtggccatgtccccccatgctaaccgtttccgccttgccagacccggcttatggccgcactctgccgcggctcagagcagcccgcctgccaggccgggaaaaggggagcgaacatgccggaattcaaggtcgacgcacgcggtcccatcgaaatctggaccatcgacggcgagagccgccgcaatgccatcagccgcgccatgctgaaggagttgggcgagctggtgacccgcgtgtcttccagccgtgacgtgcgcgccgtcgtcatcaccggcgcgggcgacaaggccttctgcgccggcgccgacctgaaggagcgcgccaccatggccgaggacgaggtccgcgccttcctggacgggctgcgccgcaccttccgcgcgatcgagaaga

SEQ ID NO: 373 - DNA, 3162 bp, Myxococcus xanthus
ccgcgtactcggaccggccggtgccgttggatggctcggtggcggaggtgctggctggcgcagtgggagacgcgtccgcgcgctgcgcggacctgggcttggtgacgccgccgtcgctggacggagacgcgaaggcgctttcgctcgtgacgtccatcgacctgctcgtgggggcccgggacgtggaggcctggagccgaggtgagtacgagttggtgatgggcgacgtgcacgacacggcgctggtgtggggctgggcgctccagttccacgaggcgcgcggccgggtggagagcgccatggtgcgggcgctcggcgccttgagcaggccggtgcccctggtgacggtgttggcgtcgcggcgcacgggcctgcttccgtcggagttcccggggcccgtggtggagctgggcggtgtcagtgcccgcgcctccgcgtggcggctgccgctggatgacctgttcgtggagagtgatggaacgcgggcgcggctggtgtcgaagcggctgggctccgaggtgtgtctctacaacggtgagctggacagtctggtgcacaccgccttctccctgccgcgcatccgtccgctgcgcgtgtcgctgggcgagcacacgcctcggttgaccctgggcggtgtcgtggtgcagcgcgagcagtggcggctgtcgcaggcggagcgggaggcgctgctcgcgggccgcgatgactcggcgagacttcgcgcggcggtgagcgtgtggagcgagcgcgggatgccggactgcgtcttcgcgaagttcaaggacgagcgaaagccggtgctggtggacgtgcgcagcccgccgctgctccgcgtgttcctcaacctgctggagcagaaggaggaggtcatcctgtcggagatgctgccctcgccggaccagctctggctgcgaagtgcctcgggtgggcgccataccgtggagctccgttgcacgctgatgtggggctcggagtccgctgccggagcgcgggaatgaggctgctcgtcctgccacctcaccgcgacgtgacgctcgtgccagaggcgccggaagggtggcagtgtgtcgacgtggcgcgcgacttctgccggcgcgtcttcgcccacgacgcggtggaggccgccgccgccgcacgcgagcgagcgcccgcgaccgcgcagacgatgcgagagctgctgctgttgcgtgccgcccagtcgctgcatgcgcgtgcggactcgagtgtgagcacccgcctgcgagcgctgggggcggtgctctccgccatttcggggccgcccgacggggtgcacctccggctggacgatgtggagctggaaggcggcacgaccgagcggagcgcggacgtcttgcgctccttggaccagctcgcgtcgtatcgggaggacctgaccctcgccgctgctcgcttcgctgaggccgagcgcgtgcggctctggctcgaacgcgacctgcaactgcctgccgcggcctggctggcgcgggcctgtccggagcaggtgccgctcgaagtcgcggggcccttcgcctgggcgcaccgggccgtcctggctcaactgtccgtgttccagcgcgccaacttcgtggacgcggccccacttcgctggcgcgtgtcgcccggattggatgaggcggtttccacgtcacgcgtctggctttccgaggcgctggacgtgagggccacccctccggacacggtgcgcgccctcacgggaggcgcggaggcgtgggcggggcatgtgtcgctcgattcgctcctgcatccggaccgtgctggtggaagagcggctgcaagggtggcccgtccgtgggggttctttgcgccgtggacagcgacgcctggctcgaccccttgggtgcgcgcgtctcccgagaggcgctggctcagggcactcgccggcttcgggacgcgggggtccacctcgtggcggagtggtggatcggcgcgcccggcgtcgacgaagcggacctcgacgcgacgctcgctgtgctggacgcggagccggtgttcgacacgctcgcgggagtgcgtcccttccactggccgcggatgccttccgaaagtggccgcccgctgctgtggccagacgtgaaagtcggcgcgcctcccgacgaccgggacctcgcgaggagccggcccttcgagcacgcccgttccattgccagtgcccgtgttccgcaggtgcttgctggactcgcgacgcggctgctcgcgcgagggccgctgaacccgggccgggtcgccgccgcgtgtcttcccgaggtgtctcggccccgtgcaacggacgtgagcgcagcggccatccagctcgatgcggactgtgcatgggtccagctcccggcggggctggatggtgctccgaagccgtcgtggttcgcggcgaacctccgcacgggctcggtgctcgcgatggacgcgcggctggcgccgaagctcgccggcctcgttcggcccatggaagtggccagcgtgctgggggccgttccccaggcgcagcgggagaagctggtggacacactggtggccaggtcggtgctgacgagggtgaacggatgagcgagccctggacgttgggcgaggtattcgtgctgcggcacgcgggctttccctttgactggctggagtcgctggggatgtctcaggcggtgctggatgacgtcgcccgcttgctcgaggccgaggacgcgctcgtggacgccgtgcgcgcggagaagggcgcgtccggcgcgcaagccctcctcgatgcgctgtcccaggggcgggagccccgaatcgacgcacggctggggccctcgtgtcaggacgcatgggctcgctaccaggagcgtcgcgagtccgttcaggcgggttacaccgcggaacgaaagacactgcgacggcaactgcgagagcgagccgcggatcccgccatccaggaggccgtgttcctctccagcccggcgatgttcgacaacgtctgggtgcgctacctgcgcggcggggagcggccggacacgtccgatgcatgccgggtggagcggcaggtgtacaccaacctccagagcttctgcacgaagaacgaaacaaccagcttcttcggccccatttcatacggcgagcgaaccaccgaggacggctacgacgtgcgcacggtgcccagcgcacaacacgaggccgccg

SEQ ID NO: 374 - DNA, 1550 bp, Myxococcus xanthus
acgccctgatgctgttcgcctcggcgggcatgagcctgcttgcgatgtcgaacgagctcatcacgctcttcgtcaacatcgaggtcctctccctctccacctacgcgctgacgtcgtacctgcggcgtggcacgcggccgagcgaggcgggcttcaagtacttcatcctgggcgccttctcgtccgcggtgctgctctacggcgcggcgctgctgtacggcgccaccggcaccacccacctgacggccatggccggtccgctgtccaccgccatgtcgtcgcagccgggcctggtgtacgcgggcatcatcctggtgatcacgggcttcgccttcaaggtcgccgcggtgccgttccacatgtggacgccggacgtctacgagggcgcgccgacgccggtcaccgcgctgatgagcgtgggcgtgaaggcggccgccttcgcggcgatggtccgcgtgttcttcatggtgggcaagggcgtggacccgcagatgctgctgggcctgttctccgtgctggccttcctcaccatggtggcgggcaacctgctggcgattccgcagcgcaacgtgaagcgcatgctggcgtactcgtccattgcccacgccggctacctgctggtgggcgtggccgccctcttcgtcaccggcccgggcgagcagttccgcctgctgggtgcgtccgcgctgacgggtggcaccccgctgggcctggcccgcgcggaggcgctgcgcggcatcctctactacctgctggcgtacacgttcagcgcggtgggcgccttcgccatcgtctccgtcctggagcgtcgcgaggacgaggagaagggcaccgcctgggacctggagcgcttcagcgggctggcgcagcgcaagccgggttgggccttcgcgatggcggccttcatgctgtcgctgggtggcatcccgcccaccatcggattcatgagcaagctgctcatcttccaggccgccgtggatgcgggcctcatcggcctcaccatcgtcggcgtgctctccagcgcggtgggcatctattactacctgcgcgtggtggtctacatgttcatgcggccggtgccggagggcgcgcaggcgctcgagaagagctggtccaccgaactggcgctggtgctgtccaccgcggcggtcgtgattctgggcatcatccccggtcccatcatgggctggctggagcaggccagcagcatcttcggccagtagcctcccgcctccgctgtcacaccccgcccgccccggcttcgtgctcgggcgggcgtcgtgttttcagcgcccgtgaatcagggcgccgcgtccaccagcaggccgcgaagctccagcgtctcgaggcgcgtctgcgctcccgcatcccggaacaggtgcaccaggggcgcgtcttccgccaccgtgacattcagcgaggacgcgccctcctccaactggccgaaggcctcttcgagcagtgtccgcgcatgcccgggagacaccgcgaagaagggaaacaagctaggaccggggcgcaggtccatcatccccaactgtagagcacac

SEQ ID NO: 375 - DNA, 1811 bp, Myxococcus xanthus
gccggcgcgaaggtgtccatcatccccttcgaataacccactgcctcacggccggcgcaccacccggtgcgccccgcgcagcagcgacagccagcgcgcccccgcctccagcgcggggccctgcgcctccgccagggcgatgggcaggtgcgtctgcggtgacacctcgtccagggacgtcgggtccaaatccaacgtcccgcccttcgacagcgccacgcgcacccaggcgtgggggcgcgccggcccgccgtccaccaccagcagcccgtgcaccagcgccaccttcacgccccgagcacgggcccccgccgcgaagcgcagcgcgtgcgccaggcacccgcccgcctcgccctcgccgtcctcgctccagtccgcaccaccgggcgtcttctccgggaaggccgcgtggacctcggcagccagcgcccgcgccgccgccgcattccacggcgtcagccccgccggccgcgctggaacgtcgagcggcggctccagcgacagcgcgcctcgggccccctccacgggcagtccgtccgcgaaaagctcgggaggcgcgcgcagccgctccccaggcgcggccacggtgaagcgcgagtcgcccacctccagcgcctccatctggccgtccgccccatagcgggcctggaaggccgtccccaacaacgttccctccacgcgccggtcctccacgcgggtgacgcagtgtgggccctcgcggcccgtcagctcctcccgccccacgacacaccccacggcgggcacgcccttccagagccacagcgcctgcggcaccgccggcgagccacgcacccgcccctgggcattcaccgccagggactgctcccggcggcgcgctcccgcctttccggcgcgggtgtgcaggtgctggctgacgtaggtaaaacggcccggctccagcttcagcgtcaccgtgcctaccggcacgccgcgccaggcgaagacgtaacgcgtggaatccgcctgggacgcgggtggcgcgccagcgctaccaggattctctggctttaccgggagcgtcagcagcagcagggcaagcagggtggccacggccccagtgtgcggcgttttgaggaccggcgcgagaaggcggagtagcgttccactccttcatgggcgccaaacggtacctgttcacgttcggcctggcggcagggctggtctccgcgctcctcctgggggggatgctgcgagccgtgtccggggcgccgcttccgaatgccacctgggcggtggtgctgctcgccacgcccgcgctctatctggcggggggatacctcgcgtggttccgctgggcggcgcagcggcggcaggtgcgccggcaggtgatggcgcggctggcggagggcgacctcaccaccacggtggggccgcgctatgaaggccacgaggacgtgcgccgcctcatcctgtccctgcggcgcgccctggcgcaggtgcagcgggtgacggccaacctgcaccgcaccagcacggacgtgagcgggcaggcccggatgctgctggaggccgcgcggcggcagggcggcgcggtggagcgcacgctggaggccgtcagcggaatgggcggcagcctccaggtggcaggcaagcgggtacaccaactggaggtcttcgccgtcgacaccaccggcgcgctgctggagatgacggagcggctggagcaggtggtggactcgctggcccaggtcaacaccttcgcccacaacaccacgtcgctgatgcaggccatggccgaacggatggccaacatcgccgcgtccggtgacgaactgggccgcttgagagca

SEQ ID NO: 376 - DNA, 2291 bp, Myxococcus xanthus
agcaggcggcccctcagtcctgagtgggatgcgccggcggaagggggacggcccacccctccaccggaacattcccaccctgttactcctggtggggcacgtagacagcgacgccgcgcggcgggacgacgagcaccgtctccgtgccggtgagctgcagcgtctgcccggagaagatgtccacgtaggtgccgctgctcgcggccaggcttcccatcaactccaacaccagtgagcgctccacggcgctccggttgatggccaccagagcacccttcccgttcggcagatcgcgctggaacacgtagaggtcgttctccacgcgcagggtccgccgcgcgcccgtctgcagcgcctcgtgcgcccggcgcgcctgccccagcttccgcacgaagtcgagcaactcccgctccagcggcgcaagcgtgctgccgaaccgcatgaagcggcggttgtccggatccgccgcgcccggcaggccgacctcgtcgccgtaatacaccagcggcacgcccggctgcgtcagcacgaaggcgaagccgtacttcatcttctctaaggcggccggatccgtcaccaccgtggacgggcggttgggaccgaagggatcactccctccctcgtgcagttgccccgcggcctgggagatgaagcgcgccacgtcgtggttgcccaggaagggcgaattgagcgttcccggcacataggcctcctcgttggcgcgcacggcgtcgtccacacgctgcaagcccttgccgtccgcgaaggcctcgcgcacgggccagtacagggggaagtcgaactgaccgtccagctcgcgtgggctgatgtaacgggcaatctgagggcgcccatccgtgaaaacgtacgtctcgcccaccaggtagaactcggtgcccgtcatcgcggtgatctccttcagcttcccgcggagggtgcgcccggccacctgctccatgtgcttcaccgcgtccatgcggaagccgtcgaagtctgcctgctccagccaccagagcgtgtccgcggcgaactggtccacgaagtccgacgagcgccagttgaaatccggcaggtagtccgtgaacttgcaggtgaggcgcttggcttcccagtcgcagtcctgcgttccacacacgcaactggcggccgtgttgaaccagccgtctcgcgcatggttcgcccaatacgggtgctcctcgtggacatggttgagcaccaggtcggcgatgacgcggatgccccgcttgtgcgcggccgcagtgagcgtgcgcagctcctccagcgagccgaagcggtgctgcgtctcgcggggcttcgacggccagtagccgtgatagccggtgtagtacttaccgccggtgccgatgaagcgcccctcggggttctgatccacgggggagatccacagcgtgcggatgcccagcgcgtcgaagtacccctcctccagcttctgggtgatgcccgcgaagtccccgccaagatagttggcgatggggtccacgtccgccaccggcgcgtcgttctccagccgaccattgtggaagcggtccgtgaaggcgaagtacatcagccccgagtcccagcggaagcgctccggctctacccagaacggcagatagagcgactccgcctcgcggccctggctgtccttggccaccaccttcacgtggtgctttccctgctccaggccctgcacgttcaggatgaaacggccggaggcggcgtcataggcgtccggccggggcgtgccgtccagcgacagcaccatgccatctaccgccggacccgccttgtccgtcccatcgaggtaggagacggccacgtccagcgagccctcgggcgtcaccgtgaagcggttcagctccagcacgggctggcggcagtccgggacgatgacgcgcgaatactcctccgcgcgaacccagcgcgagtacgggttctccgggtccatctcctgcttgtcgcccaccacgaagcggtagccgtaggcgcgcggctccagcccatccaggcggagcgtgaacacgccgtcaccccggtcggtcatgggctgagacagggcggcgaagttgttccattcccccatgacccgaacagtgcccgccacggactgctgcggtgcgtaggtcaacgtcacgtcgcaggtccggattgggatggagtcagactcaccacatgcggctgccatcagcagcgcagggagcgtcaggcgtcgaggaaggcggaaacgcttcatgcgagcccccttgtacgggaggctccctcgcttttccaagccccggcggggagcc

SEQ ID NO: 377 - DNA, 1281 bp, Myxococcus xanthus
ggccatgcaccgaactcgtaggtgcgcagctgcgcctgcacgcccagcttccgcaagtcccgcgccaccacctgtccggcgcgcacccagtcggaccagccgcccaccacctcgatgtccagcgcgagcggctggccatccgccttgcgccgcagcccgtccgggccttccttcaagcccgcctcgtccagcagccgcttcgccgcctccaggtcgtgcttcacccaagcaccctgggccgcgtccgcgtcgcgccacgtggcgtacgcgtcgttgagcgcggtggcgtccgccggccgcgtgtagccgtacatggcgatctccaccagccgctcgcggtccaacgccatgctcaacgccttgcgcacgcgcacgtcgtccagcggcggcagggtggtgttggggtagaggaagacggtgctgccgtagagtgggaaccagcggccgtggtgcgccgggtccctggcgacgaaggtgcggtccacggcggggacgaagttgcccgcccagtccacttccccttccaccagcgccaggttggcctggtcattggtggggaaggccaagaagcgcagcgcggagacggcgggcttgccgggctgccagtagtacgggttgcggcccagctcgtagacctggttgcggaagacggtgacctcggtgaagggcccggtggccaccggctgcgggttggtgaacgtcaccgggtccgccaccttctcccagacgtgccgggggacgatgggctgctgcgccagctccgcgaagccggggatgtagacgcgggagaactggaaggccaccgtgtgcgcgtcctccgcgcgcacgtcctccacgaagcgccacacgccgcccgcgtccagcgccgcgtgctgctcgagcaactggaaggtgaaggccacgtcgtccgcggtgaaaggtcttccatcggaccagcgcacgccggggcgcagggtgaagcgcagcgtgcggcggtcctcggaccacgcgtggccggtggccagccagggcgtccactggcccaccgcggggctgaagatttcaaggcactcgtagacgcccgcgcgcgtgggccaacgagcgcccgcgcccgcgaacagcgggttgaagttgcgcacccaggtgctctgttgctccacggagacgaacagcactccgggcggccgtgggcggggttccaccttgcaggccaccagcaggagtgtcagcgcccagagcgcgaccctcacgtgggcctcgcgtagacgcggacgtagtccaccttcatctgctgcgggaaca

SEQ ID NO: 378 - DNA, 1660 bp, Myxococcus xanthus
gagcgccccgctccagcgcttcctccaccgcggcttcggccagctcggtcgcaaactccgtggccatgagccgctcgacctcggcgtcggggccggcctccgcgcccagcgccgcgtccaccgcggcggtggcggcggcttcggccacgtcggctgccagggcttccgccaaggcaaggtccacgtcgcgctgcttcggcgtggggacaccggcatcgttcaccgggccgggggcttgtgaatccagcgtgagcggcgcggacaccgcgggctcgcgcaggggacgcacggcgtcgtccgcgccgtgggcagaagtctggggggcctgcggcgtccgcgcctgctgggacggggcgggttcgcgcggcgacagcgcggcgtccgctgcctcagtcctttcggcctgcggcgcgggagcccgcggccccgatgcctgcgccggaggccgggcagccgcggcggcgcccttcatgcctccggccgccttgcctcccttggccttcccggacgtcttcttgccctcgtgcttgcgcgacttcgcggcagccgccttgccaccggccttcgcgggcgccgtcccgccaggccccggcttcttcttcgtcaccgtctccgcggcggcggccttttcctcgccacccggcgtggaggattcggtggggcgcggcgcggcgccgcgcttgaagggatcgttcccaaggacacccttggccatgactagctcctcttcagcgccgcagcggcgtctctgacatggtggagggggatgaaaccgagtgcggactcggcgcgctcgccgtccgcgacccatgagtaatggatgtagtcgagcagggccacgggcaacgtgcccgcgcccacggcgtccaacgtatgcaggccggcccgaaacaagggccctggcagagggagcggccgtgcgcccgcctgctgaatgaggccggagatcggcatcaccccgcggcccacgatgttgaactcaccggacgcgtccgcgcgcagggccaggtgcaaggcacgcgcggcgtcgtcttcgtgcagcccctgccagagcggatcgaagcccatcagcgtgggcaccacgggattcttcaagaagcgcgtggccgggttgtccaccgagggcccgagtaccggcgcgaagcgcagcaccagcacgcgcatttccggatgccgctcccggaaggcgcgcacctggccttccacctccaccttgtcggtgacgaagcggctgtgcgggcaaccctggagcgccgagtcctcgcgcagcatcgcggggttgttcccgcgcgcgccgtagacagccgtcagggagggcaccaccagccggggcagccgggagcggcccgccgccgtcagcacgttcatggtgccgatgacttccagctcgtgcgccagggagccgttgcggatgggtccgaacaggaacgccaggtgatagagcgcgtccacggggcgctcggtgagcgcgtcggtgagctcgctctcggcatcgtaccgggtgaggtccacgcggtggaactccaccttgtcgccctccggacggacgacgtcgagcacgaggatgctctccacgtcgggatcctggtccagccgagacagcaggagccgcccatagtcgccgctcgcgcccgttacccgcgatgcgcagccgtccctt

SEQ ID NO: 379 - DNA, 1785 bp, Myxococcus xanthus
ccctcaacgcgaggtgtcattcggggttgactcaaaaatcagtcgccgccacacttcctgcgtctcaacgcgccgctgacctcatcctttttcaccgagggcgggcagcgagccgtcacgcaggagtggccatgtccgccgggatcaacacctacaagaccgaccttcgagagatcttcttcacgctgttcgagcagttcggcttcggccaggtggccggccaggcgccgttcgatgcctggggtccggacgaagcgaaggcggtgctgtcggagacgtatcgcttcgcgcgcgaggtgctcgggcccctcaactcggtgggtgaccgggagggatgccgggtggagaacggcgccgtcttcacgccgacgggcttcaaggacgcgtggaagaagctctacgagcagggcttcaagacggtgggcgtgagcccggagcacggcggccagggctcgccgatgatgctccaggtgacggtggaggagctgctgtcgggcgccaactcggcgttcaacatgtaccccggcctggccttcggcgcggcggaagttgtcgcggagtgcggcacgcccgagcagcagaaacagttcgtggagcgcatgctcaacggcacgtggggcggcaccatgtgcctcaccgagccgcacgccggctccgacgtgggcgcggccaagtcgacggcccgccgcaacggcgacggcacctacaacatccgcgggacgaagatcttcatctccggcggcgaccacgacatgggggacaacatcatccacctcgtgctcgcgcgcattgacggcgcctcgccgggcaccaagggcctgtcgctgttcatcgtccccaagctgcgcatcaacgcggacggcagctcgggccagcccaacgacgtgggcgtgggctccatcgagcacaagatgggcatcaacggctcggccacctgtgtcatcaactttggtgagagcgacaactgtgtcggcgagctcgtgggcaccgtcgagcacgtcggcatgagccagatgttcaagatgatgaacggcgcgcgcatcgccgtgggcatccagggcattggcctggcgtccgccgcgtactacaacgcgctggactacgcgaaggaccgcaagcagggctcccacttcaccaagtggaaggaccccaccgcgccccgcgccgccatcatcgagcacccggacgtccgccgcatgctgctggacatcaaggcgcatgtggagggcatccgctcgctgatcatcaagctggccatgcacctggacaaggcgcgccaactggccggcaaggatgacgacgcggccacctaccacaagggccaggtggagctgctcaccccgctggtgaaggcctacagctccgagcaggcgttccgcctgtgcgcgcaggccatccagatctacggcggcgccggctacatccaggactacccggtggagcagtacacccgcgactcgaagatcttctccatctacgagggcaccacccacatccaggccatggacctggtgggccggaagatgggccaggcgggcggcatgcacttccagcagttcatgggcgacgtgggctccttcatcgaggcccaccgcgagcacgccgtctacggcgaggccgtgaagtccctggccgcggcgcaggaggccctgatggccagcgccatggtggtgttcggctggtcgcaggacggcagcaagttcccgctgattccgctgtccgccaaccgcttcctggacatgatgtcccaattcgccagaggctggctgctgcctttagagcaca

SEQ ID NO: 380 - DNA, 1584 bp, Myxococcus xanthus
tgctctacagcccgtcgagccccggcggcaagccgtcacgcaggagcggcaggttcgcccccgagcccacgcccacctccagcacccgcaccgggcgcccgtcctcgtgcggcgtcagcgagccgagctccacacggcgcatgtaccccgcgcgcatccgcgcttccgagacagattgaagcagcggtgtcagcagcgtcgtcagcgggtcatgcaacaccggcagcccgtcgtagatgacgcgcatcagccggtccgtaccgcgcaccgcgtcctcgcgatacagccgcgccatgccgcgcgctacgctccatgcctccccgcagccaccgcagcgcagccacccgtcgcggatgcatccatccgtctcgagcccgtggaacaccagcgccccaccacatgcgggacacgccagcaacgccacgtcccggacgcgcacaccgttcatgaacgcgcgagcgcctccgcgcgggcctgctcatcccgcatgcccagccgggtgaacaactccaccgcgcgctgctgatggacccaccgtgccgggtcctccaatggcaggtgcctggccagcgccacccgcgcgtgggcctcctcgaaggactgccccttcctcgatgcgacagcgacacaccggcgccacgcctcgaaggcccgcgtggcgtcgttatccagccaggcctcctgcccacgccacaagcgcgccgcggcctcaccgaaggggaacaccttggcgaagacctccgcctcccggcgcgcggccttggcgctcgccaccagcgaggcatccgtgccccgctccaacagcgtcaggagcacctccgccaccgtcatcacaccgaagtagacgaagtgcgccacgggcttgccggacgacattctcgccagcgcctggtccgccgcggcccgggccccttccgcgtccccttcacgcagccgcaacagcgccagcgtcccctccacgatgatgcggtccgtctgcccaccctgggcttccgtccacgccagcgtctgggtcagcgcggcgcgggccttcgcgtagtcgcccaaccgtaaatggatgtgcgcctggtagtgcagcgcccagtgctccgtctggagcgctccgcgccgccgcgccgagtgctccagccactccatcagcggcagcccccgcgcgaacttcccctggtagcacgacaccaccgtcagcagcgcgcggcactcctccgccaaccgcacgtcgcccaccgagtcgacgatacccatggcccgctccagccacgcctcggcctccgcccaccgcgccacgtacgcgccatacacggcgttgcgacacagcacgaaggccaggtccgcggggttgcccacgcgctcggccacctccaacgcgcggcgggaccacgtctccgccaccgaccggatgggcagcgtgcccgccaccaccgccatgctcgtgtagccccgcgccagctccggcgacgcgcccgccggctcgcacaggttcaacgcacgcaggccggaccagagaacgggcagcgcctggtgcgcatagatgaacgcatcgagcagccgcatcaacagccgccccgccacgcaccgcatccg

SEQ ID NO: 381 - DNA, 1344 bp, Myxococcus xanthus
ctggcgcccggcccgggtccatccaggctgacagccgggtctgctgctccggctcggacaggtggatccagtcctgctcgtcccacggcagcacggacctacggttcacgagctggagcggcgcttccagttcctcacccacgaagctggtgcggaggatggggtagcgcgccatcacctgctgccaggcctcgcgcagcgcctcgcggtcgaggtccgtgtccaacgtccacgccgcgcgctcgaagtacatccccgagtcggggtcgagcatggcgtggaagagcatgccctgctgcatgggagacagcgggtagaggtcctccatctccgggtatgactgcatcaggccgttcagcgtggcctgcgtcaccttcgccagcgggaagtccacgggggagaaccgcgccgcgtcctcgccgcgccgctggtccaccagggcccggagcgcgtggacgtagccctgcgccagtgcgcccaccgtggtgcgctggtgcagcgcctcgctgtaggtgaaggacacctccagcttgccgcccaggacgtgtgcattcacctccagcacctgccgccgctggccgagcgccccctgctgcgcgccgaagggctcgtccgcgggcgccagcagcgacgaggtgggcagggccgagtcgagctggcccaggtagttgaaggccaccggcgcttccggctgcgcacggagccgggtgccttgctcgtcctggcgaaggtaacgcaccagcccgtagcccaggcccttgcgcggcacctgccgcagggaatcacgcacagcgcggagttcgtcacccacgctgccatcccggggcagctccagcgtcaccgggtaggcgctggtgaaccagcccacggtgcggctcaggtccacgccgtcgaacaggtcctcgcggccgtggccttccagttggacacgcagccggcgctgtcccgtccaggtggagagtgcctgtgcgagcgccgtcagcagcacctcgtcgatgcgggcacgccaggccgtcggcacctcctgaagcaggagccgggtctcctcggcgtccaacgccaccgtcaacgtgcgtgcggaggccaaggtgttgtcgccgtccgtggtgtccacggggagcggcgctgtgtcttcaccctggctcagccagtagtcggcctcgtgctccagctccgtgctggccgcgaaggagtccaagcggcgagcccaggcctggaaggacgtcgtcttcggaggcagcgccaccggctgcccctggccgagctgatggcacgccgtctccaggtccatgagcagcacgcgccaggacacggcatccaccgcgaggtggtggatgcttgaga

SEQ ID NO: 382 - DNA, 1707 bp, Myxococcus xanthus
gcccacggcgctcgaggcgcgcagggacgttcttaccaccaggggactccgtgtggaaggcgtctgatttggtcctgagcttcccgcgtacccacccggttctctggaaggctacgactcgcggcttgcgtacgcgctgggaacacgtcgctacgcgctcatcatctccctgcgaaatctcccggcaattccgaacagcgagctgttgaacgacgtggactgtggatattgccatacggcgaatgcggcctgtcgaggcgcgtcaatatccatgtctgccgttggaattaaaatcgggcatggaggggttttgctggatgtcatttttgacacgcctggcagacaggtggcttgctcgactttgtgtttgggctgcgcgtagactggccgctgcgatgtagctgtttgcgggaatagttcgctgcccgagggcaaggagcgtttgccgcaaagcgttgcatcgcgatccgaccctctgagtccactacaacccagggaatcacatgttcaagaactgcatcgcccgtgctgcgattcttgcgaccactgctgtccttgccaccggctgtggctccgacgttccagaagaaagccttgaggctgacgcgctcggcacgcgcagtgacgcgctggagagcatccagttctggcacgactttcgcgcgtacagcggcgtgtcggacgagtgtaacggattcaatgtctccgaaggccggggcctggggcagtggacgagccaggttcgcctggacaccgactcccggccgcaggggtgctggcagaagttcggcatctatgacccctacggtgagctgagcgggctgtcgctgacggtcagcttcttcgggcagggcaacccgacctccaacgggcagtgcgacaacccggggacgtacgtcgtccccgtgggccctgtgctcaactgggccggtccctggggaatcgataccaccgacgcctatggtggctgcgtgcagacgttcagcatctccgggcgcagtgacgtggcgctggatgtgcggttcgacgcggaccgacacaatggtcagtgcctgaacgctgggatgcacacggtgacttcgagcaatgccgtcaccctgacgctcgacatggacaatcgtttcggcggttgctaccagaccttccggctccggaagatgacgtgtggcgacaacatctgtgaggccggtgagacctgtccggccgactgcaatcaatgcggcgacggcatctgcaatggctcagagaaccgatttacctgccccgaggattgcagccccgtcatcccgggcgagtgcgcgattttctgcccgcccgagttcccctgagcctggctgcacggagagggctgcgtggccctctccgtgcctccaaggcacgctctggtcaggacccgcgttgttcagtcgggaaggtttttgatgacgtaatcgcacgcgtccccaaccgttatgatcttctcggcttcctcgtctgggatttcgatgacgaaggtgtcctcgagatccatgacgaactcaatgtggtcgaggtagtccatccccaggtcctcgatgagccgggcttcgggggtgatcgattcgaaatcggcacccgaatgatccttgacgatcaactttacgatgtcgcacacgtacggcacggagttgatggagcgttgtccgacgagttgagcggcttctgccggaattgcgctggacgtgaacc

SEQ ID NO: 383 - DNA, 1841 bp, Myxococcus xanthus
ggagagccggtcgccgggaggatcggcccgctccccgctcgaacaaggccgggcgcatcaactttccctcgcccaggtccaggctctgatggacctccgcacccacggactccaatgcggcgccctgctccgcctccagcacggaagacaggtccacgcgccttacaggcactcgctcgggcacgcccgcgatggactgacgccagccttccggcgcccgcgtgaagcgcagccggagcgcatcatggtgcgacaccagcgcccgcaacgcctcctccagcagcgcggcatccaccgggcggcgcacctctagcaccgcggccaggttgtagtggtgcggctgaggtaacgcccactcgtcgaagaagatgcgctgcatgggcgtcagcggcacgggcccctccaccagcccctgctccgccgtgcctgccttcgccgtcccggcggcggcagccaactccacgagcgtctgccgctcgaagagcatggccggctccagctccagccccagggccttggcccgggagacaatctggatgcccaggatggagtcgccgcccagctcgaagaagttgtcgtgcaggctcacgcgctccacgccaagaacctgcgtccagagcgcggccaacgccttctccgcttccgtgcgcggctcggtgaacaccttcgcgttgcctccgcgcgcggcgtccggagccggcaacgccgcccggtccaccttcccgctgggtgacagcggaagcgcgtccagcgcgacgaaggcagcgggcaccagatggtcgggcaaccgttccttcatgaacgagcgcagcgccgatgcgtccagctccgcggcttgcacgacgtaccccaccagcctccgcgctccctgcgtgtcctcgcgcacgagggccaccgcgtcacgcacgtcggggtactggcgcagcaccgcctccacttcccccagttcgatgcggaagccacgcagcttcacctggaagtcggtacggcccaggtactccaggcgcccgtccgcgaggaagcgaacccggtcgcccgtgcggtacagccgcgcccccgcctctcccgagaatgcatccgggacgaagcgctcggccgtcagctccggccgtcccaggtagccacgcgccacgcccggtccgcccaggtacaactcgcccggcacgcccggaggcacgggctgcccccgcccgtccagcacgtacgcacgcatgttcgcgacgggacggccgatgtccgggcgctccacgtccagctcggtggagagcgtcgcgcagacggacgcctccgtgggcccgtagccattgagcagtcgccgccccggcttccatcgccgcgccagctccggcgagcaggcttctccggcggagatgactgtctccagcaagggaaggccctccggctccaactgcgacagggacgaaggcgtgagcgtcaccgtggtgataccccgcgactccaacagtccgcgcagcggcgctcccggcagcagcgactcgcgcggcgccaggtgcagctccgccccggccaccagcgtggacagcacctccaggacggacgcgtcgaacccgagcgccgccgcctggagcacacgccgccctggccgcacgtcatgcgcccggatgatggtgcccagggtgttgcagaggccctgatgcggcaccagcacgcccttcggagtacccgtggagccggacgtgtagatgacgtaggccagatgctccggcaacgaacccacgcgaggtggctccgacgggttgcgcgcgagctggcgtctgtcgccgtccagcgcgacgagcagctcgccaccccgcgggggagcaccgtcccgcgatgggcat

SEQ ID NO: 384 - DNA, 2775 bp, Myxococcus xanthus
tccagcggccacgcccagggcacggccaccgtgagcaggaccaccaacaccgcggtgagcggcgtgcccaggcggaagaagtccgtgaagcggtagtgccccggcccgtacacgagcacgcagctgggctccagcggggtgatgaacgaacagctggccgccagcgtcaccgccatggcgaagggccgcgcgtccacgccgagctgctgcgcggcgttgatggccactggcagcaccaccagcgccgcggcctggttgctcatcggcgcggacaggacgatggtcagcaccatcagcaccaccatcaccatgcgcgggccccccaatgcgcccagcgccgccaccctatctcccacgaacgcgcccgcgccgctcacctccatggccagccccagcgccatcatggagccgatgagcagcaccacgcgccagtccacgcggaacgcggtgcgcgggtccacgcagccagtggcaatcatcagcaacatgccggtgaggcccgccaccgacagcggcaccacgtccagcgagcccgccgccagcgcgcccaggaacagcaccaccgccagcagcgccttgccgtagcgcggcggctggtactcgtggccgctgagtaccgtcaggttgcccgcccgcgccagctcgtccacccggtcgcgcgcgccgcgcagcagcagcacgtctcccaccgacagcggcagcatggacagcgagcgctccccgaaggtgcggcccaggagctggagcttggtgacgcgctggatggcgggcttgcggtgcagggccagcgccaccaggccgtagcgctccacgaagagcgtctccttcaagctgcgccccaccaacgggctgtcgggcggcacgctggcttcgatgaggatggagtccttgtcgtgcagctcctcgtcggacagccgcacgtccgggcggatctggatgccgcgcaggtccttcacccgcagaatcgcctcgcggttgccctcgatgagcagccgctcgtcgccgcgcagccggtaccccggcaccgcggacagggcctcgccgtcgcggatgatgccgatgacgcgcagccccagcccctccgagatgtcccccagctccttgcccacgtagcgcgagtccggaggcagcaccgcctccgtgaggtagtcgcgcagcgtccagtcctccatggcaccgcggccctcgcgcgccggcagcaaccacggcgccagcagcaccaccccgaggatgccgacaatcgccagcggcagccccaccggcgccagctccgccacgccgatgcccggcatgcccagccgctgcatcgccgcggacatcaccaggttggtggaggtgccgtagaggaacaccatgccacccaacatggaggcgtacgccagcggcagcagcaccttgctcttgggcaccttggcgcgctgggccgcgccgatggccaccggcaggaaggccgccgtcgtcaccgtgttggagatgacagaggagaaggccgccaccgccaccatcatcgccatgacgaacgtctgatggccgaaacgggcgaagaaggccaaccgttgacccaccaactgaaccacgcccgtcgatgcgagtccctgcgtcatcgcgagcagcgtgaagatgaagatgacagtgtcgttgctgaacccctcgaacgcctgcacgggcgtgagcacgccggtgagcgccagcaggcacaccaccacgagcgagctgacctcgatgggaagcgtgtcgaacgagaacagcaccagcgcgacgacgacaacacccaggacgatggcgatggtcataaggcccgccccaacctgcattcgctgcgctgatatggcgagtgccgtggcgcactgcgccgtttacttctggatgaccggccgctgataagtggaattaggagcggcctgttcggtaccaagacgggcggtcggtcacaggttgcatttatgccccccttccagaacgtttggggcctgtctccagacctgaaccacgaggacgaatccatggcttcgacgcaagttgcggcggagggccagcaggcccccacgaaaaatcccacgctcctggcctgggtggccaagatggccgagatgacccagccggacagcatcgtctggtgtgacgggtccgaggcggagaagaagcgtctgacggaccaggcggtgaaggagggcatcctcatcccgctgaacccggagaagcgccccaacagctacctccaccgctccaacccgatcgacgtggcgcgcgtggagcacctcacgttcatctgcacgccgaacaagacggacgccggcccgacgaacaactggatggagcccgaggcggcctacaccaagctgggcaacctgttcaccgggtgcatgaagggccgcaccatgtacgtggtgccctacgccatgggccccatcggcagccccttcaccaagctgggcgtggagctgaccgacagcatctacgtcgtgctgaacatgcgcatcatggcgcgcatggggaagcaggcgctggacatgctgggtgacagcgacgacttcaaccgcggcctgcacagcaccggcgacgtggaccccgaccgccgctacatctgccacttcccccaggacaacaccatctggagcttcggctccggctacggcggcaacgtgctgctgggcaagaagtgcctcgcgctgcgcatcggcagctacctgggccgcgaggaaggctggatggccgagcacatgctcattctgggtgtcaccagccccaagggtgagacgacctacgtagccgccg

SEQ ID NO: 385 - DNA, 1498 bp, Myxococcus xanthus
gttccaccccgggcgccgcccaaccggagccaagagttagggagccgttcccacatcgtcaaccctggggcggtaattcttgccggaagtggcaaattccccatgcacggcgcggacttacgtccgcccgcgagtgtttctcaggtgacgattgaggagcgcgcgagatccgcgcggaaatgcccgtactgccccgcggtgcggggcgctcagacacccgaggcgggaggccgggcggcatcgcccagacccaccaggtccagcttcagccgggccgcgtactcgaagatgcgagggtcccggtagaactcgccgaacacgatgcgcaccaggcccgcgttggcgatcagcttgaagcacggccagcaaggcgaggcggtggtgtagatggtcgccccgtcgatgctgacgccgttggtggcggcctggatgatggcgttggcctccgcgtggacggtggccacgcagtgtccgttctccatcatgtggcccacgtcatcgcagtgcggcagcccgcggatggcgccgttgtagccggtggacaggatggtcctgccccggacgatgacggcgcccacgtgcttgcgatcacacgtggcgcgcgaggccacctgcgtcgcgatgtccatgaagtactgatcccacgagacacgtccggccatcccacgcctccagtccggcggatgtaccccgctcgcgcgcggtgtcgagattcctgccagccggccaaggcggacctgggacaccgcgcgaagtcgctaacgcccggcggagtgtgcgagtccaccctccgtcgcgggcttgcgcgccagcagccggccaaagcccttggcctggaggaagtggcgcaccttcgcgctgggtgcggcgaacgtctctccgggcatgggcacgtcgaagctgtagttctcctcctgcacctcgaagtccaccttcgcggtgcggtagccctcgacgatggccagcagccggcccgtcgtcaggctgaagatgccgccgcccgacgcgccgtagccgatgggggcgtccgtcttcaccatcttcgggcgctgggatgccttgtcccattcgacctgggacagcatgccgccggacagcgacagcgcgcggccgaatggcgaggcggccaccaccacgtcctcgcccagctccagctccgcgtcgtccgccagctccaccgcgggcaggtccagccccggcacgcgcaccagtgcgaggtccaggtcaggcacctcgcccatcgccaccacctcgccccggtgctccagcgactccgcgcggcggtccaccagcacgcgcagctccggagcctccatcccgtccatggccaccgcgtgtgcgttggtgaccacccaggcaaccgtggctccgttcgcgtcccgctcggcgcccaccaccacgcccgacgccgtgctgagcaccctgccctgcgaggccagttgcagccgcacgttgtgcgggaggatgcgccgcacctgctccttgcgcgtcatgcgcg

SEQ ID NO: 386 - DNA, 1315 bp, Myxococcus xanthus
gcccgccgccgtgcccgccgctcaggtccatgccggggaccgccaccacgagcaggctccggtccgggctgaggctgatgtggtggggataggtcatgtccttcaatcgaagggtgctggtgacctcctgccgctccacgtcaatgacgctgagggagttgctgccaccattcacgacgaacacggcgtccttttcgaggacggggaacgagttcgggtccttgtcggcgcagccactcatcgccagcgcagtcaggaagggcatcatccacagtgtcggcttcatgcgttccatttcgacggtcctttcggcggaatcatgtcgacggcatctacagaggcagtgtccggttgtgaatgcagcttgattgcatgtgttgcttagggtgactccttgaagtcatcggaacgcaggccaaagcgcttgaggagccggtggaggctctcgcgctccatgcccgcgcgttcagcagcccgcgtcacattgcccccgaattcccgcagcagggcgatgaggtaatcgcgcgatgcacggtcccgcgccaggtccaccgcctcccggaagggcatcttcaccagatggtctacgggcagtgctccctgttgtccgcccgtgacttcaggggggagtgcgtcagggcccactcgggagccagtggtgatggccaccgcgcgttcgatggcattctctagttggcgcacgttgcccggccaggtgtacccggtgagcgcacgcaacgcgtccggctccaggccatccaccggctgccggtaggtcttcgccgccttctgtacgaagtgcatggccagcagggggatgtcctcgcgccgctcccgcagggacggcagatgcaccgggaagacattgagccggtagtagaggtcttcgcggaagcggcccgcagtcacttcggccttgaggtcgcggtgggtggcggtgatgacgcgtgcgtcgatgcagcgcgcaaccgcgtctccgacacggcgcacttccttgtcctggagcgtgcggttgagcttcacctgaacggacaggggcaactctccaatctcgtccaggaagatggttcccccggaggctgcctcgaagagaccggccttggtctctaccgcgccagtgaaggcgccccgggcgtgaccgaacagctcgctctcgatgagttcggagggcagcgcgccgcagttgaccgcaatgaagggccggtccttgcgtgggccgtcgtggtggatgggccgcgccaccaactccttgcccgtccccgtctccccggtgatgagcaccgtgatgtccaactgggaggcgcgctcgggccat

SEQ ID NO: 387 - DNA, 2998 bp, Myxococcus xanthus
cctatgtgcccgaggacgtcctggctgatttgcgagagaaggtccctgcggccacgtccgtgtccctgctgcccgcgcatgacctgtatgtctcgtcgcatggcgggcccgcctgggtgacggaccccaagcaccatggcatcgaggttccgacgtggggctccgccaagggcggcaccctgggcgaggccgcccacatcttcgtccgccccgtgctggatgcggagcggctggtggggctgtgggagttcgacccgaaggcggacgacgtggtgttccacaccttcgagccgctggcgcccaagcggcgcaaggccgtgcaggccctggccgaggacacggccacgttccttcgagaggacttcagcctcgcgcgcagcttcagcctggacaacgaggactccgtgcagaagcgcgcggacttcgtgaagtcgctgggggagtaggccggagcctcagccctggagcatccgcgtgaagcggcgctgcatctcctcgggggacacgttctcgatgcgggcgttgagggcccagcgatggccgaacggatctctcaggtgcgccgagcgttcgccgtagaactcgtcctggatggggcgctccagggtggcgcccgcgtcgatggcacgctgggcggcggcgtccacgtcatccacccggaggttcagcgagcacgtcgtgcccccgcggctctgggggctcaggatgtcgtactccgggtattcgtccgcgagcatcagcgtcacaccgcccaggtccatctccgcgtggcccacgcgcccgctcggctcggtgagccggtacttctcccgggcgccgaaggcgcgtgtgtagaagtcgagcgcggcgggcgcgtccttcgtcaccagggccagggagaggcgggggccctcggggagcgtcgcggcggaggaggacgggttcttgttgttcatggagcaccttcctgggtgggggtggatgccaggaggatgcctccggcgcgctcgggaggattggacgaattttacttgggctccgttttcaccagccgggtcagctcccggtccagggcgcctgcgaactgctgccggtcctgagccgagtatccgtccgggcctccggtcgtcacgccgctctcccgaagctcctgcatgaagttccggacggagagccgctcggcgacgttctcctcggtgaagacctctccgcgcgggtccagcaccacgacgcccttgggcaccagcagcgcggcgagcggaatgtcctgggtgacggccaggtctcccggctgtgcctgctgggcgatgtgccggtcggcgacgtcgaggcccgcgcccacctgcacgctggagacataggccaaccggggcagggagagcgcgtggttggccacgaagacagtgtggaccttcacgcgctggccagcacgcaggatgatgtcccggacggggcccgggcaggcatcggcatcgacccagattttcatacggggacgactatctcaggatccgcgcgcggactcatccacggcgcgccgagcggccgtgtcttttggcccaaggctcagcgcggactccatgcgggcgcggtggttgcgcccggtgcgcacggccgttccgtcggtgcccaggaccagcaggtactctccctgtgacagtgtctccaactcgcgcacgtggtccagactgcgacgcgagcgcctggaaccgggcttcggcgagctgggtctggactggaaggggcgcgacctcggtgggccttccgggttcctgctcgtgcattgcgtgaaaggctgtcgggcgacagggatgccttgcacagcggtggggacgaacggcccgtgggcggagacaaaccgtgagaggcaatcccttgtggtcgtcatggcgcaatgcatcatccaggatggaagacgtcggctggggaggtgtggaaggactggcggtcgcatctatgatgacgcccatgcctctattttcaatgcgtgtcgtcattccaatcattgccatcgccctgctcacctcggcttgcggtaccgaagccaccggggaatgccaaggcaccctcctgggcacccgtgtgaaatggcccattgatggtgaaatgtcccggtggatccgcaatggctccggcgggaatgggcagcacggcacctggattgacctgagctacgaccccaagggcactgcgggtatgacgaggttcggcgtggacatccggctcgtgaatggggccgtcgtcagcggcgggccggtgacggtggcgttggccaacgaggacgggcagcggctggtgccggctgccgactcgctggtggtggactggctcgccagcgtggcgacacgctcgacgacgggctttcccgacacgacgggcatgccggtggcgggctcggtgaccctggacgcggtgaatgatgacttggccgcgggccgcttcgtctatcgctacagggatggcagtgagctgacctgcaccttcaacgtgcccgtcgccggagcgggccgctggctttttggacggggactacgacgacgatgatgatgacgattgaacccgactcatgcactgcactcgctcactcgtggcgagtgtcatagaacgagcgcatgaccaagaacacgggtggctgcttttgcggagcggtgcggtatgaggtgagcgcgccgctgacggcggtgacgtactgccattgttcgaagtgccgcaaatggcatgggcacgtcggggcctacgcggctgtggaccgggatggcttccggctcacggcggagcacggcctcaaatggcacaccgtttcgcccacggtgcggcgcggcttctgcgtcgagtgcggttccagtgtgctgttcgatgaagcgccttccgcgaagatgtcgatttgcgccgggacgttggagtcgcccaccggcatccgcgagaaggcgcacatctacctgggcagcaagggggactactacgacatcactccgggcctcgtggagtacgacaccttccctgggaagtgagcacttgc

SEQ ID NO: 388 - DNA, 1656 bp, Myxococcus xanthus
ctctccgccggagtgacgcccgggcaggacgtgctgtgggtgagcgagggcggagcgcagccccccgaggagctggcctctcgcttcaccacggtggaaggccccgtggagttcttcggtgactttcgtgggcgacggttgcacaccttccaggtgtggcggctgcgagcgcgcaagccctgagcgtcgacaacgggcgcagcgcctccacgcctggccaaccggccttgttcaccgacgggcagtctggccccctgcctttgacggtgccacgggtgagccctaggtttccggttccaggtgcggtggaggagccgatctctcccaggggcccgcggacctgcttccaggaggggcttcgccgtgacgcacgcattccagtcccctgccgcgccggatgacgtggcccggatgaaccgctcccggcggctcgtggtggaggccctgggctgcggactgctcgtggtcgcgctggagggcgcccaccacggcgccgagcacctgggcgtgagcgccacggatggacgcctcttcatgtccctgggggcgggcgcggtgctggcatgtctggcctacgtgcttcaaccgctcacgggcgcgcacttcaatcccgcgctcaccttcgcggatgcgctcgaagacggcacaccgtggcgtgacgtgccgctgtacgtgctggcgcaggtgggcggtgccgtcgcgggccggtgggtggcccacgtcatgtgtcatgagccgatgctcgtcggcgcgagtgagcccacggccagcttggcgcagttcgtcacggagctggtgtccaccttcgggttgctcgtcatggtgcgcggctgcgtgcggaatcgccctaccgcgattccgctggtcgtcgccggctatctggccgccaccgtctggttcaccgactcccgggccctggcgaacccggcgctcatcctcgcccgggcgttcagcacccgccccagtgccatgcactccatggacgtggagtccatcatcgccgcgcaactgctgggcgccgcgctcgcggtgctgctcttccgctggttgcagcggacgccgcgaatgaagcaggcccgcgtctggcccatcgtcttcgaatgctcgcggccggaggtcgcgcagcaggccgtgggcatcttcaaccacctggcctcgccccagcgcgcgcgggccacgacgcaatggcacgctggcgatgacacggacctgccaccgctcatcgtccggctggtgctcgcgggagaacccacagagccatcacaccctgacggtgtctcctggcagctgcgggtcccagccgacgcggtgaccaccgaggagccccggctccgcgcggagctccgagcccccatccgccaactccttcgaaaccggggctggctgcggctccatgccgtcggagacgcggcacgggaaggccccagcgggccgcggccctaatccagccggcggtgacgcgcccggaacagcgcgtcgtacagccccaggaagaggtgcccgcccaacgtcaggccctgctcaatctcggcggcccccgcgtccgtctcgtagggagcatccaactgccggtagaagccttccgcgtgctcttcgtcgaggtccgcgtgcgtggggtagtgcaccacctcgccgtgctggagccagccccgcgcg

SEQ ID NO: 389 - DNA, 1843 bp, Myxococcus xanthus
cagcggggcacgaaggccgccacgcgttaggttggccacacggcgcggagggtgcgcccggccacccttttcgccacctcacgtctgcggccagcgcccatgcccgcgcccgcctgaagcgagcggcgcggtggaacggtgtggcgtgtcacgctgaaccgtcagcaggtgtggcgacggagctcaggctcgtcgaagaagtgacggggcggggcctggtccacgagcatcccttcatcaaggagcagcacgtggtcggcgaccatgcgcgccagcgggaggtgctgcgtgacgagcaccaccgtgcgctcggcccgcagcatcagcagccgccgcgccaaccagcggacgccgtctcccgacagtcccacttcgggctcgtccaggaggaccaggggcgccttgttggcgatggcgacggtgagcagggccagccgccacagcccttcgggcagcagcgccaccggccgctcgcgcaggcggtccagccgcaccgccgccgctggcgcgcaggcccacacggactccagcgtctggcgcgcatcggggccgagcagctcgcccagtgtgcgggactccgcgggccggccttggggcaccaccgcctgcgccgatacgggaagggtgagctggccccgcacccagaagtcagcgccgtctccgagccggtcgttgaccagggcccgcagcagggtgctcttgccactgccacccgggcccagcaccacgctggcgcgccgccagggcaaatcgaaagagagcttcgcaagcaccgcgcgagggccatagccggcgcccaggtccctggcttgaatcacggcgctgcgctcctttcttgatgccggggggacggctttcaacggggggcggccagtgcctcctgttcgggaagaggcaccgcgccgtgttcgcccaggaggcccgtggcgagccgctccagtgtctcccgccactccgcgcgctccacggcggtgggattctcgatgcagtcgtccagcacgtcgtccacgcccaacaggggatgggcgagctccgccagccgctcggcgctcagcgaagggtccagctccaggctgagcaggagtgagcccagcagcgcctggtcgtgctcacgcagctcggggcggaggttcacctgcgtgagcagctcggcgaacaccgcgacgtcctgccacagcctccggccggacacggcgtcatggccgtcctgcccgcgcagccagtccagcaccgccgcctggagccgccgcagctcggtgcggtcctcgatgcgcaggtcctcgtagatttcccggcccgtcagctcggagaagcacaccgcggcccggcgcagcacgggcgccagccacggtgccgtgggctccgcgcgcgtgagcagcccccggcggaacagcacgtaggcctgacgcaccttcagcgaccgctccagctcctgggtgaggagtccttccagccggggcgtcagcccctcgtgcgcgcacaacgcacgttccaccgcggcggcgcacttgaagaggcggcgccgggcgctgccacacatggcgatgatgttccagggtgcctcggtggccgtcatcatccccagccgctccagccgttcgcccaggtccaggcgcgccatgaaggccaggtccgcgatgcgctgccgccgggtgttggccacgaagcccggcgggtcctcatcctcttcgtaatgggcgcgaacggagcccatcgcctgggcccccgcgaggacggcgttccgaagcgccggcacggactcctgcaagaggcgcggggcctcctcctgctcgcaccggcgcaggtccacctgccgcgccaggtgaatcgcgtccgtcagcgc

SEQ ID NO: 390 - DNA, 1343 bp, Myxococcus xanthus
tgacgactgggtcttcttcgttgggtatccgacggcacaagtacctcaggagctctttgaccaaaagctccttcaagtccagccggtgggataccagaccgaaacactggcaccagccaagtggcctacgatcataacaaccaacccgacagtcgacatatacatcgactacaatgacgacgcactccgcaagtcacagcccgtcaaaatgatccaccccaagggcatgagcgggggaggtatttggttggccaacctgatacctcacgaaggcatttggagccccgacaagatgcaactcatcggcatagagcacgcatccgacaatggaaagagctatgcacgagggactcaactacaacactggctaaggatgctcagagaagaccagccgtcattagccgccagcatcgaccaactattcccgacaatctaaacagatttcaagccaacctctctcgccgacccatgacgaaccaccaagagcagaaactccactcactacgacatcacacacttccacccactcacagcgggagctatggttgatgcatggaccagcacaaaagaggaccgagggaagtaccgcccgatgagtaccaagcactaatggaggctcccttcgcgcggtcgattcggcgagtgggcctcgtcgcgctgttgacggaggaagggaaggcggagggcaaaggaactgcctttttcgtaaaggtaggcaacaaatccctcgtactgacggcgagacacgtggtccgcatcgaacgcgacgacgcgccagcagcggtgtggccattcacgccccgtagcgtgcgattgatggtcttttcacgcgatgcggatctccaatcagagagtcaaccaatagggttccctctgaccgaagccgatatcctctgggaagacccgcgcctcgacgccgtggcgtttgctgctccggcagccctcgtagccaacggtgaatgcgacttcccggacgtaaacattgaagaggattttcgggctctacaaaatatccgagcacggccaagcgagattcaaactcgtctcccttgcttcattgctggattcccaaacctcacccacgtcgtcgacacgacccctcgaatggagcgtcttggattcctaagggcgcccgccttcatacaacgaatgcctgattcgacctgggacggcttaagctctcgtgctcctcaggttgaggttcgtttggagttcggagacttaagcccgatgctgcccacagggttgacgcctgttgcagcgcggtgggcgaagctcttgacttccgtgcctgaaaacgagcgaccgctcctcggtggattcagcgggggggcctgttttca

SEQ ID NO: 391 - DNA, 1245 bp, Myxococcus xanthus
agcagcacggacggcatatcattgttgtgcgtggggttcacctcgcccaggttcgccgagcgcaggttgcgcacccgccagctcgggtccacctcgcggcgcatgtcctgcgccagctcgtccagcagcgcccgcgccagcacgtcactgcccgggaagccggtgaagttgagcgtgccgtccaccgggttgggcccgtacacgtaggcctccgtccccgacacgttgcccgtggtggacgcgttggtgtgccacgccacgtacaccgcgtcctcgccctcctcgtgcagccacgcggcgaagcgaggccgggcggtgacgtccgcgttgcgctcgttggtcagcgcgttggcccccgtgggtgcgtacaccgtgaagggcgcgccgctgaactgcacgtggtagcgcgcggactcctcgtagcggggccgcgccaggggcgccatcgccgcgtcaccgatgacgccgctgccaccgccgaagcgcaccgcgtccagcgacagcgtgccgccctccgcggtgtcgttcagcgccaccaccgcgccggaatccgggtgctgccccgccttgaaatagaagcgccccagcagcacccacgtcccgccgtgacggcgctggttgacccggaagtggctctcaccgcccgcgtgcttcaccacgtagtgcgcgtccggcgcgcgcgtggggtcggccgcgtaggagacgtagacgtggtagctgccctccgcgggaatctccggcgtccacgtcgcgctcgcggtggcgctgcgcgcggaggccatcacccgcgtcgtgcccagcgagaagggctccaccgcgttgcccatgggtgtcggcggcgtgccccagccgggctgagcggaggactcgaagacgtcgccgtcctccgaatagccggcctgcccgtcgtcgacgatggacatgtgcccgttgaggtccggctcccgcaggggcaccacggtggcgccggcgcccgtcagcatgggcagcaggtactggttgaggacctcggcggagatgaggtcctccaccacggcccaggtgttcggccgctgagtggcccagcggttcagcggcgcgctgcgcgtgaaaccgtgacccgggctcaggtacaccaccttgccggagagcgcgcccgtgcgctgccgcgtctgcggcacgcccgacttcgtcccggaagcccccgtccggagctcgcgccggacgaccggtggctccgcggcgaacaagcggcgagtttcatgc

SEQ ID NO: 392 - DNA, 2178 bp, Myxococcus xanthus
gtgctgtggaccagcgacgccgcccgagtaccggccgtggccttcgggtgggaagccgccgcctgcgtcgcggtgggcgtctggggaacgaagactgcgccgagcttcgtcagcatctaaggcgtggtgccctcgagtcccggccgcgcgggctggaacgagctggtggccgcggaggcggtcgtccgaggggaggacgtcgtctcacgggcgttttcggtggtcgggcgagcgaggaggggcgagcggcgggggccgacgacgctggtcatgccgtcattatccacccagtgggcttcgcggttgcttcccccatgtatattttcgacgcgaccgtgaaagctggaaatccagcgatgtgacagagcgcggcattgtccaggggcaatgccgcggctcatgacaggatgccttgcgtgccgctttcgctgcctgtgttgctcgtcgccacgtttctcgcggccgcgccttcctcgtcggaagcgtcgtctgacgcgccggcgcaggggctcgcgtcggccatcgacaactacgaggacgcgctgattgacgaggccctggcccggcatggacgggtgctggagccggcgccggagggcaagattctggaagaggtgttggtggccaccgaggacgtggtggccgaaatcgaccccttcccggacttcctcaacatcttccatgcccggacgcgggacgacgtcgtccggcgcgaggtgctgctccaggtgggggcgccgtactcggacgtgctcgcccaggagtcggcgcgcaacctgcgcgggctgcgcctgttctccatggtccgcctggtggcggtgaaggggcgcacgccggactcggtggcgctgatggccgtcaccaaggacatctggtcgctgcggctcaacagtgacttcgcggcggtgggctcgctgctccagtatctgaagctgcagggcacggagcagaacttcctggggcgcggcaagcgcatcgccgtggacttcgtgctgcggcaggacaccctcagtctggggcagagctacaccgacccgcgtgtgctgggcagccgctggtcgctgagcgagtccatcgccgtcatccaagggcgggagacgggcaagacggagggctcgcgcggcaacctcgcggtgagccggccgttgtactcgctgtccacgccctggagcgccagtgcctccgtgtcctggaacgtggagaccaaccgcgtctaccggggcgcgtccatctggcagttgccatttccaggcgggcccgcggtgccctacgtctaccggaccgaagaggtggtgggcggcctctcgtacacgcgctcgatgggcacccgctacaagtggaacgtgggcggcaccgtgggggcctaccattacgcctacggcgcgccgctggcgtccggcctgtccccggagcagtcggagtggttcaaccgcaactacctgccgcgcgccgaggacgccggctacgtcggcctgagcctgcgcgccttcgacgcgcgttacgaggtgctgcgagacgtggactcgtacgtcctggccgaggacttccagatgggccactgggtggcggccaccctgcgctacgcgccgccggtgtttggcgagcaaagccacttcgtcgaaggcgggctggcgctgcgctaccgcctgcggctgggggactcgctcaccaccgcctccctgtcgggcgccgtccgccggccgctggggcctgggggcgcgtggaccaaccggcgctgggcggcggagttgattgaggtgtcgcccaaggtgctgggcgggcgcttcgtggcgcgcgggctgctggatgtgaatatcgacgacctgttcgaccgcatccacctgctgggcggcgccaacggcctgcgcggcgcgggcgcggatgcgtactccggccggcggctcctgctcttcaacctggagtaccgaagccgccccatcgtcgtgaagacggtgcacctgggcggcgtgctcttctgggactcgggcagcgccttcaatgaccggcccgccatggtgcacacggtgggcatgggcctgcggctgctcttcccgcagttcaacgtcctgcccttccgcgtggacttcggctacgtgctcaacgacgcccggccgccggtgggcagccgcttctccttcgcgggcgggcagatgacggacgtacggcccaacttcatgg

SEQ ID NO: 393 - DNA, 2006 bp, Myxococcus xanthus
ccggctggcgcgcggtgtgaaaggcgacgctggcggcggaagcctccgcgcgactgaaggcggcgcagcgcttccagcacatcgacgccgagcgcgtgcgcacgacccattcgcactaccgcgtgctggaggagaagaagcgggtcctcgtgcgcgacgccctggtccaccgctggacgcagcgccagcgcgagcggctgctcgcgggcacgggcggccggctcaacgggcagggcgcggagctccgccgacggctgatgctgcgaggagagcgcgccctgcgcgtgcgtcaggtcatcgccaccgggcaaggcatcgaagggggcgacccgctcttcgacgtccgccccgtgtggatggccagcccgcagaccgtggcgcaaatcttcccccgccgccccatcttcgacgtcgtcatcttcgacgagtcctcgcagtgccggctggaggaggccctgcccgtcctcacccgcgcccaccgcgtggtcatcgccggtgacccgaagcagttgccacccacgcgcttcttcgaatccgccgtggtgcagaacgctgagcaggaggccgaaagcgagcagggcctcttcgaggagcagcaatccgaggtggaggacctgctgtcggcggcgctcaacctcgacatcgaccagtgctacctggacgtgcactaccgctcccagaacgcggacctcatcgccttcagcaacgaccacttctacgacaagcggctccaggccattcccgcgcacccgtcccacagcgtgccccacgcgccattgcggctgctccccgtgggcggcacctatgagaagcgcaccaacctggtggaggctcgcgccgtgggctcgctggtgaaggagttgctctcacggccgcagccgccgtccattggcatcgcgtgcttcaacctcacccagcgcgacaccatcaacgacgtcctcgacgagatggccgccagcgacgcgtccttcgcggcgcggctggccgaagcgcgcgtgcgcaggggctcgggttcattcgaggggctcttcgtgaagaatctggagaacgtccagggcgacgagcgggaccacctcatcatcagcaccacctacggcccggaccggcacggccgcttctaccggcgcttcggtccgctgggcagcgcgggcggaggccggcgactcaacgtgctggtgacgcgagcgcgggagcagattcacctcgtcacctcgattccgcgcgagtcctaccagtccgcgccccccgttgaagcgggccggcagcccaacggcggctggctcctcttcgcgtacctgcgcttcgcggaggccttggagtcggcctatgcccaggacgcccaacgcgagcccgaggacaccgtgtccgaggcgtcgcggcccgccgagacagcagaggtgttcgtgaggcccacggacgcgggctcggccttcgcgcaagccctggcaggacatctggccacgcagcaccgcgtgtcctcggaggtccactggggcaatgacggcttctgcgtagacgtcgcactccggcaccccacccgcccgggcgatgtcaccgtcggcgtgctgtgtgacggcacgcgctaccccaaggccgcggaccgcgtggagtgggacctcttccgcacgggcgtgttggaaggccagggctggcagctcgtgcggatgtggacgccctccttcttccgcgaccccgagggtgccaccacccaggtcctccaggccgcgggcgacaagctgatgcgcgagccttccgcctcgcctcaggcggccatgtccgcgcggggcgtggtgcactgaggcgaaggcgacgtcacttcgcgttcgcctccggcaaccacaacacgccgagctccaactccaccgcttcaaagggctcggcgcggacgcgctcgtcgtctgaccacgtgcccagttcgagccaccgtcccccgctcagccggaacacctccagtgtccgcgcctgagggtccacgaaccaaacatgcccgacgccctcccgcgcgt

SEQ ID NO: 394 - DNA, 1621 bp, Myxococcus xanthus
ctctacagagctgctcatgagcgctgggtgcgcccgcgcttcaagccgaaggcctcggggcgcgagttcgacgtggcgcccacggaggataaccccgtcatcatcgccggcttcggccgcgtggggcaggtggtgggccgcctgctgcgcgccaagcgcatcggcttcaccgcgattgacgccagcccggagcagattgacttcatgaagcgcttcggcagccaggtcttctacggagacgcctcacgtctggacctgctgcgcgcggcccgcgcggacaaggcgaaggtgttcgtgctggccatcgatgacatcgaggcgtcgctgcgcaccgcgcgggccgtgcagcaacacttcccccacctcaccttgttcgcccgcgcgcgcaaccgcgtgcatgcctacgagctgctggacatgggaatcgaacgggtgatgcgtgagacgttcctcgacagcctggagatgggcgccggggtcctccaggagctgggcctcacgtattcggagagccggcgcgcccaggaacggatgatggaacacgacgagcgcctcctgcgcgagacggcccggttccaccgcgacgagcaaaagctcgtggagttggccgacaaagcccgcaaagagctggagagcctcttcgagaaggacgaagcggagcaccccgacagaaccgcgtgagccaccgcctgcctgactttctccagcctccctcgaaagtgacttcctgaaattcttgtttcaccctgggttgcatccacccgggtcgcattcctctgtcacggatgcaccctggaggcggtggccgcctcccttccaggcaacgggggcgacacgccgtgcgctgatgcctgcctggcatcgcgcggggcggagagcggggtatggttccatccccaccgctgaaaccgaagaggcatgccccccacccccgccaagaagcgccagcgtcccctggccgagccttccgccgaggcaccctcccccgagctgctgcagacgctcctggaggcgctcccggacgccttcttcctgctcgatgcgcggtggtgtctggcgtacgtgaatccagacatggcccggctgctcggcggcgcggcgcggctgcaggacgacgtgcgccgggtgtgcccggagctgctggagctgagccgtcacctgcacttcgaacagcccgtctccgagcagccctccgtccgctacgagcacgcctggccggaagcggagacctgcctcgacgtgcgcgtgcgcccggtggagggcggcctgctggtgcactgccgtgacatcaccgaggagcgcaaggggcgcgaggcgctgcgccgcaacggcgaggtgttccgcgccatcctcgaaggcaccacggacgccgtctacacgaaggacctggacggccgcttcacgatgatgaacgcggcgggcgcgaaggccgtgggctaccgcgccgaggacgtggtgggacgcacggacctcgagctgttcgacccggcggtggcgcgcaccaacgcggcgaacgaccgcgaggtgttcgccttcggccgcaccgtcacctacgaggacgcgcagccgggcgtggacgggccgcgcgtgtggctgtccaccaagggcgtgctgcgtgacg

SEQ ID NO: 395 - DNA, 2341 bp, Myxococcus xanthus
ctctagagagttcagcagcacctccaacctggcatcccggtagatgaggttgcgcgtgtagcgccctcgccggaagtgcaggtagggctggaggctggccggttccaggaccaggcccgccaggccttctcccacgccccccaggcccggcaccccgcccgccttctcccgaaggagctccacccattcgcccaggcacatggcgttcatggaagtgaagctaggcaaggctccgacacggtgctttccggcttgtcgggcggaggacggctcaatgcgtcgcagcgcacttgagggcaggtcgaccatcgagtaccagacgcccgcctcggcgaggggagcggggctcggtccccgccttgcaggtggcgcggcgacggaagcgtctgtcgcccgccgggaagctccccggcgaatggacgcgtagaagacattgtgaccttcccggactcgggctgccccagggggctggcggccagggggggaaggcgtgaggggggacgagatgaagaagcgactgggtgacatcctgctggagcggggtgtggtggacgcgttgcagctccactcggcgctggcgtaccagcgcaagtggggcgtgcctttggggcaggtggtggtggaccagcgcttcagcaccacgcagcaggtgttggaggccctggccttccaggcggggatgcagacggtggacctggacgtccagccaccggacgcgagcctgacctggctgattccggagcgcgtggcggaggcacaccgggtggtgccgctgaagctggaagggcaggggggccgggactcggtgttggtggtggccatcgccgcccccgccagtctggcgtccctggacgcggtgaagagcgtgtccggcaagccccgcgtggtggcgaagctggcgtcggatgcgtccatccgccgggccattggacagctctaccggggtgaaaccggtgaggcagtgcctcggcgtcccggcatggagagcttctcgctgccagaggcggacgagagcatgcccatggtgctcggcggcagcatggcggagctgacgaacatggaggctcctggcggtgaggatgggctgccgctgctgagctcgctggaagaggtggtcgtccaggcgcaggcggtgcccgcggagatgaggcggctggtgcaggccatccgcgccatgcccgaaccgctggccgctgtcgcgcagccgctgcccctggaggcagggcgccccgaacaggccgcgacgcctgccacgacggagggcttgcacctgacgcatgtctctcggcctgggtccacgaaggcgccgttctccgcgcgcgccatgcagcgcacggccggaacgcggaaccacgtcccctcggcgttgcccgtgctcacggccgcgcagccggtgcccatggctcaggtcctggtgtacggctggggtgaggaggccaccaccgggctggtgcgagtgatgtcccaggcgggcctgcgggcgcaggtcgcaagcacggaggagctgctcgcggcgaacgcggcccaggtcgtggttgcgccgctgccggcgatggagtcgctgccgcgtccggtccacgcgcaggtactggtcgcgggcaagatgccggaacaggacctgcctcgcgcccaggcggtgggggcccgcggcttcctcgccgctccggtggatccggatctcctcctgcgcgcggtgcgccggctggcgcgccccgctggtgacgcggacctcaagcgcgccagctgaaggtccggaagaaccacgacagcagcaagtcgaagcgaggcgccgaggtcgcggcgctccgcgactcgctcgtcgagacggcacgcctgcgcggtgaagcgccgggccacgacattccgccgcttgacacgtaagcatatccttacgcattatcggcgcacgatgatgcacaccgagccaggggtgttcggagcgatcagccatccggcgcggcgccgcatgctcgacctgctggtcgatggcgaccgcccggtgaattcaatcgccgagaacttcgagatgagccgcccggcggtgtcacagcacctgcgcgtgctgctcgatgcgggcctcgtcaccgagcaacggcacggcagggaacggcggtaccgcctcgtgccggagcgactggagccggtacgcgactggatcgctcactaccaacggttctgggacgactacttttcccgactgcggtggcaccttgagaaaggcgacaagcagcaatgaccacaaagacaatccgacgggagctgaagttcacccagtcggccgccgtcgtggggcgcgcgctcgccacccgcgaggcgcttgcctgactggatggtaccccga

SEQ ID NO: 396 - DNA, 1811 bp, Myxococcus xanthus
caggtccaccgtcaccaggccgcggcccaggcccgccaggtgcccgtgcgcgtcggtgaggcccggcaccaccgtggcgctgcccaggtccaccacgcgcgcgtccttgcccgcggcggcgagcacctcatccttggtgccggtggccagcaccttgccgtccttcaccgcgagcgcctgcacctggggcttcgccgggtccagcgtccggatgcgctcggccacgtacactgtcgtggtggcggtgggctctggcacgggggccggattgtcatccacgggcggcacgcgccgggtgcagcccgaaacgcttgtcagaaggagtaccgccccgaggagtccaccaccgagtcgtcgtagcgtcatgtctggcacctgtctggaagcccgcgccaattcctggcgcgtccggcgcgacactctggcgcacctggaaggagaggccaagcatgggtgtccccctccaggcgcgttgacgtcactgcacggttacaggttggtggggcagggctgcgagcgcggcgagcagcccgtggactccacctggtaggtcagctcgtacttgccaccgtggccttcgagaatcgaggtgaaggtgcccgtctggccacgcagcgtggtccagccaatctgctcctgcacatcgaagatgtgcatgctcttgtcccagagcgccaccagcttgccgccggcgcccaccgtttgcgtcgtgaactgcagcggcggcggataggaattcagggggctccactccacccgcttgttcggcgtcatgtaatcgtcgttccagatgacctcggactgattgtcgccggtgacctctgcctccagccaggcttcgtcgttgccgtcgatgtccgacgtggtgatgcacttcagggacagcaggttcgcccgccagaacagcgtgtagtagggccagtcggggtcgggctcaccgccaccaccgccgccctcacaggatgggtcattgcactgcgccggcggcgccaggctgctctcctgcaactgcttctccagcgcgatgatgtccaccggcttcgcgtccgcagcctgcgcgtccacgccctccaccgcgtccgtctccacgggcgcctgcgacggctccatgggctccgtaccgcaggccgtgagcgcgagcaccgcgcccatcgtcagccccagcgtctgttgcttcgtcttgctcatccgcatctgcgcttccttcgggtgtctggccccagcagcctggatacgcagcggttcacgaagtctggcaattcacggatgcggaaaaagtcagcccccctcacggatggttgggatggagccggtggcgcatcgacgtgcgctggttcgtgtagcgcgtgttctggaacagcttgatgagcgccatgcccgccacgaagccaccgatgtgcgcccagaaggcgacgccgccggacgcctccgcgctgaccgtgttgagctggggcaggccgctgaagagctgcacgccgaaccaccacagcagcaccgcccacgcgggcacggggaagacgcggatgaagatgacgatgatgaacagcatgttcacccgcacccgtggatagagcagcaggtacgcgcccatgacgccggagatggcgccggacgcgcccaccgtgggcaccggcgagcccgggtccaccagcaggtgcgccgccgccgcggccagtccgcacagcaggtagaacaccacgaagcgcaggcggcccatgctgtcctcgacgttgttgccgaagacccagaagaagaggcagttgcccagcaggtgtccccagccgccgtgtaggaacatggaggtgatgggg

SEQ ID NO: 397 - DNA, 1164 bp, Myxococcus xanthus
gggcgaggggcatcagctcccactcgaactcccggctcaccagcgagtagtaggcctggtgcgccacgtgccgcgcgaggccgtacttctccgaggtggcgagcgacttcatcaggtgccagccggagaagttcgacgcgccgatgtagcgaatcttcccggcgcgcacgaggtcgtcgagcgcccgcagtgcctcctcgacgggcgtgagcgcgtcgaaggcgtgcagttggtagaggtcgatgtagtcggtgcccagccgcttcaggctggcctccaccgcgcgggtgatgtggaagcgcgaggagcccacgtcgttcggtccctcacccgagcggaaggtgcccttcgtggagaggatgaccttctcccggcggccggagatggccttgccgagaatctcctccgccaggccgcgcgagtagttgtccgcgctgtcgaacatgttcagcccggcctccagactgatgtccaccagacgcgtggcctcctcgaccccgctgctgccccacaccttgaagaagtccccctggcctccaaaggttcccgtcccgagcgtcaacaccgggaccttgaagccagagccgccgagctgccgatattccattcccatagaggggcctcctggtaacgggcgagccccaggtgctcaatcggaatgcgcgacccgggcagcaattccccccgctatgctccggcggggcgaacgttaacgtgggggccggcacgttctcccggagtccattggcatgaagtcgcgcatcacggttgcctggagcaccgtcgcgtccctcctggccgtgctgcctggaacggcggcgcatgcccacgccggcctcccggagacatccaacgtcaccctccgccgaggccacccccaggacttcttctccgggacgacgttcggcgcggtcatctcccgcgacagcggcaagacctggcgctgggtgtgtccggatgccatggggtatggcggatggcgcccggaggcctacctgtggcgggagaccggcgacatcctcgccgccaccggcagcgccctgctgcactccccggatgagggctgctcctggcgcacgcatcccttcttcaagtcgacctgggtgacgggggctggcggccccaccccacccgatgaaccgcgtctttccatgcccgtcaccc

SEQ ID NO: 398 - DNA, 1935 bp, Myxococcus xanthus
agcccgggcctgaagcagcgggcggaagaagcaccgcgtccctccgcggagtggtcattgccggtgggacggtggagcgtcagccgcagcctgcgcaggcctgcctctcgcagcagccgctcggcgagggccacgtccggtacgggcgcgggtcccatgtccgcgtcatccatcagctcgggtggggtcagcgagcgagccacgcgcgcgccggggtggaactggctcaccatggccgggatgtccatgcccgcgcggagtgcgcgacggaccctcacgtcgtcgaagggcgcctcccggtggttgagcacgacgaaggccgtggagggcgtggtgctcgcggcaagctggaaggcctccaggccgggcagctccacatgctccgtgtcgaggaacgacaccaggtccaccgccccctggcgcagcagcgccaccgcttccttacgagaaccggcgagcaggaactccagccggtccaccatcggtccgcccggacgccagtaagaggggttccgctccagcaccacgtgctcgggttccagggcgaggagccggaacggcccggtgcccaccagccgcccgttggcgtccgtccgggccaccgcggtggcggtgagcgccatcaactggaggaagaacgccttgggctcgcggaggcgaatctccagcgtgtggtcgtccagcacttccaggccggacacgtcgcgcgccatgccagcggcgtactccggcgcgccctccacgtcctccaagaggctccggtcgggcgagcggagcgccgggtccagcagccgctccaggtggcgcttcacgtcgctcgccgttagcagcgtgccgtcgtggaaggtgacgccacggcgcaggtagaagcggtagcggcgcgcggaagggtctgcgtcccagcgctcggccaggtcgggctccagcccgccgtcctctctgcgcaccagtgtggagaacacgcacgaggtgagctcggagacctggttctccacgctgaagagcgggtccaccgcctggcggtttcgcagcgacgcggcctggtgcatgcccacgcgcagcgtcccgccggagtggggcgtggggagcttgaagtggtacacctccgcttccaggccctctgcttcgtggcccagttggtccaccgttcgcgtcagcccgtcgccgatgcggatgacccggcgtgcgtcctcgcgcacctgggcgacttcctcgcggatggaggcgtctgccttggtgagcaccacgttggcggagcgcagctcctccagggcggcgctcagccgcaccaccgactcggagaggtcgcgcccggtgcgcgcctgggcctccgccttctgcgaggcgccctggcccacgcgggccatctcctgtgtctggcgcagcagctcgcgcgcgtggccggactgttcaatggccatgcgcgtgacgttctccacccgcagggccacgcggcggctggcttcaacgaccgtggccccctgcgcctccagccgttgcgtctccgccaccgtggcttcaacggcggtgaaggtgcgctgggtgatggtgcgaatctccaccagggcctcggcggcgcggtcgcccagggccacaccggcggtggctcgctcgcggccttcctgcaccagcgccaccgccgtctgcacggcgtcgcgcacgcccgccaccatggcgccgatttcgcgggtggagcgcgtggtgcgctcggccaggttgcgaatctcgttggccaccacgccgaaggggccgcccctgcacgcccgcctgggcggcgatgatggcggcattgagggccagcaggttggtctggtccgcaatctcctggatgacgtcgacgatgcggccgatttccgtagagcgcgtgcccagcatgtccatcagcttggcgggcttacggaccgtctccttcacccggtacatgcccttgacgct

SEQ ID NO: 399 - DNA, 1260 bp, Myxococcus xanthus
acggggcctgagccccagcattcacggggccttcttgaacaggcgcttcctctgtttgatggccagcacgtagaagcgctcgcgcagggcctgggcatcctcgggagacaggtcccccgactggcccaggtgctcgtcccgccaggcaatcgcccggctgatgcaggcggacgccgcggcggagatgttcaggctctggctgaaacccttcatggggacccagaacgtgccgtccacgccggccagcacgtcctcgctcacgccgcgccgctcgttgccgaacaccagcgccatcttcccgtcgaagcgcagggtgtagaggctggtggccccctcctgaatggcggaggcatacagcgagaagccacgggacttcaggtgctcgcggcactcggcgaacgtcctgtacagcttcacgtccagccacttgtcgcagccctgggccaccctcgagttggggacgaagggcgcttccgggttgatgatgatgtggacttcctgaacgcccatggactcgcaggtgcgcagcaccgcggccatgttgaagctgtcctccagccggtccaggaccaccgtgaagttgcgcgtccggtgactgacgacgcgatcaatcttctccttgcgcacgtcgagcaggaactgctccggctcgaactgctcccgctcatagcgctcgtagcgcgcaccaccacccgacatggactcagctcctcccgccgcccgacttgcgcgccggagcgcgcttcgtggccgcggatgccttcttcgcggcggccttgcccgacgagccgctcttgcgcgcggatgccttcttcacggcggacttcttcgcgggcgcggtgcccgacttgcgagctggggccttcttcgccgcggccttcttcacgggcgcggtgcccgacttgcgagccggggccttcttcgccgcagcagtgcctgccttgcgcgctgcggacgtcttcgccactgcacccgccttccgcgccggagccttcttcgtcacggccttcttcgcagccgcagacttcttcgtcgcagacttcgtcgccgcagctgcgcccgcattgcgagccagagccttcttctccgcggccttcgtcttggccttccccgcccgagccgccttggcgggaatctccacgtggagcttctcggtgcgccccgtgaacagcacctccgccacggagtccatcagcggctgcatgccctcgccggtggcgcaggacacgggatacacacggatgccgcggtcacgcagcg

SEQ ID NO: 400 - DNA, 2560 bp, Myxococcus xanthus
  unsure (1)..(2560): unsure at all n locations
agggacgcggctctcgagtcaccctgtccatgcccctggcgccctcgccggccaagccgcttctggcgagccccgggggtggaaagtcgggccgcccccccgcgcgcaaggatgtcgaggacaccgagccccgggattcggcccagattcgcgtgggccgctaccacatcctggataccctgggcgcgggcggcatgggcgctgtctacagcgcctatgacccggagctgcaccggcgcgtggccatcaagctgctgcacccggacgccaacccggcggcgcgctcggacggctcgtcccggctgcttcgcgaagcccaggcgatggcgcgcctgtctcacccgaacgtggtctccgtctacgacgcgggcacgttcgcggggcgcgtcttcatcgccatggagcgggtggacggcctgtccctgcgccactggctccgcgccgagcaccggacctggcgagaggtgctcgacatcttccgccaggcgggccgagggctcgccgccgcacatgccgctggactggtccaccgggacttcaagcccgccaacgtcctggtcagcaaggacggccgggcgcaggtgacggacttcgggctggcccgcaccaccgcggacctcgacgcggccgaggcgggccggggcaccacgcccgcgctgccgcgcctcgccccggaagacctgctccagacggcgctcaccgaggccgggctcgtcatgggcacgcccgcgtacatgccacccgagcagcacgaagatgggcgcatcgacgcgcgcggggaccagttcagcttctgcgcgtccctctacgaagccctctacggacagcttcccttcaacggcaagcgcccggaggattacttggaggaagcccgcgccggccgcgtgcgcccaccgcctcggggcagccgcgtccccacgtgggtgctgcgcgccgtgacgcggggcctgtccccggctcccgaagcgcgcttcccgtccatgggcgtgctgttggatgcactgggcgcggacccgctggcggcctggcgccgccgtggcgcggtggccgccgcgtccatgctgctcaacagcgtggtcgccgtcacctggctcctggtgggctcgcagcgggacggcccgtgtccggatgccgaggcccggctcaccggcgtctgggacacggcacgccgggcggaaatccagaaggccttcgccgccacgggcaaggtccacgcctccgccgccttcgaacgcgtggcgacgaccctggatggcttcgcgcgcgattggacgcgcatgcaccgcgaggcctgcgaggccacccgggttcagggccaccagtcggaccacgagctcgcgctgcgcatggcgtgcctggaccggcgccactcggccctggtggcattgacgggcgtgctcgcgcagacggatgcggaggcgttgaacgccgcaccggacgcggcccagcgactgcctcccatcgccgcctgcgcggacgtggacgcgctctggcggggcctgtcggagcccgaggggcagcggcagcaggtggaggccctgcgcgcccgggtggaccgggccacggccctggtggacgccggccgctacccccaggcgcaggaagaagcgaaggcggtgctgtccgaggcgcggcagctcggctacgggccggtgctggcggaggcgctggagctggagggccggctcgggctcgtcgcgggggatgacgctcgcgccgccgcggccctgcgggaatccctcttcaccgcgcaggcgcaccgtcatgaccacctggcggcgcgcgcgtcggcgcggttggtgaccgccgtctcctccgaccccaccctggagtcctggacggtggagcaggcgcgcgcgtccatccaacgcgcgggcggtgcctccgaattggaggccttgctccagacgagcctgggccgcaacgccttcctccgaggccagtacgcccaggcagtggaggcctttggccgctccgccacgctgcgcgagcaagagctgggtcccgagcacctgctcacgttggagtcgctccgcaaccaggccgcggccctgtcccgcacgcccgagacggagcgcgccatgggcctgctgcaccgcgtgctggagacgacggagcgcgtgctcggtccggaccatcctcagacggccatggcggccaacgccatgggctaccacctggtcatcgtccgccgcttcgaggaagccctcccctacctccagcgcgccatccacctggaggagcagtcgctggggcacgacagcgccacgctgagctatccgctcaacaacctggccgaggccctggaagcgctcggccgcaacgcagaggcccgccccctgcgcgagcgcgcgctcgcggtggacctgaaggcctacggccccgagcatccggagaccgccaccgacctggccctgctcggcgcgctggccctgcgcgagggaaagccgcgcgacgccatggactacgcccgccggagcatcgcggcctacgaggccttccagaaggaccacctggacacggncgctccgctcaccacgctggggcctgccctgcacgc

SEQ ID NO: 401 - DNA, 2370 bp, Myxococcus xanthus
ctctcaggcgtcttcgcgcgcgggcagcgtcacgggcaccccacccaccgtcagttcgcgcacgcgcgagcctttcggctggccgcagtccacgcgcagcgagctgccctcggacacgtgaaggaaggcgccagagggcgacgcgatgctctgcccttccaggtacagcgcgcccacggacagctccagcatgtccacgagctccttctccgtaaggtccaccgtcacgacgaggttctcgaagaggatgagctcgtggagcacgccatccgtgagcgggccctggcgcagctcggtccgcgtgacgcacagaccttcctggcgcagcgagccgccgttgacgacgcccagcaccgcagggcgggtggagtcatcctccgcgtgcaggagggcatccgcgacgagctggcccagcgcattgttgtcgtgccgcgtgtagaccttgtcgaggagcacatcgtcggccaggtagcccacgacggcgtcggggtcctccaccaggggctggcacgaatcgttgtaggcgatgcagccgccgtggaaggcgcccagcccgaaggtgagcgcggcgaacagggagcgggagcgcggcatcagtagtgggccctcacggtgaggaatccggacatgccctcgcgcgggagcagcccggggacacggtccggacggggcacgtcgtcgcgaaggtcgttgtcgaacaggttgtgcgccaccagggccacctcgaagtgctccaggatgggctcggtgcggagctgtgcggtgatgaggctgtaggacggaatcttgtagcggcggatgagctccagcacggagcggctgttgttgcgccgctccgcgcccgtgcgcaccaccacgtcgaaattcacataggcgccgatgggcatcgtcacgccggcgttgaagcgcgcctgcggcgtgtcggtgagcaggcgggactgggcgggcagctccaggtcctccgcgcgggagatgctggcgttgagccacgcatacgcgcgcttggaggcctccagccgggcctcgccctccacgccgtacacgcgcacgcccagctcacggttgcgcagcgggacgatgttgcccgacgtgtccacggggacgatgggcgaaccgaagagggccacgtacgcgttggcacgcagccgcacgcgcgcgtcccccgccgactggatgaggtccgcgcccagctcgaaggtgtccaccgtggcgggctggaggcgcgggttcccctcgaagcggccctggttgtactccgtgtccggaatgcgctcgaccaactcctgcagcgtgggcgcgcggaaggcacgcccgtagagggccttgagcaccagcgcgtcggtggccgcgaacaccagccccacgcgcggattgagggtgggcacgaagcgggtgccgttgatggcgccggacgcgtccaccgtgggcaactgggtggcgtccatgcgcacgccgaacgtgagcgtgagcgcgttgacgacggtccactggtcctgcgcgaacaggcccacattgaggcggcgggacgcggcgccgctcgtcaggtccaccaggccctccggccgcgtcaggccgtccggacgcacctgggcgtccagggtgtagttcgtcacgtagtcgtattcgcccagcgactgctgatccaccaccgcgcccagggagaggcggttgtaggcgcccagggccacgtccgcgtccacggagccggtgagcgagcgcacggagacgcgcgtctgctcctgcatgccctcttcgaacaggcggttcgcgcccgtgccggcgctgaagtcgtgaggggtgatctggaagaagcggtcggtggactgctggtcatacgcggcccgcgcgcggagcgtcacgtcgggtccaaaggagcgctcccaggtcaggtccgcgaggaagacgttccagcccagcttggagtcctcgcccaccgtgtcgaagaggcccaccagggcgctgcggcgctcggtgaggaagcgcgcggaggcccccaggcggcccgcgtcgcccatggcgtaggtgacgcccgcgcccgcgttgaagaggaagcgctcgtctcgggtgcgccccgcggggtccgtcacgtcgcggagcccctgcgagcgcgactcgtcgtccaggccgtcgttctcgatgacggtggagtcaccagcctggctccacacgtcgatgtccgcgaagacgcgcagattcccagcggtgtgccccgcggagatgtgtccgttccccgtgacggcgagccggtcgtcttgtcccgggtagccgccgacggacacggcggtgcgaacgccgtccgacgtgtccgtgacgatgttgaccacgcccaggaaagcaccggcgccatagagagcggagccagggccgcgg

SEQ ID NO: 402 - DNA, 1646 bp, Myxococcus xanthus
ggtaactgccgccgcctccccggggtccgcgcagggacacggaggcctggaccacgggccggccgtcccgtcccaggatgcggccggacacctggaccgggtcgccgtagtcacccaactccagcggcgcggcgagcggctcgcggggatccacggtgaacgtcttctgcggcacccacacgtcgcctgtcgccgtcacgcgcaccaggaggctggtgcgctgcgaggcctccagcggcagggccagggagaaggcgcccgagccgcgcgccaccggcacgcgctgggacaggggtgtcaggtccgcgtccagcgcttggacctgcagcgcggcgtccacgggctgcgcgccctggcgcaccacccggccttccagccgggccacctggttgggggagggcagcaccagttgcaggggcacggcgccgccgggcgacacggtggcttcgcctcgcaccggtggcagccccaggtcctccggctccaacgtcaccgtgtacgtcccggtccccacgggcagcacccaggcgccgttgagagggaccaggtcggccgtgaagaggcgcgccacacccggcagcagcgcgctctccccgcgggcggtgaggtggagcggctcgttgtaggggcgcggggcgctgccggcgggggccgtggcgcgcacggtgctgccctggacggtggcgggcccgaacagtgccaggttcagctccggccggatggcgtctacctggaagtcctgcgcgtgcaggccgtcatgggggttgggcgtcacctccaccacgatgtcccggcccgggtcgccgcagccgtccgggaagcacacctcgttgatggcacagtcgctgtccgcgcggcacaccaactggctggggtcgggcgcttcctccagcagcacgcagccggcgctgggcagacccgacagcaggaccgtccacgcgagccgccgcacccgcctcaccgacagtctccctggacggtgttgaccacccacgaataggtgacgacgaagcccgggttgttgatggtggtgccatccggcagttgcactggccggggccgcaccacgcggtccaccagctccgcgtcggtcaccagcgcctccaccaggtgggggccgggtgtgctcagcgggttgttggcggacgcgaggctgatgagcagcgtgccccggtccgagcgccggggttcgcgggtgctggccaactcatactggcggtaggggccgcgcgggtcctgcgggttgtagtccacgtaccagtgcacgacgatgcggtcgtccacgtccgggtcctcgacggccacctcgaaggtgaggtcgcagccgtccgcgccgaagtccgagatgaagcgctgctggggcgccaccaggctgtcgatgatgcgcggcggccggttcatgaagtccggcacggcgtccagcagcgtgtcgtcctgggggatgaggcagccggacgcggcgcagcccgcggccatcagcagccacagctctcgtctccaggagtatcgccgcgtcgtcgcttccatcatccggacgggctgctcccctagagcagctcgtctccctcctcgggcggcaggggccgccctgacttctccgcttccagcttctccagatgccggaagatggtgcgcctttagagcac

SEQ ID NO: 403 - DNA, 1769 bp, Myxococcus xanthus
cttgttggtgacctcgcgcgcggtgtcgcggtccggaatcttgaaggccaccaccgcgtcgtactcggccgcgggccgcttcccactcctccaaagcccagaggatctccgcgtagaagaagcggaggttgaaggcggagtccgccacgaagtccgggttcgcgttggaggcgaacgcgtccacgtactgcttgtagatgtcacgcgccagccggtaggtctccacctggcgcgtcttctgcgcctcctggtggtactcggtgaccatgacgcgcatggcctcttcagtgacgttgaaggcgtttcgcaggacggccgtcttgccctcgttggccttccaccacccgccaccagggctgtagaggtccaccatccgcttcatttccttgcggaccaactggcgctggcggagcccctcgtgggcgcggacgatggcctgctggtactccggcgcgttggcgcccatgggctcgtcgtccacgagcgtgcggtacgcgaggatggcgctgtcgaagtggcccgcgtccaccaggcccgcggccgtcttggccagcaggcggcccacgcgctgcgccggcgccttctccttgaagtaggcgatggcttccttcggctggtccaactggacgtagaagacggtcaggtcgttgagcgcctcggtgcgcaggtcacccaactcagggctcttcgcggcgtagtccaccacctcgtggagcttcttcagccccagctcgtagtcgccggtgttgtagtcgcaccaggacagcttgtagacggcgtagccgtagattttcggcacgcccgagtcccgcgccttctcatagttctccttggcggggatgagcttgttgttctcgaagtagtggttgccgagctggatgtacgcgtccggcacgaactgcgacttcgggaagtcgcggatcaactcctcgtagcgggccaccgcgtcctcgcggcgtcccagctcgtagtagttgtaccccatggagaagaggacctcgtcgcgctggggataatccgggtacgcgcggaggatgtcctcgtagatgcccatcgtttcggtgcggtagcgctcgctgtccgcgtggttcttcttgggcggctccaccttctcgccgcgcgccacggccgcgtcgtattccttctccgccgcgaggaagcgcgtcatctccaactggtagaggtacttggacttctcccagtagagctccgacaggcggtagagcatctccgccttctgcggattgccgtcccgcagcttggggatgaggcgcttgaaggcggcaatggcctcgtcgcgcttcttgtccgccagcgcgtcccgcttggcgtccgggatgcggggcagctccgcgaacttcgccgacgcgggctgaacgcgcgccggcccctgccgcacgtcctccggcgcaacccccggcggcggagccttctcctctgccttgcggtcgacctgggccttcgcggacttctttttcccgcccgccttgctggacgcaccggaggtcttcgacgcggacgccgcagcgggcttcttcccccccttgcgggcctgcgtttccgccgcctctcccaccccgccagtgatgagcaccgcgcccaccgccagcgcaccgaaacgaagaaccaccttcatgcgagctcctgccgtgaagccgacccggcatgcgggcaatccagcacccactgacgagggacgacggaaagtagatgcgcatttctggattgagaagtggcggtggaacggtgcttgcgcactgtcaacaacg

SEQ ID NO: 404 - DNA, 1272 bp, Myxococcus xanthus
cgtgctgctccggcagctccagcagtgggggattccgcgggagcgcatcgtcacgtaagggcgcagccggaatacacgggagaacgcggtggagtccgcgcgcatcatccaggagcgagggtggaagtccctgctgctggtgacgagcgccgcgcacatgccgcgcgccgcgggttgcttcgcggcggtggggctgcgtccggacctgttgccggtggactcgcgggcgtcgaacacgccgctgcggcgcatgagctggttgccgaggtctggggccctcaacctgagcaccgacgccctgcgcgagctggcggggcgtgcggtgtatcgcgtgcgaggctggacggcgccttgagcgccgcgccccgtcctacttcagcggcgcgggcggctgacgcgcgtcgggagccagggcgccagtgccgagccgggagatacggccatccgcctgggcatgcggcgacggcgtgccggtgcggaacgcctccgccagcacgtccaggggcgagttacccgtcaccctggccggcgtggacggctggttccgcagcatgtcgtagccgtccttgccgctggcgaggaagctcagcgtcgccagccggtacgtggccgccttgtccaacggcctgccgcccaccttcacgcccagcacccgctgtccggcgggccggtccgaatcgaaggtgaactccagcccggacacctgcggaaagcggcccggccgtgagtcctcgcggctgaggctgacgccgttctccagcgccgcgcgcagcgtgtcccccttcacctccagcaccaccagctcatccgcgtacggcaggatggcgtgcaaatcccgccgggtgacaccacccgcgggcagcaccgcgtccgcgcgcagcgccccggcgttgaccagcgccacgtccgccctggccgccgcgcggaacgcatccgcgacgaacgagcccaggttcgtctcctgggtgcgcaccatcgcggcccgcgcttccaggggcacgggggagcggcctacgtgctcggacagctggttgaacagcgcggcatagggctgcatggccgcgttgaaggccgcgtcctccggcacctgccgcgtcaccggcagcgtctgccacgtcacctggcgcaccgtggccgtcgccgcgtccacgtccagcgtgagccggcccaggtccaccgcgtccgccgccaccttgaagatgggcgtgcccgtgctgcggtcctccagcgcctcgtggtcatgtcccccgagcaccgcgtccaccttgacgc

SEQ ID NO: 405 - DNA, 2602 bp, Myxococcus xanthus
agctcccttgtgcctttacactctacgaatgatttccaaccattctgagggaacctttgggcgcctccgttacattttaggaggcgaccgccccagtcaaactgcccacctgacactgtctcccggcccgatcagggccgcgggttagaatttcaatacagccagggtagtatcccaccgacgcctccaccgaagctagcgctccggcttctcaggctcctacctatcctgtacaagctgtaccaaaattcaatatcaggctacagtaaagctccacggggtctttccgtcctgtcgcgggtaacctgcatcttcacaggtactataatttcaccgagtctctcgttgagacagtgcccagatcgttacgcctttcgtgcgggtcggaacttacccgacaaggaatttcgctaccttaggaccgttatagttacggccgccgtttactggggcttcgattcagagcttctcccaaaggataacccctcctcttaaccttccagcaccgggcaggcgtcagcccctatacttcgccttgcggcttcgcagagacctgtgtttttgctaaacagtcgcctgggcctattcactgcggctctctcgggctatacaccctaccagagcaccccttctcccgaagttacggggtcattttgccgagttccttaacgagagttctctcgatcaccttaggattctctcctcgcctacctgtgtcggtttgcggtacgggcacctcccgcctcgctagaggcttttcttggcagtgtggaatcaggaacttcggtactatagttccctcgtcatcacagctcagctttcatgatgagcggatttgcctactcatcagcctaactgcttgaacgcgcatatccagcagcgcgcttaccctatcctactgcgtccccccattactcaaacggcggggaggtggtacaggaatatcaacctgttggccatcgcctacgcttttcagcctcggcttaggtcccgactaaccctgagcggacgagccttcctcaggaaaccttaggcattcggtggacaagattctcacttgtctttcgctactcataccggcattctcacttctaagcgctccaccagtccttacggtctgacttcgctgcacttagaacgctctcctaccactgacatcaaagatgtcaatccacagcttcggtgatacgtttagccccggtacattttcggcgcagagtcactcgaccagtgagctattacgcactctttaaatggtggctgcttctaagccaacatcctggttgtctaagcaactccacatccttttccacttaacgtatacttggggaccttagctggtggtctgggctgtttcccttttgactacggatcttatcactagcagtctgactcccatggataagtctttggcattcggagtttgactgaattcggtaacccgttgggggcccctagtccaatcagtgctctacctccaagactctcacaacatgaggctagccctaaagctatttcggagagaaccagctatctccaggttcgattggaatttctccgctacccacacctcatccccgcacttttcaacgtgcgtgggttcgggcctccattcagtgttacctgaacttcaccctggacatgggtagatcacctggtttcgggtctacaaccacatactaaacgccctattcagactcgctttcgctacggctccgccttatcagcttaaccttgcatgggatcgtaactcgccggttcattctacaaaaggcacgccatcacccattaacgggctctgactacttgtaggcacacggtttcaggatctctttcactccccttccggggtgcttttcacctttccctcacggtactggttcactatcggtcactaggtagtatttagccttgggagatggtcctcccagcttccgacggaatttcacgtgttccgccgtactcaggatccactcaagagggaacgaagtttcaactacagggttgttaccttcttcgacggacctttccaggtcgcttcatttacttcgttcctttgtaactccgtatagagtgtcctacaaccccaagaggcaagcctcttggtttgggctaattccgtttcgctcgccgctactcaggaaatcgcatttgctttctcttcctccgggtacttagatgtttcagttccccgggtctgccttcaatatcctatgtattcagataaagatactgttccattacgaacagtgggtttccccattcggaaatctccggatcaaagctcacttacagctccccgaagcatatcggtgttagtcccgtccttcatcggctcctagtgccaaggcattcaccgtgcgccctttctaacttaaccattagcgaataaatggtacaacataaagttgtgttatttattggtttgattaaagaaaagtttcacttttcctcagcaattactgttatctagttttcaaagaacaatcgcaaccaaaattcttcttatctaataagaagaaagtagtgtgctttctataattgagagattgaactctcaaaactgaacaaagtgtcaaaacgtacgtcatgtaaaaatcct

SEQ ID NO: 406 - DNA, 1713 bp, Myxococcus xanthus
acgtgctctaaggccgtctaacaccggcacgaactggcccttcgccagcttcaggccgttctccagcgcccccgccttgaagccctggcggttgacgcggtggatgtagacgatgtcatgccccttctggcgctgacgctccacgcacgcccgggcgatgccacacgtctcatccgtcgagtcgtcgaggacctggatttcgagcaggtcgcgcggatagtcgatgcggcacaccgactccaccaggcgctccaccacgtacatctcattgaagatggggagctggatggtgaccttgggcagcgactccagcgcgcccttcggcgtcggcagcttgaacttgtgccggtagtacaggaacgccatccggtacctgtgcgagccgtagactcccagcacgcacaagagactgaaatagacgcccaggaagatgatctcgacggtggtcatcggtgacgctcaacccctgccacagcccagagggcctgcggtccttccgtgcggagtggcccggctgattccgtctcgcgcggaccggcgcgagatgggtcatccaagcccccacatcgtatgtacccgaaaagacaaggttttgaccttcggggagtgatcggcgccggacaataggaatgcgttcaaggccgtgtcaaactattccccggatttgaacgttccgttcacggggcgctgacaccctgcgtcactcctatgacacccagcttgtgtccctggcgccggggttgaaacaacgccaggggttgaccgacctgaggggtcagctcaccgcgcggcgaggcacgcccaggtccggcggagtctccacggcgggagcctccaggacaccggcttcgtcacgggtggccagcgccaggatgcgctccgtcagcgcggcgaagtccaacccggccctggcggcgattttcggcagcaggctggtgggggtgaagcccggcagcgtgttcacctccagcaccacgtcgttctccgtgtccgagcacatcaggtccacccgcgcctgcccgcggcagcccagcgcgcggtaggccgccagtgccagggcctccacgttggccacgcgggtgggagacagccggggtgggcagaagtacgcggctccgcccttgtacttggcgtcgaagtcgaagccctcgcgcggcgtggccacctcgcagctgcccagcacctggcctccgaggatgcccaccgtgacttcccggcccgccacgtagcgctccaccagggcctcgccgccgaaccggctggcctgcgccaccgcgaacgcaagcgcctccggttcacgtaccaaggcaagccccatgagacgagccgtcgtacgcgggcttcaccactcactggaagcccaggtcgccgagcagggccagggcgcgccacgcgtcctcgcgctccaccgtgtagccatggagcgtggccaggatgtgcaagctgaacaaccgcttgtcgaagggcttgttcatggccaacgccgacgacatgacccccgagcccgagttcggcaggttcaacaactacagcacgccctggacccggccgtcctaccccatgcacccgtggagcgcgacgaacgacacgtccagttacgacgcgctaagcgcccggtccactgcccgccctgccaagatgggtgtaagctgatgtgccccggactggagacgcgccaccacggcctgataaggcttgagcgatatctcccga

SEQ ID NO: 407 - DNA, 1667 bp, Myxococcus xanthus
tggcgacggagctgatgaaggtgacgccggagctcatccagaagacggcgaaggagtatctgcgccgtgagaaccgcaccgtgttgacggtgacgcccgccacggcgcccgccaccaagacgcaggccccctgaggacacgcacccatgaccacgcactcaattcgcacccgccttgtcgcgcccgcgctgatggtgctcgggatgctgtccacgcctgccttcgcggccgctcccgcctcggcgcccaccaaggaagcgcctccggccgccgccgcgcccaagcccttcaaagtccccgtccgcacggagttcacgctcgacaacgggctggaagtctcgctgctgccctacggcgacatgccgaaggtcgccatccaactggccatcgacaccggcaacatccacgagaaggccacggagacgtggctggcggacctgacgggaaagctgctgtcggagggcaccaccacccgttccgcggagcagcttgcccaggcggccgcgcagctgggtggttcgctcaacatcggcacgacgatggaccagacctatgtcggtctggaggtcctctccgagtcggcgccggacgccgtggccctcatcgcggacgtcatccagaacccggccttcccgccggcggaggtcgagcgcgtcaagggcgacctcgtgcgggagatggccatctacaagagccggccgggtacgctcgccgacgagcggctgctccagtcgctctacggtgaccacccgtatggccgctacttcccgccggaggcccagctcaagggctacacgccggaggccgtccgcgcgcactacgacgccaacatcggcgcggcccgggcgcggctgtacgtcgtcggccggttcgagccggcgccggtggaaaaggccatccgggacgcgttcaccggctggaaggccggcgcggcgcgcctccggaacgtgcccaagcagaaggtggcgaaggcggtccagttcatcgaccgccccggctcggtgcagtccacggtgcgcgtggcggtgaagggcctgccgccctccagcccggactacgtcaagcagacggtgatgaacacgctgctcggtggctacttcagctcgcgcatcaccgcgaacatccgcgaggcgaagggctacacgtattcgccctacagcgatgtgtccacgcacctggaggacgcctactgggtgcagaacgcggacgtgacgacggccgtcacgggcgagtcgctgaaggagatcctcaaggaggtggccaccctgcgcaagacgccgccgcccgcggacgagctgagcgctgtccagagctatctggcgggctccttcctgctccagaactcgtcgcgcagcggcatcatctaccagctccgcttcgtggacctgcacggcctgcctgattcgtatctgcagaactacgtgcagtcggtgatggccgtcacgccggagcaggtgcagcagctggccgcgaagatgctgacgcgtgaggcgatgaccttcatcgtcgtgggcgaccagaagttggtggcgccgcagctgaaggtcgtatcccccgcgctgaagtgagtcctgggagggcggaggctataccttcgcctccggccaggcgctacggtgtcgctactacggcgggcctgacacctcatcccctacctcgaagaggcc

SEQ ID NO: 408 - DNA, 1583 bp, Myxococcus xanthus
cttgcttggcgccatggagccggcgacgtgcgcgccgcacttccgggcgaaggtgcatggcacatatgcactggaccgggcgttggcgggccgttcgttggatttcgtgctgctggtgtcctccaacgccacggtgctgggtggcctgggattgggggcctacgcggcggccaatgccttcctggatgcattcgcggcggcgcgctcgcggaccgggggcccgcggtggctgagcaccaactgggatgggtggccagtggatgccgccgagggcgcgaaggcggtccagaccagcatcgaccagttcgccatgacgcccgacgaggcggtggaggcctttcgccgggtggtggaggcgccgctggaagggcaggtgttggtgtccacgggcaacctggacgcgcgcgtggcgcagtgggtacggcgcgagggcgcgggcgcgaagaaggacgcggggggcacgttgcactcacgtcccgcgctgggcactgagtatgtggcacccaccgatgaggtggagcgcgcgctcgtgcgtgtgtggcaggagcagttgggactggagcagttgggcattcacgacaacttcttcgacctgggagggaattcactcctgtggctgaagatcgtcgggcggatgaagcgggagctggggcgggacgtgcccctcaccagcgtcttcgaggcccccaccgtggccaccctggcgaagaagctgggacagggaccggccccagcggagaccaccgccttcgagtccagccagagccgtggggctcaacgcagagagcgtcgcagccgtcgcgaatagggcgcgtgcccgcactgaagcccccttcgacctacgagaacctggagacgacaccttggacagcaagctccctcaggagttcgacgacgccgacgtcgccatcatcggcatggccgggcgctttcccggcgctcgggatgtggacacgctctgggccaatctccgagagggggtggagtccatccgcttcttctccaaggaggaggcccgcgcggccggtgtgtctgaggagcggctggaggacccgtccttcgtgcgagccgcggccatccttccggagccggagtcgttcgacgcggccttcttcgagatgccgccacgcgaggcggaaatcacggacccccagcaccgtgtcttcctggaagcgtcctgggaggcgttcgagcacgctggctattcaccgcgtgactacgtcggcgccatctccgtgttcggcggcgccacgctcaacacgtacctgttgatgaacctggcgcggaacccacgcgtgctggagtccttcgagccggtgcaggtgaacatcggcaacgggggcgacttcctggccacccgcgtctcgtacaagctcaacctgaggggagccagccacaccgtgcagagcgcgtgctccacctcgctggtggcggtgcaccaggcttgccagagcctgctcaatggcgagtgcgacatggcgctcgcgggcggtgcatccgtcaacgtggggttcttcaacgggtaccggcacgcggagggtggcatggcctctccggatggccactgccgccctttcgatgcg

SEQ ID NO: 409 - DNA, 1429 bp, Myxococcus xanthus
gggtccacgttcgcaacactctccgcggagtattcggcgacgagggagtcgacgaaggcgcgcgccagctcgcccttcgacgcagggatgtcccggatgcgctggacggcgaacttctggaggaacctgtccaccgcctcgcgcggcagcgccttcagcgcggtggccatcgcctgcgcgagcttcacgtcgacaggctcggcgggcttcgcgctggaagcgcccgcaggcgacgcgccgctcgccgcgccagccgcctcggccgcgtacagcttcggcaggtcatgctgctgcaacgactggaaggccgccatctcctcttgagtgagctgccggtccgggaggatggagtacgtcgtcttcgtgtccttggccgcacctcggcgcttcacctcgaaggcccaccgctcgagcccgtacttcgcgcgcaactccatcagcgtgttgaagaaggtgacggcctgctccatcaccttcacctcgcgcgtcccgtagacggcgacgttgagggccacgcgcagcgagggcttttgcccctgggccttcagcgtctcgtcgaaggggacgaacttgttgtcgacgaaaaccacctcgcgcgggtgcggctccccgagaaagacgacgacggcggtgtccccgtcattcgcgagcttcagccaggcaccgccctgctgctcatgctgcttggccattgcggccgtctgttcccacatgttggccatgtgcttcactcctctttctggcaatgcgtcgtggtggggtgcgcgcgccggtacatggaaaacaactcggtgccgtcctccgcgcagcccgcaggctcgacgttgaagtccgcgtcggcatccacaacgtgctgaatctcccagcggcggaagaggcctggcaggcggatgtagtcattggcctgtgccccggcgcactcgcagcagaggcacgcgctgcggccctcctcttccggccctgagtcgccccggcccaccacccggaggcggtgtccgtcgatgcgcgcgaagaagcgcacgaatgtttcatcgcgctcgaagttgtttcgcgtggctgttctcattcagtccttccaggttgttggcaatacgagggcgtcgctgtccgccggggcggacaggctgcgtgaatgcgcttcacgaatggggcccgagaatgggcccgcccttcagtcaaagcccggcagcaatgaatcggggacatcagccgcctgacattgcaggccaccgcgccgtctcccgccctgctgcgacttcaatcccgtccaggttggttcaaatctcaccactactaaaagcactttcgcgaagcgatttgggacaacgaaattttccgggcatttttttcttcatttttcgcaagcgccccagggcccgctggacgcgcttgcgcactgccgcaggcgcaagccccaagctcgccccca

SEQ ID NO: 410 - DNA, 2724 bp, Myxococcus xanthus
taacagccgcctcctggccgagcgcctcaagcaccaggtggagtccgccgggctcgccacgcggctgttccgggccagcgactatccggtgcgggagctggccaaggagaagctgctctgcgtggtcatcagcacccagggagatggcgacccgccggacgacgcacgcggtttcagtgagttcatcctcggcaagcgcgcgcctcgcatggaggggctgcgctacgccgtgctggggctgggagactccagctacccgcgcttctgcgaggtgggccggcggctcgacgcccgcttcgcggagttgggcgccagccggctgttggagcgtgccgattgcgatgtggacttcgagcccgtggccaagggttggctcgaccaggcctacaccctggcgcgcgaagcactgactccgcaggcgacggtgacggccacggtcgtgccgctgcgggagccgcacgccacgcccgcgttcaccaaggaagcgccctacacggcggaggtgctgctcaatcagcgcatcactgcacgcggcgcgctcaaggacgtgcggcacctggagctgtcgctcgcgggctccgggctggaatacgcccccggcgacgcgctgggcgtgtggccccacaatccgccggagctggtggcgtccttcctgtccgagctgcgcctcgacggagaagcggcggtcacccgagagggccgcacgctcccgctggcgcgctggctgagtgacgagttggaaatcaccaggctcaaccgccccttcctggagcgacaagccacgctgtccggcagcgcggcgctgcacgaagtgctcgaaccgggccgcaccgaggccttccgcgcactgctggcggggcatcaggtcatcgacgtactccgcgcccacaaggccacctgggacgccacggagctggtccagtccctgcgccggctgacgccccggttgtactcgattgcctccagccccaagcgcgtgggtgaagaggcgcacctcacggtggcggtggtggactacacggtgttcgacctgcggcacttcggcgcggcgtcgtaccacctggccacgcgcacgggcggcaccgacacgttccgcatcttcatcgagccgaacgaacacttccagctgccgcaggactgccacacggacgtgctgatgaccggccctggcaccagcgaggcgcccttccgggccttcgtccacgagcgcgcggagaccggagcgaagggccgcaactggctcttcttcggtgagcaacacttccgcacccagttcctctaccagacggagtggcaggaggccctgaagaagcagacgctgcaccggctgtcactcgccttctcgcgggaccgcgctcagaaggtctacgtgcagcaccggctgcgtgagtccggacgtgacgtctacgaatggctcgaaggaggcgcccacctctacgtgtgcggcgacgcccagcgcatggccccggatgtccacgaggcactggtggacgtcgtctccacccacggcggcaagagccgcgaggacgcgcacgcctggctcgaatccctgcgcgagcagcggcgctacctgcgcgacgtctactgacccattccgattgcgagcaacgacatgagccaccagcccaagcctctctccgaagtggagcacatcaagacccagagccgcctgctccggggaagtctggcggagagcctggaggacccggtgacgggcggcctcgccacgccggacaccaacctcatcaagttccacggcagctatcagcaggacgaccgcgacgtgcgcgaggagcggcgtcagcagaagctggagcccgactacagcttcatgctccgcacccgcctgcctggaggcgtgtgcacaccggcccagtggctggtgatggacgccctggcgcgcgagcacgccaaccacacgctgcgcatcaccacgcggcaggcctttcagttacacggcgtcatcaaggatgacctccggcccaccatcgcccgcatcaacgaagcgatgatggacacgctggccgcctgcggcgacgtgaaccgcaacgtgctgtgcaaccccaatccggtggactcgcgcgtccacgagacggtgtaccagtgggcggtgcgcatctccgagcacctgctgccgaagacgcgcgcctactacgaagtctggctggggaaggagaaggtggccggcggtgaggacgagcccatctacggcgccacgtacctgccccggaagttcaaggccgccgtggcggtgccgcccctcaacgacgtggatgtcttcgcgcaggacctgggcttcatcgccatcatcgaaggcgacgcgctcgtgggcttcaacgtctccgtgggcggcggcatgggcgccacgcatggtgacgcggccacctatccccggctggcggacgtcgtcggcttcatcccgccggagcagacgctcgccgtcgccgaggaggtggtgaagattcaccgcgacttcggggaccgcaccaaccgcaagcacgcgcgcctgaagtacgtcctggaggagcgcggcgttccctggttcacggcagagctggagaagcggctcggcttcccgctccagccagcgcgccccttcgttttcgagcacaacggaaaccgcttcgggtggacagagggccatgacggccggtggcatctgacgttgcacctgaacagcggccgcgtggcggaccggcccggcgcgccgaatttgacgggcct

SEQ ID NO: 411 - DNA, 1579 bp, Myxococcus xanthus
ggggcggggatgcgatgaagtggcggatcgccagcgttgcgttcctgctgggggctctgtcgtcggggctcacctggttgtccgtacaaccggtactcctccggctgttggacgcgctccgccgctgggtccccgaaggaagcgcggaagaagcgacgctggctcgtgtgcaaggcctcctaccctgggtgttggggctcgacctggtcgcgttgacggtcctcacctacgtggtgctggacctgatggtgggacgcccgctgcgccgcaccgaggcggtggtcgagcagttcggtcggttggactgggaggcgcatctggttccgacccagggaggaacgctggtgtctcgtatccagcgcgccttgcagcggatggcggaggcgctccgcgaagaacaggcgctcactcgcgcgcaaatggcgtctttgcgcgcgtcgcatgcccaactggctcgcacgcagacagagttggttgcttcggagcgcatggccacagtcggacggctggccgcgggcgtcgcccacgaagtaggcaacccgctggcgggaatccttggctacgtggcactggcgcgtgtcaaggcggacacgccggaactgaaggacttcctggagcgtatcgaccacgaagtgcagcgcatcgaccgcatcatccggggcttgcttgacctgggacgccccggtgtcacgtcgctagggccggtagaggtaggcccggtggtagagacgtgtgtgcgcctggttcgtgcctcccctgagttgtcgggcgtgacggtgacgctcgacctggagcctggagcgcttgcacgcacggacgcaggcccgctttcgcagattgtcatcaacttgctgctcaacgccgcccaggccatgggggggcagggacgtgtgcgggttgccacgcggcaggcggcgggtgaagttcgtttgctcgtggaggatgacgggacgggcatccccgaggacgtcatgccgcgcctgttcgagcccttcttcacgaccaaaggacgtgaggggacgggattgggactggcggtgtcgcagcgcctggcgcaggtcatgggcggcaggctcgaggcagagaacatccccagtggtggagcccgtttcaccgtgtgcttgcccgtaccctgaggaaaatgcttgcgtcttcgggacaggagctatcggccctgtcgcgggtaggcgatgatgcgcggagacggccatgcccctgttccgcaccattctcgttgccgatgatgagccctccatccggcacatcctcacgttggtgctcaccggccacggttaccacgtgcgcgcggtggccgatggcgaggacgcgctgaaggaactcgccgcgcgtgactaccacgtgctgttgtgcgacgtgcgcatgccaaagaatgatggactcgtcgtcctgcgtgagggcctggattcgcaccccgcgctgacggcagtagtgatgagcgcctaccgctcgcaggaacaggctctacatgccgttgcctcaggagagttcgactacgtccagaaaccatttaaaccggacgatatagtgtttgtactccgtaaggcagaagaacgggagc

SEQ ID NO: 412 - DNA, 1721 bp, Myxococcus xanthus
tgtgctctcaaggagcctgtatcccaaatcctactgctgactagaactggcacctttgtcgtagcttgcaagacatatcttctgcggcgtgccctccgtctgttcgatgaaccgggcgaaatcgcgggccttctggaaggctccgactagctcgtcggtatgctggtacagctcgacctcaacttcgtcggcgagctgtccctgtcggtggcaccggccgattgcctgttcccacgcagcgccgtcggccggtggattcacgaacagcattcgcgagaacatcgtcaggttcttgcccgtcccgtgggcacgaagtgaagcgacgatggaccgcttcccactctcccggatgatggtcgccgacgcttccgggccgccgccgtagaaaggcacgcccgccgccttcgcgatgcgctggccaagctccgggaactcaacccagacgattcccggctgccccttgcgtagcgcccacttcgccgcgtcacgcacaatgaagtcggagagccacacggcttccgtgacgtggacgacgtgcttgtgcatctccgcccacgagggccacgacatcgcgcgccaagtcggcagttccccgtcgtagggcggggactggtgagcgcgaatcgcggcgcgcaccaggagccccggggagtcgagatgctcggcggggcgcttgaggcgctcgcgtagctcccggttgaactcctgccgacgcgcgaaccaccgaacgatcagctcggggtcctgcggaacgccctggacgtcggggtaccgccagcggtggaagaagccgctcgcgagctgccgcgcacagacgacgcgttgcagctcgtcgacgaactcttcgccgtcggggcgctggccgccgagcgcagtctgaatgtgggcgagcagttcgtcggggaccttgcccgggtcgcgcgtgcgaatgacgagcgacatgccgacggcgctttcgtccgtggctacgacacccggcgttgcgttgcgccaccgacgataggcatcacgcacgcgtcggcgctcacggtcggtttcgttctccccttcaagtggggcaagcggatgtgccgagtcaacgagctggagaagcgtgcccggaggggccacggtagtcccagggtcgagcgccgaggcccattcctcgacgacgtgctgcttcaacggtagcgggctgccgtcacgcagcgcgtactccgcgaggtgggcgtagtccttaaccgttcttgtcgccagcgtgcccgactgagctacgaggcgcgtttcggggtgctgctccaggtagcgaaggaatcggccagtgcgggcgctcttccggtccttcagcttgtgcgcttcgtcgcagatgatgaggtcgggccggatgcgcgtcaggaggtcagtgccttcctgggtcgaaaacttctcgtaggtgatgacgtggaggacgggcaagccaggtcggaaccacctgccgcccgcgaggttgggcaagcgccagtgcccgccgtagaagtgccagtcgacctcgatgagctgggctcgaaggttggacggcaggagtaggacggcgaccttgcacccgggcacgacgagcggcagcaggaggtcgaccaacgtcttcccgtgccccacgccgatgggaaagagcccgccacccgtgcgcgcggctttcaagagggcgaggcgctgaatggggagcaacgcggacgggcatcgcttcccaagcgtcccgcaagtgc

SEQ ID NO: 413 - DNA, 3109 bp, Myxococcus xanthus
aggaccactgcttcgacgcggccgacttgatgcgccgggagctgccggtgcaattgcagaaggcggcgctcgcgctctttggccagaccagaggcccaccgccggctggtgcgcgccgacaagaaggtgcagtacctcaacgagggcttcgcgtacttcacgcaccacaccttcgacttcgtgcgcagcgcgccgttggaggtccccggcttcgaccccttcgagtacgtgcgcgtggtgaacgagggcatgtaccgctacctgctgtcgcgcgatgagagccaggtgtccttcgccgggccgaagcacgacgacgcgcgcggcgaccgggcatgggtccaggagcgcggcgtgggcaacaccacgcacaaggtgtttggctatgcgctgcgcaagacgttccgccactgcaccagcgacgtgacgttcgaccggccgtcgttcgagcgcgcgatggcgcaggtgccccccggcacgctggtggtgctggcgcccacccaccgcagctacttcgacttcctgttgactagctacctgtgcttccagcacccggagctgggcatctcgatgccacacatcgccgccgcggaggagttcggccgcatccccgtggtgggcccgattctcaaggactcgcaggccttcttcatcaagcgcggcgtgggccgcgaggtgccggagctgggcgaggaactgcgccggctcaccgagaagaacgcttcgctcatgttcttcgtcgagggtcagcgcagccgcgcgcggctgatgctgccgcccaagcgcgggatgttgcgcgcgctgcagaatacgaagcgccagttcgtcgtgttgcccgtcgccatctcctacgaccggctcccggaggaggcgtccctgtcggaggaactgtccggcaagccgcgcccgaagatgacgctcaccggcgtgctgtcgtggctcacgaagctgacgcgtggccaggtgcagttgggccgtgtgcatctgtcgtgtggcgcgccgctggcgctcaacccggacaccgacgtccgcgcgatgagccatacgctcatggcggagctgcagcgtcacaccacggtgagcagcttccatctgcgcacgttcctcgccgagaacccgattccgggcgtggatgaagcgtggctgcgcgaggccatcgagcgccgcggaggccgcgtgctcgacagcgacctgcccgtccccagctccctgtctcccgcgctggcacactcgctccggaatcagtggcagcactggttcgccggtgatgtgctggcccggcagcccggcaaccccgcgctggaggaccacctgtcgcgctaccgttggtgcgccacgccgctggccgagctgagcgacgcgcgcgtcgacgccgtggtgaaggcgctcttcgagcctgtcgtgcgcgactaccaggaagcgacgaaggtgcgcgcgcctgatgagctgaaggccgtggcggtgacacaccggccgcacctcgatggcgtggtgcaggcgctggtctcgcgcgacatcgtgaagcccgcgggtgacaacttcgagtgggggccgaacgcggcggagctctcgcagttccatgaggcatgcgcctggcgcggggtgcagccgtgaagacactcgtgacgggagccagcgggttcctcggacgcaacctgctggagacgctgggcgacgacgccgtggcgctggttcgctcaccgctgccgggcccggtggcccaggtgtcgggcacgccgctcgaccctgacgcgtggctgtcccaggcccagggcgtgaaggtgctgattcactccgcgggaatggtccaccacagccggcagcacgccgacgagatggtgcgcttcaacatcgacagctcgctggccatggtgcgcgccgcgaaggcgctcgacgcccggctggtgctggtgtcgacgtcaggcacggtgggctgcttctcccatccgaccatcgaggcggacgagcactccctctacgccgaggcgctcgtgggccggtggccctactacctgtcgaagattctcgccgagcaacagtcacggaagctggcgaagcaactcggcgtggagatgacggtggtgcggcctccggtgctcctcggccccggggacaccttgggccgttcgacgaccaacgtggcccgcgtgctgaacgggcgcctccccttcatccccacggggggcatcgccttcaccgacgtgcgggacgtggcgcatgcgctcgccgtgctggcgaagaagtccgactggcgggacacgtaccacctgtccggcaccaccctgcctctgcgcaccttcttcgagcgcgtgggcgaggtcgccggcatccgggtgaaccgtcccggcgtgccgacgctcgtcgtcgacgggctcgcgaagctcggcgcccacgtgccgctcaagaagctgccggaccccgtggtgctcgagatgtcgacgtgccactgggggttcaagactctgtggagccacgaggagctcgactaccggccgcggagccaccggcagaccctgagcgacacggtggcgtggctgcgcgaggcgcaggcgcggcagacgcccctggcgggctgaattctggaggggcagcgctccgtcgccgcccctccccctcaaacaacgagggagcgatgcggcacatggcctagactgggtccgaaccaaccctcttacggacccggtcgaccatgaagcccacgccaggagacatcttcgtcgtccacacccctcggcttgacgcctacacggcggtccaggtgaccgccctgaaggtcgaggggaaacacgagctggcctgtgtgctggcgttggattgggtaggcccctccctgcccgacgccgccgcggtggcggccatggctcccgcccacttcaacttcttcttctggaaggaccactgcgtccacgtctgggcgtccgccgaggttcctcgcggcttcacccgggtgggccaccggccgcccctcgtcgtcgaggacgtcaacagctacagcggttggccatccggcagcgccctctacagtcagcgccgctgggaggccatcccccaggcgcagcgcgacgccttcaagcagatggtcgcagcacccgaccagcaagtgctgttcacg

SEQ ID NO: 414 - DNA, 1680 bp, Myxococcus xanthus
atgtgttgaccgcgcacgcgcgcgacgccgctggcaacttcaccacctgggcgccgatcctcgtcaccgtcgccaacgctgttgtcgacaccacgcctcccgaggtgcaggtgaccgcgcccgttgcgggagaggcggtcagtggtcccttcacggtgcggatgagcgcgagcgacaacgtgggcgtcacccgggtccacgtcgagctcgacggcgttcaggtcggctcgccggacatggccgcaccctggtcggtgacgctcgacaccgaggcgctccagccctatgggctcaggcagttgaccgcggtggctcgtgatgccgctggcaatgtcaccgtctccgcgccggtctccgtcaacgtgagcgcgccacctcccgacgtcacgccgccccaggtccaaatcgtcgcgcccgagagcggcgtgacggtgggcggtaccctccaagtcagggtcgacgcccatgacaatgtgaggattgcgggcgtgcagttgcaggtgaacggacaggacttcgggcgcgaagacctcagctatccctattggatcaacgtctccaccaccctgctgggggacggcaccttcccgatgacggcggtggcgcgggaccgcgccggcaaccggaccacctcggcgccagtcatgttgaccatcgccaacgggccgcccgtggtgctcgatatcccggtggcgcatcctcgggtgtggttcacggcggaccggctggcccgggcccaggcgtacttcgcgcagaacccgtacacgcccgtcgcgaacgtacaagcgcccgagcaggccatcgatgcggcaatgcactcgctgctcaccggcaccccggcgtcgtgccgcgccgcgattgactgggcggtgcgcaccgagattcccatctccgagaacacggtgtcgagcgatccggcccgctggtacggcgaggcggccatcctcacctacgactggtgtttcgcccacctgcttccggcggagcgcacgctcctgatcaaccggtggaacgtcgccatcgagtcgctcaacgacaatccgtggggcggcatcggcatggagggcaacaactactacacggggtacttccgcaactcgctcctgtgggccattgccagctggcatgaaaaccagccgttcgccaacgagctcctgcagtacgcgatgaaatcacgctgggccttctcgctgcggccctatctggatgggccggcggcgggtggcgcaccgcacgagggctcaacctacggccgccggacgttcggctacatgacggtgccgttcaccacgctgggcctgtatggccacgacatgtggaaccagaccgactacttcatggcgtcggtcttctggtccatctactcgaccacgccggggcccagccggaggggccaattccagctgttcgagaccttcccattcaatgacgacgagcgctggctgaaccggtggaatcccagcaacaccgcgcagacgttgctgggcagctacttcgccccgctcatcggggagtggtcggaccagcccatcgcgggttatgccaagcgcttcctggagctcaccggccatccgattgacgaccggctcatccggtacgtctacagcgacacgctggcggcggtgccgtctcgtgacctcgcggagctgccgctcgactaccacgcacctggactgggca

SEQ ID NO: 415 - DNA, 2537 bp, Myxococcus xanthus
cgctcggcggcgaccgggtgcgcgtcctgcgcgtcaccggcctggagatacgcctgacgcgcgtcggccagccggccctgcgcgatgaggccttcggcgtccgcgaaggcgcgcgcgccttccagtgcgagcagcagctcctcgtccgggggcgacggcggcggcagtcctcccgcggagaagcgcaggcgcaggcccgtgctggagacctccgcagccgacaggcgcgcggtgtccagcgtcggcatcttgtagccgcggctgaccgccgccagttggcacagcgcgggcagcacgcgcgtggagaatcccgtggccccgcggacctcgacatccggcaccagcgccagcgcgcccatggccgcggacaagagccccggcacctgcacggacggcgtggaggagaagccatagaggcgcacgtcgtagaggtagacggcgagccgctccccatccgcgtcgaacgccaccttgaaggtgaagggcgtgtgctccggcgccggcaaccgtccctggccttcgaggtagccgggccggaagtgcaggcgcaggtcctcgatgccggccagacgcccggccagctccgccacccggcgcgtcaccaggtccgcgtcgacggacagctcgaggaagccgaagtgcagcttcttgcgctggtagcgcgtggcgccggcgctgacgttgaaggggaagctgacgtccggaatctggagtgcgaagtcggagatgcgcagtcccggcaggacctccagcgccgggaagcccacgaacgccctgcggtccagcaggcgcaattcgggggcggcggcgcgcgcatccagcgccgtggcgggcttgggagaatcgctttcggtagccatcgcgggagcagggacgttagcacgggctccaagccctcgaaatttctggcaaaccccagcttgtggggcaagcaacgaggcgtgatggctccctgaatccagggtgaaggaacgggctgcgcgctgggccgaagtcggacaagatgcgccccgcgtgctggcccctgactcccttgtcctcgacggtcgcttccgggttctccgtccgctgggctcgggcggaatgggtgaggtctaccttggcgaacaggtctccctgggccgcaaggtggccatcaaggtcctgcaccatgacctccacgcccaggccggcatggcggagcgcttcaagcgcgaggcgcgcctcctctccgccgtggagcacccggccgtggtgcgcatcgtcgacttcggcgaatccggcgaccacgcctgcctggtcatggagttcgtcgaaggtgagagcctgtacgacgtgctcacgccgggccccatgcccccgggccgcgcgctgcccctgctccagcagttggcggagggcctggccgccatccacgacaagggcatcatccaccgcgacctgaagccggagaacgtcttcatctccaagagcgcccggggcgagcaggcccggctcctggacttcggcatcgcccggttggtcgagccagacgccgccagcagcgtcagccagattggcgtggtgctgggcacgccggagtacctgtcgccggagcaggccgtgggcgcgaaggtggacacgcgcagcgacctgtactcgttcggcgtgctgacctaccgcgtgctgtccgggcggctccccttcgacgggcccctgccgcgaaacttcctgtcgcagcacgcctccgccgcgccgctgcccctggaccgcgcggcccccacgctgtcgcgctatgtgggcctgctgtcgctggtgatgcgcctgctggagaaggacgcgagcaagcgtccccagagcgcgcacgaactggccgacgcgctggccgcggcgcactccgccctctccgccttcacgcccggcctgggcacccctgcctacgtcccgcagcccgggagtggcgccacgccctcctcgggcacgtcggtgttcggcaccgggagtgcctcggggagcagttcgggccccacgggcacggcggccttcgcgggagtcgctccggcgccgcaggcgagcagtggtaccgccgcgttcggcgtggcctccagcagcggctcggcctcgggcgccctgccggcggcctccccgcacacggggacggcgtccttcggactgaagtcctccggcggcgtggccgcagtgacgggcggcaacgcgtcggtggtgaagccgcagaacctcacggtgatgctcaccgacatccagggcttcaccgagcgcaccagccggcagacgcacgaagagaacgcgcggatgctggagacgcacgacaagctgctgatgcccctggtgaaggagcacgacgggcgactggtccagaagcgtggggacgcgttgctggtggtgttccgctcccccaccgcgggcgtgctgtgtggcatggccatgcaggaccggctgtggcgccacaaccagacggtgccggaagtggaccgcctcaacgtgcgcgtctgcctgcacgcgggcgaggtgctcgccacgccggactccgtgctgggcgagcccatggaggtcatcga

SEQ ID NO: 416 - DNA, 1448 bp, Myxococcus xanthus
tcatcggacagcagcgcgcccaccaggtagttgggcaggctcggtgagtacgtgcagcacttggtgtccggccggaacatgcgactcacgccgtccacggagtcgacggcgccctgcgcggagtcctggctcatggcgcagttcgaacaggtggccttgctctcctcgggaacgtcctgccggaagaagtcaggaagaaggtcgcggtagagaagaggaaggctgtcgagcaggcgtggcatggcggctcccggaaggtgtccaccgacgcgccggactcactggcgcgggctgtcttcccggagcctgacgagcggaacgacgcgtcgagcggcctagaagtagcagatggagtcgaagccgcagtagccctgacggtctccgcactgacagtcgtagtcatccgcacagaacatcgccgagcagaaggggccacctgagccgccggtgccgccgcccgttcgataggtgtactcgcacatggagttcacgcaggcggccgtctgcgcactgggacacgcgtttgcgcactcccagtcctcgtcacagaaggactggaagcagatggccagcgaggactcggcgctcgcgcggttctcacagagcgcctcgggcccggagctgatggggtcggccgccgcgacggtcgcgaacgtcagcagcagggcggcactccaggcgaagggacggcggatgaaagacatggctgctcctgagccgacatcccgggcgggagcgcatgggaatgtcaggctgtcaaagaataccaggatgtgtctggggtgaaggcaggcgttctcgctcgctttcattcaatgtcagacattctttccgaccgacgtggcacgtcgcgcgaagattccgtcccgactgatgcgctgcgtatcacgcccactgcgtgagctgcccatgcgctccgtgagggggcgccttcgtgagtcgtgtttcacccgcgcaggcaggtcaaaaagcgtggctgtaagtgaaatagcgcgatgacctgacggtacaggtggcgtgtccagtaggctacgcagccaatgccgtgggtcatccccccgttgaccactcggaggtgtgccatggacggatccggtcccctcccgtttccggttgaagcccaggacgttggcgtcatcggacgcgtgcatgctgcgctgacgcatcagtttccacacctgcatccggtggcgcgttatgccatcagcgggctcgtgcgtttctgcgacgggtggcggcggctgtttccggcgcggtggccgacccaggtggtgcccgcgctgacgacgtgggagcagttcctgacgacggagccccgctcgcgccgcatcatggtgacggtgcagccgttgggcgtggaaacggccggcgggacgtgggcaccggtgctgctggcgcgtgtggcgcgctggtaccgcgacagccgcggcgtgcgccggcagaaccag

SEQ ID NO: 417 - DNA, 2642 bp, Myxococcus xanthus
tggcgcagcggctggtggagggccccctcgcggagcgcatcctgtcgggcgagttcgtcacgggcgaccgcgtgcgcatcgcggtgaactccggacagctccagttccagcgcgagtgatgagccccagcccccgcccccgcgcagggccttcgaaacggcgcccacccgtcgtgattgtcgggatgggccgcctggggggcgccctcgggctggcgctccaggcgaagcgctggcccgtgcgcatccactcccgcacggatgaaggccgcgagcgcgcggaagcgctcggcttgaagacggccgctcccgcggacctgaagcgggcccgcgtcatcctcctatgtgttccggacgcggcggtacccgccgtcgcacaggcgctgtccaccaccctcccccgcacggccgcgctggtgcacacggcgggcgcgctctcgctcgatgcgctgggcacggccaagggccggagtcgcggctcgttccatccgctctgcgctgtctcctcgccacgtgactcgctggtgggcagcaccgtggcggtgagcaccccgtcacgcacgctgcgggaggtactgcgacacatggcggcggacgcggggctccgcgtcatcgaggtgccagaagcccaccgcgcagcctaccacgcgggcgcggtgctgagcgctggaggcctggtgtcgctggcggatgctgcggtggcggccctgggcgcagcgggaatcccgccaacggacgcactggcggccctgttgccgctgatgcattcggcactgaggggcttggagacccggggtctcgcggggggcctcaccgggcccatcgtccgcggagactccggcgtggtggcggcgcacctggaggcgctccccgcggacgtcgcgcccctctatcggctgctgtcgcggcgcgcgctggggctggccggagaccggctggagcccacgtcgcgcgccgcgctggaacggctgctcaagccgtcaggatgatggaaccctgcagggccttgcgcaccacggccagggcctgttcggacgcggcctcggcctcggtgagccggcgcagggacagctcgccgccctgaacctgcgtcacggagcgcttcaggtcggagagcagcgtcagcgcggcctgcagcatctccttgccctgcggcgactcggtggcgggcttgccggccgccttcgccacgtactccgagaagcgctggagcgtctccgccgtcttcgcggggtcgaactgctccagcagcggctggatgcgcgaggcgttgatgcggatgaggcgaagcgcgcccacccggccgaagcccgggtgcaccagtccgatgtcactcatctcgaacgcgcccagcaggccctcgtcgggggccttgtgcgcgtgcggcaccaggtccacgaagagcggcagcgggtccgcgccctggcggaacatctccagctcctcctcgtccagcggcgggaagctggccggggtgccgatgaacagcagcggcagcaccaggtcgtgccagaagtcctcgggcgccgagcctgtcccaccgatggtgccgaacaggtgcgccatcaactccgccagacgcggcgcgcgctcggcctggtcgatgagcgacttggtggtgtccaggcgctggagggactgcacgatctgcccctcgaactgctggcgcgcctcgggcggcagcggcggctgggtgcggcccagcgcgttgcgcacgtcccgagcgagcccgtccggcttcgtctccagggccgtggcggccttcttcgggtccaggacgacgaactggaggaacccggggtcgaagaggcgctggtagtccaccggcgtcagcttgggcgcctggcctcccagggcctgcgccgggctgccgccaaagcgggcctgccccagcgaacggcggatgtccgcagccaggtcttccaggcgggccagcttgccctgccccagcgaatccatcaccgcgccgaacggcgacagcatgatgatggcctccgggaagcccagcgtggcgccctccggcgagtcccggttggggaaccagaaggcctggtgctcctggatgagccgcagggcgaacgcccccgccaggcccagcgcgagcgtctggtgctccggcttgttcacctggaactggccgcccgtcagctgcgcgatggcgggttcaatctccacccagggagccttgagcagatcgactggcttgccggtggcctgctccagggcagcggcgacctgcatctgggcattgtgaacgtgctgcggaacgggatgcgcctgggtggcgggttcggacatggcggaatccagactcggaaataggaaggcgacggggccatcccttaccgtgaaattcgcggtcgtggctacgatttgtggcctgtaggatggcctgcatgcccgcttcccgctggtggcttcgctgggctgtcctcgccacctgtttcctgctgacaaacggcgggtgtgccttcgtcacaccccgtttcccccagaacatccaggcctcgttcgctcgggacgagatgcgcaagctcaccacggagtccctggagctctactaccccgcccagctccggggcgcggccctgcgcatggcgtgcggctggagggctgcgtggcccgcctccaggagctgtagag

SEQ ID NO: 418 - DNA, 2054 bp, Myxococcus xanthus
ccgcaatccggagccccacctgcgcccggcggagttcatcacgtccatgacgtggaccccgcccgaagacaaggccaaggccgctgagcttggccgccagttggctgaagcgtacgacgtccactcgcgcgagagctgctccacatgccaccgatgaacacgaagcgcgacggcgccccgtcgcaggataccccctcctccttcgcgctcccggtcgtcacggaccggcctgccgccaggtccgacgttgtcggcgaggcgctcgagcacgcggccgccaacgcctccccctccgagcccggctatggccagacgtactggcgcagcctggaggagaagctcggcacgcccgactacctggaagcgacgcggccggagttccccgtcggcgcggacctggctcccacgggcttcgcccgccgcgagttcatgcacctgctgggcgcctcgctggccctggccggcgccacggcgtgcagcacccgtccggtggatgagcgcatcctgccgtacaccaagacgccccccgagctcgtcccgggcaacccgctccactacgcgtccggcatgacgctggccggtcacacctccggtctgctcatcaccgcccgcgagggtcgccccgtgaagatcgagggcaacccggaccacccggtcaaccagggcgccgctggcccctgggagcaggcgttcctcctgtccctgtacgacccgagccgcgcccgcgtgctccgtcagggcaagagcccccgcgccctccgcgtcctgcgcgaggagctggtcaacgccgccagcaaggccgccgccaatgacggtggcagccgcgtgcgtttcctgtccgagcccggcaactcgccgctgaccggcgacctgcgcagccgcatcctgaagaagctgccgaacgcgcgcttccacagctacaccgcgcagacgcacgacacgcaggacgaggcgacccgcgcgctcttcggcggacagcccgtttcggccgtctacgacttcgcccaggcggacatcgtcctgtcgctggacgcggacttcctggagagccgcccggagaacctgggctacgcgcgccagttcgccaaccgccgcgacccgaacaacggtccgctcaaccggctctacgtggccgaggcccgcttctccatcaccggcggcatggccgaccaccgcctgcgcgtgaagtcgcaggacgtgctcgcggtcgccgccgccgttgcccaggccgtgggtggccccgccgcctcgatggctggcgccgccgccaacaaggcgtcgctgaagtcggaccacaacgcgtgggtgcaggccgtcgtcgcggacctgcgcgccgcgcagccgggccgcaccctggtggtcgcgggtgagcgtcagccggcggcggtccacgcgctggcccacgccatcaacgccgcgctgggcaacaccggcaccacggtgaagtacgtgcagtcgtccatcgcggagcaggagggcctgagccaggtccgcgcgctggtggaggacatcacggcgggccgcgtggacacgctggtcatcaccagctggaacccggtgttctcggttccggcggacacgggtctgaaggagctgctggacccggcgaccaaccccaaccgcggcaacctcaccgttctctacacgggcctctacgaggacgagaccagccagtacgccgactggttcgtccccgcgacgcacccgctggagacgtggagcgacggccgttcgttcgacggcaccgtggccattgcccagccgctcatccagccgctctacaatggcgtgccggagtccgagctgctggcgatgttcctcgacgagccctaccgccccgcgtaccagatgctgcgcgactactggcaggctcagtccgagggccaggctaacttcgaggcccactgggagagctgggtgtcggacggtgccatccccggcacgcaggccgctccggcgcagggcgctccggacttcggcgccgcctcctcgttggtgacgggctacacggcccccgccacgggcgagctcgagatcaacttcgtctacgacta

SEQ ID NO: 419 - DNA, 2740 bp, Myxococcus xanthus
gcccgaggcggggtcgctgccgtagcgccgctgcgaggcgctgctcttctccttctcctgatgctcccgctgaccgtggggcagcttgagggcgcactcgttgaggctgagcagctgcactagcgttgaacggcttgctcatgtagtgcaccgcgcccacgttgagcgagcggaccttctccgtcacaccctggtgggcggacagcaggatgacggggatgcgcgcggtgtccgacgaggacttgagcgccatggccagatccagaccagtcaggttgggcaggaacacgtacatgaccaccaggtccggccgctgggcattcgcccgagccaggccctccgcgccgtctggcgccacctgcacgcggtacttggagcgcagcacctgcgacagcaccgcggcgatgtccggctcgtcctgcaccaccagcacgcgcggctgctcctgcggcgtggacgcggcggcgggcggcgggcgcgggttgcgcggcgcttcctgcgccagcggcagcgtgaagacgaagatgcaaccggtgtccggcgggctctccgcccagatttcaccgccgtgcagctccacgaactccttgcagatggccagccccaggccggtcccacccttgccaccgtggcggtagcggtcgaagacgaggtgcagctcgtccggcgggatacccacgccgtcgtcctgcacgcacaccttggccgcgtccccatccgggcggcccaagcgctgggtgctcaccaccacctcaccgtcctggcgcgcgtggtggatggcgttggtgatgaggttctgcagcacctcgtgcagcttcacctcgtcaccgatgagcatcaggctgtccgggcagtcggcgcgcagggacacgccccggtccgcggcgagaatctccagttcgttgacggcgtcgcggcatagctgcgccacgtccaggacgcgaggctcgatggacagccgcgccgcctcgcccttgcccttctccagcagcgactccaccaggccgagaatcttctttccctggcgaatcatcgcctcggaggactgccgctgctgcggctccagcggcccctcctgcaacagccggccgtgccccaggagcacctgaagcggcgcgcgcaggtcgtggctgcacaccgcgatgatttcgtccttgagccggttgagctccttcagccggcggttggcctcgttcagttcctggtagcgctggacgtaggcctcctccaggtcctcgcgcttcttcttcaccgcggtgtgcaggcgcgcgttgcggatggagttggccagcacgccggccactgcctgggcgaactcctgctcgtcccggccgaacgacgcgtcagcgcgcgagacccgtaggaacagcgcccccagcaggtcgccctgacagatgaggggctgcaccaggatggacttcacgcccagcggcaggatgttggtgcggacctccgccatcagcgggtcgcgctgcgcctcctcgatgaccaccgattcccgcgtctccagcgcgcggcgcagctccgggtagcgcatcacctcgatgtccaactggacgaggctcgggtcctcctgcgtggccaccaccttcgcggtgcgggcatggctgccctccaccagcaccacggagcaacggtccgtcccggtgacacggccgaccttgtccacggcgatgcggagtatctcctccagctcgagcgaactggtggccgcctgggtgatttccagcagcatccccatccgcaggcggatccgctcttcccggtcacgcagccggcctgcgcgcaaggcggcctccagacggggcaccacctcgtcggcgctgcggatccaatcgtccaccgccagccgcttgaaagcttccgccgagcgcgcgcggcccaggtccaccagcaccggcaggcgctggagccggtccaccttgcgcagcgactccagcatctccgcggcccgcttcgccgtcaccgccagcaggacgacctctggctgcaacgtgtccgcgacctgggccagaccgctctccttctccgccgacgcacactggtagccgctcgacgtgagccgctccatgagcgcatcgcccgcttccttgtcggccgccaccagcacgcgcccccgctgatcagcctgcatctcgactctcacggtgaaccccagacccggcggcatggcgccgggtagagaggctgcaaaaacccgctgcgtgcgaaagagttcatggttcggatcccgatcatgccgctgaacacgccctggagccagaacggcgggcatgggtgggaggatgtggccacgtcggtccccgccgcccccaagccctccgggagccgagcgtacacgatggacgtcacttcccaatcacccgcggaccgcgcacggccgcccgccctgcctaccgcccatcaggcgccagtggggctgcacatgcaacttcctggcgcatccctggcgctgtgacgccgcccaccgcacaaggtcccaacggcgcgggcggaactaccacagcccgcggacattgggggacgttccgcacccaggggggagagagaatcggttcgggcctctccggcaaacgggcctggatgcctgggacaccgcgtaccggctagagtcggcgccatggcccacccctccctgacgcggcgcgcgcggcgctccgcactcatcgtcgccggcagcctggccgccgcctgtggcggcagtgagccgccccctcccgcgccggatccggtagagcac

SEQ ID NO: 420 - DNA, 1882 bp, Myxococcus xanthus
gcgcgcgcgggcggcaagctcgctgagcgtggataaagtgtgtcctcaccgcttccgcctgccggtggcccccggggtggccgccagccgcctgggacgcgagcccgactgggacgtcacgctggccgcgtggcgtcggctgtgcgggggcaacgccgtggtggagggggcagggggcctgttcgtgccgctggactcgaagcacgacgtcatcgacctcattgccaccttgcgcctgccggtgctgctggtggcgcgcgcgggcctgggcacgctcaaccacgccgcgctgtcgctccaggcgctggccgcgcgccgcattcccgtgcgggccgtgctgctgtcgcgcgggacgtccgcgaaggatgtttcggagcgcgacaaccggcggctcctggagtcgcggcacggcgtcccggtgctgggaccggtgccctatcttcccgacgcgcggcgccgccatgccgcgtttcgccgcgcgctgcggccgttgctgccctgaacgcgcggaggccggaaaatcggcctccggcgcgtttccttccgagggcgagtgctacaggttgcgcaagttttcgggacatccggccgtgaaatggacgtgccgttttttccgcgcgagaacgcctcacgaatggcggacatcatcgacctcacgttcctcgcggacgtccggcggttctacaagaagctcatcgaccagagggggctttcctacttcctgcaaaaggaagggcctcggctctttcacatcgagccctccaaggtggaactcgtgctccggaccgctctgcgcacgcgcgaccctcaacttccccggcctcacgacaaggccatcgagcactgccgcaaggaggttcgccgcgacctgattcgtcgtgtcgcgaacgccatgctgcaaacgggcctgtgagccgcttctccgcgcggacggacttcgcacggacacccaacccgctggcactggcgctcgagaggctccgcgccagcgggcgtcccctcctggacctgacggaatccaaccccacgcgtgtggggttgcccctgccggacgcggcgctcctggcccccgaggacgccttctcctacgaacccgagtccctggggctcgcctccgcgcgacaggcgctggtggcggacttcgcggcgcggggcgcccaggtttccgaagcgcacctgctgctgacctccagcaccagcgaagcctacggctggctcttcaagctcctgtgcgagccaggggacaacgttctcgtcccggccccctgctaccccctcttcgagcacctcgcgcgcctggagggcgtccagacgcgttcctatgccttgccgcgcgcgcatggcttcggcctggacgcgggggaggtggcttcggcgtgcgacgcgcgcacccgcgcggtgctggtggtgaaccccggcaaccccaccggccacttcctgcacgacggtgaactggcggcgctggcggacgtgtgcgcgcaccgccagctggcgctcgtctgcgacgaagtcttctcgcccttcgcatcggcgccggcgcccgggcgcgtggccaccgtggcggggcgcgcgctgccgatgctcaccttcgccctctccggcctctccaagtccgcggggctgcccggactcaagctggcgtggacgcacgtgggcgggcccgcggcgctccgtgacgaggcgctggcccggttggactgggtgggggacacgtacctgcccgtgggcacgctcgtgcagcgggtcctgcccgcgctcctggcccatgcgccgcgcttccaggcggcggtgctggagcgggtgaggggcaaccgccagcgcctgctcgcggcccggcctcgcgacgccaactgggacgtggtgccggcggagggcgggtgga

SEQ ID NO: 421 - DNA, 2492 bp, Myxococcus xanthus
aaagccgccgcacacgggggcagcgccagtacctcatctccagcatggggctggaccaggtctcctacttcgtgtcgcagcgcttcgttgacgagaagatggcgggtgcgttgaaggaggtcgtcacgcagcgcgagcaggtggatgcgctggcgaaggacgagcagcgcctgcaggaggagcgcaaccagctcttccgggaccaggagcgcatccgctccaacatcgagtcgctgaagagcggggcatcgcaacgcgagctggcggaccgcttcgtgtccaagctcaacgagcaggaggaccgcctggaggccattgccagcgagttggagaagctggcgaaacagcggcaggaggcgcagaaggcgctcaaccgccgcatccaggcgctcagctacacggcggacctgtaatccgcggtgggctgcccggaccgcaccgggcagccttcgctacccggagacgatgcgccagcgcagcgtcccatccttgtccggcgcgacgatttccacgcgcggattcttggcgctggagcattccaggtacgccctgaagccccccgccatctcatggagggccaccggcgtctggtaggtgaactggcgcagcagcagcatgcccgtgccgttctcctcctggtgcagcagctccccctggtcgcagtaggagcgccacatgcgccgcgccatccccagcaccatgttgggcgtggtgaagcgcagcaccatcttgaagatggagtggatgtctcgcagggtgacttcgtagcccaccgtgtgggccccctccggcttcccgtcgaagtgccggtccaccacgtgctggatgatgccgaagtacgtctccaccggcacccagcccaccgccagcgtcgtgcgcggatccgcgtggggttgcagctcgggaagcagcgactccacggccgtacgcgcggtgtcctcgccgaagcgctcgtgcacgtaggccagcaggttctggacggtgaagcccttgtaattcactccggacaatgaggctgtcacgcttgcgataccccccgctccaacctgtgagccggccttggctcacaggagggttgcggcaaagccgtatgctagagcactccacgacacggcggaaatagcagtacacgccaattccccgcgacagccacgttgcgccctggattccccgactgtcctgggcgctcagcgctggaaggcgcggtagacctccacgccggccaccactgtcagccgcacctcggcgccgggcagcgcggtgacgggcccgtccaccgggtccaccgacagggccacgaagtccgcgtccatgccgggctggagccggccgcgccgggcttcggcgaaggatgcgtgcgccgcgcccacggtgaagccctccagcgcctcctgcccgctcagccgctgctccccgtaccagccgccttccggcaggccccggacgtcctgacgcgtgcgcgccgcgtacaggcccgccagcacgttggggcgctccacgggaaaatcgctgcccaacgccagcaccgcgccggacgccttcagccgctgccacgcgtaggccccgcggatgcgctccgctcccacgcgggcctccgcccacggcatgtcgctggtggcgtgcgtgggctgtacgcttgcgatgaagccgctgcggcccagccgttcgatgtcctcggggcgcatgatttgcgcgtgctccacgcggtgccggccggactggagcgtgccggtggcctcggccgcgcgcgcgagcacgtccagcaccaccgtgttggcccggtctccaatcgcatgcgtgcacacctggaagccccgcgccatgaaggcgcgcacgcgcgcttcgtactcctcgggggacagcagcagcagaccgcggtggccgggttcgtcgctgtagtcctggtgcagcgccgcgccccggctgcccagcgcgccatccagggtgagcttcaccgcgcgcatcgtgagcatgcgcccctcataggggccgtccttcaggtacgtctcccggtcgcccgtctgtccatccgccatggcgtagacgcgcagcggcagcttgcctcccttgtcccagcgctggagcaggcggaaggtgcgcaggtccatgcccgcgtcgtggacaccggtgaggcccacttgcgcgccgcgctggagcgccgcggtcaactgcgccgcgtgctgcgcgtccgtggcgggcggcagcacggactccaccagctccatggcgttgtccaccaggatgccggtgggctctccgccctcaccccggaggatgcgcccgcccgccgggtccttcgtgtcgcgggtgatgccggcgcgccgcagcgcctcgccgttgacccacagcgcgtgtccgtccacgcggctcagcgccaccggccgcaagggaaagcgcttgtccaggtcggcgcgcgacgggaaggccttctccggccagtcgttctggtcccagccgcggcccagcagccactcaccctggaacgcggagga

SEQ ID NO: 422 - DNA, 1230 bp, Myxococcus xanthus
gctgagaacaccgatcaggaccacgctgacattgaccctgattactgtcacccaccactgtccatgcatgatggcatgacgctggccgagcgctatggtgagcaatgtccagctcgaacagcacagatatcagccggaccgggatggcccattggaagaacgcgccgcccatcagccccacccacagcggggcgcccaggacgatgagcatcatcatgggcacggtgacggccagcgtgccctccagcgagcggcgcgtcaggttcgtcagctccgcctcggagcgctcggccgcgcgggacgccagcggcatcagcacccagccgaacaccgggttgaggaagaaggtgaggcccgcgatgttccatgcggcgccgtaccagcccacttcttcgtggctggagaccatgcccagaatcatcacgtccaggcgcccgttggccgccagcgccgcgccggtgatgaagaagggcaggctggccttgagcaccttcagcgtggccggcacgtccaccttgaaggtgaggcccatgtgctcgcgggccaggtaccagcccacgcccagcttcaccgcctcggacgccaccagcggcaccgccagccacggcagcggcaggcccgccactgcgacggccagcaggcccccgccccacaccagcttggtgacgatgttggagacggacagccccgccaccttgcccttggcgtgcagcagcgcggccacggaggcgttgatgatgatgagcgactgggccagggcgaagacgtagacgagctggcgcacctcgggcggctcgtcgaagtgggccatcaccagcgccatggcgcccatcagcaccgcggtgaggcccagccgcagcagcagcgtgctgccgaagaagtcgctggcgtgctcgggccggcgcgacacctccttgcggatgtacatctccaggcccaggtgggtggcgatgaagaagacggcggagaagctgtcggcgtagttgaagcgcccgaagctctccggtcccaggtgggccggcagcaggaagcgcacgcccatggcgatggcgtacgtggccagcagcgagccaccgagttggagcccgttgcgcacagcgcccatcgcctcatgcgagcgctcgcgctcgcccgcgtcctgcgaaatggaatggctgggactgttcacggtgggagcgtgcggccccggcgccggccaggactgcccgggtgcatagaaaacgagcgggg

SEQ ID NO: 423 - DNA, 2378 bp, Myxococcus xanthus
cttccgtgtgctctaagtgagccgctcacgcagacactcgaacacggtgcccacgccctccgcgtccgagccgtgcaccaccagccccgctggcttgtggaacatcaacgtcaacacgggcgcctccaggttccgcaccagcccgtccacccgcacttccatctccggacgcaccggcgcgaagggctcgtgctccacccgcccatcgagcgtcacccgtccctcacggatggccgcttccgcctgggcgcgaggcatcactccggccttccccagggccctcgccaaccagtccgaccttccggagggttgcacgtcctccggccccctccggcgtgccgcttccagccacctcggggtccgctgcttccgcgccatccacccacgtcctgtctcattccacccaccttcgcccgcgccctgcaccgcccaccctgcctgcgtaccaggctccgtccaggccagccatgcagcatgtctaccttctgaggcgaaggcacgcggggacgatgacctgtgaagccctcgcgacagtttccccccctcggaacctgaaggagtcagcatgggaagcgtcattgacggcagcatccaaggcagcgggtacgggcagcgctcgaaagagggctctcgcatcacccgtggtgagcccggcgcgtcagtaatcgcgcagcccggcaaggagcaggcgaagcaattgggcagcgccgcgaagaagcgcgtctaccaacaggtggagagccgccggggtgacgtggccaagggaatgcggggactcgtttccacgctggagagcatctcgggcagggaggaggcgaaagtggcgcggccgctgcttggcagcgcggcgggactgcttcgccgcacgtccgaccggctggagaacgaaaccaccgaagagctgctcgcggatgcccagacacaggtccgcgagcggcccggactcttcatcgcggggtgcgtggccgcgggcttcgtcctcggccggctcatcaagtcttgagggaagcgcccagaatggaacccacgattccccaccgggacgcagacggcttcggagcgctcttctccgagttcaccgagcaggcacgccgacgggtccgcgccgagctgcgggaggagggacagcaagcgcctggcggcacagggcgctcgaatcaggaagcgtccgacacctccagcgtcaccgcgagccacatcgaaacgacccgcttggaggattcaggaaaaacgcgctgatgggcggaactcccaggaggaggcggacctgaacccgcgacgttgaaggtgcgaggcgccgggcccaggcaggtgggctgcgcccctggaaccaggggtgtgcccactgccgtttgactcagcctgaagcctctgccatgtgcgccgccgtggccgtccctcctgaactccgcaccgccgtcagtcatcccccgccgccgggccccgccgtcgccttcaccatccggctgggcgaggcgctgcaccgctacggcacgcccgcgcatcgcctggagctgctgatgcagcgggtgtcggagcgcttcggactggaggggcgcttcttctccacccccacgtccatcttctcgtccttcgggccgccggaggcgctgcgcacctcgctcatccgcgtggaaccgggggacatggacctggagcggctgacgctgctggacacgttggcggacgacgtcatccacggtcaggtgcccccgacggaaggggcccagcgcgtggacgccatcctcgcgcagcccgagcgcttcggccccgcgctccagctcctgtgctggacgctcgcgggcggcgccgcggggcggttgttcggcggaggcctcaaggagatggcggtggccgcgttcagcagcctgctaatcggcaccctgaacgtgctcacccggaagcagccctccacggcccgggtgttggagccggtggccgccatcctgtcctccgccgtcgccgcgctggccgcgagcctgatggggccgctgtccgcgcaggtggccacgctggcgggcctcatcgtcctgctccccggcctgtccctgacggtggccatcaacgagctggccacccgcaacctcatctccggcacctcacggctcacggcggcggcgctcgtcttcctccagttgggcttcggcgtggccctgggcagccggctgtcggtggtgctgcccgagccgcccgtggcgccgttgccgcccgcgctgccggactggactcagttgcccatgctgctggtggccatcttcgcggtgtgcgtgctcttccgcgcgcgccccagggattggggctggattgccggagcctgcaccttcgcctttgggggggcccgtctgggctcgctgctgctgggggctcagttgggcgcc

SEQ ID NO: 424 - DNA, 2585 bp, Myxococcus xanthus
gctctaacggtcccaggacgatgacttcggcgcgtccgagcgccaatgggcgctggacgaggcccgccgccgccgcgtgccggtgacggacgtcctgggcgccatcgacgaggagctgcacggccagcccgtgctgcccccgcgcaaggccaccgccagcccctgcaagccccgccccttctacgactgagtcccggcgccctccgcccatgatgccttcccctcgcaggctgatccgcttcgcccaccgcgccgccactctcaccagcgtgcggctggccctgttcgccgcgctggcgctggccgccgcctggcgtccgctacagcaggccggaggcatgaacgacttccgcgacgcgcacctgctgcactcgtacgaggacgcggggacgcgcacggtgacgcattacgggcagctgccgctgtggaacccgtgggcctgcggcgggcagtacacgctgggcagtccgcagacgcgcgtggcgtctcccacgctgctcgtgtccgcgctcatgggcgctcggccagcggagccgctgctgttgtgggccttcctcgtgctcggcatggagggcttcttccactacgcgcggcggcgcgtgggctccgcgctgggcgcgctcgccgcggcgccgctgttcggcctggccggcttcacggcgctctcgtggtccattggctggctcaacttcgcgggcttcctgctgctgccctggctgctgtggggcacgcgccgcgcggcggagggccatctccggggcgccgcggtggtggccggcaccttcgcggtgctgctgggctttggcggcacgtacccggtgcccatgggcgcgctcttcgtcgcgctggaggccggacgcacactgtacgggctgcgcgggacgccgcggcgcaagtccgcgctgtgggccctgggcgccaccgccgtgttcaccctgggcgcctgcgcgttccggctgtggccgctggtggagaccatgcgctcggcgccacgcatcatggcgggcacgccgggcaactccgcggaggcgctggcgcgcatgctgctccagatgccggcgagctccggctacagcgacccgggcaacttcttcctcgcgcccgcggtgctcgcgctgattccgctggccgcgtgggcctggcgccgcgcgctgtacccggcggtgctggcggcgctgtgcgtgtggatggcggcgggctactccgcggtgccctcgctgttcggcgcgctgcggctgctgcccgtcttcggaacgctgcgctatccggagcgcttcctcgtgcccgcggggctcttcctggcggagctggtggcgctggggctcgccgtgctgctggtgcgcgtgtggcgcgtgccggccgcgcgcacggcgacgtcctggtggcccaccgccgcggtggtggcctgcgtcgtcatcaccgtgggctggggcttccaggtgcgcgccttcgaccggctcagccgctggtcgcagatggtgcccgcgcccggccccgtgcccgaggaggcagagcgccccttcgctcaggcccgcggcaaccgctgggcacagggttacttcctggcgctcaaccggggctccatcgcctgtggcgaggcgtggccggtgcccatgtcggagcgcctgcggggcgacctgccccaggaggagtacctggaggacgcctccgcgggcaccgcgcgccgcgtggagtggacccccaaccgcgtcacggtggacgtgacggccacgcgccccacggtgctgctggtgaaccagaactggcacccgggctggaagtcctcggagggcgaggtggtgtcccaggacgggctcctcggcgtgcgcgtggcggaagggacgcaccacgtggtgctgcgcttcctgccgcgctccggactgggcggagcgctggtctccgcgctcgcatggctgggcctgggcttcgtggcctggcggctgcgcgggcggctggggcccgcggccatcggcgtggcgtgtgtgccgctggtgacctggggcgtgctgctggcgacgtcacctgagccgctggcgcgcgcggtgcccctcaacgcggatggctcgccgatgcgcgtggcggcgctgccgcccaccgcgaagcccgtggatgcgcgcttcgacgtgccggtggagctggtgggcgcggagataccgtcggcgccggacgcggaggggctgctccacctggtgctctactggcgcgtcaccgggccggtgccccgctccgcgggcatcttcgtccacttccctggcccgccgggcagcaagcggaagaacgcggaccacccggtgttgggcggcacctacttcttcgccgaggccccccgggacacgctcctgcgggacgccttctcggtgtccacgaaggactgggacgcgggcgagcggaaggtcctggtgggcctgtggcacgccgggggtgatggctcacgcatcggcggacggggcgcggacgacaagccgctgacgtcgtcccatgtcgaggtgggcacactcgcggtgccgcccaaggcacagtccgaggaaaagccctgagtccatcggacagcgggcagcggggacgcatgacgcgacgcgatgatg

SEQ ID NO: 425 - DNA, 2067 bp, Myxococcus xanthus
gccctctcaagatgaccacccactgcgccaactgcagcgcggcgaacagcgccgcccagaaggccaggccccacacggagaggcccttcaccgtccaggtgctcttttcgtgaacaggcgcctgggtgtcctcggcggtgtggggagcatcctccgtggcatcggtgcgctccttggcggaggacgccggggcctccgaatccaggtccttcgtggcctccatcaccagcgcggtgatggccttcgccagggacgtgcccgcatcggccccctgggccgcggcctcaacgtcccggatgcgctgctccagcctcgcatcgggcgtgtccgccgggatgggggagggcttctgggcgtccggagtggctcccgcgacgtcctctgcctctccggtggaggcgctctcgggggactcgtcgcccgctcccgacagagaggggaccacggctgtgggctcgggctgcacttcgggacctgagggcgtcccctcgccagcgcgctgcgcggcggcctgcttgcgccgggcaacctgcgcgtcgatttcctggaggcgttggatggtctgagcttcaacctctttcgcacgccgggtggcagctgccgcctccttcttgtcgtgctggtcgacgagggcctcggcgacttctcgaatccgcgccgccttggcgcgcgcttcggctcgggactcccgcttgctggcgctttccgccgcttcagttccggaagtcatgcaactcagggccaatgccagagctgcaatggattgaagaaacccgacacgaatgtattgtctgcgtgcgaccgggtcgcccagcagcgctccaccgatgtggaacggcaggctcatgccgtagaagaactggcgcaggcgcccttcgggcggtttccggtctttcagtgagaagtgacgcgcacccgcgctcacctcgccccagagctcgcgcgctcgggccccgccctggccggcaaacccctgctctgtgtgattgtgaaccttgccttcgggtgaggaaccgccgtgccgcgtgtcgctgtctgccacgtgtctcagcgtagcacgagccgagttgtgctaaaggcgcacctgtgagcgcgaaccctctccgtcctcgtcccttccgccagccgctgtccggcgtgctggtcctcgccctcggtgtcgtcgccggctgcgagaagagcaatcccactcctcctccggccgccgcgccggaagccaaggctcccgttgctccttccgaagtcacgctgctcgtgacgggtggcgcgttcggtcagctccagccctccgagggcaagggcggcgcggcggagctgctcggccgctggatggccgatgagaagcactgtcccggtcccgtgaaggagggccagcctacgtgcgcggacgccagcacgctggcgctcgccacgggtgaccactggaacggcccggccatctcctccttcttcctgggcacgcccacggccgaggtcatgggccgcatgggctacgccgcctccgccctgggcaaccatgagctggccttcggcaaggaggccttcctcaagaacccgcggcgcgggtggcttcccgttcctcgccgccaacctcaaggtgaaggacccggcgctggcgggcgacctgtccatgccggcgttccagattttcgagcgccgcggcctcaagattggcgtggtgggcctggcgtccgagaagacagtccgcaccgccatgccgggccgcgcggatggcctggaagtgacgggctatgaggaggcgctcaccaccgccattccggaggcccgcaaggccggcgcggacgtggtcgtggtgctcgccgacgagtgcgtcaccgacctgcagcccgcggtggcgaagcacccggagtggaaggtggcgctggtggccggtggccggtgcgcgcagcccgtcgagctgaaggacggcgcgaccagcttcgtgtcgctggaccgtggcttcggcaagtacctgcgcgcgcacgtcaccttcgacccggcgaagcccgagggtgagaagctgaccggcctggataccaaggtcgtcgaggtgtcgggcggggcgcc

SEQ ID NO: 426 - DNA, 1368 bp, Myxococcus xanthus
ctgccgccgcaccccggcgggcatgaggcggacctggagcggttcagcgaccggccccacctgtccagcgtggcgggccgggggcacgaggaccagcgccggatgctggagcggggcctgggcaaggtgaaggcggcgcccgaccggctggagcgactcaaggcgctgctgcaccgcgagtccgccatgctctccctggtggatcaggtgaacgaggagacgaaggaaatcatccgccgcatgtgggacgcgcagaaggacgagggctactagcgtcatggcggccctggacccggatgatccgaaggacgaggcgaagctggacacgcttctgcagcgctgggcggatggcaaggccacgctgcgggacgtgcgtggctactcggacgaagagctctacgccatcgccaagacggcctactacttcttctatcaaggccgggtgagcgaggcgcgcacgctcttccagggcctgtatgccgtcaacccgacggacgcctacttcgccaaggccctgggcgtggtggagatggcggctgggaacgggcagggggcgctggcggccttcgacgtggccgccaagctgacgccgcatgatccgtccgtttatgtggggcgcgcggaagtgaagctggccatgggccagaagccccaggcgctggaggatctgcgccgagcggcggcgatgcagccgggggatgaccccgtggtgcgcaaggcggcggccatgatctccgccctgagccgccgctgacggccgcatttcacatccggaatcgactgttcttccggggagtctggtaggctgcccgacgctcaattcttcgtcgtcagggaggtcgttgacatgtcgaacccgaatcctgatccgcgcgttcccgcccagatgcctccggaggccccgcccgaactggtcgccaagcgcgagcgtctcgtcaccgagctggagaaccaggcgaagtccgcgacgggtacgctgcagcaggtgatgcggaagatgtccgcgctgctgggcaacaccaagcccggtgcttcgctgagcttccagctctaccaggacgtgaaggacgcctttacccggcacctgaacgaggcgacgaagacgccggccctggccaccatgccgcccgtgctggtggagtccgtggagtggatgcaggcgtacctgaacgcccgcggcttctccaccgacgaagccgctgcctccgcgcccgccgccacggcggctccggccgccgcggccaaggcccccgtcgggccggggggggcgaaggacgcctttgagacgagcagcaataagcacgcgtcgttgacgggggacgtgccgcctccgccggccgcgcccccggacgtcaaggccgagcagaa

SEQ ID NO: 427 - DNA, 2856 bp, Myxococcus xanthus
cttctgtttcggtccctcaagggggacgctgactcttcctcgggtcgtggcgtcgtggagacgtcggtttcttcctcggaacgtggcgtgctgggtccgtcggtctccgactcgggccgtggtgtcctggagacgtcagcctcggcttcgggactcagcctgtcgggggcgtcagtctctgcctcggggcgggggcttgccgtggttgcggcatcgctctccgctgtgggccggggagcgatggactcgcggaaagcgcgagcccgtgagccaggcacgacgcccgcgccgcgagccatccaccgttgctggacgcgcttgatgcgagggacttcgccgaagccgccggtgacgacggacatgagcaccgacatgcccagcgcatgccaggagaactcacccgtgatgagctgggtggcgacttccagcaccgcatcggcggcgatgttggccacgaactgaagggccacgctcttgacggcgttctggatgagggcgcccgcgcccgcgccgaacacgccgccaatcgcacccaggagcgcggccttgcccacgcccgccatgaggcgctcgcccgacgcccagttgttgaggacctggatggcggccgacgtcgccgcgccgacaatggcaccacccactatggttccaatggtcgcggctgccgcggtggcgcccagcgcgctcggctgcgcacccaccgcgctgaatgaccgccgggccgacgaccagcgccaccacgatgacgatggcgatgatgagcaccaccgccagcacgcccttccaggcgggctgttccttcgacgccgcctcttgggcctggacgggaatgtcgcagtcgagctgcgccttggagtcgcggaggctctgttccagcgcatccgcggagtccaccagtgcgctctcgacatgggtgagaatcgtcgtgcaggtcgtctggaagccggtggccacggtctccaggccggtggctccgtccgaagccacctgttgtgcttgcgtggtgaacgcgtcgcgctgctggccgaagcttgtggtcgctcctgccgccaatgcgcccatggatgccgtgaaggaatcaaccagggccgctgtcgcttcctcggaggactggcccagccgcagcatggcctccagcccttggttccccacgccgtccacgcgctccagggcgccggcggctccatgctccacctgggagacgaggccatccagcccgccttcgagcccgcccatggcttgcccgaggatgcgctccagttgttcgccctctggagcggactgcgtggagaacaggtcgcgcacgcccgtgagcgcctgcaccagggtgtcgatggcgcccgtcacggcgctctggatggacgtcgccgaggcgaaggccgccagctcgatgaggacctgttgcaggtagcccgtgtcattcacggactgacgctggtcgtgttcgtggcggtccagccgggccaactcggcgatgaaggccgagtcgacggaggccatcatcgagtcgcgcgtggtctccgcctgcgtcagggcttgtgtccggctgctttcgagcgcggcgacgagttgctcgtactgcgtgtcgagcgtctcgcgggcacggcgggccgcggcgatgacgccgcagcggtccaactggcgccccttcatcgcctcgccggcctgcttcgtggccgtgtccaccaggctcttgcgatagcccttggccgtctcgcgcgcggccttcatctgggcctcggcgcggcggtcggtcaggtagcccgcgaagaacctgtccttcttgttgatcttgcagtcttcgtattcctccgcgtactcctcgccgagttggacgcactcatcgcccactgtcgggccgagtgcttcgtgggcaatgcgggcctgggcgtagagggagttgacgctgtccagcgtggtggactcctgctcgtcaacgagcatcaggccggagtcgtaggcggcccggagcgactcgatcgcactgtcggtctccgagtggatggtggagacggtggtggaatgctcggacaggacttgctggcgggctccctcggcctgggcggtggcggcgacgcgcgcctgctccacgctggcgctgatggccgccttctgttcctccatggaggcggagatcgcgctcttgtacgtctcggcgagcgcgccgatgcgggctggaacatcatcccgcgtcaggagaaccgcgtcctcgattcgattggccgcctgaaggaagaacgcgtccgcgcgtgagttcgcgtcaacacgtcgcgcgtcgtccgccgacgtcgcacctggcgccgggacgaactgcacgccgccccggagcgaaatggcaccggctccggcattggcgagcgaggcggacgcactgccatgtgctgccacggcatcccaccgctggacttcggttgtgtcgatggcttcgtccagcggcgtacgagcggcctcattcgcggcgtcttccgccgttgccccgccgttgcccccagatgcctccgaggacggtgcggccgtggcgtcacccgtgggggccccttccgcggaagctccagcggattcaggggtggaagcgttgctgtccagcgtggactgcgcgggcgccgcggcttccgtggaggagggcgcctgctcggagatggcttcctcaatggggcagttgtctcgctcctcggcatcgggactgacgctggatgcggcttcctgtgactccgtgggcgctggctcgggaggctcttgttcgggctcgccctcgggttcttcaatggcctccgtgtagcaggttgcgttctgggggccgccgcccgcgcaggtctgtgcgccctcggtgccgccgggaggggcggccgtctttag

SEQ ID NO: 428 - DNA, 1921 bp, Myxococcus xanthus
agctcgcctccgcgaggtggtgcaggaacagctcctccatgtgctcgttgccgagccactcgtctccgtacttgcgctcctgaagcacccagccggcggacagcagggtccgcatgagctgctctgcctccaacaccctcatcccggagcagaacccgtgccgctgatacgtatgggacgggtccagggtcaggcgcttgccacccatgagctggggaaaggcccgctccaccagttgctgcacgacgtccggaaacgcgagcgtgctccccagcatgggcaggctctggctccagatcgtgctcacgtaatcatacgacctgcgaccgagcaggaggctggagatccaccccaccagccactccgcatccatgcgcgtattgcctccgtagaagcggaagcgctggtcccagtacccccgggtgatgctctgggtgctcctgcggaggaagttcgccagggtgttgtagatgcggatgcaggccatgaactccagccggtccgcatggagctgcccacggtcctcctcgggagccaccggccggagctgattccagacgccctcgatgaccgtccgggtggtgaagtcccggtagggattgcccttcttgttctggcctcccaggaagggcttgaggtggaagaagcccgccccgcccgccaccatggatttgcctcgggagcgcttgctcttgccgcgcccgtgcatgtccttgaagcgcagggcctgctggatttccttctcgaggacgaagccctggtacttcgcgacgtccttctccttgccatggggcgtcttctcgagcctggcggggatgtagacgtgctggttctcgccgccaatctcccggatgccggagaagacattcaggaagttgaagaggtgctggcccaccaccccaggcgtgccgccccgggagcagcgaatcttcgggttcagggagaacttgaagccgttggcgatgttctccaggtgcagcagcgtttcgaggtgggtgaggaacaggcgctcggactccacgccgaaggacagggcgaagaactcggagatgaactcctcgaggcgctccatatccttgctgccgagcccgaggttgccgacgaggaagtcgaagacctccgccccctggcccctgtaggcacggagcatgatggcggccagcaactgatgtccgatgcgctcgatgcccttggggcgcacctcctgcttgagcacccgggcgcagacctcgagccccagcatgagggcagtctgatgcagctccagcgcgagtgaaggccaggtgcgggccatgcccgtataggggctgatgagcgagttcccaccccggatgcacatgcggttgcgcgcggccttgggccagagctccacgatgatgtcgcaggggcggtactgcgcattccgcaggagcttcgccagggccatccactgcgccggggtggagatgcggaactcgtagcccctgttctgtccggcgatcttctgcttgttcttgatggtgtgaaagagcgccttctccgtgaactggtggatgggcccctggggtatcttgagcagctccgccgtcgcctggcagacctggtagtgattcgacaggttctcgaagaggtcctgcacggcccggaggaaggccacggtggcctcgaactccttcctggcggtgtatgtgccctggttactggtctcaatcgggcccagcggcgtctcgtcgtcatcgctgctgtagtactcgaagtcgggcgaaggcccccggagtggggccggccccccctcgtcctcgtcctcgttgtcggagctggcctcgtcctcgtcctcgtcctcgttgtcggagctggcctccttctccttctccttcgggttctgggccttcggcgtcggtttcttctggcgcttgcgcggcctcttctcctctttagagcg

SEQ ID NO: 429 - DNA, 2453 bp, Myxococcus xanthus
gcgtccgctcgttccatggctcgtatccttggctaggtgtgttccacccgtgcaggtgggtgatgcctcttggataaggtgttgcctggacgcgtcctggctactccactggcatcgattgtccggctcggtgctccggacgccatgcggctcagcgggagtgggtgtccgccagtcgctcgggaatgcgcgcgacgaggaggtcgatggccgcgcgcaccttcgaggtcaggtgtttgctctgaggccacaccgcgtagatttcgttgccataggggcgctgcgtttccagtacttcgacgagtcttccgctgctcaggtgctcggcgatgagccagcgaggaagccacgccagcccggccccctgcaccgcggcgtccatgatggtctccacgtcgtcgaagcgcaggcgcgcctggacggcgatgcgctgctcgccgccttgtccgtccgggaatcgccagggcttgttgacgccgttgcggccgtagacgaccgcgtcgtgctcgcccaggtcttcaagtgtcttcgggcggccgtggcgcttcaggtagccgggcgcggcgcagacggacatcgtctggacgcccagccggcgcgccgtcagtcccgcgtggtccgccagtggcgcgacgcggagggccaggtcgtagccttcctcgacgaggtcgaccatccggtcgctgaaggcgatttccagctccaatcccggatgctggaggaccagctcgcgcagcagcggcgcggcgcagtgccggccgaacatcacgggagcgctgacgcgcaggcggcccgtgggcgcgcgccgtccagagtccagcgccgtctccgccgcctcgagctccgccaatgcgcgcacgcatcgttcgtagaaggcctggccgtcctcggtgagggccctgccggcgcgtggtgcgctggaacagccgggtctgcagacgctcctccagccgcgcgatgctcttccccacggccgagcgcgagagtcccatgcgctccgcggcgagcgcgaagctccctgcgtccacggcctggacaaaggcgaagacgcccccaaggcggtccctcatgacgctgctcccattggtgcctgcgtgtctccagtgactcgacaaagtgtcgccactggcgacgctgcttcgtccgtatagctcccgcatcactttcatgcaggacgcggagcggacgatgggcgcaacgatgaagcgttggcaggcgaagcaggcgggacgggggcacctggaactggcggaggtggcgattcccgctccgggtgccggtgaggtgttgattcgcgtgtcggcggtttccctcaactaccgcgagaagctgatgctcgacggggggggctacctgacggcgcaccagcccttcacgccggcttcggacatggcgggcgtggtggtcgcggcgggcgcgggcgtgcagcgcttcaaggaaggggcgcgcgtcatcgccaactttcagacggactgggtggacgggcccgtgccgcgtgggacggtgcgcagcctgggcggaaacgcgccgggcgtgctggccgagtacgtcgtcatgccggagcagtggctggtggcgtctcccgaaacactcgatgacgtgcaggcgagcacgctgccgtgcgccggcctcaccgcttggacgtccctggtggagctgggcgggctgcgtccggggcacaccgtggtgacgcagggcacgggcggcgtgtccctgttcgcggtgcagcttgccgccgccatgggcgcggaggtcatcgtgctctcgggggacgaggacaagctggcccgcgtgaaggccctgggcgccgcgcacggcatccatcgtcgccacaccccggagtggcacacggcggtgctcgagctgacgcgaggcgcgggggccgaccacatcctggagttggtgggtggggacaacctgggccggtcggtgaaggcgctcgcgtcggatgggcgcgtctcgctcattggcgtgttcgagggattcgagagccgcttcccggtgcagcccttgttcatgagctccggcgtcatccagggcatcttcgtcggacaccggcgcgggctggagaacctggtgcgcgcggtggaccggctggcattgaagcccgtggtcgacactgtctattcgctcgatgcgctgcccacggcgctcgaacacctggaccgcgggccgtttggcaaactggtcatcacggcttgacctggacccgcggcgcggcttgcgccccgacgcgctcggggccaccggtggtggtggctgcaggacgaaagacagacgcgtgcgagggtgaaggaccacggcaggcgttggcggaagacagaacgatggggtcaggcggcgctgcgagggtttgaatcgccagcgggcctggagtggcgcatgcgcccgggcgtactgtcccggacggcatgcgcacactctatggactcagttactcgcccgctctagag

SEQ ID NO: 430 - DNA, 1293 bp, Myxococcus xanthus
tctggctgttgctgccgtcgagcagcaccaggcccatctgctgccagatggcggtggtggccaggtccgcgccctggcgggcgatgttccaggtggtcagggccgcttgggacaggttcggcgtgggcgtggcatccgtgtaccaggtgttgcccgcgcggtcggccgccatggtgttgacccaggggatgccctgctcgcgcgcgtagacggccttgaaatcatccaggctgcgggcctggttcatgcccaggaactgcgccagcagggtgtcgttctccaggttggcgtcacggtaggtgagcacggactgctcggtccactccgcggtgtcggggatggagatgatggggccgtagtggctgctgtacatgcggcgggtgacgttgacgagcgtgccgttgtcgagcaggaccaggatggtgacgtccttccaggtcatctcccgctcttcgttgtcgtagtagtacgaggtcggcttgcccggcaccagccgcagcccgtacagcgtcatgcgctggccggaggagaaggtgtgcgtccaggccacgtcgttgttgaagccgatgaggatcgcgggcacgcccagcaggcccacgccgtagatgtccagctcaccggggacggtgaggtggctctcccacagcttgagctcgccttcccaggggaagtgcgggttggccaccaccatgccgtggccggtggcggagcggtcgcggccaatggcccagccgttgctgcccacctggtgcagttcgggccgctggaccttgacgtggtcgcggtccggcgtgcccagggtggtcgccgtcacgtcgggcggcgtggccgcggcgagggcgagggcgacctggtagctgctgcccgtcagcgccacgctgtaggcgtaggccagcaggtccacatcggagatgggccgcacccacctggcgccggtgcagggcgcggggagttgctccttgggcgtctcctcgatgtagcggttgaagccggccgcgtagcccttgagcatggcctggagggtggcgggctgcgtgctgatgcgctccgtggcgcgcgcatggaggcccagcgagcggtaggcgaagtcgctgcccgcgtaggtgctgccggggcccatgcccaggaagcgggcgcgctcaccgcgcaccttgaggatctgatccgcgaggatacagacgtggtcctgggcgaaggcatagccattgccgtacgccacgctgcccatgtcctttccggtgatgtggggaacgccgtgggcggtgcggcggatggtggcttcctaggtgggcg

SEQ ID NO: 431 - DNA, 1960 bp, Myxococcus xanthus
taccccgagatgggcccgcgcgcggtcgtcgttgcgggggtgcctgctatgctcgtgttcccatgaaacgcaccttggtgtccgcggcgctcgccgcctcctccctcgcgttcctggcttgcgacctggatcagctcacctccgaccacgtcatggtcggcacgttgctctccaccccggaggtggaggtctccgcttccgcgttggccggctatgacgcgggcaccttcagcccggacggtggcgacgtgctcgccctgcccgcgcagacggccgccatcgtcttctttggcagcaagacgggtgagaactcgcagccctccggcctggcgggggccgacatcacggtgcagccggtgggtggcgaggccacggcgctcgcggacgagggctccggcaactaccgccgcaccagcgtgggcgcgtccaacttcacctaccagcctggcgccacctaccagttcatcgcgaaccggggtggcacgcgctacgtgggacaggtggacgacgcgccgatgaaggagaccatcgccgcgctgcacccgcccgaaggcttcctgcgcatcgacgcgagcacgcccctgtccttcgaccggccggcgcccccggcgaatacggaccgcacgctgggcttcgtcaccgtcgtgcccctgagcgccgagggcgcgcagggcgagccgacgtacaccaacctgccctccacgccggtccagttcctccaactggtgggcctgccgggcccgtaccgtgaggcccgcgtgacgattccgggcaccgcattcccccagcgcgagcagacctacctggtcatcttccacgccgtgcgaatgggcggcgccgaatccggcaacctgttcctcggcagcgcgctgctggcgggcaccgccgaggtgggcgtcgtacgcacgcgctaggacggaccttccggcgcgaggcgcgtcagcccacttcgatgtccagcccgatgcgcccttccagcttgaggcgcagcaggtgccccgcgaagcgctcggactcctcgcgggagaggacgttgcggaaggcggtcccgtccgcgacctccacctccagcaccacgccccgctgaagcagccggaagaagtcctcgcctcccgaagggcgcgaaacgaacacggggaggaagcccttcagcggcaccacctcccctgccccccgcacgcgcgactccaaccccaccgcgtccggacgcacttcgtccgcggccacgcccgcgtctgcatagagcggcgcgggcggcagcgacacgtcctcggtcgcgtcatccagcaggaagccgtaccgggacggaatcctggccgcgaacaggaagcacagcagcacgggcgtgtctccggacacgcgctccagatggagaatcgcgcgttccgtccccacacggcgcagcagcaacgtcagggatgggcggctcgcgctcaggtagcgctggacgcggtccttgagcgtggcacgaatctccgcgaaggcctcggcatgcttcgcctcgctctccgtctctcgccgggcaagcgcgtcgcgggcctgcgtcagcttgtcctccgcgtcccgcaggaagtcccctggagcggcgggcggagtcaccagcgcgggctcggcgcccgacgaaggtgtcagccccgcggcgcgcaccgcgcccaacaggaacgagccctgctgctccagccgctcgcgctcctcacggaagcgcaggcgcgacgccgcgtgctccacctggagctccagccacgcctcatacccggactccagcgtctccagcgcgcgcagccgcgccagcgccgcgtccgggctcacgccctcgctggccccggcgtgcttcaccatcccaccctgcgtcgtctcgctcacgggcgaggactctaaccggctccaaacgggaaggcccccacccgcggccgttgccggcgcgaatggaggcccctggccccgtccagggccgcgtgcg

SEQ ID NO: 432 - DNA, 1433 bp, Myxococcus xanthus
caaccgcgagctgctggccctggaacgagagaccgcgcccgcgcgcatggcggagctcgtggcgtccctgctgcgcacgctgcacagcgtgaagggtgcggcgcgcgcggccagcgccacgcgggtggagacggcctgccaccgcatggaggagttgctggagcaggtgcgggacgcgggcgccggcacgcccgacgtgtacgagctgtgcttcaccaccgtggacgcgctcgacgacgcgggccggcgcctggccgcgcgggaggacctggcgggctcgcccctggagagcctgctgccccagttggagcgcgccgccggacgccgggccggcgcgcccgcacccacgagcgccgcgccgccaccgtcgcctccgcccatgctgacggacgcggtgccgtccccccccgccgccgcggccagcgtggagccgcatccaagcggcggcgcgtctgccggagccgaagcgctgcccgtgcgcgtctccgcgcagaagctggacgcgctgctggcacgcagcggtgagctgcgcgtggcgacgctccggctggaaggccgcgcggacgcgctggagtcggtgcgagaggcgctggcgcaggcccgcgaggcggtgctcggcacgcccggcgaacaggcgctgctgcgcgcggagacggagctggcgcgggtgacgctggagctggcggcggaccgccggacactgggcggcgtggccacgggcctggacgacgaggtccgccgcgcgcgcaccctgtccttcgaggaaggctgcgagggcctggagcgcgccgcgcgcgacgtggcgcgcagcctgggccggcaggtgcggctggagattcatggcggcgcattggagctggaccgctcgctgctacaggggctgcgcgagccgctgctgcacctggtgcgcaacgcggtggcgcacggcctggagggccccgaggaacgccagcgactgggcaagcccgccgagggacgcctcctcctcaccgcgcgactcaagggcagccgcgtcgaggtgacggtggatgacgacgggcgcggcctggacctgggggcgctgcgggagcaggcgcgcgcccggggcctgcgagtgcctgaaagtgacgaggaggccgcgcggctggtgttcctggccggcctgtccaccgcgacgaaggtgacccaggtggctggccgtggcgtgggcctggacgtggtgcgcatgcacgtggaggggctgcgcggcagcgtggaggtgacgacccagcaaggccagggcacccgcttcatcctggacgtccccctcacgctgagcacgctgcgggtgctgctggtatcggcgggcgggcagacgctggcgctggccagtgagagcgtggcgaggctggtgcgcctggcgccccacgaggtgcgcgacgtggaggaccgccccgcgtgggcctctgtagagc

SEQ ID NO: 433 - DNA, 3459 bp, Myxococcus xanthus
cggcgcgcggtgtagcgaaggaccgccagcgaaccccgctcaggaagggcggttcaccgcgggcgggtggggcacgtcgcgttcgcgctcgtagtagaggctcgcgcagccctgctcgtagaccacgagcacccggtcactctcctccagcaggtcggagaccttctccgtggtcttgcggacgagtacgtcgaaccttcccgggcgctgtttgtttccggcccggactgtcacgactggcatgcggggttcagctccttgtgccccgcggcgagcggttccgggaggacatccccggcctgggcccatccgaaggtaacaaaggcgtgtcataaccaaacgaacagtccgttgacaagcgggccgcgccatggcgggaagaggctcccatgctccgcaagctccccgttctgctggttggtgttcttggtctggcctcttccgcgggcgcgcaggaggcgcggcggcctccggagcaccgctctccgacgcccgcctgggcgcctcgcggcgtgctcctgggtgtcagcgcccaggatgggctggtggcctcccagacgaaggtgcagtggcagttcaccttctaccaggaccgcaaggacgccttcgccttgctactggagggcagtctctcgtgggggctcgcgttccccgatgccgaggagggcaagccgcagaacgcggtgcgctcattctaccagcacagcccgcaggtgggtgtgggttaccggaaccacctgcccggccaggtgcactggggcttccaggtcaccggcggtcccgtcttctacggcgcggacttcgacggtgggctggagaaggaccggcgcgtggcgggcctcatcgagggccgcgtccacctgggctatcagttcggggacatcgccggtgggctcgctgtggggtatgccgaggcatttggctacaagcgccgcagccttggccgcttcttcgtaggtggcccgatggtcgggttgttcgtggattggcgctaggctttgcgtagagtgtggcttgcgagcaccctgttcgcacgccgcgtatgcccgagccgctcagcgcccatgtgtcgcgatacctccgcaaccgagaagtcttcgagcggaacctgccagccgcgctgctcgtcttcactccagcgacggaggaagacagcggcggggacggggaggagtaccgtctgaagacggtgacgaacgcggggaaccccacgctgggggccagcgggcccttggtgtttcccgtcgtgaaatcgcggacgaacgccttcgggcggggcatcaccgtggggcggacgggcaataacgacgtggtcctggacgacgggagcgtgtcccggttccacgcctggttcagccaggaggaaggccatgcgggcttcctgctgacggatgccgggtccaagaatggctcctgggcggggggcgtccgcctcgtgccccggaaggccgttccggtggcggatggagcgcggttgcgcttcggccaggtggaggtcggcttctacacgaccagcggttttatgcggatgcttgccgtgaggatggctccctgagccttgccacgtcttcgtgggcctgcgtaacgtgcggagtcgccctctgtcacacacgggagtgttcgcggtggccttgaccacagaagcttttggactgaccgacgtcggccgcaggcggcagcacaacgaagacgcgatgctggtggatgcggcactcggtctctacgtggtggctgacggcatgggcggtcactcggccggcgaggtcgcgagcaaccgggccacggaggtcgtcaagcagcacatctccgccaaccgccatctgttgaaggacctgggcatcaacccgacgccggacagccgctccgcggcggcggcgctcgtcgaggtgtccgtccagcgcgcgtgcgcggacatctaccggacggcgatgtcggacgcgaccaagcgcggcatgggcacgacgttcgtgtgcctcgcggtaggcggcaacaaaggcgtcatcggccatgtgggtgacagccgtgtctacctggtgcggcatggccagtgtcaccggctgacggaggaccacacgctggtcgccgcgcagctcaaggccggcacgattaccaaggaccaggccgccaactcgcagtaccgcaacgtgattacccgcgcggtgggcatccaggagtccgtccaggtcgacacgctcatcgtggacctggtgcccggggacatgttcatcctctgctcggacggcctgcacggctatgtcgaggacgaggaggtccttccgctcatcgccggcatcgcgcccgcggacctgcccaagcgcttcatcgacgtcgccaacgagcgcggtggcaaggacaacatcaccgcggtggtggtgaaggtcgcgggcgaaggctccagcgtcagcgaggagtcgagcgaagcgcagtcgcgcatggaggcgctgcgcaagattccgctcttccgtcacctcacctacaaggaacagacggcggtgctgtccatcgcgaccacgcgcacgtatcccgcggggcgcgaaatcgtggtggaggggcagccgggcgaggagctcttcgtcgtcatccggggccgggtggccatcgagaagaacggcgtggagatcgccgagctgcgcgcgggtggccacttcggagagatggggctcatcgacaacgcgccgcgttcagcgacggtgcgagcgacggagcccacgcgcaccatggtcatctcgcggccggacctgatgggcctgatgaagcgcgagtccatcctcgcggtgaagatgctctggagcttcgtccaggtgctcagcgaccggcttcgcgccaccaactcggagctcagcgaggcacggcaggaactggccgtggcccaggcgattgctccgttcgccgaggagtaggaggacgcgtcatggcccctcgtcgaccgaagcagcttcgtccggaatcccaagcacgtcagacgtcccaggtacgttcgcgccgttccgttgtcggagggcgacgcatggcgagggcggtgggcggcgacgtggtggtgaagttcctgggcgaggtggttgagctgcgccatgagctgagggcgacgcagggggacatcgaaggcatggcgatgggcatggagtccatgcgagccggcatggcgaccatgcggtcgaacatggcggccatgcagtcgaacatggactccatgatgggcaacatggagacgatgatgtcgaccgtggagtccatgatcgtcgggctgcgttccgtgtcgggacgcatgagccggatggaggcccatgcgggccgcatggcccggctgctgacttccatggcggattcgacccaggagcgtttcgagcgggtcgagaagcgcctggatgacctcgaagacaagctgtaggcgaggctcgcccatgcgttcgggaaaggacgcgtccggaattttcagggggaatcggccgttccgcgccc

SEQ ID NO: 434 - DNA, 2461 bp, Myxococcus xanthus
ctctaaggggagaacatcgcctcgcaccgcgagagcctccttcgcgccaaggtgctcgtcaccttcaagacggacctgtcgctggacgtgcgcatggcggacctggcccgccggccggtggacgcgcagcgctcgcgcgagctgttcaccgagctggagttcttcgccctcctcaaggagctgccccagcaggacggtgtcgccggggcacccgatgaggtgaaggagaagcccgcgccgctggcggtgacgccgcggctggtgggcgcggacgcggagctcgcccaactggcgggcgccgtgcgcgaggcgggcgccgtcaccctgattcccgcctacgagggctcgcctttcggcgcgaagctggtgggcctgggcgtggcgctgccggacgggcagacggcgtatgtgccactgcggcacgcgcaactcggcgtcacccaggtgcggccggaggccttcaccgcggccttccgcgaggtgctggaggacgcggcggtgaagaagggcgggcatgacctcaaggcgctcagcctggtgctggccaacgacggcatcaccctgcacggcgcacacgacgacgtggagttgctcagctacctgctcaacccgtcccgccgcgagcacgcgctggtggacctgtcgcgcgagcggctgaacacggagctgccgccgctgccgcccgccgcggagggcaagcgcggcaagaaggaccgcgcgctggcggaccacacggtggaggaggtggccaccggcttcgccatccgcgccgaggccgcgcgccggctggcgcccgagctgtggaaggaactggaggcggcgaagctggcggcgctggctcgcgacatggagttgccgctgttgccgctgctggcgcagatggagcgcaggggcgtgctgctggacaccgccgagctgtcgcgcacttccgtgaaggtggacgccgccgtcgaggcgcaggtgaaggaggtctaccggcacgcgggccgcgagttcaacatcggctccaatccgcagttggtggaggtgctcttcacggagctgaagctgcccatcatcaagcggggcaagacgggcccgtccgcggaccaggaggtgctggagaaactgtccgaggagcacccgctgccgggcgccatcatcgagtaccgcagcctgtccaagctgaagagcacctacctggacacgctgcccacgctggtggccgccgacgggcgcattcacaccacctaccaccaggcggccaccgccaccggacgcctgtcctccaccgacccgaacctccagaacatccccgtccgcaccgacctgggccgggagattcgccgcgccttcgtggccgcggaagggcaccaactggtgagcgcggactacagccaggtggagctgcggctgctggcgcacatcgcgaacgaccccgtgctcatcgaggccttcctccatgacgaggacatccacacccgcaccgcggccgaggtgttcggcgtggccaaggagcaggtggaccgcgagcagcgccgcgtcgcgaagatggtgaacttcggcatcggctacgggctgtcacccgacgggctgggggcgcggctgggcattgcccaggacgtggcccgcgacatcatcgagcggtacttcacgcgttacgcaggcatccggcgctacatggaggagactgtcgatagggcgcgcaagacgggctacgtggagacgttctacggccgccgccgctacatggcggacctgaactccaagaaccgcggcgtggcccaggccgccgagcgcgccgctcatcaacatgccgattcaaggcaccgccgcggacctcatcaagaaggccatgctggcggtggacgaggcgttgacggcccagaagctgcgcacgcggatgctgctgcaggtccacgacgaactcctcttcgaggcgccagacgcggaagtggagcaggtgaaggcgctggcggtgaaggccatgtcctcggtggccgacctgaaggtgccgctcaaggtagaggtgggcgcggggcgcagctgggcgtacgcgcactgacgcgcgggcagggcggggcggcgcgaaaaaatacgggaggagcgcccacccccgtaggcgcccctcccgcatgctccacccgcggcccccacagccgctgctgcacaccctgcgacaaatgcgccgacccgtccgaccggcgagtcgcgtggacccccatccacgcgtcttgccagcggctcgcggtgcgcgctcaccactccccagcgggagcacgccttcccacaaagcgcgccatgggcccccacccaggcacactccctcccgccggtctcggacgcgctcgtttccgggcacgtcaagtcgaacgggccggccaacccctacacgccctcagtgcattgccgtacgtccgtctcccgtgtccggggacacgcgccgcgtccgggaaggacgctcgaagtactccttagagca

SEQ ID NO: 435 - DNA, 2484 bp, Myxococcus xanthus
gccatccaacaccggcatgctgccgagctggatgaagctcttcaggctccgggtgacgaagtagggggtattccagacgcccgtgtggctgtggccagtcacgttgcccaaacggtagatggcgacctgcatgccccggctacgggcctgcgccaccaaccgctccgccacccatttgctctgggcataaccggtgcggaaacccgtcgccccctcgatggcatcatcctccgcgagcaggccccctccctggcgaagatgcggcgggaagacggacagcgtggacacgtggtggaacaccttcgggcggccccggcacgcaagctccagaagcgcctgcgtcgcttgcacgttgggcgccctcatctcccggtacgggtagaggaagctcaccaccgcgccgcagtggtagatggcgtcgacccgcccggcaagtgcttcgagctgcgcggacgagagccccagcccgggctccgccagatctcccgggacaggttcaatccgctcccgaaagcgctcctcccagagcccataggcgcggagctttcgttccagcctggcccccgcctcctcgcgcccagccgcgcggatgaggcagtggatgcgcgcgggcagccgatccagcagctccttcaacaggaaggcccccacgaagccggtcgcgccagtcagcaggaggtgccgaggggggcgaggccgcgcgggcaacgtgccacgaggttcgagcccgggtggcagcacggcgtcggccatcggatccacctccgcctcccccctcggaactggcgagcgctccaacgccgcgtcgatgaccgctgccatccccgcgatggtcggctgttcgagcagcgcctgaagcgacagctcgaccctgaaggtcgtgcgcgcccgcatggcgaaccggaccgccagcaacgagtgtccgcccaccgtgaagaaactgtcgaacacgccggagaccgcactccctcccagcagctcgcgccagagctccgccacggcgcgctcggtggcgctccgcggcgggacgaacgcccccgctccccgtggcgcggccccccaatccggagctggcaatgcgcggcgatcaaccttgccgttcggcgtcaacgggaagcaggccagcgggacgaacacggtcggcaccatgggcccaggcaaccgctccgagagccactggcgcagcgcctgcacattcctcccgtcctgacccgtccgcgggatgaagtaggccaccagccgcacatcctctgccgcgtgcacccgggcaacgaccaccgcctgctccaccgccggatgccctgcgagcgtcgtctcgatctccgccagctcgatgcggtgaccacgcaccttcacctgatggtcgatgcgcccaaggaactcgagccccccgccctcccgccagcggacgagatcgccagtgcggtacaggcgcgcccccagcctggccgagaagggatccggaacgaagcgctccgccgtgagcgctggctggccaaggtagccccgggccacgccctctccgccaatgaacagctcgccggcgacgcccaccggcaccgggcgtccgcccgtatcgaggacgtacaactccgtgttgtcgatggcgtgtccgagtgacgggtcggcctcctcgtcctggaggcgctccaccgcggaccagatggtcgtctcggtggggccgtacaggttccagacgctcccggccacttctccgagcgcgcgggcgagcgggcgggacatggcctctccgccgcagaaggcccgcagccccaggcccgccgggagcccggcctgcaacagcatctgccaggtggcgggggtggcctgcaacacgctcgcgccgcaccgagtcaaccccgcggccagcagtgccccatcgcgttgccacgcctgtggcgcaatcaccacgcgggcccccaccgccagcggcagaaagagctccagccccgcgatgtcgaaggagagtgaggtcagcgcgagcaccacgtcctccggccgcagccccggctcgcgccgcatcgactggaggaagttgagcacgttctggtgcgtcaccatcacgcccttgggacgcccggtggagccggaggtgtagaggacgtatgccaaccgggtggagagcaccggccgcggcggcggcgtggagggcaacgcggccagttcggcgcgcacctcatcgaacaggattgaccgcacctgccccgcgggaagccggccgcgcaccgaggactgcgtcaacagcacggccacgcccgcgtccggcatcacgtaggccgtccgctcggccgggtagtctggatccaacgggacataagccccgcccgttttgagcacccccagcaccgggaccagcagctccaacgagcgcgggagggagagccccacccgggcctctggaccaacgccatgggctggcagcttgtgggcaagctggttcgcgcacgcgttcaggttaggtggtcggcacccgatcatagggga

SEQ ID NO: 436 - DNA, 3275 bp, Myxococcus xanthus
tccccgaggatcgcatcctccagttcaactccctcagtttcgactccagcgtggaggagatcttcctcgcgctttgcactggcgccacgctcgtcctccgtgacgcggcgatgctcgataccgtggagggcttcctcgccgggtgtgaacggtgggcggtgacgctgctggacctgccgaccgccttcttccacacggtggtcgccgcgatggccgagaggggactcacgcttcccgcgtcgcttcgtttcgtgatcgtcgcaggggaacgtgtgcgcgccgaccgggtgacgcagtggcaccgccacgcgccaccatccattcacctgatcaacgtctacgggccgaccgaagcaacggtgtccgccacctgccacgacctgtcggctgcgacgacaacggggctggaacgacgtccccatcggacaaccgctgcggacgatgggagcctacgtcctcgatgggcggcttgaacccgtaccggcgggcggcgtgggggagctgtggttgacgggtgagggactggcccgaggctacttccgcgatcccgcgctgaccgccgagcgattcatggcggacccgcacgccaccacgccgggcagccgcatctaccgcaccggcgatctggcccgcatgcgtgcggacggcgtgctggagtacctgggacgcgccgacgaccaggtgaaggtccggggcttccgcgtggagctgggtgaaattgaaaccgcgctccgcgcctgtgagggcgtccgcgacgccatcgtcctgctccatggggagaacgcggggaaggaggcgcggctcatcgcgtacgcggttgccgcaccggaagtggcgccgtcggccttgcgcgctcagctcgccgcgcggctgcccccctacatggttccggccgcgatcgtccggctcgccgcgttcccgtatggctcctccggaaaggtggaccggcgcgccctgcctcccccgccctcctcgactgagggagaggcccgtcgatcgaagaccgagcggatgctcgccggaatctgggcggatgtcctgcagctcgaccgcgtgggcatcgaccagggcttcttcgagttgggaggccactcattgctggccatgcaggtcctcgcccggctccggagcacgttcggggtggaactgccactcagggccttgttcgaggagggcaccatcgcggcgctggcggcgcgtatcgagcaggccggaaacacccccgccccccgcgccactccgccgctcgtccgcgccagccgcagcgcaccaccgccactgtccttcgcgcagcaacggctgtggctgctggcccagatggagcccggcagcgccgcctacaacatgcccgggacgctccacctcgttggaaggctcgacgccgccgcgctcgagttctccctgagcgagctgacgcggcggcacgaaatcctgcggacccgcttgctcgagcgggatggtgaaccggtccaactcatcgagcccgccgtgaaactgcctttcgaggtggatgacctgcgcgcgctgccgcccgggcaacgggaggctcgcgcggcggagctggtccgcgcagaggccgccctccccttcgatctctcacgagcgccgctgatgcgcgcgcggctgctccaactgggcgaagaggagcaccgcctggtggtggtactccaccacgtggtgtgcgacgcgtggtcgctagacctcctcttccgggatctggcggagttctatggcgcccggagcgccggacgtgaggcggcactgccagcgctggaggtgcagtacgccgacttcgcggtgtggcagcgcgggtggctcaatgacgaagtgcaagcggggcagctcgcgcattggcggagggtactggagggcgcgccggcggagcttgagctgcccctgtcccgccgggcgcgctccagcgtccccggtccggccggcgtcgtccggcgccccctgcccgcgccgctgatggcctcgttgcacgcgctctgccacgcagagggcgctacgcccttcatggcgatgctcgccgcattcgaggcgctgctgtaccgacacaccggccaacgagatctcgtggtcggcacgccggtggcgcaccggacccatcgggcacttgaaggggtggccgggttcttcgtgaacacgctggtcctcagaaaccaccttcccgagcacgtcactttccagcagctcgtggcacgggtacgcgaggtggccctcaccgccctcgcgcaccaggatctgccattcgaaaagctggtggaggcggtccggccagtccgcacgtccagtcggccgcccttcctgcagctcatgttcctcctgcgagacacgcccggcgggggccccacgttgccgggcctgaagacctccttcgaggaggtgctgcccgagcaggcgaagttcgatctcctgcttgagattgagcaaaggggcgatggctgggtggcgagctggcagttcgacaccacctggctcaccaccgaggcggtgtcccgcatggccgagcacttcgagcggctgctccggggagcgctggagcaccccggcgcgccgattgcgcggctcccgctgctcaccgagccggaggtggcggtgatgacccgggccaacagcaccggacgtgggtacccgcgcgacgcgaccatccaccagcgcttcgaggagcaggccacccggaccccacacgccgtcgccgtcgagttggacgaccagcgattgacgtacggggaactcgctcgacgcagcaaccagcttgcgcatcacctccggcgccgcggcgttggacccgacacccgggtgggactgtatgtgcgccgctcattcgagagggtgatcggcatgctgggcatcctgaaggcagggggggcatacctgcctcttgagccgggccacccacgggagcgcctcacgcggatgctgacggacgcggacgcgaggctggtcctcaccgaggaggccttggagccgacgctcgagggcatcctcgcggaccggctctgcctcgacgccggatggtcgtccatcgccggtgagtccgcgggaggcgtgccggacgcggcgggagccgagaacctcgcctacgtcatgtacacgtcgggctccaccggccagccgaagggcgtctgcatcccccaccgggccgtggtccgcctcgtcaccgcccccaactacgtgacgctgtccgcggaggatgccttcctccacctcgcgccattctcgttagatgccgcgacgctggagctctgggggcccctgttgaacggtgcccg

SEQ ID NO: 437 - DNA, 1489 bp, Myxococcus xanthus
agtggattcgggcgtggggcgcgtgcacgactattccccgtggaatgaaccgcgcagcccgatgcacgcgcgcggcgaggcctacggccgcttcctggtggagcacctcaagccactggtggaccgcacctaccgcacccggccggagccgcagtggacgggcgccatgggctcgtcgctgggcggcctgatttcgctctacctcggatgccgctatccggaggtgttcggccgtatcggcgccctgtctcccaccgtgacgtggggcgccaaccagctcttcggcgcctggtcggcgcacagccgccgttggacgcgcatctacctggacgcgggcgcccacgagtacacggacgccagcggcgtgcccgtctactacggcgaatccacgcgcgccttctacgagcacctcaagcacctgggctacgcggaccacgaactggcgctggtgttggatccacatggcgggcaccacgagcgggactggcagcggcgcctgccatccgccatgcgctggctgctggggtgaggtgcttcgaatgaagcaccgcgggacggttcccctggagcaacggctcgtctacgtccaggtggtggagggcctgctcgagcacgggctgcgcggcagcgtgtcgccccgcctcaagcatcggttgcggcaggcgggcatcgacctggaccggccactgctgccgggctacccggtgctcctgtggggaaagtgcctcgacgtcatcgtcgaggagacccttccgggcctgccccgggaggaggccttccgccagctcgccgagcgccacgtgcagggctacgggcgcaccgtcgtgggccgcgcggtgtacggcgtgatgcggctgctgggcccccgccgcatggtgcagcgcctgccgcagacgctgcgcgccaccgacaactacacggaggtggagctcaccgagcagggccccaccacctacgccatgcggatgaactcgcgggtggacgcgcccggctacgcggaggcgctcttcgaatccctgctgcgcctgggcggcgccgagtcccctcgcgtggcgcgcatccacgaggacgcggacagcaccacctaccagctcacctggacggagcgctgagcgcgctacgccttgtcctggatgaagcgcaccgtgtcccgcagggcgtccatgtccgcgtggcgggtgaggtacatctcctcgcccaggaggctgtggtagatgctcggcagctcgcggtggaggatgagcgacgtgcccagcttcttctccacgtccgcgtgcgggtgccggtagcggcgggacttgcggcgcgcgctgtgacagacgtggtagcgcggcgtgaagcgaaagtccgccaccgggtcgcccgtcaccacccgcgcccagagccggtacacgtcgatgtcacacgtgtagttcatcatatccaccatgaagccgccgggcggccgaaggttggcctccagcaccatgaagcggccgtccggcagacg

SEQ ID NO: 438 - DNA, 1933 bp, Myxococcus xanthus
catcatcgagctcgcccgcgtcgatttgccggacccactgctgggcgccgaggatgttgagcttgagcaggaagatgtcgctgctcaccggcgtggtggtgccgtcgaggctgccgtaggtgttgccgacgacgtacacctcgtgggtgggcgtgacggcgatgccgcgcgccatgtcgctcgcggaagtgccgtactgctggagccagtacgggttgcccgccgtgtcgtagagggcgacgacgatgtcgtagttgttggggttgccgccgttggcgaagctgccgccggtgtagccggtgaagaagagcttgtcgggcgcgctgatggcgaggccggtggcgaaatcatccatctgcgtgccgttctggcgcagccactgacggttgccggcggcgtcgtacttggcgatgaagtaatcgatgccgcccgcgttggtgtagaagtcgaggctgccgaaggtggtgccggccacgtacacgttgccggcctcgtcggtggccaccgcggtggcgcggtccgtccgcgcggtgccgaactggcggacccactggaggttcccggcggtgtcgtaccgggcgatgaaggcgtcctggccgccggcttgcgggtcggcaccgagctggctggtcgtctggcctgctacgtagacgctcgtgcccgagacggccacggcgtgggcctgctcgtcgtggtgggcgccgagctggcgcacccaggacgggggtgggacctgtgcctcggcgatggaaggcgcacccgaggcgcagacaatgccgacgagcccgaacatgctcaagagagggtgtttcatcacgaactccgtttctcagtgggggaactgagccgtggctccgggaggacgcctgacgtccgctccggggggagaagtctgttgccacggcattccaggaagaccacgagatacgggcgcgcggaagatgggtaacgaaagacacgcatgagactgtgtctgacccgggtctgaggtgtcatggacccggatgcaattgatgcactggggcagcttcagcgccgttgcggctgtgacatgtgtgtttcacccaggacgtgcgccaggcgaggaagttcagagcgcgtggcctgcttcgcagcacagctttggtcagggaattcctgcggcagtgcttgtggcccgccagcgggcgcgcgacagtctccggcagccggacgtccatcacgcgcgaggtctctttcagaggtgaggccgtatttccggccgcgcgcgatgccgtcctctacgaatgtgtggaggtcggacggcgacatcgcctcacatgactcccgccagtgctggcgcacaaggtcgcagagccgcgattcgaaccgatggagagaagcctctccgaaggctgccaacggcgcctggcggataacgagcgtcatggaagagaggatacccatgcgctgcccggagtatccctcggtcggatggatgcgccgccgcgggggaggaccggtgctgcgcggcgcgaggcaggtcgccctcttgagggcaccgggcgggggagaggaggaccgcgggcgtgttggaagcccgcggtccttcgccgcggctcgttagtccttcgtgcagacgacgtcgtcgacctggaggtggtcgcggtcggcttcactgcggctcggatagaagaacaggcgccagtcacgcacgttgcccgtgatgcggaagaacaccggctgccactcgtcgctgtcgacggtgaggaagtcggtggccgggctccagccagcgctcgagtagctgcgatgccggatggtgccgtggccccgcacccggtacgagcaggagtagttgccgctcgggatgttgaacttctcgagcgtgaagcgctcggcgacctggatggggaccacgaactgcagcgccgacgaaccgccatgcaccgccgccgtgtagcgcacgagtcgc

SEQ ID NO: 439 - DNA, 2130 bp, Myxococcus xanthus
taagcccttgcgcgcagcgacgcgtagccgaagaagagcagggggacgcaggccgccatgcgcagcaggaagtgctcgcgcggaccgcgcacgccgtacaccagcgcgaggggaaagagcacggggcctcccagggcgagctgacccgcgaggaactcgccgaaggtgctccaaccgctgcgccagtcgcggcccaggccatggctgagctggaaggcgaagcccacccagtcatggtccgcgttccagaacaccaccggggcgaagaaggcgcccgccagcgtcgccgtgcgccacgctccccagggcaggcgccgcgctcgcaccgtggcgatgaggaacgccacgcccagcagcacggccgggtacttcgacagcagggcgcaccctccggccagtcccgccaggacccatcgttcccgccacagggcccacagggccagcgtccagaacaggagcaggggcgagtcgggcgtgggccacacgccggccagcgcgcccgcggggacgacgctccacagcgccgccgcccgccaggccgtcgccgcgtcgccatggacgtcgcgcgccagccgccacaccgcggccaccgtccccacaccgcacagcatcgcagtgccctcgattcccagcagggcgatgtgccaggccaccaacggtggatggtcgaagtagccccagtcgagcttgcgggaccattgccagtaataggcggtgtcgaagtagacgtccgtgcccaacaccagggcgagccgcgccgccatcgccacgccgagcagcgccacgcaggtcttcagactgaggcccgtcgaggcgggagatggcagagacacgacggcgacctacccggcccacccctctgttgaccagcgtccctccggtgctttcggcttgcccgccctcacgcgggttcgtatctcgacagcaattcctcttcctggagtcccgatggccacgccccctccgtcagttgacacttccaatcgtctggcccgggaaccctctccgtatctgcgccaacacgcacacaaccccgtggactggttcccttggggggaggaggcgctcgcgaaggcgaaggcggagaacaagcccatcctgctgtccgtgggctactccgcctgtcactggtgccacgtcatggcgcacgagtcgttcgagtcacccgagacggcccggctgatgaacgagggcttcatcaacatcaaggtggaccgcgaggagcggccagacctggaccagatttatcaaggcgtggtgcagctcatggggcagggtggcggctggccgctcacggtgttcctcacgccggacctgaagcccttctacggcggcacctacttcccgccgcaggaccgctacggccgtccgggcttcccccggctgctgatggcgctgcgggacgcctgggagaacaagcaggacgaggtgcagcggcagtccggccagttcgaggagggcctcggtgagctggccacctacgggctggaggccgcgcccgcggtgctgacggcggcggacgtggtgggcatgggccagcgcatggcgaagcaggtggacgcggtccacgggggcttcggcggcgcgcccaagttccccaacccgatgaacttcgcgctgatgctgcgcgcgtggcgaagaggcggcggcgcgccgttgaaggacgcggtgttcctgacgttggagcgcatggccctgggcggcatctatgaccagttggggggcggcttccaccggtactcggtggacgagcgctggctggtgccccacttcgagaagatgctctacgacaacgcgcagctccttcacctctacgcgcaggcgcagcaggtggagccgcgccagctgtggcgcaaggtggtggaggagacggtggcctacgtgcgccgcgagatgactgacgcgggcggcggcttctacgcggcgcaggacgcggacagcgagggcgaggaggggaagttcttcgtctggcgcccggaggaggtccgcgcggccttgccggaagcgcaggcggagctggtgctgcgtcacttcggaatcaagcccggcggcaacttcgagcatggcgcgacggtgctggaggtggtggtgccagtgtcggagctggcgcgggagcgcggcgtctcgcac

SEQ ID NO: 440 - DNA, 2632 bp, Myxococcus xanthus
  unsure (1)..(2632): unsure at all n locations
tgtctggaggagaggaccaggtcgtacttcccctggagttgcagggactcgatggccttcggcatcagcggcaggaagtgccggtagcgcgcgtggatgccggggatgtgctgaaggaaggacgtgaagatgcggcgggactcgatggccggcgactgggagcccggcttgtggatgagcgtgtagatgtccgcgtctggcaggacttcgcagagggcatcaaggacgcgctcaccacctcggtgggtgacgagccaatcgtggaccagggcaaccttcacggcacggcttctagcactgggcgcgagcggcgcggcaagcgtcgataggcccccgcgtgcccgcccgccccccctggaggccgcacgtgtggtacgcggaggccgtggcccacgtcctcctcgacctgcgcatggtgcgcggccggctgcatgggattgcccgttacgccctggagctggcgcggcggatgcccgtgctcgcgcccgacctgcacttctccgcgttggtgccccccgaagggctcgcgcccgacctgggtgcgctgacgccgcgcatgccgctgcatcgtgcgctggccgggtttctttcgcccctcgagcagccggcgctggcggcggacctggtgaagctggcgccggatgcgttccacgccacgtccttttcactgcccctcttctggaacgggcggctggtggccactctccacgacgccaatcacctggcgctggcggaccagtacacgccggcccagtccatctactaccgcgtggtggtgggccctcgcgcgaagcgggccaccgcgctggtgacggtgtccgagttctcgcgcgacgagctcgcgaagcacctcaagctgtcgccctaccgcctccaggtgattcacaacggggtggatgcccgcttccagccgccgacccaggccgaggccgccgcgttccgcgaacggtacgagctgccagcgcgctacgtggcggcggtgggcaacgccaaacgcttcaagaacctggcgctgctgaaggatttcgccggggagttgccggtgcccgtggtgctgctggcgggcaagggcgcggtggcgcacgagctggggcttcacgagaacgtggtcgatttggaggagctgcccgaggaccagatgccgctgttctacggcgcggcgtcggcgctcctgctgccctcgcgctacgaaggcttcgggctgccggccctggaggccatgggcgcgggctgcccggtgctggcgtcggatacgacggccctgcccgaggtcgtgggcaacgcggcgttgaggctctccccggacgacgcggcggcgtggcgtgaagcgacgctgcgcgtgcttcgcgacgacgtgctgagccgggagctggtggagctgggccgggagcgcgtggcgcgcttcacctgggacgactgtgcccggcgcaccctggccgtctaccgccgcgtgctggaggccccggcgcccggaggctcgcgcgggacgcctcgccgttagggcgtgggcccgggcgcgccttccatctccaggtgcccctgacgggcctcccggccgcgcaggcgttcactgccctcgcacagccccagtccccagatgagcgagaaggacaggtacacgctggagtggaacggcaggtagtgcaccaacgcgaggatgtggaagcccacccaggacagtagggcgcccgtggccgcgatggagccctgacggtagcgccggatgagggcgcgccccagcaggccgtgcatcgccagcatcagcaacagccccaccaggcccgtctccgcccacaccgtcagccagaggttgtgcgaatcggtggccagcaggtcggtgatgcccgtctcgtcctgcgtggccagggcggccggcttgtggttgccgaagcccacgcccgtcagcgggtattcacgcaccaggctccagcccacggccatggcgtgctcgcgctctccgccgtagatgttgcccagcgccttctccattcgcgtgcgccaggccgggctcatggagacgacggccaccagcgcgaacaggagcgccaaccccatcttccgcgcggagccctggaccagcagcagcaacgccaccacgctcacgagcaatgccgcgcccagcgccgcgcgcgcgaaggcgttgtagatggagatgagcatccccatcaccaccgcccccgccaggatgcgccgccgcgcctggtccgcgctgcccagcaccgacagcgcgggcccgagcgccgcgatggcgccgtgcgcgaagcgaagccggtgggagaagaagccacccgccgcgtagcgcggagactcctcggtgccgaagttctcgtgcagtcgccccaggttgagcttgaggaaggagggcagctccacggaccagcgcacccggttctggaacacgcccagcagcgcggccagcagccaccctcccgcgaggacgcccgccagcagcagccacggcacgcccacggcgccaatgcacgcggccgcggcgcccgccaccgagtccagcacctggccgtaccgcgcgccgcgcggncacgacaccgccgcgcccgtcagcagcgccacggcgggcgacgccgcctgccacaggcacagcaccccactggccccgacataggcgcgcacg

SEQ ID NO: 441 - DNA, 2525 bp, Myxococcus xanthus
tggcgggggtgacggatgccaaacgctcgcccgagcgcaggccacgcgagcgcgagtcgagccacgacgcggagaagagccccgcttcggtgagccgggcctccagccgcgcgacggcgtcgcctcgggccgcggacagccgcaggcccgccagcagcgccgcgcgagcctccgcgtccgccgtcagggctgcccgcaccgcgtcccggcacgacgcgagcaagggcgtgcgctccaactcctgcagcagctcgaagagcgccgcgtgggtgcgaagcgtctgggacaaggagtcgtcggtaagcgtcgcggtgtcgcccgggacgagcgtggtgcggtggtactcggtgagcagcgcgcgggccttcacgcccgtgaagaaccgcgtgacgcgctccgcggcgaggatgctcagcgtcagaccgaattgctggagcacccggcgcgccccggccttccgcgcgaagtagaagaacgcgtaccacttgcgcgcgatgtccaggtacgagcccagcgcggccatcgcggtggccagcacactcaaggcctgcggctgctcgcggtggaccagcgccagctccgcgtccagcggcccttccgcgagcacctgtcgttgtgtcgccagcccgtcgagctgtatccgcgcggcctggaccgcgtccggcgtcgccgagccccagcgcgcgaggacgtccggacgggccgactccagcagtggtgccagcttctccgcgaaggcgccgcgcgccgcgccctccgcctgagggtccgcgccgaagacaggcacgtctggtgacacgagcgcatccgcgtcccgcgccgcgctgtcgatagcgctcaggcgctcgcggtaggtggccagcggcgtcgccaggtacgtggcgagctccccgcccagggcctcgcgccacgggttctccggatagccctccttgccgccgcgctccagcacctcgcgcacctcgcgctcgtgcggcgtcacgtcgcccagccgtgcgtgggcgaggctcgacacagcgggcgtgagcgcggcgggggcttccacggagaaccactggcccaccagctcgtggaaggagggcgcggtgcctccgtcggggcgctcggagagggcgcggtcggcggccgtcagttcgtcatggagggactggagctccgtgtcgatgcgcgccagttccttggccacggccgcgtcggtccgtgtctccggcagcgtgtcgagctgctcgcggatgcccatgtagaggtcgcgctggtcacgctgggcgtcgtggacgacggcgcacaggtgtcccaggccgagatggtccaggcggtgcttcaccacgtccagcgcggtgcgcttgtcgcagacaagcaacacgcgctccccgcgcgccaggtggtcgccaatggcattggcgatggtctgcgacttgcccgtgcccggaggtccatggatgacgagcccccggctgctgcgtgccagccgcaccgcgcgcgcctggcacgggtccgcgagtgtgacgagccgctcctcgcctgtgcgcttgagcccctccaggttgggctcgccgccgccgtgtcccgggggcaggccgagagacacatccacgcggaggaagctctccagcgggccggagatgggctctccgtccatgagcgcgcgcatgtcgtccacgaggctctgattggacaggggatacagccccagcacggcgctggggaggatggcggcctggggctgggcatcgtcgccacgcggaatggcggccaggagggtttccggcgtgaagggggcgggcgcgggcagctccatggccttgcacacggcggccaccaactcgttcagctcgcgccacgggtcctcgcccgcttcatccgcgaagaggtcgcccagccgctggcctgtctgctgctccagccaggcgagcagcgcggtgttgggggccacgcggtccacgccggcctcggcgccttccagctccaccgacggcacgcggcccttcttgagcgtgagccgcacggggatgaaggcgatgggggccaggattcgccgggtgccgaagccgcgcttgtccttggcgccgggtggcaggtggagcaggggaaagcccacgtgaaggacgtgcgcgccggtgtcctgctcgaaggtacgggcgtcctcgacgatggtggccagcttgcggagcaggtcctgctgttcctcctccgcgcgggaaggcgcgggggcctcatccggcggaggcgcgttgtcgggacgcgcgtggcgggaaggcccttgggggggggccagcggaagcgcggcgtcggaagccacgtcgcgggaagggacgtggttttcgtccagtgcgtgcgcggccgtgggcgccgcgtccagcaggtcgtcggcatccgtccccgtggcatcgtcgtcctgggcgcgagcggcgcgggcctgggcggagcccttgcgcgggcgagcctcgggaggcggcggcttcaccacgagccgggcctgggccttctctccgagcagggcggccagcaaggtgtggggcgcggtg

SEQ ID NO: 442 - DNA, 1576 bp, Myxococcus xanthus
gcagcaggcctgccccaaacgtccccagcgcccagcccatgcggctggacggcacgggccaaccgaagtgccgcagcgcacgctccgcatgctcacggaaggactggagctcccccaactggaagcgcgtctccgccaggagtgcctccaggtgccccaacgtcatggcgtcgccacccacttcggtcacccgtatcagcgcccgggtgaggaaaggcagtgcttcgcggcaggcgcccacgcgaagggcatcctcgcccgcgcgcagcgcatagcgagcctcacgcagcgcgtccccggccatgccccagtggtaggtgagcgccgccgtccactccgcccgctgcccatgcgccgcctccatcgccagcgcggcgcgccggtgcagcgcgggccgcgcgtccacgggcaaatcatccagcaccccttcgcgcagcttgtcgtgcgcgaagcgccagcgcccatccgccacgtccagcaccgccgccgccgcgcagtccgtcagccagtgctccacgtccacatccggcgcggcctgctggagcagcggcacgtccacctgccgcccgacgatggcggccacctgcagcaactcccgcgatggaaccggcaccttctccagccgccgctgcaccagcctgcgcacgccgccagcgaagacgcgctccggcagtgccatgtcgccaagccggtccagccctcccgcctcctccgccagcgcccgcaccacctccacgaggaagaagggattgccctccgtctcgcgcagcagcaagtccaccaggtggggccgggctccgggtgcccccaccatggactcactgaggatggagacctcccgagcgtccagccgaggcagccgcagcagtgacaggcctggcagcgccgagggaagcgaaggcgcctcatcgtcccggaagctgccgatgagcaacaggcgcagcgtcaacgcccgcgtggcgagccgtgagagcagaagcagcgactcatcgcccgcccagtgcaggtcctccagcaccaccaccacgggctgggtcagccgcgcgaacacgtcctccaccacctggagcagccgcgcctgcaccatgtccgcgcccacttcggcggggtccgcgacggggtgccccaacagcgcctcgatgtccggcaccagcggcttgaggatgctggcctcgcgctcactcagcgtggtgaggatggccagccagcgcagcaccggacgccattcctggtacgggctgccacccgccgccacgccctgacctcgcagcaccaccgcgcccttcaccagcgccagcgcgcgcagctcctccaggagccgcgacttgcccacgccgctctccccacccaccagccacgcgccgccgcggcccaccatcgctgactcgagcacggtggacagccgcgcctgctcctccacccggcccacgtagcgcgcggcctggaggaagctctcgcgtgtggcggcggactcgggcggtaccggctcaccggtggcggcgcagagctcggcaatcacctcgtccgcgctgcggggccgcagcttcgggtccggcgacaccagccgttccagcac

SEQ ID NO: 443 - DNA, 2695 bp, Myxococcus xanthus
gctctacgggggaattcatccaggctttcggcggagggccggggcttcagcgccgcttgttgaggatgagcggcaggtggacggcatcgtccttgtagtccaggcagagggcatacatgcacacgttgatgcccaaccgcaccgccagctcgcgctggggctcgccacccggcgagacgtcgaactcgtagtcacccgactcgttgcggctccacgccccggccaggtcgttctgcgagtacagcaccgcggcgcgcttgcccaggttgcagcccatcaactggggcttgttgagcacccgcccgggtgccgcgtccaacaggaagaaggacttgaacaccacgtgcttcgacggcacctcggccagcgggctctgcggcagcacccgcgccatctcccggcggaaggacgcatcgaagccggccccgtcgctggcatcgttggcgtccgcgagcatgaagccgccgtacgtcaggtagcggcgcaggttggccacctccgcctcctccagcgggggaaactccccctcgccgccgaagtagaggaacgggtattcgaagaggtccggtgaactgagcggaaacgggcgcgcgtccggcacgacttccacggaggtgcggcgctgcagctcccaggcgatgcggcgcagcccggacagccgtgtatcccagcggcccttgtgacgggccacggcggggatgaagcggttcttctcaccgaaggcatgcgcccgccgcgccagcagtggggcgagcgcggcggtgccgagcaggaggtttcgacgggtcagacgccgcgcggacatagggcgtatctatataccgtcgacgggtatgcgcattccccggtatagaacggcgtcatggcgaaaggcggacagacgcccccggcgcccggctcggcggaggcacatgccgcctgggcccggaaggaggcgggcgacgtggcgggggcgcggcgcgacgccgagcgaatcctcgcgggcaacccgtccgccgaggaccgcgcggaggcggaggagctgctgcggtgcaccaccaccccgcgcgccctgtacggcttcgccctgctcgccgccaccgtcttcgtgctcctgctcgtactcgcaatcgtccgatacgcgtaagcttcggcggaccgcatcaaggagaatctgccatggaaggcctcctccaggccctcggggcttaccagacgttcaatccgaccggctgggtggccgtctaccggatgctgcccatgtgggccggcatcgtgtgctgtgtcgctggcgtgacgttgctcgtcgccggtgggggcaagctgttccgcgtgctcgcgggccccatcggcgcggtgctgggcctgctgtggacgcccgtgctcgtcatgaagctgggcctgccggacgtggcgaagatgtccaccatcgccgccgcggtgctgatggcgctgggcttcctgctccccacggccatcaccttcctgggcgtgggcgtgccgctgggcctcgtggccgggcagatcgccgggcagcaggacttcctgctgggcttcgcgccgggcttcatcatcggcgggctggcgggcgcgatgctgcaacgcccggtggccgtgatggtggcctccgcggtgggtgcgtggatgttcgtcatcggcgcgctcgcggcgctccaccaggtgggcggcgtggtgcaggcggtggccagcaagccctggggcgtcatcatcgccgcgggcctcttcgccgtggccggcgcggtgtaccagctcgccgtccggccctctcccgaggaggcggacaagcttcgcgcggagcgtgagcggctcaaggtgcggcaggcggagcaacatgcgctcgaaaaacggtggggggtcaagtagcccccagagactggtggccgtgctttacgtccccctgcccggggcgtacattccgccgcctttccccccccggaaggattgatgggtcaggctaggcgtcaggagaagcagcacgagtcccccacggagtccgctccccggcaggagcctcccgcgagcaccgcgtgggtgaagccgacgggactgactcgcaaggggtgggccgtgctcgtcggcctcatcctcgtcatccagttcccgctcatccactacgcgctgctgcgaggacaggcggaggtgacggcgaagctgccctacacgcaggacttctccgacccgggcgtggtggagcgcgacttcttctccgcgggtggctactggcgcgtgctgcagggcgagctgctcgcccccggcgtgaagaacaacccgctgtggctgcaggccccgctgccggatgacgtcgccgtggaattcgacgttcgctcggagctgcccgccggtgacatccgggtggagctcttcggcaacggcgtggacccggcctccgggtacgtgctggtgcagggcggctggaacaactccatgtccgtcatcggccggcgcgacatgaacgcgccctccctggacgccctccggcgccgcgccgctcgtggaggcaaggagaacgtggacctgaaggccagcggcttcttcaaggagaacaccaaggtccgggtggagctgcgaggccagccggtgcaggtgggccgcacgtatcactggcgcatcgagcgccggggctcgctgctgcgctggttcgtcgacggcgagctgatgctggagctggacgaccccttcccgcctgtagaggtcc

SEQ ID NO: 444 - DNA, 3626 bp, Myxococcus xanthus
  unsure (1)..(3626): unsure at all n locations
tcccggtacgtggacatcgaagacctggcccgggcacgcggcgtggacccggccaagtacacggcgggcctgggcgccagggagatggccgtcaccgaccccggagaggacaccgtggccctcgcggccactgcggcggcccgcctcatccgtcagcaggacgtggacccgtcccgcatcggcatgctggtggtgggcacagagacgggcatcgaccactcgaaacccgtcgcctcgcacgtgcagggcctgctgaagctgccgcgcaccatgcggacctatgacacgcagcacgcgtgttacggcggcaccgccgggctgatggcggcggtggagtggattgcgtccggcgcgggcgcgggcaaggtggccgtggtggtgtgttcggacatcgcgcgctacgggctgaacaccgcgggcgagcccacccagggcggaggcgcggtggcgctgctggtctccgagcaacccgacctgctcgccatggacgtgggcctcaacggcgtgtgcagcatggacgtgtatgacttctggcggcccgtgggccggcgggaggcgctggtggacgggcactactccatcacctgctacctggaggccctgtccggcgcttaccggggctggcgcgagaaggccctggcggcggggctggtccgctggtcggacgcgctgcccggcgaacagttggcgcgcatcgcctaccacgtgcccttctgcaagatggcccggaaggcgcacacccaactgcgcctgtgcgacctggaggatgcggcggacgcggcggcttcgacgccggagtcgcgggaggcgcaggcgaagtcggccgccagctatgacgcccaggtggcgacttcactgggactcaactcgcgcatcggaaacgtgtacaccgcgtccctctacctggcgctggcgggcctgctgcaacacgaggccggcgcgctggcgggacagcgcattggcctgctgtcctacggcagcggctgcgcggccgaattctactccggcacggtgggcgagaaggccgccgagcggatggcgaaggcggacctggaggcggtgctggcccggcgcgagcgcgtctccatcgaggaatacgagcgcctgatgaagctgccggcggatgcgcccgaggccgtggccccgtcgcccggagccttccggctgacggagattcgcgaccaccgccgccagtacgccgaagggaactgacgcagggcgccgggcgcccatcccagacgcgtgacgaggcaccggcaggcttcccggtgcctcccttccgccgccatctccctaccgtgaacctcgaaacccctgcctcgatgaacggggcacggctgaaaggagacggaatcatggcggacctacctgcccgcagaggcggaagcatgctgggagccccacgcggctgggaccccttcgagcgcatgcaggagctcttgggattcgacctcggccggatgctcggcccccagggcacacgggaaggcggcttcgtgcccgacttcgaggtgaaggagacccaggatgccttcatcttcaaggccgatgtccccggcgtggaggagaaggacctggaaatcaccctcgcggagaaccggctgaccatcagcggcaagcgggaagaagagcgccgcgacgaaggcgaccgctactacgcctacgagcgcaactatggctcgttcagccgcaccttcacgctcccccggggtgtgaatgccgacaacgtccaggcggacttcaagagtggcgtcctcaacgtgcgcatccccaagaagtccgaggagcagcccaagcgcatcaaggtcggcggtagcgaacgcagtgagaaggcgaaagcctgagccaccaggaggggcgatcgggagaagccggccgtgttatgggacttggcacgacaaccggcttttcccgaaagaaggctacccaatgatgcgccgcgcccttcccctccccttcctggccaccctcctcctgctggcgtccgcgtgcgcgaccaccggcgcggcgccagcggaggcggacattctccaactcgtgagtgatcagacggaggcctggaaccgccaggacgcggtggcctggtccaaggacttcgccccggacgcggncttcatcaacatcgtgggcaccgtcttcgaaggccgcgatgaaatccaggagcgccacgcgggcatcttcgccaccatcttcaagggcagccagagccaggtcaccgtgcgcaaggtccagttcatccaggaggacctggccattgtcgacaccacacacgaggtgacgggccatcccggcctgccccccggcgtccaggacaccgagcccggcctgctgcgcacgcagatgcggtacgtgatgaagcacgtgaacgggcagtggcaaatcatggccggccagaacacggacgtgaagcccaggccccaggcggccgcgccccagacgccctgatgctcagtgggtggtggaatcctcgcgctgggcggcgcgcgcctgacggaacagcggcgccagcgcggcgaagccagccaccaccgtggagccgttgttgaccacggcggcggcgacaggcggcagccatcccagcgccgcgagcaccatggccacggcattgggcaccagcaccagcccgagccccaggtggacgcgggccagggtgtcgcggcctgcgtcgaacgccagcaacaggtcatcgaggctgcctcgcagcagcaccacgtccgccgtctccagcgccacgtccgtcgcccccctcaaggagataccaacgtcggcgagcgcgagcgccggggcgtcattgatgccatcccccaccatggccacgatgcgtccctggcgccggagcgtgcgcacttgcgtggccttgtcctcgggaagcagctccgcgatggcctcgtccacgcccaaccggctcgcgacctccgccacccgcgacggcgagtccccggacagcagcacgatgcgcctgcgcccgttctccttcagggactgcaccacgcccgcgctctccggccgcagtgtctccacgtagctgatgcacccggccagcgcgccatccacggtgacccacagggtggcgacatcgcgcggcacggaccgggccagcgccgagcccgcgtccgtcacgtccacaccttgctgctgcatccagcgcgcgctgcccacgcagacgcggcgcccgttcacctgggcgcagacgccccgccccaggacgaactcctccagtcccgcctcgggctgcggcacctctacgccttgcgtctgggcgtgcctgcgcaccgcctccgccacgggatgagactgacgcagctcggcagcggcgctcagcgacagcacctcgcgcgcgtcccagccccgaacgggaatgacgtccaccacttccgggacacccaacgtcagcgtacctgtcttgtcgaagacgatggtgtccgcctgggccagccgctccaggtactgcgcccccttgatgaggatgccctgacgcgccgcgagcgtcatcgccaccagcgcgctcgccggcacgacgatgcgaacacccgtcccgaagtccgtgatgaggatgctgatgggccgtgacgcctcgcgcgtccacagccacgtcgccgcggcgagcccgaaggtcggcagcacga

SEQ ID NO: 445 - DNA, 2226 bp, Myxococcus xanthus
cctgctgatggccctgataccggtggtgctgggcgtgggcttctggaccctcgccaagggtgaggagaagacgttccgcatcgtcacgccccaaggcttcaagtccatgcggggtgggatgacgacggagcaggtgcgcgccgtgctcggacggcccatcaccctggagcgggacaccaacggggcggagtgctaccgctacgggcagcccaacttcgtcaacccgcagttcctcatctattcggtctgctacgaggacgggaagctgcgggacgtgaagacgcaccagtactccgcctggaacgtggaccccgccacggggacgttcgcggcgccgggcgaggagcccgcggacgcggcgcccgtgcccgcgcaggaaggctgagcagggcctttcatgccgaaacgatgatggaaccatgcgtggctgcccgcgagtcgcgggtgccagcctccctccgttcaatgaaacggaggtcgcaccatgcggcggttctctcgggggctcgcggttctcctggcggtagcggggctttcttccgcagcggcgtctgacgacgtcgtcgggtacgaggcgcccagcgaggaggccttgcgctgcctcagtgaggacctgcccgtgacggtgaaggtcgactatgtcctcacgggttgttgggtgttcacccaaagcaccttctacctgaaggtgacgcaaagcggcgcggaggtctctggccgaggggacgactgggaagacccggtcaaactcagtccgaggaagctgtcgcgggccgaaggtgagcgcatcctccaggatttgacgagtgtgatgcttcgtcgtgagtccgagtcggcctcaggtcatgcgccgacccgttacgtgaccacggtcgagtgggtctgtggtggtgtcagggggacgaagcgcggcacggtggcgttcacggcacccgcctacgacttgtattccacggatgaggaagagggagacacctccgcgcgcgccgttggcgtccgtgacgtcgtggtgaaggcgctccggcaggcgcatcgctgacacgctgggaatccaacgcatgagcgcgggcgtgctccatcgaggcacttcgccacaagggttgcctttcgttactggcagttggaatccgcatcgttgtccgcgccatccgcgcaccggcccgtctccgtggcggcgtcctcgctgatgtggagcgtgtaccggatgggcgtgtcctggtcgggattcgccatgccgtccaccaccaccagcaccgtctggccctgcgccagtgtcaccttcacggcgggcgagccttggggactcccgttcgcgttggaggcgcaacccaactccgtgccccggcaacccgtgagcacgtagagcgcgttgccccactcgctcggtgccgtgtcgaagacgtaggtgcccgcccgcggcgccgtccacaggtgcgcgcggtcctgctggagcagcgcgccgcaggtcccctggaagccgtcaccggaacccgccgtctctccgtggaacgtcaccggcagcgcgctgcccaagtcatggtgcgcgcagccacggccgctgcagcccggcgcgtcgtggcagtccgtgtccgcgcagtccacccagcggtccccatcattgtccatgccgtcgaagcaggagcccgcctcgctggcccgcagctcatcgatgtgcagctcgaagtaccccgcgctgaaccggtccaggctcgccgagtccacgaccaccagcaccgtctgtccctgcaccagcggcaccgaaacacgcgcgccgccgccgtagctgatgccgtccttcgcgcacgccagctccgcgcccccgcagccgccgctgcgcacggagacgagcgagcgggtggccgacttcgccgtgtcgaaggtgaagagcgcgctcttgggcgccgtccacaggaagccccggtccggcgcgccgctccctccgcacgaggactgatggtcatcccccgcgtgcgcggtggagcccttcaccatcaccggcaacacgctgcccaggttccggtccacgcacacggacgcgctcgccgcgcagacgttgggaacgcccgtcgctccgcaggactcgggcgccgtgcaggtgccacactccaggaacccgccacacccgttcggcacggtgccgcaatccttgcccagcaggccgcaggtgtaggggcggcaggaaggcgccgcgcacacgttgggcgtgccgccacctccactggagag

SEQ ID NO: 446 - DNA, 2470 bp, Myxococcus xanthus
gtgctctaagggttcccctccgcgcccagctcgaactccaccgcgctcacattgtcgcgcaggcccgccagctccgaccgcgggtcgcccagcacgaagttcaaccccaggcccagcagggggttctgccccgaggcgcccgacacggcggcgttggccgcgatgatgccggcggcgcgctgggcctcctccagggtgtcgaacttgtactccaccgtgccgcccgcggtaccgaacacgctggcgctcgcgtccgccgcccccttgccgcccatcttcccgatgatgcccgcacccacatctccgctggcggagacggtgtagcccccgccctcctcggcgctacggctgacggtcaggtcacccttgccggtgatgccgacggcgtagacatccacctcggcattgaggcccacggagacgctctcgcccggcttgagctgttccacctgcgtgttgaagttgagcgcgtccttggccgcgcccacggtcttcgccgagtcgcgcaccacgccggccgcgccctggaggatgcccccggcgaggtcctgggcgaagtcctgcaccggattctgcgccggcgcgtcctggatggcctgccccaactggtccagcccgttggccaagacgtccgtcgccttgcccagctcctcgcccaccttctgggccgtgtccttgagcgcgtcgcccgccttggtcctcaggtcctcgaagaagtcgcccaccgtctcgcggtccttctgcttcacgtcgcgcccgctgtcgcccggcgcctcgtgtcgctcgaagacgtcctgcgtgtgcttcttggcgaccgacgcaatctgctccgtggtcttcgtcgccgtcgccgccgcctccgcggtcttcttcgcggctgcctccgcggccttcttcgcggccgcctccgccgcgcgcttcgccgcttccgccgcgcgtcgagcggcatccgccgcgccaccgatgattccgccgattcccatgggatgtcctggttggggcgggcgtccgcgtcctcctgcttctcacggagtgacgcgggcaccgccggttcactggggttggggtgggagcgcgaggggcgtcatgaagcgcgtcgcccgttcgcgcgggagtgcgaggcatgccgccccgacacgccctcctcgagcttcagcaacggccttcgtcctctggacgcatgcgggttcagcaccatggactgaggcccctcgcgggatgcgaggacgtggaccacgacatggaaggctcctgcccgggggatgggcattcgcatcgaggaacttccttcattttcctgaggtcgcggcgaaagtttcgtcggttcttgagaggcgggccctgtggctctttgagccccccgccgcggcaggggcgcatgcggaccgttggggagcggccccattgaaaggagcgcacccgtggaggtcatcgacctgttgattcagcagcaccgcgaagtcgacgcgctgttcctggcgttccgcaacgcctcggacgacacgagccgcagggacctgtgcatccagctcgcggaggcgctcatgctgcactccaccatcgaggcgcgctggggctccccgaaggcctcgcgggtggtgggcgacgagaaaatcgagcacgcggagcaggagcaccaggagatgacgaagctcctgggtgacatcgtgcggatgcgcgacgacatgaacgcggtgaaggccaaggtcggcgcgctggagaaagtggtcaagcgacacatcgcggacgaggagaagaacatcctcccgcaggtggccaggaacatcaccgagaaggatctcggcatgtcctgcaaggacctggtccgcgaggcctcccggattcggcgtgaggagatgagagactggggcggcgcgtccctctgacgccagccttcgcggcgcaccccgggggggcgcggcgtcttgctccgacaccaccgggcctcttcgtctcgcgcctcgcgacggcgcccccgccgacggctcccggcggggtgaaccagaacgtgctgccccgacctggcgcgctgaccacggccacattgccgcgagccaatccagcccgagtcttcgcgacctggtccgatgtggagaccaaggcccagtggttcatcggtccgcacgagcggtggacgcccgtgaagcgcgagcgtccctcaagcaggtgcgcaggaggcgagcgctgggcatgaggcagcggcgaggaaggagcgggtgaaggagaggacaccgcgagtggactttcgccgagttgctcaggaggccgagttgctcaggaggacgttcgacttcgacgtgttcggctgcgtgaggtgtggaggcaggctcaagggtgttggcgtacgtgaagggggccccggggtgcgggcgattgtggagcacgtgggcttgcccacggcctgtgcgaggttggccccgggacgagggccaccccaggccgtgtggtgttgaggctcgagactttagcg

SEQ ID NO: 447 - DNA, 1909 bp, Myxococcus xanthus
ggagttgagccgggtggcgtctgatcacctgcccctcgtgctgcgcttcgaggcccccatccccgtggagccttccgtctctcctcctgtgcagctcatcgggtagactggacggatgggccgacgcgcgcgttcactggccgacgcttgcgtgcgccggacaaaaactccgtgacgtggttgtcgcggaacaggtgcatgcctaggttggcccgcacttgagaggccgtatgcgtcggccggagagcgcatgcacgtgggaagtgaacaggcagagcgcgggatttctgcgctcgtcgggcgcatggccgacggcttcagccggctggtgacgcagcacctgcaactggcgcgcatggagctggccgaggacgtcaaggccacgggcctggacgtggcgatgatcgtggccttcgtgcccttcatcctcgtgggttatggcttcgtgtgcgcggcgctggcggcgtggctgtccacgtggttgggatgggccggagcgctggctggaatcggcctgctgaatctggtgggaggcgcgggcggagcgatgtgggcggtgaaccggctgaaggcgcgccggatgatggatgatacgtcgcaggagctctcgctcagcatggccgcgctcaccaacgccgcccccagcgcatccgtgaacgcgctccaggggacgaaccgtgaaatcttcaaggagcccccgcatggccggtagcaatggacagcccaaggcctacagtccccgcagcagcgcggacctgcgtgccgaaatcgagcgcacgcgcgccgagctggccacgtccgtgagtgcccttcgcgaagaagtggccgtggccgccgactggcgccagtgggtgagccgcaatccctacgcgtgtgtaggcgcggcgttcgtggtgggcctgtggttgggctcgcgcgactgacgactgccgtagtacccccaattgaggagatggcttcgatggagatgaatccgcagcagatggccgacagggcgcgtgagcttcaggaccgcgtggtgccgcagatagacgaggcccgtcagaacatcgtggacctgaacaaccgcgtggtgagcttcatccgcgccaatcccggcacgtgcctgctgggcgccgtggccgtgggtttcctcgtcggacgcattgcctcgcgccgctgaagacgcgcgctggaaccacacgagagggtgaacgcatgacgacgtttccaggtgcatcgggcaatggcacgccgcaggacccgcagggcggcggcttcgggcagcgagtggaccacattggcagcgacgcgcagcagctctggtccgacgcgcgcggcgcggtgacggacttggggcagacgctggacctgcgggggcgcgtggagcgcaacccgtacgggatgatggcggccgccgtgggcgtcggctatctgctgggcggcgggctcttcacgccgctgacggcgcgcatcctccggctcggtgtgcgcctcgcggcgctgccactggtcaaggatgaactgttgggcatggccgaatcggccttccagggctatcagactggacgtggtatggctggtccgggcccgcagggctccgccgcggcgaacgccacttccgcaggcactcctcgcccgccgacgtactgaggccgggctttcctccaccccacaacccccggagtctcaaatggtgaacttcaacaacctcaagaagctggacaaggacgacctgctgcacctggtgggcctggagacgcgtcgggacacggtggacacgctcctgcccgtcgtgggcgccttcgccggggcatcctcgtgggcgcgggcctgggcctgctgctggcgcccaagtcgggcaaccagctgcgcgatgacctccgtcagcgcctgcacagcggccaggagtacctgtccaacgcggtcg

SEQ ID NO: 448 - DNA, 2140 bp, Myxococcus xanthus
tacttccaacaccagcaggccttggcggtggcacgcatcgttaatgagacggggcgcacgacgagtcgcacctaggccgagagtgtggccacccgcgcggctcggaagtggacgacacacgatgtgctgcccctctagaggagtcccctgtacgcaggcttcgtgccgtatggcgacgagacgcacccgggcgagcacccggcgcttgtagacagggccaccttccaccgggtgcaggacatgctggagagccccggcattcagtaccacgggcgtaaccccgactacgtgctgcgagggctgttgcgctgcggcctgtgcggcgaggcaatgacgcccggcagcacgcgcaagggcgagcgcgagtaccgctactaccgctgcgtcacccgggacaagcaggggaaggaggggtgccgggccgctccccttccggcagccgccctggaggacttcgtcgtcgctcagctgcgggaagtctcggtaggtgacggcttcgctgcccaggtgcatgcccgcctcacggcgcggctggaggagaaacaccaggccctgcgcgccgagcgcgcgcagttgccgagggacttggccaagcgtgctggggagtccgcgaagtgggtggactccctctccaagttggagggcccagcccggcgcctcgtcgaggagaagctgacggccgcggaagaggaggtcgccggcatgcgaaagcggctggcggaggtggagcgcgccctggacgccattgagggggagagggtggaggctgcgtgggtggcccaggccctggggaacttcgacgcggtgtgggacgccctcacctctacgaatcgggggcgcctgctgcgggccctcgtcggccgggtggtggtgaacgaggcgacgggcaaggtcgacgtgcatatggcccacgttggtgaggccgcagtgactgggcgcgaggaggtggcggcgtgagcgcgagccccgagtctcagccggcggaggcgggcctcgtcagcgcgcacttccaccgcgtgcgtcgcgcgaaggtggtgcgcctccgagggggggcgccacccccgccgcgagaggtgtcgcgccggccggcgcacgtcgcgcgaatgctggccctggctcaccatgtggagtccgccattgggcggggcctcgtggcgagcgcagcggacgtcgcgggtcaactcggctttacccgagcgcgtgtgacgcacctgctggacttgctgctgttggcgcccgacatccaggaggaggttctcttcctcgaggcggtggagggagaggagcccctcagcgagcgaggactccgggccattgcacactcggggacgtgggaggagcagcgcgagcagtggcgtgaggtgaaagcttcattttgagactggagtccggatgtctggactccttggtgtagcgtgagtgcaagaggctgagttgttgtccgcgttgagagtgcgcgggctgtacggcccgcgcggaaagtgagcgaagacacatgcagaacgacatgaagggcatcatccaggctgcggtggcggaggcggtggagaaaacgatgagccggcaactggagctgcaggagcggcaactggaactgctggggaagattgcgcagttcctgggcattgagtccggctcggctcatgcggcgtccgcgccgaagcgggcccccgtaccgtctcccgcgtcgaagcgcatacccgcgcccgcgccaacgtccacgccgaagcgcacgccctcggtgtccgtgcggaagtatgtgaggccggaggctgcgccgaagcccacgcgggccggccccgcgccccagaagagccgggggcgcccgcgcgcagcgggacgcactgcgacggccgcagcccccagcgccagtcccagccccgaggcgcccgtctccttcgcggtgggacaggaggtgcgctacaagcaagggcggggcgccttcacggcgaaggtgaaggccgtcgacgagaaggcgaagacggtgacggcggagcgcgtctccgacggcaagcaggtggtgcgccccttcgacaaggtgacgcccgcctgacgcgagctgcggggcagggttgagttgaagagcgtggttctcagccgacagaagccccaagagaagtgcctgcgggactacacggac

SEQ ID NO: 449 - DNA, 2020 bp, Myxococcus xanthus
  unsure (1)..(2020): unsure at all n locations
tcttcgggcgtggaatggtcccattgcgccgtcaggcgaaggccgcttcctcgaaggtgatttccaggttgtagcgcaggtccgcgccacgcgagctcgtccgccgccctccccggccaccgccgaagatgtcgccgaaaatctcgccgaagatgtcgttgatgttgacgccctggaacccgcccccggcgccaccgaagccgtcgaaggggttgcccgcgtgcccgaagcggtcgtacttcgcccgccgttcagggtcgctcagcacctcataggcttccgaggcctccttgaacttctcctcggcgtccgagttccccggattgcgatccgggtggtactgcagcgccaccttgcggaacgcgctcttgagctcctgcgcggagacagatttctggacgcccaggacctcgtagtagtcgcgtttctgacccgccgccgctgacattgattacaacccctggaatttgctgtgcttttttacgctacgtaaaatctcgagtcactataacgcagcgaaacgcaccggcaatccagtggggacacgcaccgcccgcgcccccccggtgccagacgggcatccgggcgggtggcgtggtgggaagagaggaagccgtcagacggtccacacgcggttggccgtcagctccatccgggccagcctgcgtttgagtccggggtccaccgcgcccgtcgcggcccacttgggcaccacgaagtggagctccgcgttgtacagcttcgcggcgctggccaagaggctccagcggttctccgccgtgggctcgtccaccatgtgcggggtgacgatttccaggatgatgggcgtgcgagccgaatccgactgccgacaggtgaagtcggggcgatggtcctcgatggtccccgacaggatgggaggaggcatgaagccggggaggcgcgccttgatgtccgtataaccgatggtgcggaagtactcggccatcagccacaggagccgccggcgctcctcgtcctccaccaccggctcacagcccggattgaacagggcctctttttcgttattggtttccatggctcccctgaacctgtccgcagggttgaaggtgggcaatggaactggcccgggcgccgcaaacgcccggtggcagggcaaccgacagggcaccagcccccgaaacccggtagccttggaccttctggcgactcagtgacagagtccgccgccgaacagtggctccccgtccttctcctcacgtctatcgtcggctcctcggctacctccgcccgtaccggctgctgctcgccgcgggtgtaggcgcgtccgtggccgcggccatcgccacgtccgcctatgcctgggtggtgggccccctgctgcgcgcgctgctcacccacgagcccgtcaccgtcgccggggtatccctgccgggagacgccctgctcaagcggctgcccctgctcgtcgtggcagtggccatcgtgaaggccaccgcgcagttcctccagggcgggctgatgcagcggctgggacagcgcgtgatggcggacctgcgcgggttcctctacggacggctgctcggccagccgcccgcgttcttcgagcggcggcactccggtgagctgctggcgcgcttcaccgcggacgtgcccctggtcgagttctccgtgacgcaggcgctcacgtcctacgtgaaggacgggctgcaaatcatcgcgctgctcgtcacctgcttcctcatcgacaagacgctgttcctcttcaccttcgtcgtcgtgccagtgacggtgctgcccatcaaccgcttcgcgcgctcactgaagaaggtggccacgcgctcgcaggagcggctgggctcgctgacggcgctcaccgccgagcagctccagaacctgcccgtggtgcaggccttccgcggacagccgcgggcgctggaggccttcgaggtggaggcggacaagtacctgggggagatgcgccgctcgctcttcctgcgcggcgcggtgagccncacggtggagctcctgggcatcgccg

SEQ ID NO: 450 - DNA, 3383 bp, Myxococcus xanthus
  unsure (1)..(3383): unsure at all n locations
gatgcaacgcgcaagctctccgctgaaggcatggaggcgacgctccaggtgctggagtccttcgctcgcgaggcgcgcgagctgggcgccgaaggcatcgctgtgtccgccaccagcgccgcgcgtgacgcggagaacggcgcggagttcctcgccgccgcgaaggcgcgcgcgaatgtgacagtggaaatcatctccggtgccatggaggcggagctgtccttcgccgcggtgcactcggacttcgcgtcggacgcggcgggccctctgctggtgctcgacattggcggcggctccacggagttcatctacggcaaccgtggcggccacgtggacttccggcacagcttcgacgtgggcgcggtgcgcatgacggagcgcttcgtcggcgctgacccgatgacgtccgaggaccgcgcgcgtgtcgaagcccacctgcgcgacaccttccgcgccctccccgccccgccgcccggcgcggccctggtgggcgtcgcgggcacggtgacgacgctgtacgccgtgcagcacgccatccacccttacgtcgcggagcaggtccacggcggcacgctgtccgtgggccagctgtccgccctcgcggaccggctgtgcgccatgccgctggaagcgcggcgtgccctgcccggcatgcagcccaagcgcgcggacgtcatccccgcgggtgccctcatcttgctggagtcggtgaaggcgctgggactggatgcctgccgcgtcagtgacaggggcctgcgctggggtctgctcgcgcaccgctttggagccggagccacctcttcatgaacgcccaatccgcggcctcaccggccgcgtccgccgtgcccgccagcaacgcgggttatgcgctgctcatcctcaccctcatcaacctggtcaactacctcgaccgctacatcgtcgcggtggcgctgccagacatccagaaggaattcggcatcaacgacacgcagtccggcctgctgggcaccatgttcatcgtggtgttcatgctggcctcgccgctgggcgggttcctcggggaccgctacccgcggcggctgctggtggtgggcggcgtggttctctggagcctggccaccggggccagcgggctggccacctcgttcggcgcgttgctcctggcccgcgcggtgattggcatcggcgaggccggctacggcgccgtggcgcccagcatcatctccgacttgtacccgcgcacgcagcgcacgcggatgctggcgttcttctacatcgccatccccgtgggcgccgcggcgggctacggcctgngcgggtggctgacgcaggcctactcgtggcacgtcgccttcttcgcggggggcgtgcccggggctgattctgggcgccatggccttcttcatgccggagccccagcgcggcgccatggatgggccggacgcgcaggcgaagctgcccttcatggtgggcctgaagggcttggcgcggaactcggccttctgggcggtgacggccgggtacacgctgatgacgttctccattggcggcctgggcttctggatgcccacgtacctggtgcgcgagcgcggcctggcgcaggacagctcgggcttcatcttcggtgcgattactgcggtggccggcctgctggggacggtggcgggcggctggcttggcgacaagctggaccgcaagcgcgagggcggcggactgtggatgtccggcatcggcctgatgctggcggccccgtgcatgtacctggcggtgagcctgaaggccgtgggccccaccttcgcggcaatcgccctggcgcagttcctcatcttcctcaacagcggccccatcaacgcggccatcgtcaactgcgtgccgcccgcgttccgagccttcgccatgggactgaatgtgctgtgcatccacctgctgggtgacgcgatttcacccacgctcatcggcaccatcgcggacgcatccagcctgcacaccgccatcgcggtgaatgccctgcccgtgctcctcggcggcttcgcgctgctgctgggcgcccggctgttccgtgaagcagtgcccctcgcgcgtcagggctgagcggcggcatccagccttggccggtactcgtcggccaggcgctccatctccaaggccagccgctcgccatccgcgagcagcaggcgcttgaggcgcgcgcggttgcccagcgtgaagaacacgcggatgtcgcgctggagcgactcccagcgctcggcgaagtagagggtgaacagcgccagcggtggcacagcgaggaagacggccacggacaggagcgcgcttccccacaccgccgcggcggctgtcagcacgccccaccacaccagcgccaccacgaaggcggtgaggaacttcaccgtggcctgcacgtccagttcggcgtttcggctggcgagccgaggtaactggtagggcagccagaacaggcccagccccagggcgaacagcggcaggcccagcgccagcgccagcacgttcttcaccacgaagggcaccacgttccccggccggtacacgagcgccaggtcctccagccccgtcgcctgcaccagcgccatgcggtgccggaagccggcgagctgcgcgcgcagggactcgaagcgctccggctcctgcgcgcggaacatctggacgccgcgcgcccacagtcgcaggcgctccgcatcgagcgccccaccctgcttgaaggcgaagagctgctcggccagttgcgccagcgggaggtccgcccactgctccaggttgagcgtcactgcgcgaagcccgctggcgatgcgctcggtgagggcgcggacggcatcgggttccgccgcggcgtccgcgggcaggaagtcctgcacgtcgatggcgggccccacgtcgatgagcacctcgctgcggaacacgtgcttctccgcgtaggtgagccccacggggacgatgcgcaccggagcccccgccttcgccgcgctcacggcgatgcgcgccgcgcccgtcttcagctcggcgagcccaggctcggagtggctcttgccctcggggaagatggtgatggcgcgcccctgcaccagcgcgcccttcgcggcctccagcgtgccctcgttgccgcccatcttcgccgggtcatcctgcttccggtacaccggcagcgcgtccaaccccttcaacagccagccgatgacgggcatccggaacagcggcgccttcgccaggaaggtcaccttgcgccgcgtgaggatgaacaccagcgccgggtcgataaggccgttggggtggttgcccacgaagagcaccgggccgtccggctccagcgccggggcattcaccttcacccggtagaagagtcggagacacagcgccaccaccgcacgcacggaatccgtagaccg

SEQ ID NO: 451 - DNA, 1335 bp, Myxococcus xanthus
gctggtgcgctacgccctctggcgccgcatcttctgtggtgagggctgggcccgcatcggtcccgaggtccgcttgccggggcccgtgcgtccgcgcaccatcaaggacgatctgctccagcgcgtggtggaacagccgctgccggaggcgccgctcccggagtcccagacggagcggctggccattcgctactcgttccccaactggttggtgcagcgcctggcccaggtgtacccggaggatgtgctggaagggctgctggcgtcgctcgatgaggagccgtcgctgcacttccgcgtgcggcccccggggacccgggacgcggtgctggcggcgctgaaggaagagggcgtcaacgccgaaccggtggccgcggcgccggatgctgtgcgggtgacggactccagccaccgcgtcttcgagactcggatgatgaagtccggccggctccaggtgcaggacgtgggcagccagctcatctccgagctgtgccgtccccgggagggctcgctggagggcttcaccgtggcggacgtgtgcgccggcgcgggcggcaagacgctggcgttggcggacttcgtcgggccccagggcagggtgctggctggggaccgttcgcggcgtcggctggctgaggcgcgcgagcgcgtgcgccacttctctctccggcaggtcgcctttccgcatccgcttccgctgtccgacgcggacgtccttctgatcgatgcgccgtgcagcggcacgggttccctggcgcgcgagccggatcagaagtggaagctcaccgctcaggaaatcgccaagtaccaggccacgcagtcagagttgctggatgaggtgtcacgccaggcgaagccgggggcactcatcgtctatgcgacctgctcggtgatgccggaggaggacgaggcggtggtggaggccttcctcgcgaagcatccggacttcacgctggagccggtcgaggacgtactcggcgcggagcgggcggcgctcgccgcgcaggggccctatctgaaggcgttgcctcccaaggttcccgggggaggattcttcgcggcccggctgcggaggacaggggcggggccgggttgacaggctccgagaacgcacgctacgcaatcgttgatttctcaaggagtgtgactgacttggcggccgactcgaagcagtccgaggtggtgaagcagatcaacgaggccttccaggcggcgcaggaccggttggcccagcttcgcgaggccgtggagcgcaacacggacctggcccgggcgaacgctcgcaccaccgtgttgaaggatcaaaaggagaaagccctccaagaatttggccaa

SEQ ID NO: 452 - DNA, 1664 bp, Myxococcus xanthus
  unsure (1)..(1664): unsure at all n locations
catccattccgccgggcgggctcaccatccacgcgggcaacaagcccacgcgcgcggcgttccgggtgaatggcccggacgaggtccgcgcgctgctggcgggtctgctggagccgtaaccacctcgcgcccgccggaggttcggcgggcgcgggcctgctcgcgttcgctacggcgtcgaggacgcggtgcggttggccgcgttctggatgaacacccggcggccgaaggcgcggtccacgcggccgaggaactcgcggaacgcggggtagtcgtccgcggacacgcgcgcggtggtgagggccacctcgccctcggccaccagcttgccgccctccaggcggtagctcagcttgatgtggccgaacttcgtcgtctcctccacggcctggggcagctccgccaccgtccagcccgcgggcagcgcgtagcgcaggaggaaaccgttggtccacgggctggacatcaccaggtcgaagcggcgctgggccagcgacgcataggcctgctggtaggtgcgcccggtgccgaagggcaggaagcgcatgccgttgggcagcacctccgagtagcgcgggatgctcatcttgaagtccaacgccacgttgtcatccagccgcgtggtgtcgctcagcttcacctcgtgcaccgtgaggccggggaagctctgcgcccaggcgcgctcgaaggtggacttgcgcgtggcctccggccggtaggcgcggcggtagtcgggcgcgtgctgcccgcccacggagctggagccggtgatttcagcgccgccgtccgcgcggagcgtcacgtccagcgacatgcgcgtggcgttgtccgccgccttcgcctccggcgtggtgaggaaggtgctcttgccgttgggctccaccaccagcacgttggccacccggtccgcgctgggcagctcgttggcgccgtggaactccgcggtgccgtccaggtacaggtcgaacttgggcacgtaggcgatggcgtggttgaaggccgcgaggctcgcgggctcctcgccaatggagcccaggttgcgcatgcgcagcagcaccagccggctctccacacccgccacctggagcatggagtggatgaggctcgccttgtccttgcagtcgccgaagcggcgcgccagcacccggtccacgcggtagggcttgaagccgtggatgccgaactccagcgccacgtagcgcgtgttcgtcaccacgaagttgtagatggcgcgcaccaccgccagctcgttcttccggtccacgccctggagcacctggtccaccgtctgccgcagctccgcgttgggctggagctggtcgcgcaccaggccccaccagtagcggcccacctgctcccacgtctggtaggtggagacgtggaggttctgcgccacctccgcccagccgggcatgccgggctccggcaccaccttggcgacgtgcttggcgttccagcggtacagcacgcggccggcgtccagcgtctcctgcgcgctcgccacgccggtcagcttgctcttgttccaatacaggggccgtgcctgcggcatgtccaccaggtactggaagcgcaccttcgggtagacgccctgcacgctctccacgtcaccccagtagtccgacaggaggttgtnctgcgcggtgtcgtccaggcggtacgtc

SEQ ID NO: 453 - DNA, 2387 bp, Myxococcus xanthus
gattctctccttcgagagtatctctccctcttcttcagcgacccgaagggccaggcccgcaacgcggcgcagtacctgcgggacgtgatggaccacttcggcaccaccacggtgccgcaccccactggcaccatccgacgcttccaggtcttcgacgtacccggcagcgaccgggacgaccgggtggcgggccaggaggaggtgcagaacgccatctaccggttgctcggcaacttcgtgcgggccggccgtatcaacaagctcatcctcctgcatgggcccaatggcagcgccaagtccacgctcgtcaatgccctgaaggcgggcatggaggcgtactcgcggctgccccagggcgcgctctaccggctcgcctgggtgttcccgtcggagaagctcatcaagggctccatcggcttcggcgagcgggactccgccagtggggagatgaccaccttcgcgcacctggacgcggagtccatcgacctgcgaatgccgtgcgagctgcgggaccacccgctcttcgccgtcccgcccggcgagcgccgcaggctgctggagacggcgctcaagaagaagggcctgggcaacggggacggggagagtggcgacttcatcctgtccgactacgtgcgggacggcgagctgtgctccaagtgccgccgcatctacaccgcgctgctcaattcctacggcggggactggctgaaggtgatgcgccacgtccaggtggagcgcttctatgtgtcgcgccgctaccaggtgggcacggtgacggtggagccgcagatgagcgtggacgccgtcgtccagcagctcaccgcggaccgcacccagctcaacgtgcccgcgccgctgcacagcacggtgctcttcgagccgcacggccccctggtccacgccaaccgcggcctcatcgagtactcggacctgctcaagcggcccctggaggccttcaagtacctgctgggcttcagcgagacgggcgaggtgccgctggagcccttcgtcctccagctcgacgaggtgctcatcgcgtcggcgaacgagaagcacctcaatgccttcaaggagctgccggacttcgcgtccttcaagggccgcatcgaactggtgcgcgtgccctacctgcgccgctaccgcaccgagcagcagatctacgacgcgcagatcacctccaccaccgtgggcaagcacgtggcgccccatgccacggaggtggcggccatgtgggcggtgctcacccggctgaagaagcccattccggaccgctacccgcaggacgtgaaggagctcatcgaccaggtgacgccggtggagaagctgcacctctacgaggagggcgcgccgccggaccggctgagcctggccaacaccaaggagctgcgcaagctgcgcgaggacctgttcacggagtcggacgcgtaccccaactacgaggggcgctcgggcgccagcgcgcgcgaaatcaagacggcgctcttcaatgccgcgcagaacaccgactacaagtgcctcaacgcgctggcggtgctggaggagctgtccgccatctgcaaggacaagagcgtctacgagttcctcttgcaggaggtggtggacggctaccacgaccatgacgccttcgtgcggctggcggaggcggagtacctggaccgggtggactcggaggtgcgcgagtccatgggcctggtgtcggaggggcagtaccgcgagctggtggagcgctacatccagaccatcagccactgggtgcgcggagagaagatgcgcaaccgcgtcaccggggtgatggaggcgccggaagagcagcgcatggtggaggtggaggtcatcatcatgccgcgcggcgaggacgcagccgacttccgccggggactcatcgcctccatcggcgcgcaccggctggacaacccggacgcggtcatggactacggccgcatcttcccggacatgttcaagcgcctgcgagatcactacttcgaggagcgcaagcgtgtgctgcgcaagaacaaggagaacgtcctcaagtacctgtccgaggaccgcaaccagctcaccgcgcgcgagcagacgcaggtgcagagcacgctgaagacgatggcggagcgctacggctactgcgagtcgtgcgcgaaggacgccatcctcttcctgatgaagaagcgctacgcgtgaccgggcaggcgtccggggcccgcctggacgcctgctttcaaagccggaaagggctcgggatgatgggggctgccagggagttgtactggctgcatccgtttcccccccagaccggagagtcgatgacccgcttcctcctgggcgcccccgccctgctcgccctcgtgtcgtgcgccggtgccccgtctcagccgggcgccgccaccccc

SEQ ID NO: 454 - DNA, 2712 bp, Myxococcus xanthus
cgcgtgctctaaagctccaacgcgtcgctgcgggagaacatcaccctgagcgacccggagctggacatggaccgtgtcgtggaggccgcgaagctggcccacatccacgacgacatcatggccatgcccatgcagtacgacacgccgctgacggaccggggcctctccatgtccggtggccagcggcagagactggccctggcgcgcgccctggtgcgcaggcccgccatcctcctgctcgatgaagccaccagcgccctggacgccaccaccgaggcgcacgtgcagcaggcgctggcgtccctgaagtgcacgcgcgtcgtcattgcccaccggctcagcacggtgcgcaacgccgacaccatcctcgtcatggaggccggccaggtggtggaggtcggccggcaccaggagctgctggagcgccagggcacctacgcggccctggtgaatgcccaacgggaggagcgcgccgtggcgacgggctgaggtgcctggagcgcgacccggcaatcaagaatatcctgcctaccgcgaccgatccgccgcacgtccgccggcgccagtgagggattcatgaacctgcatgactacagccgctttgacgcagtgggattggcggagctggtacgtcggaaggaagtcacgcccgaagagctgctccgggtggcggtggaggccatccacgccgtcaacccggcactgaacgccgtcatcgacacgcgagagggcgacgccagcgaggcgctgaagcaaggcattcccgagggccccttccgaggcgttcccttcctcatcaaggacattggcctgcacgccgcgggtgtgcccaccgacatgggcagccggatggcccaggggacggtgttcccccatgacagcgcgttgatggcgcggtaccggcgcgcgggcctggtgctgctgggccggacgaacgcaccggagttcggcaacaacgccaccacggagccggtgctgcacggccccacgcgcaatccgtgggacgtgaagcgcagcccgggcggctccagcggcggctcggcggcggcggtggcggcgggcatcgtcccggtggcccacggcaacgatggtgggggctcgctgcgcatccccgcggcgctttgcggcgtcttcgggctgaagcccacgcgtggccgcaactcattggggccggacgcgggtgacttcatcttcggcatgggcatcgagcacgtgctgtcccgcagcgtgcgcgacagcgcggcgatgctggacgccacccaggggccggaggtgggcgacccgtacttcgccccgccgccgcagcgcccatacctggaggaagtgggccgcgcgccgggccggctgcgcatcgcgctgatgacggaagcccccatgggctcaccggcgagcgccgaatgtgtggaggccgctcgagcggcggcgcgcctgtgtacggagctgggccatgacgtcgtcgaggccgcgcccgagcacgacggccaactgctgcacgaggccgtctgcaccgtctggtcggcgaccatggcgtccctggtgggcatgctgggccagttctccggccgcgacccgggaccggagctgctggaggccaccacctgggcggcggtgcgccacggccgcgagctgaaggccacggacctgcaacgggcgctcggggtgttcaacctcgtgtcacgtcaggtgggcgccttcttccagcagtatgacgtactgctgtcgcccacggtggcggcgccgcccttcccgctgggcctgctggacgccaacgcaccccggacggcccgcgagtggtacgaccacgcgttcggccactgcccctttaccgcgctcttcaacgtcaccgggcagcccgccatgtccgtgccgctgcactggagcgcggaggggctgcccatcggcgtccagttcgccggccggtatgccgccgaggccacgctgttccaactggcgggccagctcgagcaggcgcggccctgggcccagcggacgccaccggtgcacgtcacccggcccgcggagtcgccgtgaggcgcgcggtgggcccctgaagaaacgcggaggcccaccgcgaacccgcccaggtcagtcgtagcggctggtgagcttcagcgtccacgagcgcagcgtgccgctgcccaccccggacgggttggcgatgtgcagcttccagcgaccattgacggcgccgtcgcgcgggatgccccgcgtcacgacgatgcgcgagggcggcgtgccctcgttcggaccgtcccacagcagggccgtctcaccacccgggtcctccagcgtcagcaccagccggtgcggcgcggtgtggacgatgtccagctccacgttgatgtccatgggcaccgtggccaaccccaccgcgacgagcggcgccgtcaccagcgggttcgtcgactggagccgcaggtccgagtactcggtgaaggagctgcccatccacgccggggcgcagtagccctccaccgagcccgacgccagaccgatgcagaccgacttcggggtctggcacgcgacgaagcgggagcacacctcgccgtagccggggaagtacgaggcgtcgacgcagcggccataagggctggagccgtcacccgggcggccctcacagacgagcccgggctgacacagggtcggacccgtgcacgggtcaccttccgccgcgagctgcgtgtggaccttgagctgtcccatcgtgacggc

SEQ ID NO: 455 - DNA, 1796 bp, Myxococcus xanthus
gggcgcatcgaaggcattgcctacgacgcggaatactggtgcgacaacatccgcgagcccacgctcttcgcgaaggccgcggggcagatgctgaaggacgggtaccggctctgcatcgagctggggccccaccccgtgctgctggcgtccatcaaggagtgctgcgcggaggcccgcgtcgagggccgcgtcctcacctccctccggcgacaggagcccgagcacaagacgttcaccaaggccgtggccgaactctacgtcgcgggcattcccatcgactggagcggcctctatccgcagggctcgcgctacacccagctccccacctacccctggcagcgtgagaagcactggcacgagtcggaggaggccctcacggaccgtcggggttctgacgagcattcgctgctcggcccccgcgtctccgcgccgctgcccacctgggaacgcgggctgaacgcgcgcttcctgccgtgcctccaggaccaccgcgtccggggctcgctcgtcgtccctggcgccacctacgtcgagctggcgctcgccgttcgccgcgccatgggcctctccgagccgcatgcactggaagaggtgcggttcgagaacgcgctcgtcgtcaccggccatgacgagcccgtcgtccggaccacgtacgacgaggcggcacagacggtgaccatctacagccggccgcgcgacaaccgcacggcgtggacccgtcacgccaccgcgcgcatccgccggaacgtccacacgccaccggagacacaggcccgggtgagcgagctcgccatccacgccgaggcgccgctcgacaccgaggcgctgtaccggatgctggcgacgcgcgggctcgagtatggccccagcctgcgcggcatccgcacgctgcgccgcaacgagaaggagctgctggccgagattgtccttcccgaagcggaagtggcgcgcatcaccgcggattcgcagatgctgctcgaccccgtgtggttggacccgtgcctccaggccatggtgtcctggcttcccgaggacgacgcgcggctctacctgcccatgggctgccggagcatccagctctccacccctcccgtggcccacgcgccgctgtggtgccatgcccggattcgcgcgcgcacggcccacaagctcgagtgcgacatcacgctgctggacggcgatggacgggtgtgcgcgaagctgacgggcgtcgagtgcgccgcgctcgcggaccgtgaggagtccgtgcccaggccggcgttctacgactggacgtacacgcacgccttcgaggccaccgccgaggagctgcccgcgaagagccagggcacctggctcgtcttcgccgaccagggcggaatcggcgccgaactcacgcgtgaactccagcggaccggcatccaggacctggtcctggtgacgcggggcgagacattcgtccgcgagtcgaaccaccgcttccagattcgtcccggaaacgcggaggacgtccgttccctcgtggaggccgtgggccgtgtccgcatccagcacgttgcctacctcgccggcctggacgcgcgtccgggagtcgagtcgaacgacgtgcaggcgctgctcgacgtggtgctggccctggcgccgggcgatggcgcgtcgctgcgcatcgtcacccgcgacgcacagcgcgcggccccgggtgacggtctgggtgcgctgtccgccacgccgctgattggcttcgcgcgcgtcgtccccgcggagttcccgcacctgcggacccgctccatcgacctgccgaagagcgcctcggcgtc

SEQ ID NO: 456 - DNA, 1744 bp, Myxococcus xanthus
  unsure (1)..(1744): unsure at all n locations
atgcggaccacccaaaaggcatccggaaatgcggacccggctccaccgctcccacgaagcgccccagccggaggatgacccccatttcgtccggctgcacctgggcgtagctggtcatcagccccaccagcaggaacaggccgagcaccgcgaacaggatgcggcgcccgattccaggccccagttgccgccgaagctcacgtaggacgtctgacgggtcccgccctcgtgggtcggaattcatgacgcgaggattccatgacatccatccgtcttcccccgtacaggctgctcatgcaaggggcgccacgagaattccagccagccgggcaccatgcgcagcgctcacgcgcttgaccggtatgggcatgtcactccggtcacttcgattgacgctccacggcacggtcattagggaagccgcacttgccagggaggaatccgttgagagacctgaccaaccgacgaatcgtgctcgcatcccggcccgaaggacgtcccactggggagaacttccgcatcgaggacgtctccgtaccggagcccggcgaaggtgagctcctgctgaaggtccagtacctgtcgctggacccgtacatgcgaggccggatgagcaccgcgaagtcgtacgcccgcccactggacctgggcgaggtcatcgtcggcggcaccgtcgcccgcgtcgtccgctcccgacacccgggctacgcggaaggcgacatcgtcctctcctactcgggctggcagacctattcgctgtccaagggtgaaggtctgcgcaagctcgacccggccgccgcccctgtctccaccgcgctgggcgtgctcggcatgccgggattcaccgcctactcgggcctcttcacgattggacggcctcagcccggtgagacggtggtcgtcgccgcggccagcggtcctgtcggcgcgacggtggggcagttggccagaatcaagggcgcgcgagcggtgggcatcgcgggcggaccggagaagtgcgcgtacgtgcgtgacgagcttggcttcgacgccgtcgtggaccaccacgctccggacttcgccgagcgtttgaaggaagcctgccccaagggcgtggacgtttacttcgagaacgtgggcggcgcggtctgggacgccgtcttcccgctcctcaatccgttcgcgagagtccccgtctgcggcctcatcgcctggtacaacagcacgggtcccttcgagggcccgaaccggctgcccctcgtcatgcgcgacgtgctctccaagagcctgacgctgcgaggcttcatccagacggagttcgtcagccagctcccggatttctaccgggacatgagcgcatgggtgcgcgagggacgcgtgcgctaccgcgaggacatcgtcaacgggctcgaccatgcgcccgaggccttcgtcgggctgctggaaggccgcaacttcggcaagctcgtggtgaaggtggacgaaacggcatgacggccgacgcgtgaagcaccccctgcgtgcccggaacactcgggcacgcaggggcaacctggctcagctcggcttggcccgtacggactggaaggcccgcgtggcgcccgtcaccagcagaacgatgaggccacccgcgatgacgccggccaccgcgttcatcagagacggcacgagcgcgcccagcagtccgccaacgcctggcaccgccgcaaccgcgggggtcgcgtgctccatgaagtgatgcaagggcnccgatgccgtgcgtgag

SEQ ID NO: 457 - DNA, 1963 bp, Myxococcus xanthus
ctcaaggcctttcaccggattggtttcgagcccgacggaaaggtccacttccagtatcaggtggtggtgcaggagagccccgtgggcgagccggaggtgtcctgcatcgcgcggggtgacttcgacggcgacgggctgaactccctctaccgcgttcgtctggatgccaacggaatgacgacgcccatcgaggtggagcgcgagggcgaatagtccgccgcgcaaccccgcgcttccgtccgccgaaaatcaggaagccgggaccccccaagccagggtgaggcattgcccatgtcctccttccgcatccccaacgtgattgaccgcgccctccgctcgctggggggcggtcgtggcgccagacgccccgaaggtccgggcgcgccggggcctcagctccaggactggggcccgtcggcgcagccaccccggccgggggacaacttccgcccgcgattgccgccgcccctgcacccacccatgggcggccaggagcgcgcgccggtgaagtcggtggcggagctggtgccaccgggcctggaggacacgccggggcaggaggcattgggccagcgcttcgggtcggacgcggcgctgctggcctcgcatctgtcgcctccgcaggtgccaggctcggagcgggccacgcggctgtgggcgttctacacggcctacgccacggcggcggcgcggcacccgccccagcccgaggcgcgccaggccttccgcgaggcgctggaggggcagggcttcggcgagctgcgggacgcgcgcaccggcgaggacggcgtgacgcggggcctgtgggtgatggaagcccgcacccccgccgaagcccggacgcgagccgccgaggtgcggctggatccgcctcccgaggtgcgccactcggaggaagccgcggcccggccagccgagcagccgctcgtccaggcggccggcgcccgcgcggccacggcccttcacggcccggtcatgcccgcgctgcgtccgcgcgacgaggcctcttcatcggaggacgcgcagcaagacggggatacccagcgccgacgcgggacgaaccgccgcctgggcgcgcggatgctgtggaacgtgctgcaccgcttccgcgcggggccggacgacggggcggtggcggaggggcagtgggaccgggtgacgtttggcgcactgctggtgctgctggccatcgcgctggccgtggcggcgctcgtcagcctctaggcccgtcggcccgtcggcccgtcggcggcgccttcgccggcgcgaatctccttggattgtgtccgcttgtgctaggttgccgcacctacttggcaaccgacgacctcactctcgtcaagcgcgtccggaccggcgaccagcgcgctttcaaactcctcgtcgagcgttaccagcgcaaggtgtacgccgttgcgttgggcatgctgaaggacaaggaggaagcgatggacgtctcccaggaggcgttcgtcaaggtctacaagtatctggaccacttcaagggcgactcgtccttctacacgtggctctaccgcatcaccgtcaacatctgcatcgacgtcatccgcaagcgtggcggaggcggcgaggtcgtggagttcgacgagagccagtccgtggacctgtccgaggcccgaatcggcgccctgggcagccggctgggcaccaatccccagaagagcgccctgcgccgcgaactggcggagaagatccaggaggccctggccacggtgccggagaagcatcgggccatcctcctgctgcgggaaatcgagggcatgtcctacgacgacctcgcccgcaccctggacatccccaagggcacggtgatgagccggcttttccatgcccgggccaaggttcagaaaatcctcagtgaatacctggagttggacgaagcgaagagcggcgtgggcagtgattgagcgggcctcgaatatctgagggactgtagagcaca

SEQ ID NO: 458 - DNA, 1628 bp, Myxococcus xanthus
tgataatgttgtggcccgccgtctgcaccatctccactgcgattttcagcacctcgggtgccgtcaggtgggcgtccgccagcagcaccagcgcggcctggaagtagttgaagatgggcaccacgcgcggtccgtagggcgtgaagtgcgcggggggcgtcagcctgtccaggtggatgaagatgcggcgcaccgggtcgcccaccggaatcttcttccacgcctcgcgcacccgcagcgcgtcgtccgggtacaccccgcccgcctccagcacctgcgacaacacgcgctcgtccacgcggcccgccaccaggtccgcgaagagcgaatagatgaacgcgtccgcctccgcgtcgtcaccgaagaggacttcctccgcctccaccggcgcatgcacccggctctcaagaatcgcgggcagcttgtagcccacctgcccgcgcagggcccgaaaacggccgcgcagcaggttgcccacgttgtccttgaggacgaactcgtcccaccgcacgccgtccagcttgagcttctcctccagcacggcccgcatctgcttcggactgccggagacgatgcacagccgcgagtccccgttctccgacagctcgcggatgagcgcgctggcgcccggcacggccaccttctggtgggccttctggaatgccgtccgcaccaggtcacggagcgagtcgaactccgtctggaggtacgtcttgtccaaatcccagcggtagatgcgccggggcggacgtgggtcgatgcggtccggcaagctcacttcttcaggccttcccggatggcggcgcccaggttgttcgacaccaccttcgccgcgaccttgcccgcgttggcgatggcccacgacttcgaacgcccgtgtgccttgatgaagattttatcgaaccccaggatgggggccccgccgtactggttccagtcggtgatgtccttgatgcgctggatgccgctggacagcatcgcgagccccgcgcgccaccgcaggctctccttgtaggcgtactgggccagctccaccaccgtgtcgtggacgccctccagcatcttcaggcagacgttgcccacgaagccgtcggtgacgatgacgtccgcggtgcccttcgggatgtcgatgccctccacgttgccgatgaagtggatgtccttcatctccgacaggcgggcatgggcctccaccacgcggggcgggcccttctgcggctcgatgccgttggacaggagcgccaccttggggcgctcgttctgggagatgatgcgcgcgtaggcggagcccatcaccgcgaacgtcaccaggtcatccgcggtggcctccaccgtggcgcccacgtccaggatgagggagaacgggtcccccttcgcgccgcgcaccgagcgcgtcgggtacaccgtggccagcgccgcgcgccgcacgccgggaatgagctggaagtgccgggcacacgccagcacgcccgcgcccgtgttgcccgcggacaccagcgcctgcgcctcgccctccgccaccagccgcgcggccaccgccacggacgcgttcggcttgcgcgccagcgcctcgcctggcttctcgtccatgccgatgaagtccgccgcgtgctgcacggagatgcgct

SEQ ID NO: 459 - DNA, 3134 bp, Myxococcus xanthus
cgcttggatgtgcgcgccactcagcatgcgcgggtcgccatccttcgcggcggcgatctcagaggccttgcgcgcgctgaccttctccagctccttcgcgtcgaagcgcgggcgcgtgagcatgtcggtgagcagctccaccatcagcccggtgtcgcgcgacatgaactggccgctgatgaccagggcctccaggttggcggccacctgcagctcgccgcccacgccgtccacggcctcggcgaactggcgcgcgtcacggccgccggcacccttctgcagcagctcaccggtgagcgcggccaggccttccttgccagcggggtcacccagggcgccgccgcgcacccacgcactgaacgagacgagcggcagctccttgcgctccacgagctggagcttcgcgccgttcttcagcgtgacggtggtggccttggggagcgtcacgccctgctgcgccggagccgccgtggcgggcttcggagcagcggcggagccctgggccgcggcggggacggaggacagcagcagcgtggtgaacgcggccttccaggagaggggggcgctcatcgcgaggcctccttgcgggagtcgggggtggcggcctgcgcgtcggcgggcacgagccaaccaacggtgcggcgctgcgagttgaagatgcgcgcggcgaccttgcggacgtcgtcacgcgtcacgcgctcatagcggtcgggcgcgtcgaagagctggcggtagtcaccgcggaacgtctccgcggcgcccagcgcgcggccgcggccgttgttggtctccaggctgcgccagaactgggacagggtgatgttgcgcgccttcttgagctcggcgtcgctgacgccgtccttgacgacgcgggccagctcctcagtgagcaggccttccaccttggcgacgtcagcaccgggcggcaagtccgcgtagacccagacgagcgaggggtcgaagcccgggctgaagtgggtgttgacgcggagggcggcgcgctcctcctcgacgaggcggcggtgcagccgcgaggagtcgccgttggtgaggatgctcaggagcaacgtgagcgcttccacgtccgcgtccttgccggagatgccgtggtaggccagttggatgagcggggcctgggcctgcttcttcacgacgatgcggcgctctccctgctgctcgggctccttggtgcggacgggctccggcgcgggctgggaggggatgggctccaggtacttctccgcgagcgcgaagatttccgcgggcgtcacggcgccggtgaagatgagcgtggcgttgttgggcgcgtagtacgtcttgtagtagcgctggaggtcctcgatgcgccacgactcgatgtcggacggccacccgatgacggggaactggtacgggtgcgccacgaaggcggtggcctgcacctgctccatcagggcgcccatgttgtcgttgtcgatggcggagcggcgctccgagtacacgacgccgcgctcggactcggtgaccttggggtcgatggccaggtgctggagccggtcggcctcgaggtcgaagatgacgtcgagcgcggagcgcgggaaccagtccatgtagacggtgacgtcctcggaggtgaaggcgttgttggcgcccgccgttggcctccatgacgcggtcgaactcaccggggccgtacttcttcgccccgttgaacatcatgtgctcgaacaggtggctgatgccggtgatgccgggccgctcgttgcggctgccgacctggaacacggtgtagagactgacgacaggagcctggtggttggcgagcaaccgcacctggaggccgttgggaagcgtggcctcgtggacgtcgaacagggactcgagtgcggggtccgccacgcgagtgggtactttgctcggggaagccttggacataggaccccgaacctaaccagagcgtggctatagatccacgacacccgcacgcagggccatcaccacggcctccacgtgagagttgacgcccatcttccggtagatatgcgacaggtgcgtgcgcaccgtccgccgctccagcgtcatcacgtgccccacctcggcgttggacaggcccttggccacgtagcgcagcacctcgaactccagcggcgtgagcgcccaggggttctccagcttcttctccgcctgggtggacttcgcctgaacggactggaagtagttccagaagcgcttggcgatgatgggctccaagactgtcccgccctccatcacctcctggatgccggagcggatcttctccggccccacccgcttcaccaggtagccggaggccccggcctggatggcctcgtagaccttcgtctcgtcatcgaaggacgtgaggatgaggatctccacctccggggcgcggcgcttcacccgctgggtcacctggatgccgttgatgccgggcaactccaggtccaggaggacgagctgggggcggagctggacgatgtcctccaccgcggcctccccttcctgggaggtgcctaccacctccagttcggggaaggtggccagcaccttcaccaggttcttgaggagctggggttgatcctcgacgacgaagatgcgggtcgggtccatggtcaccgcctcggagacgtgaacgagtccaccaggaccttgaggtgctgcccccgcgtgatgcgcaggtccagctccttgggctcaccggtggcgacggacaccagcttgatgcgccgggtgcccaccttgacggggtatcggttgaggggcgtacggcggctcagccgctcgccgtcgacgtagacggtcgccggcacattggtggtgatggtgagatacgcgcgctgagacttcgggggaggcttcggctcgggggccgcgtcctcctcgccccctcgcgacgcggcttctggagcgggcggcggcggacgcactggcaccggcaccggcggcgcgatgggcatggcgggcggtgggcccacgggggcggcctcggccttcgcctcccgcggggcctcctccggcgcgggtgcggaatcccccccgagctgccatgcagccaccaggaaggtgaccaaccccaccccggcgatggccgccgcgatgcccaaccggcgtccataccggtgctgggccacggacaa

SEQ ID NO: 460 - DNA, 1879 bp, Myxococcus xanthus
tgctctacgggagcgacccgggtggagaccaaggaggagttcgccgacaagacgcgcagccgggcgctgctggcggacgtcggcttcggcgtgggactggccggtgtcatcaccgccatcgtcctctacccgaaggatggccccccggttgcgggtgaggtgcgagtcacgatggcgcccaagggcgctggagcaggaatggcggtgagcttctgatgcgcgcgctgcgattgatgatgacgggaagcaccctgctgatggccgggtgcagcttcaccaccgccagtgggctgaccgagtgcgagacgtcctctgactgtgaaaccgcgcaggtatgcaccgctggctactgcctgccgcagccagagggctgtggagtggtctatggcccggcctccgcggccaacgccattcccctgggcgccgcggtgccgctgagcacctccgacggcccggacgagtccgaggtgcaggcgctcaacgccatcaagctggcgctcgacgaaatcaaccagcgcgagggcgtcaacggccggcccttcgtcctccacatctgcgacacgcgctcggagccgaaccgcgccgccgagcaggcccagtggctgatgcgtgagcgccaggtgccgatgatcttcacctccagcagcgcccaggcgctcgcggtgtcctcgttcaccgtgcccaacggcgtgctgatgatgacgtacagcgccaccagcccggacctcgccgccatcaacgaccagaacggcaccacggcaggcctcgtctggcggacggccccgtccgacgtgctgcagggccgcatcatcggagacctgctccagggcgccatcctggtgaacggcgcaccgctctacgacagcatctccaaggtcggcatcagctacgtgaatgacgcctacgggcaaggcctcttcggcgtgacgctggggcgcatcgacaccacccagcggaccgtgacgtccgcccagtacgcccgcaacagcgccgacgtctccagtgtggtgcagcacatcaccaccagtctgccggatgtcgaggtcctcatcggcttctccgaggacaacgcgcgcatcatcaaccagacggctgccgcgggccggaacacccagcggtggttcttcaccgacgccggcaaggaccggggcctcttcacctcgctgggcgccaacgccgcgctcgtggacgattcctacggcacgtctccagcgcaggcccgtccagacctcgtctatcaactgttcgcccagcgcttccgctccgccttcaaccagacggacccgggccagtactccttcaccgcgcacgcgtatgacgccatgtacctggtggcgctcggcgccgcgtacgccgccggtcccgacgtcaacaacccgcaggccatcaccggcgcgcgcatggcggacggccttgcgctcgtgacgccgggcgaggcaggcacgtccctgaactacaacctgggcacggagggcttcgcgggcgctcgcgcggccatccgcaatggacaggtcatcaacgtgacgggcgccagcggcgacctcgacttcgacgccacgggcgaggcgccgtccgagtacgagctgttccgcgtgaaggacggcgggttccagacggtgcagctcatcgcgccgcccacggagtgacgtgacggggcctcagggccccaacgtccgcgcgagcacctcgacggcggcgggcgaaatcctcgggctggggcagcagcgacagcacgaggaaggcgccgccgccgaagtcgtagaagtagcccggctgcacccgcacgcccgcgtccagcagggccaggcaggtggcctcctcaccgggcgccctcggaatccggaccaccgagctccacccgccctccgccgggaccacg

SEQ ID NO: 461 - DNA, 2254 bp, Myxococcus xanthus
ctgggcccgaagcgcggcgctgtcgacaggcttcgtcgcacggcccgtccccggggggagcaggaccgcgcccgcggagagcgccaccgccgcacgcagaaaatcccgacggcccgtccgcgagggtcgagccatcgtgtcccgcccctcggtgttcgaaggctccatccggaatggggagaaggaagtcagggcgtcctggctcaccgagcccccggggaggccacgaggttgatgccgaagaggcgcacgccggtttcggtccgcggctgatgacggcttgccggcgggaagaacaggtatgagcccgctcccaagcgctgctcgccctcgatgagctcaccgctcaccacgagaacctcctctccggtgtcgtggacgtccacaaagggccactgactcccgggagccatgtccacgacccagaccctcacgtcgcgagtgctcggcaaatccctccgaaggcagccggagccgacgaccaccggttcaatgtcgtcaatccacacggacgaccatgggggtacgacaaggcgctgcatcctcggaaagctgtctgactggggcatccgtccgtgctcctggctctggggcaccaacgttaaggagacccattccataagcgcagcgaaacgatttcacgatgatgctgaattcagttcatgtgaagctgaccggcatgctcgagctccgtcacttcaagctgattgccgcggtcgccgacacgggaagcctggccgctgcgagccggcagcttcacctcacgtcctcggcactgagtcaccaactccgcgatgccgaggagcgcctgggcgtgcagctcttccagcgtcgccagcgccgcctgctcctgaccggcgcaggcgagaagctgctcctctccgcacggcgggtcctgagcgaggtggcccaggccgaggcggtctgccgtgcgcacccgcaggacgacctgctccggctcagcacgggctgctacacggtgtatggctggctgccgcccatcctggggcggtggcaggccgagcacccacgcgtcgagctgcgcatcgtcctggaggccacgcgccagcctcttggggcgctgctgaatggcgagctggatctcgccttgaccaccgacgtcccgccgcaggcccgcctggcacagactgcactcttcgaggacgagctcatgctggtggtccccgaggaccacgcgctggcgcggcggggacatgtcacggcggaggacctggtgcgggagcacctgctcacctatgccgcgcctcgggagcagctcgatgtcttcacgcgcgtgctctggccggcgggcatcgagccgcaccgggtctcccccgtccccctcaccgaggcgctgatcgagctggtgcgtggcggtatcggcgtgacggcgctgccccaatggatgctgccgagccagcaccctggactgcagacggtccggctgacgccgcagggaatccgacgccgctggagcgccgtcacccgcgcatcccgccagcgccccgctccactgacctacttcatccaactgctccgcgagcgcttctcccgccacggcaaagcagggccacgggctgcctcacggcgatgagtgccgcccaaacgctctcgctgcatcatgggtgagagcgcagaggcgtgcgctgtccttccggtcgcatctttgcgcttcttctccgccttgaccttgtgccttgccgcattggagagccgcaccgcgcctcggcaggatttgcctttgcacctccagaaccaccagtgggtgaaacaatgtcaacgggagtccttcgccacggccttgattgtcccttagcaaacacagtgaaccgcacagcgacaaggcaggaattcgcccacgctggactcacggcacgtcggaagcatctcttgggaatcaagaattgagtgaggtccatcgccctgcaatcgatggcaaagagggaatggggcaacctgtgtcccaaaatttcctggagacctgcctgcacgcacagccaggctcccgacctctgctatgttcggaaagccggaacgcgttgcggagtcctcacccatgcagtcgtgcccccaggaaacgacgctgacggacttgcttgccgggctgctttccgacgctcaccgggcccaagtcctggcacacgtcgagacctgtgccgactgtcggtgggccctgggagcgggagtgggcactcaagcgccatccagcgctccgacagcccctggggaggaggcgaattcccagccactgccg

SEQ ID NO: 462 - DNA, 2988 bp, Myxococcus xanthus
gcatcctcatctcgcggatgcaacaagtccacgcctcccgccctttcttcctgcccgcccacctgggagcgcttacatcgcctgacggctccctctcccaggtaacacgcgagtttacaatgaacaggggggcggcctgctacatcccctccaagggagtcaacgaggagtcaagtcaccatgccgaaacgcggcggcggcggtcgcggcgtcacccagaagccctccaaccgggacgtgctcccggccggcgcggagtcgaaggacacggagctcttcttcaaccgagagctgtcctggatggccttcaatgaccgcgtcctccagctcgccgagtctccggagattccgctgctggagcggctgaagttcatcgccatctacgcgcgcaacctggacgagttcttcatgattcgcgtcgcccgtctgcacgagcagattcgcggcggcgtggcgcgcctggttcccgacggagcctctcccagcgacaccctggacaagctgcacgacggcatcctcaagcagacgcgccggcacggcgacgccttcgagaaggtgctccgccccgccctggccgaaaagggcctgcgcatcctctccgccaggaatctggacgccgagcagcgcgcccaggtggaccagcgcttcaaggagcagattttccccgtcctcaccccgctggccatcggcctgggacggcactttccctacatctccaacctgtcgctcagcctggcggtgctgctgagagacccggacgcggacgaggagagcgtggcccgggtgaaggtgcccaaggagctgctgccgcgcttcctgcccctcaagggcaacgtcttcgtccccttggaggaaatcatcgcccagcacctgggggacttgttccccggcatggaggtgctgagctggggcaccttccgcgtcacccgcgacgcggacttcaccgtgtccgaggacgcggaggacctgctcaaggccgtggagacggagctgcgcgagcgccgcttcggcgacgtcatccgcatggaagtccaggccggcatgagccccaagctgctcgagccgctggtggaggccatgggcctggaggcgcgtcaggtctacgaggagcacggcctggtgggcctcaacgatttgcagtccatcgccttcgccccgggcttcccggagctgaaggacccgccgtgggtccctgtcacccaggcccgcctgcgcacggacgcggacgcgccggatggcggcacggtgatgtcgtccatgcgccggggggacctgctggtccaccacccctatgagtccttcgccacctccgtggagcgcttcgtcaccgaggccgtggccgacccggacgtgctggccatcaagcagacggtgtaccgcacgtcggacagctcgcccctggtgcccgcgctgattaccgccaccgagcgcggcaagcaggcggtgtgcatggtggagctgaaggcccgcttcgacgagcgcaccaacatccgctgggccaacgcgctggaagaggcgggcgtgcacgtcgtctacgggattccgtccctgaagacgcacgcgaaggctatcctcatcgtccggcgcgagggcgacaaggtgcggcactacgtgcacatcggcacgggcaactacaacccgaagacggcgcgcctctacacggacatgggcctgttcaccacggacccggacattggcgcggacgtggcggacgtcttcaactacctcaccggttttggccggccgaagagcttccgcaagctgctggtggccccgctcaccatgcgccagggcctgctggcggaaatcaagcgcaccgtcgccgcgcacacagccgagcgccccgcgcgcatccagatgaagatgaacgcgctggtggaccccggcatcatccacgccctctacgaggcgtcccgcgcgggcgtgaaggtggagctgaacgtgcgcggcatctgctgcctgcgcccgggcgttcccggcgtgtcggagaacatccgcgtggtgtccgtgctgggccgcttcctggagcactcgcgcatctacatcttcgagcgcggcccggagctgcgttgcttcatcggctcggcggacttgatgccgcgcaacctggaccaccgcgtggaaatcctcgcgccggtggaggacgccagcctggccgcccaggtgaaagactcgctggagcgctgcatggcagacaccacgtccgcctgggagctgacggcggatggcggatggcgccgccggctaccgcgcgccggtgacgagaagcgctgggcccagggcgagatgatggagcgcgcccagcgcatggcccagttccagggcggccgtccgctgccctgacagcacctgcacctcggtgggcgccgggagcctcagcgcgcggcgtcctcgcggcggtgggcctccacctcgcgcacctcgcgccactgaatccacccctcgcgcgcggcgtgacgggcggcctcggtggtgtcatccaccgcgagcatctggctgcccgcggcgcggatgtcctcggcgatgagcgccagctcctcggcccggcgctgatgcccgggcacgttgcggatgtagacgcagaggatgcgcccgggaaactcacggacgatggtgcggtagtgctccgcgtcctcctggccactgtcgccaatgaggatgaagggcaggtgcgacagcgtgccgagcaccgcgcgaatcttctccagtttgtgcccatggcccccgccgggcgcgaagccttggctggacaggccccagtcgcgcagcagcagcggaccggtggggattttgtgcagggagaggaactcgtccaggtgctcgtagaggttccacgggctgctggactcgtaaaagatggggttgtccgcgttcgtgccccggccgtgctggagcgcggcgtagaaagcgtccacgcccggaaagggcagccgcacgcggtgctcggtcagtaagagcgctcaggcccgcgtcagcaggccggcaacc

SEQ ID NO: 463 - DNA, 3916 bp, Myxococcus xanthus
  unsure (1)..(3916): unsure at all n locations
ccgcctcagcggcctacgagggctgtcgtcgggtgggcgagcgcatcgcagaccccgaagcgtgccatgccggctccaaaccccgcaaggcaagagcagagccacccacacgcgtgttatgtgtctgagttccttggcaccatcactttccccgttccgtcccatcccgggtgggcccacgccggacccgcttcacgggagcttccgttctcccctcaatcgagcccgcgccgaggacgccgcgctgcgagccgatggactgctcgccgacgaggaactcacgcagttgctcacgtcgccccgcgagcgccgggtggtggtgcagcgggcgcgggacatcttcgtcaaccgcaacctgcgcatggccagtgtcgaactgttcggcttcgacatggattacacgttggccatctatcacatgcgccggctggagcagctgtcgttcgacatgacgctggcgaagctggtgagcgagtacggctatccgccggtggtgggcgggctgctgtacgaccaccacttcgtgatgcgcgggctggcggtggaccgcgtcaacggcaacatcctgaagatggaccgcttcggccatgtgggccgcgcgtaccacgggctgcgcccgctgaagcgcgaggtctcgcgtgagctgtaccggaacaagcgcgtgcggctgcgcaacccgcagttcgcgtggaacgacacgttgttcgcgctgccggagacgtgcctgttcgcgggcatcatcgagctgctggagtcgctgggccacacggtggactacggcaagctctacgacgacatccgggaggccatcgacacggtgcaccgggacaactcgctcaagcgcgaggtgcgcaaggacctggcgcgctacgtgttcctggacccggagctgggaccggcgttgcacaagctgcgctcgggcgggaagcggctgttcctgctgacgaactcccgcgtgggactacacggacgcggtgatgaagtacctcctggacgggcagctcgcggagtacccgagctggaggaactactttcgacgtggtggtgacgtcggcgggcaagccgggcttnttcaccgactcgcaccccttgctggagctggatgcctccacggaggaaggccgcgtggtgggcgaggccacgtcgctggagcgcggcaaggtgtactcgggcggcaacctggcgcgcttcgaggagctgacgggctaccggggcgagaacatcctgtacgtgggcgaccacatctacggcgacatcctgaagtcgaagaagtcgtcgctgtggcgcacgtgcatggtggtccaggagattgaggacgaaatcacgtacacggcgacgcggcaggaggagattggaacgctgtcgcaggtggaggtgctccgagagcgcctggacgacgaggtgaaccaccacaagacgctgctcaacatcctggatcggcgactggagcgagaacagctgacaccggacgagcggctgggcgtggaggagctccgcaagcagacgaaggcggagctggaccggatgcggcgggccttgaaagaggccaacgaggtcgcggacacgctcgagcaggacgtggaggaaggcttcaatccgtactgggggctgctcttcaaggaaggcaacgagaacagccgctttggctaccaggtggagcagtacgcctgtctgtacacgagccgggtgtcgaacttcctgcaccattcgcccatgcagtactaccgctcaccgcgggacaagatggcccacgagcaggccggagccctgtccgcccggctgtccccgatgggcagcgaaggccccccgaagggcgccgggaacgagtaggcctcagacgacgtgtcagaccctcccgtaggatgggaacctgtcaggtagtcacccctggaggtcgggtgctaccttgaggacttcacaggttccattcacggcgaggtgtgggcatgagcaggggcaagaatcggaaaccagcgacctacgaggacatcgagcagcttccggtcggctgggtcggagaaatcgtcgacgactcgctgtacgcctcgcccaggcccgcctacgggcacctgcgcgctgccgcccggctgacgagcctcctcgcgcatcccttcgaactctcacgtgagggtcctggtagctggtggttcctggttgaacccgaactccacttcgctcgcgatgtggtggtgcccgacgtggccggatggcgcagcgagaggctgccagagcccccagaccccgagctgccctggatcagcactgcgccagactggctgtgcgaagtcctgtccccctccacgcgaagcctggaccgggtccgaaagatgccgctgtatttccgtgaaggcgtggcgaacatgtggatcatcgatcccgttcgccagtccctggaggtctaccggcgtgggaccacgagctgggtccggagccagttgttcacggggaacgtcaccgtgaacgcggagccgttcgaggtcctccccttggacctgggcttgttgtggacgccgcgaatggaaggcaccgtgcagcagtgatagcggccctcacggctcgacgaagggccccacgcggccccagatgacgtcggtgaagcgcgagccgggctcgtcctccagacccagcttgcgaaggtcgtcggtgtacttcgcgcccttcaccaccacccaccgccgcgccacgcgccgggcttcctccagcgtctcctgcgtcaggggcgcgtgttccgcgaagcggcgcagcatgtcgaacgccggctgtgacttgcgcggcttcgcgaacatcggatcgaagaagacaacgtcgaacgcgcgcgacggcaacgtcttcaggtactcgcgagcatccgcatgcaccacttcaatgagccctgagtcctcgcccagcgcatagcgccgcagcccctcccccgccaccgcccccagcgccaggctccgctccagccccaccacgcgccccgagggccccaccgccagtgacgccaccatcgcgtcctgcgccagccccaacgtgcagtccagcaccgagtccccggcgcgaagctccgccacccgaacgaaggcatccggctcccccgcccgcagccgcatccgccgcaggtgcgccatgcccgcgtggaacccgaacgagccctccgcgtcccacagcgtcacgccgtcaccgcccaccaccaagagcgccgccgccttcgtccccagccacggcgccacgctctccttcgcgcgccgaggcaggaagggcacaccccaccgcgccgccacggcacgcgcctcgcgcaccagcgccgcgtccaccttcgtgctcgtcgtcactgccagcggtaccagggtcaccctcctgcctcgcatccaccatgcccgcagcgaaggagcaacggattccgccatccacgacgctccgcgccacgccacgactggcccatcgcgtcaaccgaggaaggccctgccgagactccgtctcggagccgacaggattagtacgaattaacgaactccataggaattcgcgccctcgtgcctcagaatcggacttccttcggacgatggagaatctccccaatccgcgcccggagtggttcgcttggagaggacaacgatggacaacagagcagcaggaatggccgttgtcgtactggtcgcaaccctcttggtgggcgacgcgttcgcagccacctttggagtcacgccgtcgggcgcgtccgccgtcttctacgtcgacaccaacgcctgggcggacatccactacgtccgcaacaatcaggggcagctcaactatcggatgggcatcgtcaacggccggaaccagtacacggtgacgggcctgtccgcgggcgaaaccatcgactactccttcacgtactgggacgagtcctgcaactgtgcccgtgacacggcgtggacgcgctacacgcatt

SEQ ID NO: 464 - DNA, 2168 bp, Myxococcus xanthus
actgtgtacttgtcgagtcgcatgcctccaacgtaagagtcggccaccccttggcaagcagcgcacgtggcgcgacgtttccgcttgtctggaatagtttggactcctggtaactacctgcttttcaaggtgccggagttgccagcgggtatgatgccgggtataggcggcgcccaatcccctggggggctgaaactgaaagcacacggcggatatctcctacgactcgagagcttcggcggcctggagctgctccggttggcgcgtgaagcgctggcgctggacggtgcgatgggcgcgacggggctgaaggtgtccgtcaaccgacgccgcaaggtggtccgtctggcgtacgtggctcccttcaccgagggacggcagggcgcacactggtatgcggcccaccatgcgctcccccggctgctttcccgggcgacgaacgccgccgtccaggcctacgtctatgatccagacgaaggcgagcaggtcatcgcgtacggcaacggccggcgcgtgggcggtgagcgggtcgtctacgaggacgtggagctcccggtgccgctggaccagatggacgacgcggccttcaagcacatgcaggagcgctggccggtgggccacctggcgtacgtgttcggcctgacgcgcaaggagctgctgcggctgccgcgcgtggctccgggccacgagctggcgctggagggccgtgacgcagaaggggccgccgtcctggaggccctcctgccgacctgccaggtgacgctgccggagtccgacgccctctgagaagggctactcctcctgcggcccgtcctgcacggccatggcctcgcggacgcgctggctgcggaagtactgccccagaagcgcgaaggtgcccgccaccaccacggtgccgaagatggcgctccccacgcccatcgcgctcaggatttcgcgagaggcctcgacggtgatgtccggtgggaactcgggcatcttgctcatcggctccgccagcgccgcgaagaggcgctgcttggccacggacatctgcgcgccgtcgatggtgcgcagcccggcggcgatgatggccgcgcggctcaggacccggctcaaggcgtcgcggtgcaggttctccggactcagcatgcgcgccgcggacacgctgacaaaggcgcaggcaacggccagcaagccgagcagcaccgcgcgcggctcccgcatgggctccagcgccgcgtagtagacctcgagaatcttcgggtcgagtgccggggcgccgggaatccgaggcagctcctgctccatccggagtgagcgcgcttcgtagaagttcgccatctcgacggcttccatcagcgccgcccagcccgtgaggatggagagcaccaggcccacgatggcggcgaagcggacgccaccgggcaggcccttcctactggagtgcttcaccgcttggtcgcctccacgtagcgcaggcggaggtccgcgagcagcccgtcgaagagcttctcttcctcggctgtgaggttgccccgcgtcttcgcgcgcagcatggacaagaggtccaggttctgccgggccagcggcaggtccttctccgtctgacccgtttcaggattgggcgcacctcccaggtggatgagcaccgcggtgcccagccccacgatgaaggtgctgaaggaaatcgactcctcggacgcggagcgcgcttccccccgcatcacgaaggtctcgccgcgcttctcgtccccggagctcatgcggagaccggcccctcatcgtcggaggtctcgttcgaagcggtggcggcctcgtcgtcgctctcggcctcgtcgtcgctctcggcgtcgtcggcctcggcggtgtcgccatccgtcgactcggcggcggcggaggtctcggcctcatcgctgtcgtcggacgtatcgtcgccctcgtcctcgaagtcatcctcttcgtcgtcgaagtcgtcggcgtcgtcgagcatgagcgtctcaacggggacggacttctccgccacgtcgggcaggccctggaggtggcgctcgtactccgcctcgtcgagctggcctgagcgcacgtaccgctccgcggtgcgcttatcgaggtacttcgggtccgccgaatccgccatggttcaaatcctcagaattgcttggaaaacagcgcggcaccttatagca

SEQ ID NO: 465 - DNA, 2732 bp, Myxococcus xanthus
ggtgctgcgtctctagactcatgccggctgcccgcgctcacgcgcgaggccgaggaaagcatcgatgaagcgggccagccgggactcggcgcgcgcacgggcctgagccaggggctcaccgtcggcgagcgtctccttcagctcgaagtagtatttgattttcggctcggtgccggaggggcgcagcgtgacgcggccgccgctctccaactcgagcgcgacgacgttggacggaggcaggccccgctcgcccttcttgtagtcgctcacggcacggacggcgtcgccgccaatgtccttcggaggcgaggcacggaacgcgtccatgatgccgcggatgacctgcgcgcccgccgcaccggggaacgtgaagttgcgctgcgcgcccacgtacaggccatgcgcgcgctgaatctcctccaggtagcccagcaccgtggtgccgcgcgcctgacaccacgccgccaggtccgccatgacgagcgccgagcccacgccgtccttgtcgcgcgtcaccgtgcccacggtgtagcccagcgcctcctcgtaaccgaagacgaagcgggtgccctcggcctgctcgcgctccagcgcgcggttggcgatccacttgaagccggtgagcacctcgtcacacgcggcgcccagcgagcgcgcgatgtctcccaactgcgccgaggagacgatggtggtgacgacgtggggcttgccctgcttcgccccctgggtgaggacgtagtggcccagcagcacgcccacctcgttgcccgtcagcagccgcagcgacccgtccgcgtcgcgcgccatgacggccagccggtccgcgtccgggtcattggccagcaccacgtccgccttcacgcgctcggcggtggcggtggccaggtccatggcgcccggctcctccgggttggggaagcgcacggtggggaagcggccatccggctgctgctgctcggccacgggggtgacgcgcgggaagcccgcctcgcgcagggcgcgcacggcccagtcgccgcccacgccgtgcatggcggtgtagacgatggacagcgactcggagcccttgcccaccacgcgcagccccaggatggcgcgcacgtaggcatcgccgatggccgcaggcaaatcccgccacaggcccttggcgcgcgcatcggccggcgtcagcagcggcacgcggttggcgggctccacccgggcgatggcggaggcgatgcccgtgtcatgcggcgggatgatttgcgcgccgttgccccaatagaccttgtagccgttgtactcgggcgggttgtggctggccgtcaccatgacggccgcggcggcgttgaggtgcagcgcggcaaaggccaccagcggcgtgggcaccggctccgggaagacatgggcggggatgccctcggcggcgagcaccgcggcggtgtcctcggccagctccgcgctcaggttgcgcgcgtcacggcccaccaccacgccccgggtggcgacgtccggcacctgctccttgaggtagcgcgcaaggcccgcggtggtgcggcggatgacggcgcggttcatccggttgggaccggcgcccagcacgccgcgcaggcccgcggtgccgaactccaggtcctgcgagaagcggtcctccagctcggcccagtccgctttcgccagcaacgccgccagctccgccgcggtggacggatccgggtccgcctgacgccacgcctccgcccgctccttcagtccggtggtgtccatgagccctcgaagcctcgtgtagccgttgagggcgcgcgaggcacggggctcgcacgccggttgttcaggtgtagtcggtcagcttgctgcgggtggcgcgacccttggggccgtccttgttgccctggcacgtcacgcagaactccgcgtagggcatggcgcgcagccgcccgagcggaatctcgtcgccgcactcctcgcactcaccgaacgcgtccgggtcgtcgcgcagcttgcccagcgccttgagcacgcgggccagcacgccatccatgttccggttccggttggaggcgatggcctgcatcatctcattgagcggctgctcatcctcgtcgccgccgatgcgcgcgtcatcggtgcggttgggctcgattctcgacggcgtcttgtccgtcagctccgagtggagcgcgagcagcagcgccttgagctcgtctcgctgtttcgcgttcacggtgtccgccccgggtcagtacttcgcggaggaggtctgcccggagacgatggccaccgacgcggacgcacccacacggttggcccccgcgcgcagcatcttcatcgcgtcctcggcggagcggatgccgcccgacgccttcacgcccaccgtgtcgcccaccacccggcgcatcagcgccacgtccgcctcggtggccccgcccggaccgaagcccgtggacgtcttcacgaaggcggcgcccgcggccttggagagcgagcaggcgatgaccttctcctcgtccgtcagcagggccgtctccaggatgaccttcaccggcacgggccggctggcctccacgacggcggcgatgtcctggtgcaccagcgcgtagtcgtgcgccttgagcgcgccgacgttcagcaccatgtcgatttcccgcgccccggcgcggatggactcccgggcctcgaaggccttggcggacggcagcgaggcgcccagcgggaaacccaccacggcgatgggcaccgtggacgagccggcc

SEQ ID NO: 466 - DNA, 1713 bp, Myxococcus xanthus
ggaagaggtgcccttggaggtgaacttcaccgccagcgccaccatgcccaacagcggcagcagcgcccactgcgttcgccgcggacacgcagatgtcgaacaggcgcttcatcgccatctggtgcggcttggggctcaccgccgcgaagtgcaggaagccgtccgccaccgcgcggcgctccaccgggcgggcgcggtccaggcggaagctgtgcgcgggcagcgcgaagggcacgccgaagcgctcggccagcttgatggccgcctgcatggactcgccctgcttcagcgtgttgccggcgatgtacacctcatccaccgcggtgttgcggaggatgtgctccaggtcgtccaccgaacccatgaccgggccgggcagctctcccacggagccgttgtcgtcgtggaagcgcacgtagcccagaatctgccggcggccccggttggccaggtcctcaccggtgtagcggcccatggcgcccgtgcccacgatgagcaccgcgtccatggggcgctcctgcgaggccaccgggcggaagacgaacaggcgcaggagcagcgtcaccggccagaagatgaacagcagcgggcccaccaccggcgacgtcaccaccgtcggcaccgccacgctgcccagcgtcagcaccgtcaccaccgccagcgtcgtcaccgacaccagcgcgacgtggtccagcttgctgcgctcggcgaagcgcgagtcgtacaggcacagcgcggtgcccgtcacaatccacaccacccacgccgcgagcaccagcccagacaccttccaaccggactccgccgacaactggccgctcagccacgccgagcccaccagcaccgacgacagcagcacgaggtccaccgtgaggttcagcttcgccgcggaccccggggccagcttgggcggcccctgcacctcttcaatgacttgtccctgagcgttggccgacccaggagcaccgaccaccgccgcacttgccgttgcgccgctcatcgtgtccacccccctctgctcactttcgtgcagtcgaagcagaggtcgccgttgaggctaaaaatgttcaagtcggaaggaaaccagttttgcccgatatcgcggcgaggtgcaacccctgccgcgtcactaagacgtgaccgcatgtgaaatcttgtgaccgccctacccaggttcgagttcaccgagcgtcaccaacacatcgtgattcaccgcggctccccgcgtttccttcgtcacggtttctttgcatttacggtgccgctctgacgcgaaggcacgaatgatgcgaggcgccgggtcatccctggaagggtgccaggagtttcaagaggttacacctgcgacaaggcgttcgagcccggtgtagacgttgaagcgctcgttccggacgaacgcggccagcgtcatgccagaacgcagggccaggtccactgcgagggagctggcggcggagacgcccgcgacgatgggaatccgggccatggcggctttctggatgatctcaaagctgacgcgtccactgacggcgagcaccacgggctgacgcgtcaacgggaggcggggagcccgggggccccgcacggtgccggccagcaccagcgtccctaccaccttgtccacggcgttgtggcggcccacgtcctcatgggcggccaggaggtggccgttggcgtcgagcacggcggcggcgtggacgctctttagagcac

SEQ ID NO: 467 - DNA, 2700 bp, Myxococcus xanthus
catgccgaaggccctgtcgctcatcgagaagctgacgctgcgctcgggcggtgatttcgcgccggcgatcgagcagatcgaggcgatggcgggcgaggtgaaggaccgcaccgcgcaggtggacctgtggctgcgcgtgggcacgctgcgccttggccggatgaacgacgcggacggcgcgctggcggccttcgagaaggccgtggcggcggacccgtcccgcgcggacgcggccagcctggcggccgagcagctcctggagaagggccgggctccggaagccgtcgcggtgctggagcgctatctgggcacggtgaaggaccgctccacccaggcgggcatgcggctgcggctggcggacctgttcctgacgcagctcaaggacgcggacgccgcgcgtgagcacctggaagcggcgctgaagctggaccccacgcaggcgttggcggccttccaactggcgcggctgttggccgaggacgacgagctggaagccgtggtgccgctgctggacctggccctgctggcgccacgtccgcgcccggagcgggtggccttctgcgaagcgctcgcgctgatgttcgaggagaaggacgacgcgcgcggggccttcgaggtgctgtcgcgcgccctggagctggatccgggccgtccgctgctgttgggcacggtggtggagcacgcggagaaggcccaggtgcagcccgcgctggcgctagccctgcaacgcgcggcggaagcggcgccggtggcggaggtggcggcaacgatctggcggcagttggcccagttgctccagggccccctggcggacccgtcgcgcgcggaggccgcatggcgggaagtgctggcacgcgcgccgggtgacgcggccgccgtggaggcggtgaagtcgctgcaggcggccgcggcgctcgcggacgacccgaaggcgcggctggaggcggacgtggcccggcgcgaggcagccggcgcggcgcccgaggacctggagccattggcgcgtcagttggtgcagctcgcgccagaggatgcggcgggcgtgcagcgactgcaggcgctgtgcgtggccttgtcgaagttcgacgaggcagcggcgctcgcgggacggttggcgggcctggcggagacgcagctggagcgcaacgagtggacggcgcgccaggcgaagctgtacgccgagcggttggggcgtcaggaggacgcgacggacctgttcctcggcctgctctccgagaacgtctccaccggcgtggtggtgggcggactggagcggctggcggcggcgggcattcgcacggcggaggtgacagaggcgctggcggcgcactacggccgcagcggcgaccaccagcggcaggtggcggcgctccagcagcagttggaggtgacgacggagcccacggcccgcaagcgcctgttctcgttgctggccagcatccatgagaagcagctcgcggacagccgcgcggccttcgacgtccaggtgcgcgcgctgcgcgaggacgcgaaggacgagggcacccgcgcggaggcgctgaggctggccagggacttgtccgcgcacgcggagctggggcgtgtgctgcgcacgctggcctccgagtccgaggaccccgcggtggccgtgccgttgctgctcgaggccgcgagcctggcggaagagggcgcgctcgccgcggaggccatcgcggcgctggaagcgggggtgacccgtgcgcccgagtcgaacgcggtgctgcagcggctggtgcgtctgtacgggcgcgcgggtcggtccgcggacgcggaaggactgctgcgcaagcgcatccagggcgcgcgtgggcaggagcggttggagctgctgcttcagttggtggacctcaactcggagctgggacgcgatgcgcaggcggccgaggcgctgcagtccgcgctttcgcacggcgccgaggaaggccggcatctgccgcgtctggcggagctgtacgagaaggcgggccggacgcgcgagctgggagacacgctggcgcggatgattgcgctggccgagtccgcgggtgacgcggacagagtggcgcgactgaagctgcgccgtgcgcacctgctgcaggagtcgcaggatggcagcgcggaggcggtgcagagcttcgcggacatcctgctccagcgccccacggacccggatgcgctggcggcactggaggccatgctcgcctcgggctcggcgcgcgaggccgctgcgcgtgtgctggtgcctgccttcgagcgcaccaaggaccaccgcaagctggtggccacgttggatgttctggcggaagtggcgaaggacgacgccgcgcgagtgcaggcactgcgacacgcggcgcaggtgcacctgacgcacctgcggcagccggagctggccttcgcggcgctggcgcgcgcactgcgcctggcgcccggtgacgcggggctgcgctcgtcggcgcggcaggcggcggaggacgcggactcgctggacagctacgcggaaatcatcgcggagctggcggaggaaggggacgtcggctccgcgcgactggcgctgctgcgcgagctggccgaggtgcaggagaagaagctggacgacaaggccggcgcggtgaaggcgctgcgcgacctgctggccatcgagccgggcaacctggactgcctgcgcgcccttcagcgcttgcatcgcgcgggggaggaatgggc

SEQ ID NO: 468 - DNA, 2441 bp, Myxococcus xanthus
gctctacggtttcgcactacgaagggtacccgctccacgcccgccgtgcccacccgggtgtcgcccagggcgccctcgaagtcgagcgtggcctgcgcctccgcccgctgacctccgggcgccacgttgacggtgatgcgggcgaagcggtgctgccgggacgtcaggggccccggcgcgccggggacgggcagcgacaggccgctggactccgtcgccttgagcgcggtgatgatttccagctcggggccggccgcggcgcccaggaagcgtggaacgaacaaggccagggtggcgcccagcgccaggatgacgatgacgccgccaccgaagcggctccagtcctgggtcgttctcacgagcccagcatacgctgggcgcgctccgcggcgggcgtgcccggcagccgacgcagcacctggcgcagcgtgtcctgcgccttctccgtgtcattcagcttcacgtacgcgtcgtgcaggtcgaagagggcctcctcctcgtactccgtgcccgggtagcggcgcagcagcccttccaggcgctgggccacggccttccagcgctcacgcttctgatagaactgggccgcgtacagttcgtgcgaggcgagccggcgccgagcgtcctcccgctgcgtcttcgcctccgccacgtactgagactgggggtactggcgcaggaactcctccatggccaccaacgcggagcggatttcgccctggtccttctcgcgggacggcggcagggcgaagaactcggaggggtaggcccgcacgtgggtcatcgcggagcggaaggcggcgtagtccaccttggcgtgcgtggggtggagcttgatgaaggactggtactgctccttggcctcggggaaggcttcgcgctcgaagtccacgtcggccagcttcagctcggcctcgcgggcggcctcctggtacgggaacttcgttcggacgtactcgaagtatttctgggcgcggaagaagtccttgttctccagggcctcggagccgagccgcaggttttcatctgcgacggcggcatagtcaggctcaccggcctggccctgcgtgagggacgcacacccggtaccgaacagcaggaaggcggacagaaaggcgacggcggaacgcatccccaccacgctattcctccggccccgaggggtccagcgaagcttctccgagcaactggtagatgacgtcctccgagaagccccggctgtccaggagccggcctgcgcgggcccgctccctggcccccagcgggcggccgagcagtccccgcttctccagcactgcccgcgccgtggccagcgcgtcgaaggacaccgcgtcgctcgcctcggagatggcctgctgggccgtcccctcctccagcccgtgcgcccgcagccggtgggccaccgcctccggccccagccggcctcggcccaggagcagggtggcgcgctcacgcgcgaagcgttcgtcgtccaggtagccccaagccttcacgcgggcgagcgcggcctcgcacaccgcttcggtgaagcccttccgggccagggcctgctccagctcgcggcgactgcgcccgcgcatggacaggagcttcaggcacgcgtccgtggcacggcgaacagcgtcgggcccttcgtcctccggatgcatggcgggatacctagcatgtggtaacaggcccggccatgcaccccgtactcgcccgcttcctcgccgccgatgccgctcgggagacgctcctcaagcagcagtcgggcggagacctctctgtggaagagcaggccttcaccgacgccgcctccgcgaacccgaagcacaagtccgtgctgctgggcgtgggcggccgcaccctgtccaccgatgcccaggcttcgctggtgctgctggcggcccacgccgcggtccgcgcgctggaccaggacgccaccctggcggagcccacgaagaaggcccgcgaggccctggccgaggaaggcgccagtccggaggagacggacgcgttcctggcctccatcctcctggaggaggccttcggctacgagcaggacgtggacgcgttcgacagcgaatacgtgaaggaggcgctgggcgaagtgcccgcgctggcctcgctcaccaaggaggcggtggacgcgctcttcctcacgttcgtgaaggccgccgccaacgacgcggagcggaaggtgcgtgagggcatggcccgcgccctcttcgacatcgcgtggtcggaagggcccgcgcccatcaaccccgagcacatggaggccgtgctcgacgcggaggtggtggaccggcccgaggaggagcaggaggccaaggtgcaggcgaccgcgcagctgctccaggcgctgtccaaggagggcctcatcggccccatccgcttgtcccgcctgcgggccttgctgggtgaggacgacgcgtagcagccccgcacgggcgccc

SEQ ID NO: 469 - DNA, 3122 bp, Myxococcus xanthus
ctctcaagccgcccagcgcgcggtacttcagcgccgccaacagctccagcgggcgctcctcggtgtcctgctgctccaggttcaccgcgcccaccagcgtggccgcgagcgccagcggcacctcgctcaccgtgaagggcagctcggcgcccacgccgtaggacaccgcgttgcccaggttcaggttgcgcagctgctgcttctcccggaagtccacgcccacgttggcggccacgcgaaaccgctcgccgtattcggccaccaggcgcggctgcacgcccacgcccgagcccccgaggaagtcggagccgccgcccgtgggcagcaccaccggcaccgtcagggccaggccgaaggagccctcctccaggaggcgggccttgggcaccaggcgcaggtcaccgatgccgcccgagcccacgccctgggcgaaggacgggtccaccatgggcgccgcctgcgaacgctggagcgtcaccggcagcagcacgccgagctcgaagcggtcgaagaggcccaccgagcccatcaggtccacacccacctggctgcgcaccagcgcggtgatgaaccggcccgagcgtgggtccatgaagttgagcggcttgtccgcgtagttgacggacacgcccacgttccaacccaggtgggaatgcacctgggcgctctggacgcccaggatgtccttcgagctcggccccggcttgtactgctgcacgtcgatggactgggacgcggacagcgtgggcacctgcgccacggccggccgcgaaaccatcaggaccgccagcgccagcacggcggcggccacaggggccccaccggcccgccccgccgagcggcggaaacggcccagcaggggcagcccgagcactagcagcgccactggagggaaggtgtcggccccgctcgtgctgcacccacggccgtagatgacgaagtggtcgttgcggtccagcgggttggtcccgccggtgacttcctcgccgtcgttcacgccgccgccgtccgtgtcggcgttgttcgggtccgtctcgccgttgtcgaaggagccgttgcggttggcgtcctccgcgccatccagcaagccgtcgccgtccgtgtccgggttcagcgggttggtggggttggagccacgcacctccacgccgtccgtcaggccgtcagcgtccgtgtccgggttgttcgggtccgtctccgtgctgtcgacgcggccgtcgtggttggcatcctcctcgccgtccagcaggccgtcaccgtccgtgtccgggttcttcggatcggtggtggtgctcgggtccgcgtccggacggaaattgggcgaggtgcggtccgtgtccgccggagcgctctccagcgtcacgcccatctccgtgccgtccaggatgccgtcgttgtcgctgtccgggtccaacgcatcgatgaggccgtcaccatccgtgtcggtgatgccgtcgatgccgtccggcacgccgtcgtcgtcgctgtccgcgtcgttggggtccaggccccacgcgatttcggtcgcatcgtcgatgccgtcaccgtcggagtcgacgtcgtcggcggggttgagcggatccgtctcgcccgggtccacccggccgttgcggttggcgtcctcgatgccgtcacgcacgctgccgccgtccgtgtcggggttgagcgggtccgtcgtcgtggtcgggtcggagtccgccacgaagcgcgtcatgtccgtgttggcgccctgaggctcggcgaggcccagctccagaccgtccgacagcaggtcgccatcggtatcccagttgttcgggtccgtctcgccctcatcgacgatgccgttgtggttggcgtcctcgttgccatccaggatgccgtcatcatccgagtcgtcgtcgagcggatccgtccccgcggtattcacctcgatgccgtccggcagtccgtcaccgtccgtgtcggggttctccgggtcggtgcccagcacaacctcctcggcatccgtcaggccgtcgccatccgtgtcgaccgcgaccgaccagttgtagatcgccggcgtgccgtccacgttgcctgcctcatccaccgcgcggacgctcagcgtgtggctgccttccgccaggcccgtgaaggtgaccgggtccgagcacggcacgtacgccgcgccgtccaggctgcactcgtacgtcaccggggattcgtccgaatcgaagtcgaacgtcgcggtgccaggcgcttccgtcagcggcgggccggagatgatgagggtgtccggcgcggaggtgtccaccgtccaggtgtagctggccggcgtcgggtcctcgttgccatcctcatccactgcgcgcaccgccagggtgtgctcgccgtcatccaagcccgtgaaggtggccgggtccgagcacggcacgtacgccgcgccgtccaggctgcactcgtacgtcactggggattcgtccgagtcgaagtcgaacgtcgccgaatcactgttggagagcgcgggcggcgtcgaggtgaacgtcgtctccggcggctccgcgtccacgatgaacgtgtgcgtcaccgtcgtgctggtattgcccgcctcgtcctccgccgtgacggacaccgagtggggaccttccgacagcgtgtcgctcacggggagcgaccagttgcccgacgggtccgccaccaccgtgcccaccgggacgccatccaccaccaccgtcacggtgctgcccgcctccgtcgttccggaatacgtcaccacgggcacgtccagcaccgagttgttcgcgggcgtggtgatgaccaccaccggcggcgttgcatccaccgtccaggtgtactcggcgggcgtcgggtcctcgttgtcggccgcatccaccgcgcgcaccgtaagcgtgtagtcaccgtccggcagtgggccgaactgcgcctgggctgggcactccgtgaaaggcgcgccgttcagcgagcactcgtacgtcaccggagactcgttcgacgaaaagacgaagtccgcggtggccacgttcgtcaccaccgccgggccactgtcgatggcgtgttccggcgccgtagtatccaccgtgaaggaggagcttcttagagcactggcgttgcccaccttatccgtcaccgtgaaggtgacc

SEQ ID NO: 470 - DNA, 2605 bp, Myxococcus xanthus
gggcagtgcagcaccgccgcgctgctggggttgctgttcgcgcagtcgtgctctggcctctacctggcggtggcgctgcgctggggctcggcctggtacgtccacttggtggtgccgtacctgcgctcggtgctggccttccagccggacgcgtcgctgctggcgcaggcgcccttcatcgtccagttccacaccctgttcgggatggtggtgctggcgctggctctcttcatccgcgcgcggcccgagcccatcaccgcgcccctgctcgtcacgcctcgggaggagaccgcccgctgacgcggcggcacacccgtcatgaaagacgcctcgactcgcttctcttgtcgtgccctgaccgctgcctggatgggcccgctggccgcgctctccctggcgggctgtagcggcccggtgaacaaccagcagggctacatgcccgagcagcccgtggccttctcccacgccgtccacgccgggcagtacggcctggattgtcagtactgccacgtgggcgcggagaagagccgccacgccggcgtgccctccaccagcgtgtgcatgaactgccacacgcaggtgaagacggactcgcccgaaatccagaaggtcgcggccgcggtggcggagaacaagccgctggcgtgggtgcgcatccaccgcctgccggaccacgcgtacttcaaccacgccagccacgtgggcgcgggcctggactgccagacgtgccacgggcccgtgcaggagatggtgcgcgtggagcagaaggagcccatgacgatgggctggtgcctggattgccaccgcgacacggcggcgaagcaggtgtccgcgccgccgccttccgcgccccgcgctggagagctgctggccctgtcgtccggcgcacccgcaccggagccattgaaggcccctcgaatcctgcagccccccacggactgctcgagctgccaccgctgaggagtcccatccatgtccgacccacttcccaagtattggcagagcctggcggagcgcgctggcgaccttggcgcgctcgcacagacgcaggacgaattcgcggagccgctccccgtgggcgtcgccgccacgcctccggatgcgaacagccgccgtgacttcttcaagctgatgggcctgagcgccgcggcggccatggtggcctgccagcgcgcgccggtgcaggaaatcatcccctacgtggcgcgcccggatgaagtcacgccggggctggcgctctggtacgcgtccacctgcaacgggtgcagcgcccggtgcggcctgctgctgaagacgcgcgatggccgccccatcaaggtggagggcaacgacgagcaccccgtgtcgcgcggtggcgtgtgcgcggtgggccaggcgtcggtgctgtcgctctacgacgcgagccgcgcccgttaccccacccgcggcgccacgcgcgtgtcctggacggacctggacgcggacgtcacgcaggccctgcgcaaggccaccgaggcgggaaagggcatccgcgtggtgttgccctggcacctggggcccacggcggaggcggccgtgaagcgcttcctggccgcgtaccccaccgcgcggaccgtgcgcgacgaagccctgggggagctgtccgccatcgccgacgcccaccgcgtcacgcatggcgtgcacgccgtgccggactaccgcttcgacaaggccgccgtcatcgccagcttcggcgcggacttcctggggacgtgggtgtcgcccgtggcgttcacccggcagtacgcggagtcgcgcgacgcggcccggcgccggacgatgtcgcggcacttccaggtggagccggtgatgacgctcaccggtgccgccgcggaccgccgcttcgtggtggcgccttccgatgtggcgctggtgctggcggacctggtgcggcggctggcggtgaaggcgggccgcgaggtgcccggactggggtcgctgccgccgcccgcgctggacgaggccgcgagggtggagctcgcggactcgctgtgggcccagcgtcaggacgccctggtggtggcgggcggtgatgacgtggccacgcaggtgctggccaacgtcgccaacgcgctgctgggcaacgagggccacacggtgtcgctggcggacggcacggcgctggacgcggacgcgctgtccttggggacgctgctgaccgagctgcgcgccggcagcgtgggcgcggtgcttttcatgggcgccaatcccgtctacagcgacccgcgcggcgcggagctggccgcgttgctgaaggacgtgccgctcacgctgtccaccagcgaccggcgggacgagacggctgtgcacgtgggcctccatgcaccggagtccaccgcgctggagtcgtggggcgacgcggaggtgcgccggggcgtcgtgtcactgcgccagcccgcggtggcgccgctacatgagacgcgcagcggcgtggagtcgctgctccagtgggcgggagcgccccagccgcactacgacttcctccgcgctcgctgggaggcggaggtcttcccccaggccagcggcctggggcagggcttcatcgctttctgggacgatgccctccgtcggggcgtgctgagagcac

SEQ ID NO: 471 - DNA, 3007 bp, Myxococcus xanthus
ggatgttcgggtcgagctggcccgtctcaggacggaacagaccaggatagttaccgtacaggcgcgaccaggtgtagttggcctgggcgagccagccgtcggcgaacgtacggttcaggtagacggtgacgttgtcgtagttacgaaccggcgtcgggaactcaccggcgaagccgctgccggggttaccgaggaagtacgtgttgccgtcgtcgcggctcatgtcctcgatgaccgagttcatgtccttgtgcgtgtagctcgcacccaggcgggtgttcgccagcacttcgtactcggcgccgaccacgatttcgtcagaggactgggccttgatgtccgggtcgaccggcgtcccgccaaccgtgccgcccgtgtagaagcggttcacgttgcggctgctctccggaatggcaagcaggttcgagtcggtgttgcacgtagcctgctggctctcgaagctggacgggtcgcacgaggtcgccgtgccctggcccggctccgcgagggagcgacgcgcggagatgcggttctcacccgggaacgcgcggtccatcaggttgagcgggacctgctcgtagtaacgagcgaagttcacgaacaccttcgcgcggccgttggcgaacgggtcgacgatggcgccgatacgcggcgaccactgattgccgagcagcagcgagaggtcgccattgccgccgtagagcgcctgcacgtcgtagcggacgcccaggttcagagtcacccggttcgcgatggaccaggagtcctggaggaagccaccgaccgtggtgctggtcgtcttggcaacctgggtgaactgcgtcaccgcagagtcaggaccggtctgatacccgtagcgacgcgcatcgtgcacggcggggccctggccagcaaccccgtagttcgaaccctcctggaagaacacgccgccgccgtacgccttcacctggtcgaacgacagcaactcgacgtccacgcctgccttgaacacgtgggtgcccagcgcgttcagcaggtaggtggccttcgcgttggcctggtagcgatccagcgtctggtcgctcatgaagccagggccacccaccccgtagcccgtcaccgggcagcggagcagttgctcttccggcgtgctgccgcaggcaccctcctgcccttcgggcagggcttcgaacagggtcagcgcgcgcggggtggtgtacaccatccgcgagtagccagccaggcccgtgcgatcgcccaggttgctgccgtcacccggcagggtggacgcggtctggtggaaccagccgaggttcgcatcaacgaggaccttcttgtccgcgaaggcaccggcgtacttcagggccagagacgtcgtgttggccttcgtctccgtaagaccgaagtcaccccgacgggtagccagcacgccccgcaggcctcccgactggggattgacgctcagcttcccaaggccacccgtcgaggtcggcgtaccgttcagggcgaacgacacgttgtggtcctggttgatgaggtacgtcaacttacccatgtactgaatggtacgggagtcggcgtagtacttcctggcggaaccggggatcgcgtccgcgaccgtgaagtcggtctcgtccttgatcgtgttgccttcgtcatcgacgcgcagcgcattgagcgtgcgggtgtgctggtagcgggtgaacgacggcgcgaagccggcgaagaaccacagcttgtccttgaggatcggaccaccgagggtggcgccgaagtcgcccaggttctgcagctggttctggccggtgatgaccgtgccctcttcacgaatctgcttgcgggtaccctcgagggtgcccggcgtccagttcgcgaacacggagccgtggaactcgttggagcccgaccgggtgaccgcgttgatgacgccgccggtggaccggccgaactccggcatgtaaccgccggtgatgatgttcacgtcctgcacgaactcgatgctcaacgggctggcgttcacgccgaaggccgggtcgttcgtggacaggccgtccaccacgtagccgttctcaggcgaggtcgagccgttgatggacacgccgtagttgtcgttctgggcgccaggcgcgagctcggccagggactcgaaggagcgggtcgcgccgcccttgccacccggacgcgcaacggcgatgcgcttgatgaactcctgatcgacgttcacgcccatcgtcgtggaacccacgtcgatggtcgggggcgcgccgacgatctcaaccacctcaccgagcgcctcggggagcagctccacgttgacgcggatggtgcggttgagacgcagctggatggccgaacgagcgtacggcttgaactgctccttctcgaaccgcagggtgtagtcgccggggggcaactgggggatgcggtagttaccctgcgcgtcggtgacgaccgtctgctcaccctgaaggttgggcgaggtggcggtcacaacgacgtcagcggcaggctgccgactctgagcgtcgatcaccgtaccgatgatcgtgctcgactgcgcgaaagccgcggatccgtacagcagacctgcggcgacaacaactccggtttcccggagcactcggttcaagtgcataccagacccctccaaggtgggctgcaagtgaaaatgacccgggaaaatatccgaggtcgagcagttgtcaatagaccgttgctttttggtaaccagtggggcaattgcgcgatcacgccccgtccgtcgaccgtgcttgcttgaacctggaacgcgtttctgtatggtagcgcgccctttcatccgggcggagcgtcgccaatgggtgtccactggtgaagaggagtctagtgcatgttcgattcagtccttgaccgtggtcaggggcccaagtcgcgattcggcgtcggggctactgtctcggttatcctccatgtggcgctgttcggcctctccatctggctgtcgacgcgaccgcccgtcgaggacgataaggagattgaggtcacgctg

SEQ ID NO: 472 - DNA, 2581 bp, Myxococcus xanthus
cgcgcggggctccaacttcgtggaccgcccgaagggcaacttcgtggaccgccccacgggcctgccccagggcaccccgtcggcgctgccggcctcggccttcaccttcggctccggccacgtcgccgtccgtcccttcgcggcgagcgcggcccgcgcgcccgtgacgctgacggcgtccgccacgcccagcgcgaaggtgaacgacctccagacgacgacgtccaccgtgtccttcgaccaggacgtgaagctggactcgctgaagctgaacctggatctggcgcacaccttcaagggtgacctggtcgtcaagctgaccagcccctccggcaagacggagacgctccacaaccgcaagggcggcagcgcggacaacatcaagggcagcttcgacctggccgccttcaagggcgagtccaccaagggcacctggacgctctcggtcgaggacaaggcgcgccgcgacacgggcaccctgaagagctggagcctggacgccgccggccagacgacgggcacgggccccatcgaggagccgaagccccagctctccggcccgccggtcatcgccgtgttcgacggcggcgtggacttcaagcactccgacctggatgacgcgatgtgggtcaacccgaacgaggtcgcgggtgacggcatcgacaacgacggcaacggcgtcaaggacgacatctacggctacaacgtcggctacaacagcggcgacgtgatgcgcggcagcggcacggaccacggcacgcacgtggccggcatcatcgccgccgaggacaacggcgagggcaacaccggcgtcgccgcgggcaaggcgaagatcatgagcctgggtggcctgtacaacggcgcggacctgctcacgaacttcgagcgcggcgtcgactacatggtgaagatgaagaccgagcacggcgtgaacatccgcgccgtcaacgcgagcttcggcaacgagtaccgtgacgcggcctccgtgaagcgctggacggacgcggtgcagaagctggctgacgcggacatcctcctcgtcgcggccacggcgaacggctacggcagcaacctgaacgacgtggcggacatgcccgccaacatcgacctgcccaacgtcatcaccgtggcgtccatggacaagaagaacgacaagctcgcggacttctcctcctacggggacaaggtcgtggagctggccgcggtgggtgaggacgtgctgagcaccgtcccgggcggcggctgggaggagatgagcggcacctccatggccaccccgacggtggcgggcgccgcggcgctgatgttcgccgaaaaccccaatctgacggccgcgcaggtgcgtgacctgctggtccagacggtggaggtggactccgacctcaagggcaaggtgagcaccagcggcaagctggacatcgaggccgccgtcgccgccgccaaggccacgctcgaggacgacaccgcggtcgccgggcgctgagccggacctgaggtgacgcagtgaagaactcccggtgcccaggtgccgggagttttttcgtgcccgatttgattgcgcacaatttaattgcgtcctatttatctcgcatgtcgatggatgacccgctcagcctggaccggcaaatctgcttcccgctctacgcggcggcccgggcgatgacgcaggcgtatgcgccgctgctgtcgcggctgggcctgacgtacccgcagtacctggtgttgctggtgctgtgggagacggacggggagacggtgaaggggatgggggagcggctgtacctggactcggggacgctcacgccgctgctcaagcggatggagtcccagggcctggtgcggcgggagcggagcgcggaggacgcgcgctcggtgcgcatctacctgacgtccgaagggagggccctgcgccgcaaggccacgtccattcccgaagcgatggcctgcaagttggggctgacgctggaggaggcgacccgcctgcgccgcgacgtccagcgccttttcgaagtgctttcgcagtctcacgttgattccgcgaagtaacgctcaaggagaacaccatggctcccgtcgctatctctccgctgtacagcacctccgccaccgcccacggtggtcgcaacggccgcgtgaagtcggaggacggcgtcctggacctgcccttggccatgcccaaggagctgggtggcgcgggcggcgccgtcaccaacccggagcagctcttcgcggcgggttactccgcctgcttcgagagcgcgctgcggctggtggcgcgcatgcaggggaagaacctgggcaacgacgcgggcgtgcgcgccaccgtcaccatcggcaagacgccggacggcggcttcgggctcgcggtggagctccagggaatcctgccgggaatccccaatgacgaggcccagaagctgatggcggcggcccatgaggtgtgcccgtactcgaaggccacgcgcggcaacatcgacgtgaaggtctccgtcgctggctagtcgcacgtggagtgttcatgagggccgcgcaggcgttggtatcgtgcgcgatgtcggattcctcgctgcctcgttagagc

SEQ ID NO: 473 - DNA, 2905 bp, Myxococcus xanthus
tgctccacgtacagcacctgcgcccgctgccccttgttgcgcgacaggtacatcgtgcgccgcacgtggaaatactccgccaccagcatcccggagttcaccgccacccggaacaccggcccgtcctccgtgcggtcttcaatcgacaccacgcagcccaactccaccgcgtagggcacgaagcgccggtcattcggcttcatcgtgtcgagcatcgcctcgcccacgtagcgctcgtcctccgacaccgtcaccgggccgccttccagcgtcagccccgtggtgttcttcagctcgatgcacgccatggggttcttctcacgcgtggcccgattgtagaggagcacccgcttgccctcgaagggcttgtgcaggatgggcaccagcgcgctctggttgcggtgcaccgtcaccggacggtccacgccgtactcgaagaggtcccccacctccttcgtgagcgtcgtcaccgcggcgctcgtctccatggcctcgcgccgactcgggcctccacggccagggccgcccaccatggccttctccgcccgagagcggcgcggcgcggccatgggggccgcggcgggcatggcggacatcatcggcgcggccatctcctgctccatcatcatgtccccggcgctgccgaagctctcctccggaatcaccggcgcggcggcggcctccgtcgtcacctccaccaccggccgcttcatgtaccgggggttgtacaggtcatgcacgaaagacaccggcagcccggcaatgagcgacagcttcacgtccacccagtcctcgtcaccggtgttgtccaccagcgcccagccctggagcagcggcggctcgccctcgtccaggaggatgcggtagctcgtcttccacaccggcgactccaccacgtagctgacgaacagctcgcgctcgccctggcccgaggtgaggatggccatccgcttggagtccttcttgtacgaggacagcaccgtggccaggtagaactccaaatccttgcgcaccgcctcgtccaggaactccagctccgacacgtccaggatgtcgaaggtccgcagcgaggcgcccaccagcagcgacaggaacgggcgcatcaggctcgtctcaccggacgccaccgccagcgagtccaggccgatgatggagccctccacctgcgcgccgcccacgcgcacccgcacgcgcgcgcccttgatctgccccagcagcgccgtaaggctgccgtcctccgggatgcggatggtggcctccgccaggagctgctccagcggcttcgtggagtcgtagctcaccgccgacaccgagccgcccgacaagtcgagcaccgtcagtgacttcagcacgtcgttcatgtcacgcgccttgaagtccaggtggagcgtgtcgttgccactcacctttccccggcgctcgaagtagccgacgccatgcttgtaaaggacgacacgacgaatgcgcaggttcgtggtcatgggacgcggaactccagaaagttgagggcgggccagcaccccggtgtatcaaggttggacaggggtgacgcaatgcccctcaccgccgaggttgcccgaatgcgaaagcctgtcgcctcctccctgtcccgctccgcgatgctgtgcgcggccctggcccttggcacgagctgcaagagcgtggagccccacaccacgccctccgaggacaccaccgcgccgccggaagtttccacccaggagcccgtgacggagacgaagtcggagaccgagacggcgacggaggcgccaacgcggcgcggcaactcgccctggctgcgggcacgcgtgggcgaccgcgtggcgtattccttctccgccaaccgcaaggccatgggccggcagcagcccggcaccgtgccagaggccgcggtggccggcgtggtgacgctggaggtcgtggcggtggagttgccctgggtctgggtgacgctctacttcaccgaggatggcggcgcgccgtcgcggcggccgatgctcgcgcggccgctggtggtgcccgtgcgcgcggatgagtcgcgtgcgctggaggtcccccgcgagggcaagcagagcaccgagcagctcaccgccgcgggccgccactgggaggcgaagcgctacctcaacgacaagcggatgatggacgggcccctggagaaccgcctctacgcggcgacacctgggccgctgtacctcaccaatggcctgctcgacgcgagcaccacactggctggcttcggcatgggcggcggctcacagctcaccctggtggaagcgcgccagggacaggagggtggcaccggcttgcctccgacgctcgcccgcccttgggggccgggcacctggttcgacatgcggatggagacggaaggcaccacgtccgtgctgcgcacctgccaggccgcggagcgaggcttcatcctgcgtcagcaagtgacgccgcccacctcgggagcggcgtgcccggacttcgcccaggcggaagccgtgcccctggaggaggcggtgctcgcgcgcatctgggagtcactggacgcacggcaatggccccctgctcccgagggcctcgcaccggcgaagcgagagacgctgacggtgggcacgcaccgcgtgccggtgctccagttcgagaccgcgcaaccccaggcgaacaacgtccgcgtacaggcctacgccgccgacccctgggaggatgcgctagcggggctggcccacgagggcccgcttccagcccgctgctcgaccacgtcacgcccggtggtggcggcacgcagatcacggcctggggcgtgtgggtgccgggcgtcacgccgtaggcgccttgtgtcccggcacgcgcgcgcttgtcgaacagcgcgcgcgtgctctggcttcctttcgcgccgaccaatgacatggccacc

SEQ ID NO: 474 - DNA, 2779 bp, Myxococcus xanthus
ttcgcccagctccgcgccgtcgtaccggacgtgtccggaggtgggcaggtagagccccagcagcaggtgcgccagggtgctcttgcccgcgcccgaacggccgacgagcgccaccatctgccccggctccacgctgaccgacacgccttgcaccacccaggcggagtgggggttgtagcggaagcgcacgtcctccagggtgatggcgccgcgcagcgtgggcgcgcggccccggtgcgccgcgtcgcgttcggggggcgtgtccagcacgtcgttgatgcgctccaggtaggtgctcaggaactggagctgcccgccggtgcccagcaggttggacaggggcaccagcagcgcggtggccagcgcgttgatgctcagcatctgtcccagggacatcgcgccgtccagcacgcgccacgcgcccacgcacagcaacaccagtggggacacgcggcgcagcgtgcccgtcagcgcgtccagccacgcggagaggcggcctcgctccaactccacgttgagcaggtccacgtagaggttggagtagctgcccaccatgcggtcctccacgccaaaggccttgagcgtctgcatgccggacagcatggccatcaggtagctctggctgcgcacgcccatgtccaggctgcgcgacaggtggctgcgttgtctggcccggggcagcgcgaacaccagcacctgcaacaggcccagccccaccaccagcagccccagcgacgcatccgccaccagcagcaggcccaggtagaggagcaccagcgcaccgtcgagcgcgctggacagcaggcccgtggagagcagttcgcggatggcctgctgcgagcccagccgcgtcagcaggtcgcccgcgggccggagctggaagaacgggtaggccaggctcaccaggtggtccagcagcccctgcgtcatctgcgagtccagccgcgtgcgcagctccaccaggagctggcctcgcaccaccgacgtgagcagctcgaagagcaacacgcccgcgagcgccgcggacagcacccccatcagcgagtagtcctgccggggcaccacgcggtccaccaccatgccggtgagcagcggcaccgccagcgtcagcacctggagcacggcggacagcgcgagcaccttcaccagcgtgccggcctgccgcttcaccaggggcaccaggtagcggtagggcccgcgccgcgtgtggcccggctggaagttctcggacggctccagcagcagcgccacgccggtgaagcactggctgaactgctccatggagacgcggcggcggccctggtcggggtccaccacctcgacccagccgcggcccaggcgctcgaagacgacgtagtgcgtgaagcgccagtggaggatggtggccggaggaaggaagggcagccggtccaggtccacggagatggcgcgcacgcgcaggcccagcttctgggccgcggccttcagcgccttcgcgctggcgccgtcacgtccggggcctgtcacctcgcgcaccgcgtccaggcccatgtggcggccgtggtaggccagcaccatggccagacaggcggcgccacagtccgtcatcgtcatctgccgcacttcgggcacgcgcttgcgcaggccgagcctccaccggcgctggggctgctgcggcgcctcggccgtcatggcggcacgtttccttccggggcaatgagcgccggccacgccaggacacccatcgccagcgcgaggccgaagacgaacaggagcgcgaacgtccaccgcgtccactgtccgccgatgcgcagcaggtcaccttcgtcctgcacgacgcgctggtagtgcgccagggcttccttgcggaagatggaggggcggccgtcggtgggtggctgcatcgcggggggacgttagcgcatggggtgggggactggcccgggactgaaccagtccccctgggccttcgctacatgcacacgtagggcgggcacggcgtgcagtagtagctgccgaactgctcgcagctgtccgcacccgagatgctctccaggacctcgtcgctcaattccagctcggcggcggggttggcgggcagggccgcgcgctcctccgacgacaggctgttgaagtactcggggtcacgccacgcacggaggatgtgttccttcttgctcatgacagctcctggacaggaaaggggggacgaatcagagacagtgacgcggcgggcacggcgtgcactgggcgctggactggccgggcaggcagaagtcgccgccggtgatgacctccagaaggtcgtcccccaactccagctcggcggcggggttggcgggcagggccgcgcgctcctccgacgacaggctgttgaagtactcggggtcacgccacgcgcggaggatgtggtccttcttctggctcatgacagctcctggttgcggctggagggacggccatccggggtgcccagcccttcacctcggacgattcgtggaggcgcgaccgtcagcagcgagggcaaccgctccggcatggccagccgcgccagtccgtaggcgatgcccgccaggcccaccatcatgcccggcgtctccgtgctgccttgcaggccgaagaggtagccgtgctcggagatgccgcgcaggatgccgcccgccaccgcattcgtgcgctcctggagcttcgagtccccgagcgtggccgccgcttccaacaggaagtccgcgttgcccaggtctccgtggcacagaccgtggttgcggccgaaccccctcgccagggtggagtccagcgc

SEQ ID NO: 475 - DNA, 3132 bp, Myxococcus xanthus
tctggctggtgaccgacccggtgcaggcgcaggaccagctcatccacttcatgaagaacctctccatggcgggtggagcgctgttcatcgtctacttcgggtccgggcccttcagcctgcggcgcaagaaggcggaagggctggggagcgggaggctgggcgttccgctgcggccttgagcctcagggcgtgggggcgctgacggccggggcctccgcgcatctgcgttgggaatcctcagcgctggaccgcaaggattcgccaggtcttcgagtcgatcgcataccgcgcccccatgtcgtagggggcaccctttctctcgcatgcgtcggggtccagcgagatgctcacgaggatgattccgccttcgtacggagccgctgtcacgtcgtaggactctcgccgatagaggcactcccctccgggccggtcgcccggcgggagcttcaggtcccatggcaggtagtcctccatggcgagctggacagcctgggccagggggcgccggatgatgacgcgtccctcttccggcattccaacggggaactcgaacctcgaggcttcctccgcgggcacatggacaggacgaggcggcttcttgaagagggtgcatgccgggagcgtgcacaggcacatcaggggcaaccactttggcatgatgtctcctgtcagtcctcgcgtccgacgggggtgatgaagccgaacggtttgtctgcgggcttgatgagcccgatgcggacccactgcttccctcggcgcgagtagacctcgccgggcctgtctacatcatccaggtgggggatcagcttctggatgtggcacgccgaatcgaactgaatcttgatgagccagagttgattggctgcgcgccggtccggctcggatagcggcgaagggtgccagggatgactgtggtagtcggcgaggatggagagagaccgggcctcggggtcgatgaccttgcgaacgggaaagcaggacttcttcgtcgcttccctgcgcagttgccatcggccgaggggagagggatggctgacgcggtagatgccgtcgcctcgggagtagatgaggccgcagtactcctgtccgtaatccctgtcggtcgcgcccgggagcttcatgatggcggggcacaggcggtcgatgacgtcatccacgtcccgggatggctcgacgccagaccatggcccccgcgcccagacatagtccgagtcgtcgctgatgaagccgtagtgctcggtttcgtgtgccttgcgaggagcgctttcacaagcaaggcacacgaggagcagggacgcaggccaccagcgcttcgggtgcatgccccctgcttaggagatgcgcggcgggctcgcaagccaggctggcgtgcgctacccggcgctgacggcggcctgtcgcagcgtgaagaaggccacctccggctcgctgccccgccgcaggtaggggccgccgaagccgaagcccaggccccggttcacgtacaactggttgccattcacgtgatagtggccgcggatgtacggctgacccgcgcggcggaagagggcctccgtcagaccgcgcaccacgaactggccgccgtgcgtgtgcccggagaactgcaccagccccgcgtgtgccggtagcttctccgccgtgggcggcgtgtgggccagcaccagccgcgtgccggacaccggcgcaccccggaaggtggcctccacgtcgtcccggccggtgagtccgtcgtcgacgcccagcaccgtcaccggcgcgcccttcacgtgcacctgccggtgctcattctgcagcaccgtgtagcccatccgttcgaaggactcgcgcaggtacggtgcgttcacccagtggtcatggttgcccagcaccacgtagacggggccctcgatgccagccagcagctcgcgcacgcgcggcaacggtttgggactgtgcgtgacgtagtcgccggtgaggaacaccaggtccggcttctcctcgttgaccgcctccaccgcgcggcggattcgcagcgccgaggtggcctgccccacgtgcacgtccgacagctgcgcgatgcgcaggccgtcatgctcggcatgcatgtgctggaccatcagcacgttctccgaaagggagaagtggtcccgccagcggaggcgccgctccgtgcggaaggggtcggcaccgctgcgcgcgaccagcgcattgcgcccgtcctcctgcaggttccgccggaagctgttggccggagctgccaggggggcgtcacgacgggcgagacgtctcaggcgcatgcggttcggttcctttcggtgccagggacggcgtgagggctcgattgtagcgagcctggcgaggtgggttgaagcaggtgtccctcgcacgcttgcccagccggcggccggcgcccgaggtgcgtggaaaacccgcgcgatttcaggaagattccgaagcgtcctcaggcatccttccctcattggacagacgtccggggggcgtgcagtgacggtgaccgttgggattgctacagaaggtggaggaatcgccacgcccccttccggcggcggttcgcggccggtggagctggccgagctcatgtccacggtgccactgggcatggccatcatcgaccgcgagctgcgcttcgtcgccgccaacccggcgtacctgttcgtctttgtcagcaagctggacgagctgcttggccggagcgtcttcgaggcctttccggacgacccctcggacccgaacaacgccaatctccggcagctccgggagtccttcctgcgcgtcctggcaaagcgggcgccggacatcctggccctgattccctaccgcgtccccgagttgacgaatcagggcgtcgtcccgacgtaccggtactggagcgccacccacatccccctgctcgatgcctcgggcgaggtggcctacatcctccagcacaccatggacgtcacggagctccagcggctgcaggaggccgtccagtccgtgaccggcgccaccggcacccgcaagcctccaccgtcgcaactggaagcaggcgtcttccagcgcgcgctgcaagtccaggaagcgaaccagaacctggaccaggagcggcgccacctccgccgactgttcgagcaggcgcccggcttcatgtgc

SEQ ID NO: 476 - DNA, 3147 bp, Myxococcus xanthus
  unsure (1)..(3147): unsure at all n locations
ggcttccggatggaggacctggacgacccggagctgcgaatcccctacgccgcgttggacggcctcctggagcgggcggcggagctgtccggggacgccaacctggggctgcacatcgcccgcgtggacgtggtggacctggatgacccggccaccttcgtcgtcctcacctgcgcgacgctgcgggaagccatggagcggggctgccgctaccagcgcgtctggggagacggagagcgcttcctgatggaggagacggagcgcggcgtgcgcatgcgcttcacacccgtgggcgcgccccggcccgcacaccggcacctggtggacgcggcgctggtgcagttcgccaccggagtaagggccttcacgggcgtggacgtccggccgctcgtcgtgcgcttcacccacaccgcgcccgcggacctccgcgagcacgaggcgctcttcgggtgtcccttggagttcggcgctcccttcaacgccatcgagttctcccacgaggacgcccagcggcccttcatccacgggaacgcgctgctcaacgccatgttccaacggcaggcccagcgcgcgttggagcggctgccggacgtgtccacgaccaccgagcgcgtccggcaacaggtccggcgcgagctggccggcggggacttctccttcgtggccgttgcccgggccctgcggcagccgccgcggacgctccagcggcggctcgcgggcgaggggcagagctatgcggccatcgtcgaagccctgcgccgagagctttccgagtcctacctccagcgccgcatgtccatcgccgaggtgtccttcctcctcggctatgcggacccggtggccttccaccgcgccttcaagcgctggtggggggtgagcccggagggcttccggagggagcggctccaggccccacgctgagcctggaccgctgtccatccgagcggcgtctcaggccgcctcgcgcccgccctccgccgccgcgcgcgccagccgcttctggatggcgaggaacagcgcttcgtgcgtggcgggggaggccagctccacgtcgccaccggcctggccgaacgcggccaccgcctcccgcagggcctctcgcgcggacatggccagcatcagggggggctcgcccacggccttgctgccgtggatggtgttgtgctggtgcgcccgctccagcagccgcacccggaagtcgatgggcgcgtcgctgaaggccggcaccgcgtaggtgctggcggagtgcgtgagcagccggccattcgcgtcccagcgaagctcctcgcctgtgagccagcccaggccctggacgaagccgccttcaatctgcccgcggtccacggcggggttgagcgaatcgcccacgtcctccagcaggtccacgcgcagcacgcgcttgatgccggtgtggcggtccacctccacctcgcacaccnccgcgctgtaggagaagtagaggaaggggcgtccgcggcccttggccttgtcgtagccgatgcccggcgtctggtagtagcccgtcgaggacaggcccacccgggacaggtacgccgcctccaccacgtccgcgaaggacaaggagagctcgggctcaccgcgcaggcccaccttcccatcgctgaacagcagggcatccggcgtcacgctgcgcccgtgccggtccgacatcagccgcacggccaccggggccagccgctcccgcagcgtgacgcaggccacccgcacggcggcgccgttcaggtcggagccgctggaggccgcggtggcggaggtgttgggcaccttgtccgtcgccgtcttcgccatccgcacggcgtccaccgtgacgcccagttcgcgcatgaccacgcccagcaccttggtgtgcaggccctggcccatctccgtgccgccgtgggacaccatgaccgagccgtcccggtacacgtgcaccaacgcgccggcctggttgaggaaggtggcggtgaaggagatgccgaacttcatcggggtgatggccagtccccgcttgatgaagggggattgggcgttgaacgccgccacgtcgcgttgccggcgctcgaactccgacgacttcttgagctcctcccagacgcggaggattcgctcgtcctccagctcctggccgtagtgcgtggtgttcgtctccccggtgccgcggtagaggttgcgctcgcggacctcgtccgccggcagccccacggcccgggccacgcgggccaggacctcctccgtcaccagcatgccctgcggaccaccgaagccgcggaaggcggtgttggagacgaggtgggtcttcgccacccgccccgagtacgccagcgccggcacgtagtacgcgttgtccaggtggaacagcgcacggtccaggatggactcggacaggtccagggaccagccaccgttggataccaactggacgcgcagggccagcagccgcccctggtcgtcgaagcccacctcataggcggtatggaacgggtggcgcttgcccgtcaccgccatgtccacgtcgcggtccagcatccaccgcaccgagcgtcccgtgtgccacgcggccagcgcgacgaacgcggcgggcgcgttgccctgcgtctcctttccgccgaagccgccgcccatgcggggggactgcaccaccacgcggctgcgcggcaggtgcagcacgtgggagatgatggcctgtacctcggacgggtgctgggtggaggacacgacggtgatgtcgccgtcgtcaccgcgctcggcgaaggcggcctgcgtctccaggtagaagtgctcctgcccgccaatggccagcgtgcccgacaggcggtgggggctgctgtccagcgcggcgtccacgtcgccccggcggatgacgtgcggctcggtgtggtagctgctccgcgccacggcgtcctccaccgtgaggatggcgggcaggggctcgtactccacctccacggcgcgggcgcccgcgcggcaggcctccacggactcgcccacgaccagcgcgacaatctgcccgtggaagagcacctcgcggtccgccagcagcggctcgtcgtggcggatggggccggtgtcgttcatgccggggatgtcctcggccatgagcaccttcaccacgccgggcaccttgcgcgccgcggtctttagagc

SEQ ID NO: 477 - DNA, 3739 bp, Myxococcus xanthus
gtcgaagccggccatcttagcatggacgcgatgtgcgcctggtagctcttgcgcagctccgtgaagcgcgggttgtcgaccaggtagtagtcccggtcgggcagccacaggccgccttgcagcaggtagggggcgtagcgcgacggctcgttcaggtcctcggccacccagaggccgaagagccggtccgtggtgacgtcgcccatgttgagcgcgtccacgtccgcgcggagggtggcgcccagcaccgtggccagttgcttgcgctgcccgatggcggcgatgcgctccagctccggcttgagcggcgccacgcccttggcctcgatggccgcctcatccatgaagctggcgaagatgtcgcccaccttccgggcttcgctgccctcgggggcctggcgctgctcctcgatgagctcgcggttgcgctggtccgcctgctccgccagcgtggtgaacatgttgtagctggagcggtccggcggaatctccgtccgcttcacccaggtgccgttggcgaagccgtagaagtcgttgcccggcacgatgtcgcggtccatgccgggggtatcgaagccgaaggtcccatacgtgggcttcggcttggacgcgggggcctcggcgggcgccgtggcgacaggcgcgggcggttctgctttctccgcggaggtggaagacgcgcaggaggtgagcagcgcagtggtgcacgcggagaccagcacatgcctggcgccggggaaacgtcgatggggatgtgtcaaggattgctcctgaaacaggggactgcgagccgaaaaccggggatataaacggtccggcgtgcgaaggcgcggaccgaacagcggattcggcggtttcatcccgagcgggcggacctttcgcccggcccggctccgccacagtcgccgaacggccgggccatacccgaggggcgcgtgacggacgcctaggtttgcagggagccggggccgcgatgtgtccgcgccccgacatccaggaggctcccatgcggctgttgttccgaatcacccccgtgctgttggggctggcgctggcggcctgctcgggcatccgcgtcaacaccaactatgaccccacggccgtcgagcgcatcgatgacttccgccggtacgcttggctgccgcagccccagggcaaggacgcccgcgtctacaatgacatcattgacgtgcgcgtgcgcatggcggtggaccaggagctgaaggcccgtggctaccagagggtggacatgagcgaggacccggactttctcgtggggtggcagggcgccatcaacaccaaggtgtctgtcgacacggtggactccttctatggctacccctggggcccatactggagcccctggagttccttctacggaccctacggctatccgtacgggatggggggcccgcgcacctatgtccgcgaatacgacgtgggcacgctcatcctcgacggcgtggatgcccgggagcagcggctggtctggcgcggcacggcccaggcggagctccaccgcaacctgtcgcccgatgcactccagaagaagatcaacgacgccgtgcacaagatgctgtcgcgcttcccgccccgcccggaagcgtcctgagccggccaggcagccgcttcctcgcgttttcggttgcgagccctcatgtcggccgccagtattagaccagtggtccaaccatcggtccaggctgggtgttcgatgaacgaggcgacaggctcgaagcacgccgagcagtgggcggcgcattggtacgcggtggcgcggtcaccggcgctcgggacaggacggcccttgggaatccagcgcctggggcggcggctcgtgctctggcgggacgccgcgggcgaggcccactgcgcggatgcggcctgtccccaccggggcgcggaccttgggctcggacgcgtgcggcagggggcgctcgaatgcccctaccacggcttccgttacggcggtggcggcgcctgtctggccatgccctgtgaggggcctgacgcgaagccctcgcgaggcctcgcgctgcgcatgcatccggtgcgagaggcgcatgggttcatctgggcatggctggggggcagggcgcccgcgtcccttcccgcgttgccctggctcgcggacgcgccggaacctgattcgagcagcgccgcggtggaggaggtctggaacgcacgcttcacccgggtcatggaggggatgatggacctccatcactttcccttcgcgcaccggcgttatgtcccgccgggctacacgcggttggacccctatgaggtccacgtggacgcaggggctattcgcaccgtcggctggctgcgcaaggagacacgtccgcctgggacggggttccgtttcgccatcgacgtgggctacccgggcgtcctccacctgcgcttcacgccccggctggtcgccgccgtcgtctgcacgcccgtggatgccgagcacacgtggatcgcggcgcgcttccaccagcaatacgtccggctgccagggctccggtggctcgctgcccggctggcgattgcgttcgagttccgcttcatccagccggacgactaccggatggtccgctccagcctgcctcgctccggtgcgctgactcacggcacgctcattcgggcggaccgcgccatcgtcgcgtggcatgagctgcatcgcgcggcgctcggcgacactcctggcgcatcctgatagaagcgctgcgtccgatgccccgtccccgcgccagcaggctcgaccccgagcgcagacagacactcctcgccgtggccgcggaggagttcgcggagcacggcttcgatggggcctcctacaaccgcatcctggagcgcgcgggcttctcgaagggggtcgcgtactactacttcgagggcaaggacgacctttatgccgccgtgctggccctcacgttggacacgctggcgcagcgattcggggcctggcatcggcccgcggacgcggacggcttctggcgcaccctgcgtgagcggtacttcgcgctgacgacgcacatcgtgaacgacgagcgctcggcccggcttctccgaagcatgtcgcaggcgcgcacccatccgaagcttcaggcggcgtggctgcgcttcgaagggccgctggtggcgtggttccagcgcgtcctggcggacgggcgcgcgctgggcgcggtgcgtggcgatgtgccggagtccctgctgctgacgtccctcatgggtatcggacaggtcacggatgggtggctgctcgaacagtgggcgcacagcggcgtgccggcgctccagcgcggggcggagcaggtgttctccctcttcgaggacctgctggtccccaggcccgtgggcccgcctcccgcgaagcggcgctgaggcggaccctggcgcgggcagggcgtctcagtaggcgcgggcccggttcgcgcaggacccctggacgccgcggcagagccggatgcgaaacctgttcccctggcgggcggggccgtcaatcatctggcgcatgcccccgccatcatggacttctcccgtgccccggaatgtgcagcgacgggtacgggcgctcgtcttcgtcacggtgttcctggacctggtgggcttcggcctcatcatcccgttgctgccgttctacgtggagtccatgggcgggacggccacgacggcgggtgtgctgctggcgttgttctccttcgcgcagctcgtcgcctcgccggtctggggcggctgtcggccgggg

SEQ ID NO: 478 - DNA, 2200 bp, Myxococcus xanthus
gggcgttggcgcgtgtactgcaccgggccccttcgtgcccatcgacccgtcagcaccggcacaaggcaagtccttcatcctgaaggacagcgacgcttccgtgctgctcaccgtgcaaccgctggcggacgcctggaagccgcatgttctgcatctgttgtgcctggacacacggggcgtcgaacctggcgtaacggcccacggatgacgtcacggtggaggtgcgcggagagaacctcgcgtacgtgatctacacgttcggctccacggtcacgcccaagggcgtcatggtgcagcaccactagctggcctcgctgtacgtggcctcgaacctcgagttccacctggggcaagagccggggcagtggatcagtctcaacgcgccgctctacttctacgtcagcatggaccagctcgtccatctggcggacgggcactgcttgtgcctgctgcccgacgacacacggagggatccggaggcgatgctggcgtggctggagcaacagcgcgtggacgtcctggactgcacgcccgcgcaactgacgcttctgctccaggccgggctgctggagcgtgcccacgtcccgtcgcggattctgtgcgcgggtgaagccatggacccgtcgctctggagccgcctggcgaacacggagcgcacgacggcgttcaacgcctacggccccaccgagagcaccgtgtacgccacctatgcgcgcgtgcagcacagcccgagtccggtccctgtcatcggcaagccgctcgcggggactcgggcattcgtgctggatgcgcgccagcaactggcccccctgggcaccgcgggcgaactctatctggcgggggatggcctggcccgaggctacctgggccagccaggcctcaccgcggagcgcttcgtcccccacccgttcgcgtccacgccgggcgagcggctctatcgcacgggcgacaaggcccgctggcggcatgacggcacgctggagtacctggggcggctcgacttccaggtgaagctgcgcggcttccgtatcgagctgggcgaaatcgaagcggccctgcgtgcgcacgaagcggtccaggacgccgtggtgctggcgcgcgaggacgtgcccggcgacaagcggctcgtggcctacatcgtgggcggctccgccaccgtggaggcgctgcgtcagcacctccagcagcggctgcccgagtacatggtgcctccggccttcgtctcactgccggccctgcccctgaaccccagtggaaaggtggaccgcaaggccctgccctcgcccacgctcgcggacacccggagccaggaggcccacgtggcgccgcgggatgggctcgagctgcggctcgtgcggacctgggagcagctcctgggcgtggagcccatcagcgtgcgctccagcttcttcgagctgggaggccactcgctgctggccgtgcgtctggtcgcggccctgcgcgagtccctgggccggccgcttcccctgtccgcgctgttccaggcgcccacggtggagcagctcgccgcgctcctgcgccgcgaggacgcgggaccgacgtcgtcactggtcccgttcgacgcgggccggagtggaacggaggttccgttcttctgcgtgcaccctgtcggaggcaacgtcctggcctacgcggagctggcccggctgctggggccggagcgcccgttctacggactccaggcgcaagggctcgacggcagcacgccgccgctgggcacggtggaggagatggccgccgcctatgtggaggccatccgcacggtccaacccgccgggccctacctgctgggcggctggtccgtgggcggcgtcattgcctatgaaatggcgcgccagcttcgcgagcgtggcgacacggtggccctgttggcgctcatcgacgcctacacgcccgcggtgctcaacgccgccgaaccggagcccgacgccgcgcaggtcgtctccgctttcgcgagcgacctgctgggcatcgggttcacggacctggccacgccggacgcgtccctgtcacccgaggcccaggtagaagcgctctgggaagccggtcagcgcgcgggcgccttaccgcccggaatggagcccgcgcacctgcgggccctgctccaggtgttcgaggccaacctctgggccggccgccgataccagccgcccgcgctgaacccgggccgggtgttgcg

SEQ ID NO: 479 - DNA, 2459 bp, Myxococcus xanthus
ctcgtgtgctctaaagcccgggaggcttgctgccccccgaccgcctgcccgtgcgccctctcaagaggagatgcgtgatgagcggagcgtccagaagcctgaaggtcgacgggaaggtgctggagggaatcagccggggcccgctgccagcctcgcgcaaggtgtacgtgcccggcgtgctgcacccggacctgcgcgtgcccctgcgcgaaatcagccagacgcccacgcgcctcggccacggcccggacgcgaaggagacggccaacccgccggtgcacgtctacgactccagcgggccgtatacggatccggccgcggagctcgacctgcggcaggggctgcccgcgctgcgcgagtcctggatcctgggccgcaatgacaccgaagcgctgtccggcgtgagctccgaatacggccgcgcccgtgaagcggacccgcgtctggcgggcctgcgcttcgcccaccgccgctcgccgcgcgtggcgaagtccggcgccaacgtcacgcagttgcactacgcgcgcaagggcatcatcaccccggagatggagtacgtggcgctgcgggagaatctccaggtggaggcgtcgctcgcggcccagcacccgggccagtcgtggggcgcggcgattccgcgggtgattacgcccgagttcgtgcgcgacgaaatcgcgcggggccgcgccatcatcccggccaacatcaaccacccggagctggagccgatgatcatcggccgcaacttcctggtgaagatcaacgccaacatcggcaactcggccgtcacgtcttccatcgaggaagaggtggagaagatggtgtggtccatccgctggggcgcggacacggtgatggacctgtccaccggccgaaacatccacgagacgcgcgagtggatcctccgcaacgcgccggtgcccatcggcaccgtgcccatctaccaggcgctggagaaggtgggcggcaaggcggaggacctcacctgggagctgtaccgcgacacgctcatcgagcagtgcgagcagggcgtggattacttcaccatccacgcgggcgtgctgctgcgctacgtgccgtggacggcgaagcgcctgaccggcatcgtcagccgtggcggctccatcatggccaagtggtgcctcgcccaccaccgggagaactgcctgtccacgcagttcgaggaaatctgcgaaatcatgaaggcgtacgacgtgagcttcagcctgggagacgggctgcggccgggctccatcgcggatgccaacgacgcggcgcacttcggtgagctggagacgctgggcgagctcacccagattgcctggaagcacgacgtgcaggtgatgattgaaggcccgggccacgtgcccatgcacctcatccaggagaacatgacgaagcagctggccgtgtgcggcgaggcgccgttctacacgctggggcctctcaccacggacatcgcgccgggctacgaccacttcaccagcggcatcggcgcggcgatgatcggctggttcggcacggcgatgctctgctacgtgacgcccaaggagcacctgggcctgccggatcgggacgacgtgaaggaaggcgtcatcacgtacaagattgccgcccacgccgcggacctggccaaggggcatccaggggcccaggcccgggacaacgcgctgtccaaggcccgcttcgagttccgttgggaggaccagttcaacctgtcgctggaccccgagcgcgcccgcgccttccacgacgagacgcttccggcggaaggcgcgaaggtggcgcacttctgctccatgtgcggtccgcagttctgctccatgaagatcacgcaagaggtgcgtgacttcgcggcgaagcagggcgtgagcgacgacaccgcgcttcagtccgcgctcgatgagaagagcgcggaattcaagaaggctgggagccagttgtaccgctaggcgggtgccccttcagatcacctgtcctggacgtgacaatcagagcgggtgcgtgtcatggtggaccccgctgggtgcggtgcacgcgcccgagacatctttggaggggattttcaatggagactccgccgcaggagcaaatgggttcgttcatcagtggcacgccgatgccgacccaggatgagaagacgatggggctgctcgctcacatgggcaccatcctggccaacttcgtgggcctgggcttcgccgtgccgctggtgctgatgctgacgaagggcaaggagtcctccttcgtccgcgcccacgccgtggagtcgctgaacttccagatcacggtgttcatcgcggccttcgtcagcgccatcacggtttgcatcggcattggcgccgtcctgctgcccatcgtcggcatcgtcgccatcgtcttcgccatcatcgcgggcctgaaggcgaacgagggtcagctctacaagtacccggtcaacattcgactgggtgaagtag

SEQ ID NO: 480 - DNA, 2883 bp, Myxococcus xanthus
tggcaacgtggacggcctgtcttccatagcggatgaacgcaccgtgccgcccgcaccttccccgctggaccttacctgctgtgcgacgattccgtcctgtcgtagatttcactggaggacaacgtggctccactggtgtccggcggggcctggctgttgcaactgcgcttgaagcgcaccccgattcgcgaggcgctggccgccacgcggcaggtggtggcgctgtgccgccgggaaggcgcgctgtgcctggtgaacgaccgggtggacctggcgctgctggcggacgcggacggtgtgcacgtgggtgacgaggacgtgcccgccgaggatgcgcgcgcgctgctggggcctggccgtctggtgggcgtcacggtgcgagacgtggtgggcgcgcgggcggcgcaagcggcgggggcggactatgtggggctggggcctgtcttccccacgtcgacgaaacaggtgcccgcgccagtgctgggtctggaggccttcgcgtccgtggtgcgtgacagcccgctgcccgtggtgggcattggtggggtggggctggtgaacatcgcgagcgtggcggcggccggggcgcactgtgcggcggtggtgtccgacgcgctgctcgccgcggatatcaccgagcgtgtgaggcggttggttgaggcgtttgaacaggggcgtttcggggcatagcctcgaagccaggagcttccatgaacaaccattcgcgtcaccacgggccggcgccgcgccgccccaacatcggcatcaccccggactggagtccggccggagaacagccctttgcccgctatgagctgaaggttccgtacgcggacgccgtccttcgcgcgggcgggctgcccttcgtgttgccgtattcggacgagccggcctgcgtggagtcctatctggaccgcatctccggggtgctcgtcacgggcggcgcgttcgacattcctccgtcggcctacggcgaggatgcgcgcgagggcttgggggcgctgaaggaagggcgtaccgctttcgaggcggcgctcatgcgcggcgcgctcaagcgcaacatgccgctgctgggcatctgtggcggcatgcaactgctcaacgtcatcctgggtggcacgctgtaccaggacatcggccgtgaggtggagggcgctcgcgagcatgagcagaagcacgaccgcacgcacccgcagcacccggtggacgtgaagagcggcacgttgctggcggaggcggtggggtatggccagttgatggtcaactccacccaccaccagtcggtgcgcggcgtgggcaaggacgtgacgattaccgcggtggcgccggatggcgtggtggaggccatcgagtcctccgtgcacaccttcgccgtgggcgtgcagtggcaccccgaatacatgtccacgaccattccggtgcacgtggggctctacaaggcgttcgtgcagaaggcgcgcgagcatcgccggtgagtccccgcgtcctcctgctggcggggttggagcccacgggacgggcggggctcttggcggatgtcgccgcggtgcgcgcgctgcggggccagccggtggcggtgcccaccgcgcagacggcgcagggtgtccgcaccttcacctggacggcctcgccgccgcgcgtgctgtccgcgcaggtggccgccgcgcgcgagctggggccggtgcacgcggtgaagtgcggcatggtgcccgcgcgcgcgcagctcgaggccgcgcagcgggccctggaggacacgggcgcgtggtgggtggtggacccggtggtgcgcacctcccggggcgagccgctgacgcgcctgtccgcacgggcctacctgtctctggccgggcccgcgcgtggtgctcacgccgaacctggatgaagcgggctggctgctgggacgccccgtcgcgcgcacggtggaagaggctgtcgaggccgcggaggcactggcgcagcacggctttggcgcggtgctggtgaagggcgggcacttgccggacacgcaggggttggcggacgtcctggccacaccgggccgcgtgcgagtgctggagggcaagaggctggcacgcgcccccggacgccggggcacggggtgccggctggcctccgcgctggccacggagctgggccggggccgcgcgctggagacggcggtgcgttcggcccgcgcgctggtgctgcgctacctgcggaccggcgcggagtagggcgggcccgctgctcctgcgaaccggcaggggcgggtgcgaggtgcaccgcacccgcgcgaacacggagggctgctactcgctccgcgaccggctctcgaagcgggtgtactcggccaggaacaccaggtcgatggagccaatggggccgttacgctgcttggcgatgatgagctccacggggatgacggtgttaaactgctgcgccgaatgcccgtcggggcccgcctcgtcagacgtctcacggtggatgaacatcaccacgggctgtaccggggagactgccaagaagccccgctcgaaacccccacccgcgtctaggaatccacccccgggacttgggtcttgcttgaggaccgagacggtctccccaggacaacgggcgcgcggattatcccgcacggggagcactccctcttcgagcacacacgagacgagatcccgttcgtcgacttcgggaactacatcgcggtgcccacacaagcgaagggcttctctcggattctctacacggaattcagccccgagtgtatcttatgcagcggcaccaggctgctcttgaggctagacagctccggccactaggctgtgccagatgccctgtcgaaagctctcaaatttggcagcgcgaggagcttctacctaagccaggccttggtttcgtcgggct

SEQ ID NO: 481 - DNA, 3215 bp, Myxococcus xanthus
gtgctctacggctcctggtcctaccaggctgcgtgaagatgtcgggggatgtcttcatcatccgcctggcggatgggcgccacgtgaagttcgaggtgacgtcctactacgagctggccgtgcaggagcattgcaacgcgacgaacgagctgccgtcggggacgccgagcggctcggggcagctccgcgtgaagtgggccttcctgccatgaagctccgggcgctgctcctgctcatccctttcgggtgtggacctgtccagcaggcttcgcgtgaaccgcacgaacggcacgattcgttcgtgacgtgggaagcgggactgcaagcgggagcgcgccccacctcgccctcggcgatgcctccgcgcttcgacgagggcgaggcggtggaatcggtcgtgtcccctggggggctcttccgcatccacttctcccgttcgggttccaacgccgtgccgtcggcggacgcggacgggagtggtgttccggacgcggtggagaccgtcgcgtccgcgtatgaccgcgtcgccgtcttctatgaagggctgggcttccgtctgccgccggatgacggctgggtggggagcgacaacggcggcgacggccgcttcgatgtgtacctggtggacttcggtggcatcgcggacggagccttccggctggacggctgtctggaggcgtcgtcgcgctgcacggggcacatgctccaggagaacgacttcgcgggctacaactacccgtcccatgacgaggcggtggacatcctcgccagccacgagttcttccacgcggtgcaggcggcctatcacccgggcctgggcagcgtggcatcggagggcaccgcggtctgggccagtgagcgctaccggcccgcgctggacgacctggagcgattcaccgccgcgtacctgtcgcgtccggaccgcaccctggtgctggacccggaagggccggcggtgtccttcagctatggcacgagcgtctacttccagttcctgggcgagcgtttcggggatggggtggtgcgctcgctgtgggaggaaagcgtagtgacgccgtcggtccgctggccggtgctggtggagacggcgctacagcgcgactggggcgctgacttcgacaccgccttcgcggagttcgccctgtggaacctggccaccggaccgcgccgggcacagggcgagggttatgtgagcggtgaggactatgcgccgctgaccgtcgcgccacgcacgctgccggtggcggagccgtccgtgcgggtggcggccgcgtcggcgcgctacttcgaggtggaaggtggagcgtcttctgtcaccgcctccttcgagcccaccgagggcgaggactcttctgccatccacctgctggcggccgcggtgacgccgacgcaggtgctgcgcgtcgcgcgcgcggacggcgtggggaccctgtccgctcacgtggacgccgaggacgccacgcacgttatcgtcgccgtggtggatggacggcgcgaaggcctgggccggtatgggcggctgtgcatctccggggaggactccggcgcgccctgcaccaccgtgccaccgcccgacccggacggtgggggcgacctggacggtggcgtgggcggtgagccggatgggggcgtcgacgcgggtgtgccaggtgagcctccgcctccgcctccgcgtgacgagggtggctgtggctgttcgtcggcaccgggcgggctgacgtgggcgctgctcctgttcctggtggcggccttcatccggcgttgagcaaggttcgttcaacgcttgtgtatggagcgggacggatttctccgacgccaccgcccagggggttcccggcacgtgttgttgatgcgccggccgcgacggccgtgtgcgtcatccgcgtgacagtcggacatgggaggtgcgtgcgggagacggaagcgggaacatcccgtatcgcgttggacgctatctccgattaagcgtcacctctccaccgacgcgaatgacccgggaacgccatgctcagtgcctcaggccaggaccgctcgccctccatccgtgccgtggggcgagcactcccgccgcactacgccagtcaggaggagctcatcgccgcgttccgcgagctgtgggccacgcgccacttcaacctggagcggctggaggacctgcaccgcgccgtccaggtgggaggacggcatctggcgttgcccctggaggcttatccgccgctgctgacattccaacagcgcaatgacgcctggattcgctcggccacggagctgggcgaaacggtggtgcgcaaggccttggacgcggcggagctcacgcccggggaggtggaccacgtcttcttcgtcaccgtgacgggcatcgccacgccgagcatcgacgcgcggctggccaaccgcatgcgcttccgggaggacttcaagcgcacgccgctcttcggactgggatgcgtggcgggcgcggcgggcgtggcccgggcggcggactacctgcgcggctttccggagcacacagcggtcgtcatcgccgtggagttgtgttcgctcacgttgcagcgcgaggacctgtccataccgaacatcatcgcgtccggcctctttggcgacggcgcggcgtgcgcggtgctccgcggcgcggcggccccaggtgcgcgagggccgcgggtggtggcgtcgcgctccgtgttctacccggacaccgagcgcatcatgggctgggacgtggtggacaccggcttcaaggtggtgctgtccgcgaaggtgccggggctcgtgaaggaccacatccggggcaacgtggatggcttcctcgcgcagcatggactgaagcgcggggacatccggcactgggtggcgcacaccggcgggcccaaggtgctggaggccttcgaggaggcgctggagctggcaccctcggcgctggagcgctcgtgggcctccctgcgcgaggtgggcaatctctcctccgcgtcggtgctcttcgtgctcggagagacgctggagtccgttcgcgcgcagccgggggagtggggcgtgatgatggccatggggccgggcttcggcgcggagatggtgttgctgcgatggtgacctccacgcatgccctcttcctgggcttcatggccgcgctcgtcgtggagcggctggtggagctggttctctccaagcgcaacgccgcccgggccttcgcgcgcggcggggtggagactttagagcac

SEQ ID NO: 482 - DNA, 2468 bp, Myxococcus xanthus
gctaaatgacggggtgcccatcccgggggacctccatgctgcttcgatgggcgctgctgccactcctgctcttcgccgtgagctgttcggcctctcgccgcgtgcgtctcgacatcggcgatgaggcacccatcctcgtcgcacctccggacgcgacagaggccaatctacgagcttcccaagtagaggctggtgcgtttcaagaagcgctggcgagactcgcctgggacgtgcggcccgctcgacagccactgaatcacgcacgactcctgatgggcgtacctcggcggagcggcgtgtactggtacgagggccgcagccagcggctcatcccccaagacgaaagcgaccaaggtcctcgcttacggatgtcgtacgcggacgacgaactcacgcgagcgtacggcccgtggtgtcaccgcaagggccagtctcgcgattgcctgcgcctcctggacgaagggccgctcattgcgagcgacggcaagtacgcgttggccatggccatcgccatggactcggtctgggaggagaccaccgaagcgttggaaggcatgacggaccctcaggccgtgatggcaacggtgacagcgtcggtgagcatgtatctgcttctctgggcgctgccggaacccacgagcaagggagtcgcagcgctcatcaccgcgaccgccattgcctatctgggagtcgacatggtgtggcggctgcttgacggatgggtgtcactggtccgaacggtggaccacgccactacgttcgagcaactcagcgaagccggcgagtcctacggagaagtccttggcgtgaatgcagcccgggtcttcgtcatgctggccactgccgccatcggaagcaccgcggggctcgcggcaaagtcctcgtcactgcccaactccgcgcaggcagccctcgccatcgaatcccaggcagggcttcgattcacgtccattggcaacgtgggttcggtggcgatgaccgccgagggttttaccgtcgccctggcccccaccgccgtggccatgtcgacgcaggactcttcaaaacgctggacgcaccggcaccatctcgccacgaacaaaaacagcgtgtccacggcacgcggtggcccctggacaccgaggttcgaggagttcttcaagaaggcggggatggagctgaaggacccagagaacatcgtccccgttcagggacatcatggaccgcacccacaggagtatcatgcgttggtcttcgcgagactccgtgatgcaacccgagcatgccgcaccgtggagtcctgtcggaaggcgctgacctcggcgctcagcgaaatggcggaggaagtcatcacgcagggaacagagctcaacaggctcgtgacccggggcaagtaacggtaagactccgccatggcacatcgctacttcgcgctgtccgaagacgtccagccagggcactggtatctgggtgagcctcgacgtgccgtgacgcacgaagaggcggacgcttgcgagttcactgctggaaggcccatctccatccagggccgcatgaaagtccccgttaccgcgacaggccggccattggacttttcgaccgcgggaatcagcgccacccccatcgtccacgtcaaggtggcaacccgcctctcggagctggcgcccgacgacgtgcagttcatccccgtggacgtcgaaggccagccggatcaatacctcatcctcgtagcgacgaagctcattcggtgcattgacccgaacgcgagcagagaagtccgctactggaagccggagcacggccaacccgagcgagtgggcgaataccgctccgtcgcgggcctgcgcatcgacccgggccttgtgggcagcgccaagctgttccggacatggggctgggacatcgccctgattgtctctgaagacctcaaggtggccatcgagcaggagcagaccacgggcgcacgcttcaccgaggtgtagaccggtctccctgaaggatttcaccaaggggtccagcgccccagcaaccctgcgcttgcttacagaagtcgtcccaaacagtactccgggaaactgccctctcaaggtgctgacaggctcagcctcctcgtaaatcagacgcatggctcaccggatcgtcggccgcgtgacgcccaagccagatggctcgctgaacacggccttcgaccgctcagcgagcccacgccgccggccgcaaggccatcatcagggtgggcggcgcgggcgagcacgcgggctgggtggccgcggcctccaaaccgaaccgggcgaagttcgtacagaacctgctcaactccatggacaccttcggctacgacgggctccacatcgattgggagccggtggaagcggccgacaagccgaacctgctcgcgctggtgaaggagctccgcgcggcgaagccgaacatgctgctcaccttccccatcgggtggctcaacagcaacttcgccagcgacgcgttag

SEQ ID NO: 483 - DNA, 2488 bp, Myxococcus xanthus
gcttccctgacctgcagcgcgcgtcacctcgttggcgaaagcatccgtgttggcctgcgcggaggcgaagacgcgctgccggaaggcgatgatgacgtcatccccgccatcgtccgtcagggccgcctcgcttcgcgccgcggacaccaccgtcggcaactgggacgccccctcggtaccgggacacgccttgggctcctgctccgagccacatgccatcagccccccgaccagacccagccagacgcaacgcttcatttcacgctcctcgattgcccgtccagcaggcgtcgtacgtcacggcgcggctgatggatttccagggacgcgcatgaacgggaggacacctgattccgttcccggagcgcaagttaaccacgccagcgaatcggccgctcgcgcccctgtccgtggcaggacgtgcccggcgagcagccgacaggggagcgttcgccctttcacgcctcggccggatccacaccgaaaaggcggagcgcatcggcggcatagacgtccagttgccgctgcgtctccgcggcgtcccagcccaaccggggcgccatgacctcggccgccacacgcgcggccgcctgcccctggtcgcgcgtctcgaacgccaccttgaggcggcggatgagcaggtccgacagggtgtgcaccagttcgtgggtgacaccccaggcggcctcggcggcccggtagggaagcccctcggcgagcggccgggacagcgcggcgtcctctcgcgtcagggcccacacgcggcgccagcggctgccataggcgcgcaccaggtggacggctgtggcgtcgtctcccacctcggtgcgcgccgcggcgaactcggcgtccagcgcgcggatgtctccacccggcaggggcaacacatccgtgggcgagcggcggcgaggctggcccaggcggcgctccacagcgtccaccacgtcgcgcgccatgacgcgataggtggtgagcttgccaccgctgatggcgagcacgccggaggggctcacgtcgatggcgtgctcgcggctggcactgcccgcgtcggcctgtgtgccgtggtagccgctggccaccagggggcggatgccggcccacgcgctcaccacgtccgcgcgagtgaggcgcgcctcggggaagaaggcgttggcggactccagcaggtaggccacgtcggactcgctggcgcggacctccgcggggtgcgcgcgcgtggacgtctccgtggtgccaatgatggtgaagttgtcggcgggcagcacgaacatcacccggccgtccttgggggacagcagcgtgaaggcgtcgcggtggttgatgcgctcgcgcggtacggcgaggtggacgcccttgctgccgcgcacggccgggctcgccccattcggcgcatccagccggcggatttcatcactccacgggcccgtggcgttgacgagggcccgtgcgcgcacggtgacctcctcgccggtgaggtggtccaccaccgtcgcgccgtgcgcttgtccctgctccaggacgagcgccttcacggacgcgtggttgaggacgacggcgcccgcctcggacgcgcccacggcattggccagggtgaggcgcgcgtcgtccgtggccgcgtcgtagtagcgggcaccgcccttgaggtggtcggtgcgcaggcctggctcggccgcgtggacctgccgggcgttgagccgccggtagcccttcacgttccggaagagggagagggcgtcgtagagcatgaggcccgcgttgagcttccagcgaggcacgcgggcgcccgcgtacacgggccagatgaaggcgagcggacgcaccagatgcggggcgagccgcagcagacgttggcgctcgatgctggattcgaagacgaggcccaggtggccgtgctccaggtagcgaaggccgccgtggatgagccgggacgagcggctggaggtgccactggcgaagtcgtcacgctcgacgagcgccaccttgaggccccggagcgcggcatcccgcgccgagcccgcgccggtgacaccgcccccgatgatgaggacgtcgaaggtctccgtggccagggcccgcaggcgtgctgcgcgggacggaggcgggggcacatctgcttcggagacaacacggctgagcgcgacggattcagaacgcacggcacaagtgtagcggcgttggccggcgagggcagcggaaaccaatgcgctgcgtcaagcgcgctacacggagcgaggcgacatgtgtccgcgaggcacccatccgaggggggacggcgccttgcgcgtccggatgaagacagataggagacggccgacccttcccctcaccccgggctccacggccttgttgaacccccacgaccgacgcgacctggccagcctgggactgatggtcctggtgtacgggctcgtggtggcgccggtactgcacgcggtggtggagcacggcgatggtggtcatcaccactcccatgcccatctttagagca

SEQ ID NO: 484 - DNA, 3666 bp, Myxococcus xanthus
cgactggtactacaacgcgggcttcgacgaggcctccggcaacgcgcagatgcagaacttcggccgtggcggcatcgagggtgacccgctgcgcgtcgaggggcaggactacaacggccgcaacaacgccaacatggccacgccggcggacggcatctcgccccgcatgcagatgtatgtcttcgacggcatgcccctcctccaggtgacggcccccgcatcgctggcccgcgcctacgtgaacggggatagccgcttcggggcccaggagtacacgctggacggtccggtgcaggtgctcgcgcccacgggacggacactcggctgcacgcccttcgaggcgggcacgttcgccggccacgtggcgctgctcgaccgcggcgcctgcgacttcgtcaccaaggcgctgaacgcgcaggacgccggcgccatcgcggtcctcgtggccaacaccaatgccggtgagggccctctctccatgagcggagacgacgcacgcgtcacggtgcccgtggcctccatctcccgggagacggcggacctctggaaggcggaggtggccgccaacgcgagcaccgtccaggtgcgcctgcaccgctccaaggacctggaccgtgacggcacgctcgacaacaccatcatcgcccacgagtggggccactacatcagcaaccgcctcatcggtaacgccagcggcctcaccaacaaccagggccgctccatgggcgaaggctgggcggacgtgcacgcgctgctgatggtggtgcgtgaaggggacgactacgcgcgcggagcctacgccgtcggcggctacgtttcgggcggtggcggcggcgacggctactactacggcgtgcgccgcgcgccttacgccaccgcaccgacgctggcgtcgagccgcaacgcgctgaccttccggcacatcgagaacggcaatccccttccgacgagccacccgctcgcctacggtcaggcgggcctcggcaactccgccgtgcacagcagcggcgaggtgtgggcctccatgctctgggagtgctacgtgtcgctcctccaggcccaccccttccaggaggcccaggaccgcatgaagcactacctggtcgccgggtacaaggccacgcccgtctcccccaccttcctcgaggcgcgcgacgcgctgctcgcggtcaccgccgcgagcgacccggccgactaccagcgcttcctccaggccttcgccaagcgcggtgccggcatgggcgcgaaggcgccggaccgtgactccatggaccacgtgggcgtggtggagagcttcgcggcgggcaacttcatcgaggtcacctccctgcggctcgatgacgccctggagggctgcgacaaggacggcgtgctcgacgtgggcgagacgggcctgctgcgcgtgagcgtgcgcaacgtgggcagcggttcgctgggcgccttctccggcaccgtctccaccaccagcagcacggccacgctggagttcccctcgggcaacaccctgaccttcagctcgatgggccgcggcggcacggccaccgccaccctcccggtgaggttggccgccgcgcagccgaacgcacacgccggcctgcgcatcaccttcgacgagccctcgctccccgccagcgcgagcagcacgacgtttgaccctcgggtgaactacgacgaagtgcccggcgcggcggcggaggacgacttcgagggcgccctgtcgtcatggacctcgtccacgtggctcaacccctacggcgaggcggactggaaggtccagggtccggagggcgggcgctacatgcacgcgcccaacccggcagtacaggcggacctcttcctcatctccccctggatgaaggtgaatgagaccggcgccttctcgttcagcttccgctaccgccactcgttcgagtccgacatctaccccggcggctccatcttcccgtactacgacggcgccgtcctcgagttcacccacgacggcctgcagtggtacgacatcgccgcgatgggcgtggcctccatctactccatcgacccgacggacggctccccgggctacatcgagcaggggcccaacccgctgatgtaccgcaacgcgtgggtgggccagaacgtcacgcaggagaacggcaagacggtgcgcttcccggagtggtccaccgccgagctgcggctggcggacatgttcgccggcaagaacgtccagttccgcttccgcattggtaccgacaccgcggtgggcgcgtacggcttcgacctggacgacgtgcgcttcaccaacgtggagcgcatgcccttcagcggccgggtggacgagcagggcgacggcgccacctgcaaccagcggccggtggccaacgccgggcgcgacgtcggcagccccagcgccccggtgtatgagcgcgtgaggaaccccgagacgggggcactggagctcgtgcgccacacgctggacggcaccgccagctatgacccggagggccagcccctcacctaccactggacgcaggtgagcgggccggcggtcaccctggtgaacgcggacacggccaccccgtcgttcacggcggatgtgcccgacgactccatcctgacgttccagctcgtggtgcgcgatggcctggagaccagcgcggcacaccaggtccgggcctgggtcctcaacgtcaaccgcgcccccacggcggtggtgaccgcgccggcggaggtggcggagttctcctcggagcccgtgacgctggacgcccgcgcctcgagcgacccggacggggagctcatctcctacaagtgggcgcagacgtccggtcccgccgtcgcgctcaaggcgggctccagcgccacgccgagcttcaaggtgcccgaggtggccgtcgatactcagttcaccttcacgctggtggtgaaccactgcagggaccagagcaagacggccaccgtgacggtgatggtgcgcaacgttgaccgggcgcccgtggcggatgcgggctccgagcaggtggtggacccgctggccaccgcgagcctcagcgcgacggctggtggacccggacggggatgccctcacctgtacgtggcgtcaggtggagggccccgcggtggagctgcagggagccgacacggccaccccgtcgttcaccgcccccgaggtgcgggcggagacggtgctgcgcttcgaggccatcgccagcgcgaacgggctgtccagcgccccgatgacggcgacggtgacggtgcggcacgccaacaaggcgccccaggcccttccgcggctggtgggtgacgctcggtcgggggcgcaggtgacgctcgacgcgtccgcgtccagcgacccggatggcgacgccctcaccttcgggtggaagcaggtggcgggaccgtccgtcaccctctccgcgtccgagggtgcgcaggtgacgttccgcgcgcccgaggtgaagcaggccgtgacgctgcacttcgagctcaccgcgacggacgcccgcggcggcgccagcacggcggtgctcggggtgacggtgcagccgtcctctagcggctcctcgggtggctgctccagcacgggcggctcatcgcctgggctgctgctctccctgttcgggctgctcgtgggagccgttcgcacccggcgacgcgcgtagcggcatccgtcccccctgagagcac

SEQ ID NO: 485 - DNA, 2893 bp, Myxococcus xanthus
cccgaagctgtgccccagcagcgcgcgcgggcgcacgccccaggcttcccactgacgcgccagcgcgtactccacggcgaacaaggcgggcaacgcgatgccagggtcggccaacgtctgctccgcggcggcctcggctccaggcgagggaaacagcacgtcacgcaccgccgcccccaaccgggcccccagcccctccaggcaggcctccagggcctcacggtagacgggctccgctgcgtgaagcgcgcgtcccatgcccaccgtctgcgcgccctggcccgggaaaaggaaggccacgccctgctcgcgtgccgccacgacgtgctccacgacctgggacttccccgggccgcgcagcttcgccagcaactccgcgcggtccttcgccacgaaggcgcgccggtgctcgaaggcacggcggcccacgttgcgcgtgaaggccacgtcctccagcgccacgtcggtcggtgcggcctccatccaggaggccaggtcccgcaccgcggcgtccaaggcctccgccgagcggcccgacagcgtcacgagttgggtgggccggacactgggcgaggcaggctccggaagcggcgcttcctccagcaccgcgtgcgcgttcgtccctccgattccgaacgagctgacgcccgcgcggcgaggcaccgggccccggggccagggccgcaggcggtcgacgacgaagaacgggctgttcgcgaagtcgatggcgggattcggccgctcgaaatggagcgtgggcggcagttcctcatgcgccagggccagcgtggccttgatgagccccgccagaccggcggccgtgtccaggtggccgacgttcggcttcaccgaccccagcgcgcagtaccccttccggtccgtgtgccgccggtacgcccgcgtgagcgccgcgacctcgatggggtctcccaacgaggtgcccgtgccgtgcgcctccacgtagccgatgtcgcccgcgtccaggcccgcgaaggccagcgcctcgccgatgacgtccgcctgcccctccacgctgggcgccgtgtagccgaccttcaggccgccgtcgttgttgatggaggagccgcggatgaccgcgtacacgcgatcaccatccctgcgcgcgtcctccaacggcttgagcaccaccaccgccacgccgttgcccggcaccgttcccgccgcgcgcgcgtcgaacgcgcggcagtgcccgtccggcgacaggatcatcccctcctggaacaggtagcccgagcgctgcggcatcgccaggcgcaccgcgcccgccagcgccacgtccgactggcgcatcagcaggctctggcaggccatgtggacggccaccagtcccgtggagcaggcagtgtagagggacaggctttcgccccgcagtcccagtttgaaggacgcccgcgtcgccaggttctccgcggaggtgctcatcagctcgtagaacgaggccgggtccaggttcccctgccccaacatcgccaggccgtgcagggatgcgctcgcgcccgcgtagagcgagattttccccgcgaagcgctccgggtcgagcgccgcgtcctccagcgccgtccaggcgcactccaggaacacgcgctgctgcggatccatccactccgcctcgcgcggggccatgccgaagaaggccgcgtcgaagcggtctccaccttccagctccgccgccactggcacgaagtccggatgatggcgcaccgcctcggacatcagcggagagggctccagcgcctcgacgggcacgcgggaaatggactccacaccttcgcggaggttgcgccagaaggcccgcgcatccgcgctcccggggaagcggctggcgatgccgatgatggcgatgtcgctacccgcgctgccgttgttctcgctcatggtgtcgtgctcagtcctggccccgggggttccttccgcgccgctggagcgcctgccggcgggcctccgcgcgcgactggtgcttcacgtcagaggtgggctcggggcgtgcctcggcctgcaacctgcgggcgagttcgtggatggtgggatgttcgaagaagtgggtgatggggacgtcctggcccagcgcctcgcccagccgcgagcacgcgcgcaccgcggacagcgagctgccgcccaggtcgtcgaagaagtgggcatgcacgtccacggcgggcagccccagggcctccgcccaggcgcgcgccacggtctcttccagcggcgtgcgaggcttgcccgctggcgacacggcgagcgacggccgcggcagcgcccgcacgtccaccttgcccgtggccagcagcggaagcgcctccaccgggacgatgtcgaccggaatcatgtgctcggggagctgctcgcgcaggcgtgcccggagctctcccggtggaaggatgtctccgggcggtggcacgacgtacgcgaccagccgcggctcgccatccacggaaggacgccacgaggtgacgtgggcctggcgcatgccggcgagttcgcgcagcgccgtctccacctcgcccggctcgatgcggaagccacggatcttcagttgcgcgtccgcgcgcccctggaagtccagccgtccatccgcgcggcggcgggccatgtcgcccgtgcggtagagccgggccccgggctcgccgccgtgggggtcggggatgaagcgctcggccgtgagatccggccggtccagatagccacgggccaccgacggcccgccgacgtacagctcgcccgcgactcccaccggaaccggctggagcgcctcgtcgagcacataggtgtccacgtggggcatggaacgcccgatgttcggcggccccacttcatccggagcgatgacgccccaggtcgcgcccaccgtcacctcggtcgggccatagcccgtaga

SEQ ID NO: 486 - DNA, 2183 bp, Myxococcus xanthus
ggctcctgttcgcaggcagagggacggagcggcggtgcccgcgtgaactgaggcaacaaagtcggacgaccgcgtcgtgcgcatcgtgccgcagccgtgtccgtcatcaggccggcgtgcgccgttccagcaactccgtgatgcggcgaatgagttgctgcatggtgacggtacccaggaatcgcttctgggcatccgtgacgaccaccgggtcatagagcgcttcgggcgcgcgctccatggcgagccgcgccagggtggtgagcgccatccggtcctcgacgatgagcggagccacctgcgccgcgcccttcgtggccgtcgcgcgccgcaacaccagcgcctccagccgttcgctatgcagcacggcgacatggtccacgtcggccttctgctggaacagccgctccaactcctcgggcgtcacgggccgctccacgcagttgcggcggatgacgatgctgcccaccgtctcgtcgtcctcgtcctcgcggaagtcgagcgcgcgcatggcttcatggcgccgcgcctcgaactcgacgctgggaagcacggggacgggagcggggcgggccaccaggtagccctgcgcgtgccggatgcccaggcggagcagcacggccaactcgttccacgtctccacgccttccgcaatcagcgtcgcgttgacgctggccgcgaaggacaccagcgacttcaccaggtgctgctggtagctgtgtcggtggatgtcccgcaccagcgcctggtccagcttgatgaactgcggcgcgctgttcaccagcgtcaccagtccggagtgccccgcgccgaagtcatccagcgcgatgccgaagcccagcgccgaacactgtcgcgtcagccgttgcagcagcgcgttgtcctcgaacgccgccttctccgtgatttcgagcaccaggttcttcgggttcagcccgtagcgcgcgagcagctcctccgtggagccatccccgaatcgcgggtcgctcagcacgtccgggctgacgttgaagaagaagggcgcgctgcgttgcgcctccggcagcgtggagatgcagcgcagcgcggacgtccagcacgcgcgctccagctcccacgtgtagccttccaatcgcgcctgcgtgaagagcacgtgcggctcgcggaactcgccgggtcctcgcgaaagcacttcgtgcccgatgacctcgccacgcagcaagtccacgatgggctgaaacaccgaggtgacgctcggctcgtcacctttccacagccaggcgggcgctggtgcggaggagaggggcaggctcatgtggggaaattgtagccgaacacaccgcaggctccatgccctccccgaaagaagctgcaaggccgcatgtcacgggggggcagtgcaccagggccggaaccccggcgctcaagactcgccgaccctcggctgctcgcttgccgggccagacgccgggctttcctcgccctcggcctgtctgacttccagcggagacgagtgcatggaagccccttgaatcattgaagatacgtcctccatggactgggcttcctcccgctggagggaggagagggcccggaagcggcgcgccagggcagagagctccgcggccttgagttgggcctgcccgctgcgcagtgacagcagggccacacgggctcgttccaactgggccacctctgccctcaggcgggcgaggatgcgctcgcgccgttgtttcaggccgcccagccgctccacctcctcacccagggaggccgcggccagctcgagttggcgtctcgcgatggcatccgtgctggcgcgggcgctgcgctccaggtcttcgcgttcggcctggaggtccgcttgcgcgcgctcctcgatttgggcctccacccccgcccattcagacgcgagctccgcggcgtcgcgcgtcatctttcccagggtgcgcgccagttcctcgcgagcgggctcgcgagggagcatcgccagggactgaccgcattgccggtacaggttcaacgcccgctcggtcagcgcatggaagtcaccggcgagctgcggcaacagcgcctccacgcgcgcctccaccgggtccgctgaaagcgccaggtgcgcggccaccgcgctcaatcccacgaagaggcccaggatgccgcccgccacccccgcgcccaggagcgccggcgtggccctgagagca

SEQ ID NO: 487 - DNA, 2896 bp, Myxococcus xanthus
tgctctaaagtcctccgggagaaccaggacgtgagctgctccacgtccaccgtccgcggtttatgcacctcgccgtcgatgacgacgctccacggcttcggcttcagcgtgtgcgcgaagcgggccgggtcgttcttgtcgaagccgaactcgtagaagttgttgtaggtggtgacgtcctcgtagggcgtgcgcggctcgtccgtgtcgaaggggcccatcgcctgcgccaccggttgctccaccaggcccgcgtccgggacgaagcgctccatggggcgcgtctgcttgcggcccagcaggtgcagccctccggcgacggcgacggccgtgcccgcgaagaggcccgcgttcttcagcagctcgcgccggcgcaggtacgtcttctcgggggtgacttcggagctgggcggctcagcgggcggcttgtcgcgcatggcccctgtataacggcccgggccgcccgcgcgttaccgggcggtgccttcctgtcccgggagcgtcccggtgctctgcgtcagcgcggcctcacgggcccgggcgtccttcaggcgccacagccgccaccagggtgtgcccggggactcgtggtgctcccagtggtagccgaagaagaagcacgacagcagggcccacaggtgattgcgcggcaacgtgcgcgcgtggtgaggggccatgtccggcgtctccgggcgccggtgcggcaggtaggtgccgaagtagaagagctgcaacgtgcccaacaccgagggcagcacccaatagccgaggatgtgtggctgggagacgcccaggaagagcaacacgttgaacttggccgccatcaccccaagctggggcagcgtggtgtagcgggccatgaaggtacccagccacggccagaaggactggctgtgggtggaaaagtccgggtccgcgtcgctcgtgggtcgggcatggtgggcacggtggttcaccaccagccgacggtaggacagccccgcgaagaggaagcaggcgaccgtgcccacggcctcgttcacccagcgccggccggacaccgtgccgtgcatggcgtcgtggccggtgatgaagaggcccgtgcacagccaggcctggagagcgacgtgcagccaggtgagcggctccacccacggcagctccgctcgtgtcagcgcccaggcaaggtgcccaccccacgcgcccatgatgatgagcgcgatgacgacgccccagggaccgggcggcgctggacggagttggcgggcggaagtctccatctcacctgctttctggccatcgccggcccgccgcgcatgggaaatacccaggcggcggggcggggcaatgggccggtggctacttcttcacgtcgcgtaccagctcctccgcggtgacgtagcgcggctcgatgtccaccggcacgtccttgaggcgctccagcacgcgctgcacgggcgggcgcaccacgccgagcttcgccagcagcgcctcggcggccttccggtcgccgcggccctgaatctccatgagctgcttcgtcagcgagatgacggccttcttcatcttcgccggcaccacggagaaagtgccgtccgcgttcaccttcaccgcgccggtgtccaggaagtagttgagctgcacggcgatgcccttgccgtgcgcctcgtccacgccgaagcggatggagcggaaggcggaggccaggaacgtcgtgtacatggtgcgctccagcgacttgtcgatgacgccggtgtccaccaggcgctggagcgcccacaggccggagatgtccgccttcgcctcttcgatggcgctggaggccgactggagctccttgcgcacggtggtggccttgccacccaccgcgaagttgctggggcccaggcccggcctcacctcatgcctcaagatgtgcgtgaagaaggcatcgaaggagacgtccttctggtccgccggggtgagggccaccttggcgatgggcagcagcacgcgctcgaacttggcctcctgcacgtttttcagcatcacgcgcttggagcccatcttctccgacacccgctcgtcgttgggcaggttgaaggcggccgtctgcacgccccggttgccgtcaccggaggagaacaggctgttgatgacgcggatgggcgccagcgcgcccagcttcgggttgcgcagcttcgggtcgatggggaggttgttctccagcccctggagctgcccgctgaacttcgccagcttctgcgtctccgcgtcgtcgcgcaggcccacgaaggcctcgaaggcggccttgtagttgaaccactcgtcctcgtagacctcgtagggcccgatggtgggctcgatgctggcgtccagctccatccacgccacctcgctggcgtagtagtcgttggacaggaacgcgtccgcgcgcgaggtgaggaacgccttcagcgtgggctgctgggtgagcgcagcggcctcacgcagcaacgcggcggccagggccagctcgccctggtactccacgctgtagggcaccgtgatgaagcggccatccgtgccgcggcggatggtggtgtagaagccggtggcctccttctgctgcgcctcgggcagcgacttcacccacgcctccacctccgcctgggtggcgccagccggatagaagttcgcggacgcgggcttggccggcacgcccgggatgaagggccgcgcctcgtcgaggctgttccagggccccttgtccaacaggaacgcctgcagccgcgcgcggcccagcggcgtcgtgtcctggaccaggtccagcagcagcggctcgttgcccgcccaccgctgacgcaggaagagcgtgtccatcagcttcgaggcctggacaatgcgggccagggcgcggcgctcggactccggcagcgccttcaggtccacccgtaga

SEQ ID NO: 488 - DNA, 1901 bp, Myxococcus xanthus
cggtccagccggcaccgcccgctcacccgcatccaggcgggggtgagcaagtcctgcacggtggccagcgctggcgagggcgcgcgcacatgctccagcatgcgcagcgcgccgcccgggcgcaggacccggaaaatctccgtcagcgcctgcgccggggcctccacgctgcagaagacgaggctggacaccacggcgtcgaaggaggcggtggggaagggcagggactccacgctggcatacagcagccgcgcgtcgggccgccgtcgctgggcgcgcgcgagcgccgcttcgtccacgtcgatggcggtgacggcggtgacggtgtccgggtagccgggcaacgccaggccggtgccggtgcccacctccagcacgtggccggacaggccgcgcaccagcttgcgccgggcggcggtgaggcccagccagcccaggggcgtcatgactgcgtcgtacgcgagtgccttcatggaagcagcctcctcgtcagaaacgcgcgggcccggaagcccgccgcggatgcgccggaactccgggcccatgaaacgccaggctgccgcgagaagggcagcggacgttgcgaccctaccgcacgcctaccgttcccgggctcttcggcgacgacggcggcggcgaggaggccgcgcccggcgcctgaggccgcaggacgccccagatgccgtagagcgccagcgcgatgcagccgtactgcgcgggcgtcagtccgaagtagcgggcgtccacgtaggccatgtccgtggcgcgcaggaagtcgaagaagaagcggcacgccgcgtacagcaccgccagcagcggcagcaggcgccccttcagcttccccgcgttgcgcagggcgtacagcacgccgctgatggcgaagagcgccatggcgtcgtacatgcccaggtcgtgccgggggccgccggggaaggccaccgccaggaagaagtccgtgggcacgcccgggtggtcatgcacggcgaagcagcccagccgcgccaccgcccagcccggcgccacgcccagggcgaacgagtccgcgtagtccgagaagcgcagcttgcggaccttgaagaacacgacggcggcgaggatgccgcccagaaggccaccgaacgaggacaggccatcccagaccttcaaaatctggaacgggctcttggacagctcctccgggtggtagaagaacaggtgcacccagtggcccacgacgacgccgacgcccacgccccagggcgcgaagtcggcgagcggctccgggttcaggccttcgcgctcggcgttccggccaagcaggcgagcggccaacaggatgcccaccgcgacgaggatgccgaagggctcgattttcaggggccccagctcaatcgagggggcgtgccaatagggaatcacgtcaggcggctccaggggatgcgaacgtcccacccttaatccgggcggagggatgtgggcgaacaattgtcggaacggagtctttcccggcctcgtcttctcgggggtcgggtggaggacaccgctcctgtgtgcctccgggcacctcgctcgtacccgggagggaatcactcccacttccggacgttcgcgcaaggtcagttagaaccgaattaatccattcgtgcgtgtactacgggaaatccgtggttttttgtcaggcccttcctgtccaatcgaatgggaacgcagggcctctctggaggaagggggacaggcatgacgccgcgagcagactgtcacgtcgggccgggcgcgcgaaggcacgcgctgcggacgtgcgcgcgctcctggccgcgccacccttcgtccgggcaaccccttccacccgccgggcccgaggtcccggggggacgtcgccacaggcacgcggcgcggaggtcgcgctggtgggccccccctgt

SEQ ID NO: 489 - DNA, 2730 bp, Myxococcus xanthus
ctctccgggtccgctacctgggcaagaagggtgagctgtccggcgtgctgggcggcatgggcaagctgcccccggacgagcggcgctcgctgggcgaggtggccaacagcgtgaaggcggagctggagaagctgctcgccgaggccgtggagcgcgccgaggcggccgcgctggaggcccagcttcagggcccgggcctggacgtgacgctgcccggacgcggcgtggcgctgggcagccggcaccccgtgtcgcggacgatggaggagattgtccggaccttctcgcggctcggcttcgacgtggccagcggccccgagatcgagctggactacttcaacttcgaagcgctgaacctgccgaaggaccaccccgcgcgggacatgcaggacaccttctacgtggacgaggccacgctgggccacgcgaagaaggcggacagctccgcgctgctgcgcacgcacacgtccccggtgcaggtgcggtacatgctcaaccgcaagccgcccatccgcgcggtgatgccgggccgggtgtaccggcgcgactcggacatcacgcacacgccgatgttccaccaggtggaaggcctgctggtggacaagggcgtgacgttcgcccgagctgaagggctcgttggcggcgttcgtgacggcgttcttcggttcggacacgcgcacgcgcttccgccagtccttcttccccttcacggagccgtccgccgaggtggacatcacctgcacgaactgcgcgggcaagggctgccgcatctgcaatcagacggggtggttggaggtgctgggcagcggcatggtgcaccccaacgtcttcacctccgccgggtatgacccgaacgaggtgacgggctacgcgttcggcatgggcgtggagcgcatcgccatgctgcgctaccgcatcgacgacctgcggatgatgttcgagaacgacgcgcggttcctcgagcagttctgagattccagggggccgctggtgggcccccgtgttccagccgattgatgaagagggtggacctgtgaagatttcggtgaagtggctgggcgattacgtggcgctgccgccgtccgaggacgagctggcgcgcaagctgaccgccgcgggcctggagattgagggaatggagcgccccgcggaagcccttcgcggcgtggtggtggcgcaaatcaaggagtccgtgcagcaccccaacgcggacaagctgtccgtcacgcaggtggacatcggcgggacggcgctgctccaggtggtgtgcggcgcgaagaacttcaaggtgggcgacaaggtgccgctggccaccgtgggcgcgaagctgcccaacggcatggacatcaagcaggcggcgctgcgcggcgtggacagcttcggcatgctctgctcgtccaaggagctgggcctgagcgaggagtccagcggcctgctcatccttccggcggacacgcgcgtgggcacgcccatcgcggaggccgtggggctggatggcgtggtgctggaggtgaacgtcacgccgaaccgcccggacgcgctcagccacctgggcgtggcgcgcgaggtgagcgtggtgacgggctccgcgttgaaggtgccccagccgaagcccgcggagtcgggcacgcccgccgccgagcaggtgaaggtgcgcgtggaggccccggaccgctgcccgcgctacgtggcgcgcgtggtggagaacgtgaagattggcccgtctccgcagtggatgcaggaccggctgaaggcggccggggtgcgcgccatcaacaacgtggtggatgtcaccaactacgtgaacctggagtacgggcagccgctgcacgccttcgacctggagaagctggccggtcaggagattgtcgtccgtacggcgacgcgcggcgagaagctcaagacgctggacggcaaggaccgcgtcctggacgtggatgacctggtcatcgcggacaaggaccgggcgcaggccatcgctggcgtcatgggcggcggcgacagcgaggtgaccgagggcacccggcggctggtgctggagtcggcgaacttccagggttccacggtgcggcgttcgtcgaagcggcacgggctgcacacggaggcatcgcaccgcttcgagcgcggggcggacatggacgccgtggtgccggccattgaccgggcggcacagctcatcgcggagctggcggggggcacggtggctcctggccgcgtggacgtgtacccggcgccgaagccgcctcggaaggtgacgctgcgcttcgcccgggtggagcaggtgctgggcgtggccgtggcggagaaggaggtccgccgcatcctggaggcgctgggcttcaaggcggtggaggaggggacggggcaggcgacgtacgaggtgcctcgggcccgtgtcgacgtggagcgcgaggaggacctgttggaggaggtcgcgcgcatctacggctacgacaacattccggcgacgctcccgcggggactggccacgctggccccggagcccgcgaatgccgaggccgagcgccgcatgcgtcaggcgctggccggggcgggcttcgacgaggtggtgaactactcgttcgtcgcgccgcgcagcctggaggtgctgggtggggcggagaagccggtggcgctgctcaatccattgagcaccgagcagtcggtgatgcgcaccaacctgctgccgggcctgctggagaacctgtcccgcagcgtgcggcaccaggt

SEQ ID NO: 490 - DNA, 2760 bp, Myxococcus xanthus
tgcgcaccttctcgcgctcctcctccaccggggcggtcttcttgcccagcaccagcatctccgccgggagggcatacgtcacctcggtgtagtcctccggcgcgttgccgcggagcatgtccaccgcctcgatgacctccagcgcgttgcccaccttgcggcccagcggctggtccatgtcggtgagcagggccacgaccttcttccccatctccgcgcccaggccaatcatcgtcttcgccagcgtgcgcgcgtcctcgtcgcgcttcatgaaggcgccactgcccaccttcacgtccagcaccagcgcgtcgatgccctccgccagcttcttgctcatgatggaggacgcaatcagcgggatgcagtccaccgtcgccgtcacgtcccgcagggcatagagcttcttgtccgccggggccacctgcgccgtctggccaatcaggcagcagttcacctcgcgcaccagccgccggtactccgacgtcggcaggttgacgttgaagccggggatggactccagcttgtccagggtcccacccgtgtgccccaggccccggcccgaaatcatgggcaccggaactccgcacgcggcggccagcggcgccaggctgagggagaccttgtcacccaccccgcccgtcgaatgcttgtccaccttcacacccggcgtgtcggacaggtccaggacctcaccggactccagcatggcgcgggcccaggcgcccagctcccgggagtccatgccccggaagaagatggccatgcacatggccgccatctggtagtccgccaccgtccccgccgtatacgcctcgatgaacgcacggatgtccgccggttccagccggccgccatcccgcttggccttgatgagttcgtagggttgcacgaggcgagcccatagcaggaacccccccttcatgcactccgggaaagggcgggcatctggtagataggcgcctcatgatgctccgcctccacgtccttgccctcaccgccctcctgtgcgcgtgttccaagcagaaggaagaagcgcccccctccggcgcccagacccccgccgctgggaagacggaaaagaaggccctccccgtggggctcgtcatcgacgtgggcgggcgcggagaccactccttcaatgacgcggcgctccgtggcctggaactgtgggccgcgggcaagcgctacgagggcggcaagtacgtggacgccacccccgatgaggtccgccagtccctgccgccccacctgagctcggacgccgccagtttcaaggcgctggccatccagcccatcgtcctgcagagcaaggcccaggaggactacgtccccaatctccagctcctggtggaccagggcgcccggctcaccgtgggcaatggctacatgctggccaacgcggtgcgcacctccgcccaggaaaacccaaaggcccagttcctgctcatcgacagtcaggtgctggacgcgcagggcaaggccatgaagctgcccaacgtgcgcaccgtcctcttcaaggagcaggagggcagcttcctcgtgggcgcgctggccgggctggtgacgaagacgaacaaggtgggcttcgtgggcggcatcgaggtccccctcatccagcgcttcgaggtgggctaccgcgcgggcgtgaagacgaccaacgcccaggcgtcccaggcgctcatgtccgtctacacgggcagcttcaacaacatggccgccggcaagcaggtggcgcaggacctcatctccaagggcgcggacgtcctcttccacgccgcgggcgcggacggcatcggtgtcatccaggcggtgaaggaagcgcgcgccgcgggcaagagcgtgtacgccattggcgtggactccgaccagtcgcacgtggcgccggacgccatcctcacgtcgatgatgaagtactccgacctggccgtgtatcaggcggcgaaggacctggtggacggcacgttctccgcgggtgagcaggtgctcggcctcaaggagaacggcgtgggcatggcggaggtgcgggtggacttccccggcaaggcggaggcgctccagaaggtggaggccctgcgtcagcgcatcatctccgggacgatccaggtccccgccgtcccggcggacctcgcctccttccaggctgccgccccctgatttccctccagaacatccacaaggccttcggcacgtgcgtctcgctggcggacgcgtcgctggacgtgcgccgtggcgagctgctcgctgtggtgggcgagaatggcgcgggcaagtccagcctgatgaacgtcctctacgggctctaccagccggacgcgggcgtgctgtcgctggacggccagcccgtgcgcttcaagagcccccgggacgcgattgcgcggggcattggcatggtgcaccagcacttcatgctcgtgcccacgctgtcggtggcggagaacgtggtgctgggccgagagcccacccgcaacggactgctggacctggagcgcgcggtgcaggacgtgtccgccacctgcgcccgcttcggcttccagttggagccccgggcgcgagtggacacgctcagcgtgggctcgcagcagaaggtggagatcgtcaaggcgctgcaccgcggcgcccaggtgctcatcctcgacgagcccaccgccgtcctcacgccgcaggaatccgacgagttggcgcgggtcatgcgcggactggtcgcgcagggccacaccgtggtgctcatcagccacaagctgaaagaggtgctcggcg

SEQ ID NO: 491 - DNA, 4430 bp, Myxococcus xanthus
caggccttgcattccggatcggatgtccacagcttcctcaaccaggtctgtggccaggcctacgcgtccatctaccagccgccgcgcgagcgctggcccgcggtgcgggacttcttccgccgcgagttccccgccaccttgcgccgcgagcgtggcttcgtgggcgccagcgccgtgctgttcatcctgggcatcctgctgggcgccctggtggtgctgtgggagccccggggcgccgagctgctggtgccctccggcgtgcgccactacgtggcgcagggccgcatgtggacggatgacatcctgtcggtggcgccgcccaactcggtggcgtccggcatcgccaccaacaatctcaccgtcaccattgtcaccttcgccctgggcctcaccggcggcctgggcacgctgttcctgctggtgaacaacggggtgcatatcggcgccatcagcgcgctgtgcgcccgcgagggcatgctggggggattgctggacttcatcgccgcgcacggcccggtggagctgtccatcctggtcatcgccggcggggcgggactgatggtgggccaggcgctcatcgacccgggggagctgcctcggggacaggcgctggcggtgcgcgggcgggaagcggtgaagctggtgctgggctgcgcgcccttcctcgccctcatcggcgtggtggagggctacgtctccccaggggacatgttccccacctggctgaaggcggggctgggcctggtcctgggggcgctcttctgggcctacctgctgcgcgcgggaaggacggaggcggaggccacgggcgctccggccgacagcgcctcctgacgcttgcgctggcggtgccggaggatgcgctcataggccgcgttcagctcgcgcatcttctccgcggagccgccacggtccgggtgctgctccattgccagcgcgtggtaacgcgcgcgaacggtgtcggccgagtccagcggcgagacacccagcagccggtaggggtcctgctcttccagcgcggacagccaccggtccagccggtccttgacctcgatgaactgctcgtcctgggcgccggtgtccttcaccgggtgcgtgcgcaccttcgcgtccgcccggaagacgtcggagtacacgctggacacccagcggtggcacccggaacaccggaagtagcgaacccgggtccccggttgctgggtcatccggatgccgcagtgggtgcactccacatcgacgttttccagtgtctgccagttcgctgccgccgcgttcatcgaaccttgctcccgtttgcaacacgcctgtagcgcggggaaggtcccacgatgggagatcgcgtcaagaaaatctctccgccccgggttagaagggcctccatgcgtcccctgtttctcgctggcctgctccttgccaccgacgcccgtgcccaagcctcgtcccccccgggtccggcgcccacgcccccggtggaggccgcgccggcgcccgcgatggacgacgccgccctcctgcggggcctcctgggggcggtgcggcccgcaccggaggagattcgggccatcgccatctaagacctggcgctgctgggagatgcccgcgccctagacgcactggccacgctgctgtgggaccccaaccccctgatacagtaagcggcgttgagggccgtcaccctgttccagcacacccgggcggaggagattctcgccaacgtggtgcgccacccccggctgtcggacgcgctgaaaatacaggcgctaaacgggctggtcttccaagcgcacgcccacggcgcgcggggctgtccagaacgccgctgtcaactcgcggctcaccgcgggggtgcagaacgccgcgcgcgccgtcgtgactcagtgggacgcgacgcgccgctgacgcccgcccgtcgggcagccatgcaggcaccacccgccagcgccggcgcccaggtcaagggccgattcctggagatgtgacgcccctgcgctacactgcggcgtcatgaaaatcactccgctcgacatccggcagaagcggttcgaaacggccctgcgcggcttctctcgccgtgaggtggaggcctacctcgagctcatcgccggtgaattcgaggaggtggtgaaggagaacatcgcgctcaaggaggaagtgaagcgcacccagttcaaggtggagcagcaccaggaacgggagcgcaccctccaggagaccatggtcaccgcccagcgcatcagcgaggacctgaaggacgccgcgaagaaggaagcggaaatcatcatcgcggacgccgagcatcaggcggagaagatcgtccacggtgcccaccagcggctggtgcaggtggtggaggacatcaacgagctgaagcgccagcgcacccaattcgagtcgcaggtccgctccgtgttggatgcccaccagaagctgctggagaccttcaagagccccacgttcgcggaccgcgactacgcgcgcgtcgaggacaacgtcgcgtatctgtcccagaagaaggccaacggcgactcctgacgcaccgcgccgcgcggtgaggttgctgcaacctggggcgaggctgttatgtcagtgggaacgtgaggccgccgcacatgcgccacctgcttgtcctgctcctgctgctcgccgcccccggggcctgggcccaggaaccaggcggccctcatggcacccacgcccatgacgtcgtgacggacgccgggcctggtgcccttgacgcgtccgccccaggtcagcggggacgtgacgacgaagcgattccgcatcgtccacactgccgccgccacggcggcggcgcacgatctgtcccggcagattgaaggtgtccgagacaggttcggcaccatcctgggcaaggactggccgggcgtcaccgagattcgcctgggcgtggaccgcaaggagtttgaggccctggcactgcccgacggaaagcccccgggatgggccgtggcgctggcctaccccgcccatcaaatcatcctgctggacgcgctcagcctccatgagccggagggccagcagacgctccggcacgagatggcgcacgtggccctggggcagttggccccgtcgtggcccccctggttccaggaaggcgtcgcgcagtacgtcaccggggagcgctactccgtgacgcactactccgccctcttccgggctgtcacccaggagcgcgtgttccacttcgagcacctcgaccgggcctggccgtacgtgccgtcggacgtggaaatagcctacgcgcagagcgccgcattcgtcgcgcacctgtcggcgaagttcggcccccaggccatggccgcgctcgtggacggcgtggcgcacggcgagcccttcgagacggcctttggcaaggccttccgcacctcgctgttggtggaggagaccgactggcgtgaaggcctggccgcgcgctacggctggctcccgctcaccaccagctccgcgctcgtctggctgagcgcgtccttcctctgcgtggccgcctatgcccgccgccgccagcagcgcgccgcgaagctcgcggagatggcggcccaggatgccgcggaggacgccgcgctgcggctgctggccgcccaggccgcacaggcccaggcgcaaggcaccgccgtgagtgccggggactccacctggccggactggcccgcgggctcgcagggcacggaagcccacctggaagcccaggacagcgaggcgcccgcggacagcgccatcagcgacctcccgggtgaactggacgacgaagacggccttaacggccggccgccgaagcccaccctccactgaacgtcgcccttcccgtcctgccatgactacagggcggggcctgtagtttctacaggcgcgctgctcctctgcctgcccatcccttcaaggcaaatggctgatttcactgggaagacttatcccaggggtgttggccgatggattgctttggcttccgtacgcgatgcggaaggcactggacatgagcgagcgtggacgtaaggcagccgtgctggcgcgattcttccgtcagcagccggatcgaatctccgcgctgtggcgacggatggtgctggcggcgcccgattcggacgcgtcgcggggcgcccccacccagttggacaacctggtggagcccttcatccgcgagctgggccggacgctcgcgggcgaggagtccagtccctggagccgcacgcgcgcggtgctgcgcttgtcggcgcaccggggcgcccgctcgctctatgacgaattcgcggcgctgcggcgctgcctggtggatgcctccgaggtgctcggtggcggggattgggagcgcgagcgcatcaaccgcgccgtggacgaagccgtggactccgcggtggcgctcctcccacggatgaaggacccgcgagcggatggcccacgggtgcccatcggtc

SEQ ID NO: 492 - DNA, 3889 bp, Myxococcus xanthus
acgtcggcgacgtgtagctgccacgacgcgcggggctgcacgaactgcacggggccggaggcgccggggacgaagcgcgcgtggagcgcctccgcctcgtcgatggcctgacgcaaggcagactcgaagtgctccacgacgagcggcccgcggatttcgatgcactcacccgcgttgtagatggcgctcgtgaggtcgaactgctggccgacccagattccatgctgggccgcggacagcggccaacctgcttcgtgtgtttcgcccatcgccagggactcccgtgtgttcatgcgtcaggggcgcgaggtgactcgcgcacggcggagctacgcggcgttccgggaagcgggcgtgttgcccagggagagcagcgtgaaccagtcggcgagcgtcggccgttcggccagctccacgaaggtggtctccgcgccagcggcccgccacttctccaccagcgtcatcagccggatggagtccattccgcgctcgagcaggttgtcgtcgtcacccagcgcctccggcgactcctggagcagctccgccacctctgcgcgcacctgctcgcgggtgagtgtgctggacgtggagacggggcccagcgcgtcgagcacctgctgcgtggtggtggtgacggcgcacagctgggctgcgtagctcaacgcgagctggtggtgcgccagggagaagtcacccagcgcgtcggcgatgaggaagggccgcacgtcgctcatgaaggcgtcgctggccgtctgcaggcagccgatgtgcgcgtagataccggagatgaggatctgatcgcggcccagcttcttcatctggtccatcaggtccgtcttgcggaacgcgctgtagcgccacttggtgagctggatgtcgccttcggcgggcgtcagcgcgtcgatgatgcgcttctggtccggtccgccgttgatgccgccgccccagaagtccagcagcaggccgcgctgctcgggcgtctggccacccggttgggccgagtacacgacggggatgcccagcgccgtgcagtgctgccgcagccgctggatgttggcgaccagctccgtcacgggcgactggccctgcgtgaaggcctccacgaagtagcgctgcatgtcgtggatgagcagtacggcgcggctcgggtccggcgtccaggagaccttgttcttcggcaggtcggtggtgccgggcatgggatagggagcgatggcggggagcgccatggggagttcctttcagcgcgtcgcgcgcgaaaccggagtgggggagggagcgccggcgagcacgtcgcgcagcgccttcttgctgaccttgccgacgcccgtcttggggaacgcctcgacgaactcgacccggtcgggaatcttgaaggcggccagaccacgctggcgcaggaaggccgtgagcacattgggcgctggcggcgtgccgcgcgcgatgacgaaggcgcaggtgcgctcgccgaggaacgcgtccggaacggcgaccaccgcggcgtcgtgcacgtcggggtgggccagcagatggttttccacctcctcggccgcgaccttgtcgccgccccggttgatctgatccttggcgcggccctccaccaccaggtagccctggggcgtcacgcggaccacgtcaccggtgtggtagaagccgtcgtcggtgaaggccttcgcgttgtgggcctccgccttgtagtagccgcggatggtgtacggcccgcgcgtcagcaactggcccgtctcgcccggcgctacgtcttcgccgtcctcgtccaccacccggatttcgtcgtccggggagatgggccggccctgggtgctgacgatgacgtcctcggggtcatccaggcgcgtgtagttgaccaggccctcggccatgccgaacacctgctggagcgtgcagcccagcgtgggcttcacccgcatggccgcctcggtgctgaggcgcgcgccaccgacctggagcacccgcaggctggcgagctggtgccggcgcgtcttggccgcgtccatccagaccatggccagtggtggcaccaccgcggtgatggtgacgcgctcacgctcgatgatcgggaacaccgtgtccgggctggagttgggcgccagcaccgccgtgccgcccgcgtagaaggtgcccagcacgcccggcgagctgagcggaaagttgtgcgccgcgggcagcgcgcacaggtacacgctcgtctcgtcgagctggcagatgtccacgctgccgcgcaggctgtagatgtagtcgtcgtgcgtgcgcgggatgagcttgggcacgcccgtgcttccgccggagagctggaagaaggccacgtcgctgggcgcgggccctggcggcagcgccgtgggcgcggcgtacaggctgctcagtgccgtgaaggggcctgcgtcaccggcgacgatgacgtgtttcagcgtcgggcaggtgccgcgcacctgctcagccagggtgcggtagtcgaagccggcctgcttgtccgcgatgacgtaggccaccgcctccgtgaaggcgcagaagtagccaatctccgaagcgcggtgcgcgggaagcgcgaacaccggcagcgcgcccagtcggaagagggcgaagatgacctcgaagaactcggccacgttgggcagctgcaccaccacccggtcccgagcctggatgcccagggcatggaagccggcggccagctggctgacgcgggcgtccaggttggcgtaggtgaggcgacgctctccggccaccagtgcggtccgctcgccgtgacgctgggcgcgttcgtggaggagctggccgaacgtttcactgcgccagtagccagcctcgcggtagcgggcggcgtaggcctccggccaggtggggcagccagggagggcgggggacgtcatgactgcaccccggcaccgtggcccaggcccatggcgtggagcatggtgcggaacttggcctcggtctccgccagctcggactcgggcgtggagcccaccacgatgcccgcgcccgcgaagatgcgcagggtgcgctcactggcctccgcgcaacggatggtcaccgcccactgcccatcacccgtggcgtcgcaccagcccaccgtgccggtgtagtagccgcgctcgaagggctcgatggagccaatcgcctcgtgcgccagccgtgtaggatagccgcacaccgccggcgtcgggtgcatggccgccgccagcgtcagcgaggagatggaggggtcggccagctcaccggtgatgcggctggacaggtgccacatggtggcggtgttcacgagcgacggaccggcgggcacgttcagcgtcttgcagtacggccgcagcgcctccgcgacggcgtcgatgaccaccgcgtgctcgtgcaggtccttgggcgacttcagcagcgcggcggcgcgctcctggtcctccagcggatccgcgctgcgggccgcggagccggccaggggattggcgaccacctggaacccggagcgggacacgagcagctcggggctggcgccaatgagcgtgcgaagtcccgcgccgcgggtcccatcctgctgggggaggtcggcggcgaaggtgtagcccgacgggttgcgctgcgcgaggttgcgcagcagctgccgcaggtcgatgggggcggcggcgttgaggtgcagcgaacgtgacagcaccaccttctggagcggcccgctctgcatcagcttcagggcctgcgcgacgccgttcaggtacgcggcgggctccggcaccggctggacggtgtagctggcgctgaacggccgctgcaccgggacgtccttgtcgaacaccagcggcccggcgagaaggagagacagcggcaccacgagctgtgcgggtaccgagccgtcgaagggcaccgcgcccaccgccagggg

SEQ ID NO: 493 - DNA, 3312 bp, Myxococcus xanthus
  unsure (1)..(3312): unsure at all n locations
ccggtgcggcgcgagttcctggacctgttccaccaccggctgctgtcgctgctgtaccgcatcgagtcgaagtaccgcgtcacgagcgagacggacacatccttctcggaccagtggtcccggcgcctgctggcgctgggcgggttcgacacctacgagaaggccctggagggtacgctgccgacctggcgcctgctgcggattgccccgctgctggccagccgggcgaggacgtccgagcagttggaggtcgcgctcgaggacgtgctgggcgacgacctggagggcgcgcgggtgtcggtgcgccagttcgtgggccgctgggtggacatcgacgcccgggcgcggctgggccactccaaccaccaactggggcgcaacatgctgctgggcggcaaggccttcgaccggacggggaagattcaaatccacatccggccgctgccgccgcgcgcctacaagcggctgatgcaggaaggggacttgctgccactggtgagagaagtggtagccctcttcgtgagggaccccctggagtacgatttggagctggggctcaccgaaggcgtgcagcaccagttccggctctccagccgggagccgagtcagctcgggcgggacacgtggctgggcctgagtcagcagacgcagatgagtgtccccgtggtgaaatgagttgttagagcaggcgggcgcggcgcgcggggatttacgccgccacggcgcgcccgatataccgtccatcaccgctttcctttttgggggctcccattcgcgtcgatccgaaagcgctcgtccgtcgcctgacgcccacctctacccgtctgctcgaggccgccgtggcccgggccagcgcgggacggttctatgaaatcgtcccggagcacatgctggtgcagatgctggagccggaggactcggacgtcgcgcgcatcctccagcagttcggcgtggaccgccgccacctgctggccagcatggagcgcgccctccagggcctgcgcgcgggcagctccggccggcccgtcttctccgagacgctgttccagtggttcgaggaagcgtggctcctggcttccgtggagcagggcgccacgcggctgcgctcgggcctgctgttcgcccagttcgtcagccggcgcgcgcgctacaccgcggagctgttccccgagctggacgccatcagccgcgacgagctgatgagctcgctggacgtggtgctgcggccctcgcccgagaatgtcgaggtcgcctccgcggatgccgccgccagtggcgccgcgggaggcgcggccagtggcgcgggcggccgtggggatgaagccctcaagcgcttcgccacgtccttcaccggccgggtgcgcgaggggaagatcgaccccatcttcggccggcaccgcgaaatccggcagatggtggacatcctctcccgccgccggaagaacaaccccatcctggtgggcgagcccggcgtgggcaagacggcgctggtggagggcctggcctgggccatcgtccggggcgaggtgcccgacgcgctgaagaacgtggagctgctggggctggacctgggcctgctccaggcgggcgcgggcgtgcgcggcgagttcgagaaccgcctcaaggccgtcatctccgaggtgaaggcctcccccacccccatcatcctgttcatcgacgaggcgcacaccatcatcggcgcgggcggctcgcagggcggcacggacgcgtccaacctgctcaagccggcgctggcgcgcggtgagctgcgcacgctcgcggtcaccacctgngccgagtacaagaagtacttcgagaaggacgccgcgctggagcggcgcttccagccggtcaaggtggaggagcccagcgaggaggacgcggagctgatgctgcgcggcctgcgccccacgtaggaagcggcccacggtgtcatcatccgcgaagaagccgtcgccgccgcggtgcgcctgtccagccggtacatctccggccggcagctcccggacaaggcggtggacctgttggacacgtccgcggcccgcgtgaagattgagctgtccacccggcccgaggagctggtgcaattggaccaggagatttcggcgctggagcgcgagcgagacacgcgcaagcgcgacctcgccgagggcacgggcggcccggacgaacagacgtccctggaggccgccgaggcgaagctgagcgccacggtggatgcacgagccacgctgcatgcgcgctgggagacggagcgtacggccgtcgcggcgctgatggaggcccgcaaggccctgcgcgaggccgctccggacacggactccgcgccactgaaggcggccgtggacgaagctgcggcgaagctggcggccacgcgcggcgaggtgccgctggtacacgcggacgtggacgcggacatcgtcgcgcgggtggtggcgggctggacgggcgtgcccgtggggaagatgcgcagcgacctgctggagtcggtgctcaacctggaggacaagctccggggccgggtgcggggccaggaggcggcgctgaagaaggttgcggaaatcatccgcatctcccaggccggcatccgcaacccggacacgcccattggcgtgatgctcttcgtgggccccagcggcgtgggcaagacggagacggcgctggcgctggcggacgcgctctatggcggcgagcgcttcatgacgacgctcaacatgagcgagttccaggagaagcacacggtgagccggctcatcggctcgccgccgggctacgtgggatacggcgagggcggcctgctgacggaagccgtgcgtcagcggccctactccgtcgtgctgctggacgagtgcgagaaggccgacctggaggtgatgaacctcttctaccaggtgttcgacaagggctcgctgacggacggcgagggccgcgcggtggacttcaagaacaccgtgctcatcctcaccagcaacctggcctcggacctggtgatgcggatgttcgaggacggcgcgcagcccacctccgatgaggtgctgtcggtgattcgccccgcgctcagccagcacttcaagccggcgctgctggctcgaatgacggtcgtccccttcgggccggtgcagcgcgacgtgatgcgccagattgccgagatgaagctggccaagctggtgagccggctgcgcacggcgcacaacgtggagacgacgctggcgccagagttgctggacgagcttgcgcgccgctgcacggagtcggagatgggggcgcgcaacatggagcagattctccagggctcgctgatgccggcgctgt

SEQ ID NO: 494 - DNA, 3860 bp, Myxococcus xanthus
gccgtgcccatgtcgtccgccgtgccccaccgttacagcccccctgtgctcacgctcaccgcgcacccgcgctggctggagtcgatgttggagtccgtgcgcgacgagtggaacgcggcctgctggcctccgttgttccgcgcgacggctgacggccagcgtccgccgctgcgtcactggcggcgggtgctgtcccacttctttctcatcgtcgagtccttccccaaatacatgggcctgtcgctggcgaagacgacttacggccagcgtcccggcgacgcgagcgcccgccgctggctgctgcagaacctgggcgtggaggcgaagcatgccgagtggttcatcgactggatgcgcggaatcggcctggcgccggaagatgtcttcacccagcgtcccctgccggaggtgcgagcgctgcatgagttcctgctcgacacctgtgcgcacgggacactggccgaaggcgtggccgcgtccaactgggcggtggaaggcatcaccggcgtgtggacgcgggaggtggtggaacccttccgcgcctatgccgaggacggcgcgcgcatcgacgcgtattcgatgatgtggctcaaggtgcacgcgcgttatgacgatcagcacccggaggaggcgcttgaaatcatcaagctgtccaccgacgcgggcaccggtgagcccttccgcgtccaggccgcggccaggaagtcgctgcagatgtatgccgccgcgctccacgcgtgctgcaacgactgaatcgcgcgacaccagcgcacagccctctggtgcgcctcccgcacaattcgaggccccgcgtgggctcgtgggccccgtgtttcatgtgctctgtccggaaggcggcagcttccggatgacccgcctgtccgcttcgcgcggagagtgccgtacttgcgggtgaggacttccggctctgccctcggggtgtgagcccatggcctcggggggatgtgccacatgaatgccgaagacaaggtcatccaggagtaccggggacgtgcgctcaaggtgttcatgttgtgggtgctgccggtggcgcccatcgccgcgtatctcaatggcatggccatgggcgtggcgggttggtcgggcctgattgcggtggcgtgggtgctgccgcccatcatcgtgggcctgggcatcgcctatcccgcgtttgtgatgcacgtgctggtaaacggcgcgctgcgggagcggccggaggacacgcccggcgcgcggctggagcgaatcctgcgcctgccgtggcgcgcggcggtcgcatcctcgtggggcgcgtgcacgctgggaggtctctggttcagcctccacgtgtgcctgctgtggaagaaggacctgtccctggtcgtggtgggcacgctcatcggcatctgcttcggcgtggtgcagggctttcccatcagcgtcaccctggagcggttgctgttgccgctggcgctggaggagcagcgcaaggacccgacgatggcgctcaagggcggaggcttcttctggccgcggcaggcctggttcatgcccgtcaccttcattggctccagcatctgcgcgttggtgctgagcgggtgcgtggtgctggtgaagctgcaaggcgtccggaacgaactgcacaatgctctggtggcggagggcgcgcacggctcggcggagacgctgatgggcatgggcggcatgctggcgggtgaattggcgttcgggctggcctgggtgggcggattgctggcgattcccgccgtcaccacctggatgctggcgcgtcgtcaggcacacgcggcgggcgcggtgggcgtggccatcgagtcactgtccgcggggcgcgtcgtctcgcccgcatgggtgtccacggatgagatgggggacttgtcggctggtatgaacgcggtgctcgttcgcctgcggcagttgcccctggcgctcaatgcctccgccacgcggctgagcggcgcggggcgccaccttcgggattcgcacgatgagcaccagcagagcctggtccgtcaggcgtccgcgctgcacgaggcgcagatgacgtcggaggagattcggcgcacgtcgctgatggccgtcgagcgagcggaggaggtgcttcaagtggcccgccgctcggaggccctgggacagcagggagagtccgccgtggagcggagtctcaacggcctggcggacatccgccgcgtggtggacggcatccaggaacggctgacgcggttggcccagagcaccacgcagattggcgaaatcaccgagacggtgaaggacctggcggaccagtcccacctcctggcggtcaacgcggccatcgaggcggcgcgctcgggcgagcaggggcggggcttcgcggtggtggcccgcgagattcgcggcctgtcggaccagtccatccaggccacgcggcgcatccgcggcatcctccaggacatcagcacgggcatccgcgacgcggcgaagatgggggaggccggcgtgcagaccattggcacgggcctggaccagatgcgggcgtcaggggactcgctgcgggagctgtctcgcatcgcccaggagaactccaccgcggcccggcagattgccgccgcggtgacacagcaggatgccggcttcacgcaaatcttcgacgccatcgcggacctgtcgcagctcatggacgccacgctgaagcggttggagtccacacaggaggccaccgacacgctgagggtcgtctccgacgacgtggcgcggatggcgcggcagttcaacgcgacggggtgacggatacgccgtggcccggctttccacccaacggcagcgtgaggatgaagcgcgtgtctccaggcgcggagtccagccgcagcgcgccgccgtgcgcgagcgcaatcttgtgcgccagtggcaggcccaggccggtgcccttctcgcgcgtggtgaagaagggctcgaagatgcgctcgcgcgccgtgccgggcacgccggggcccgtgtcgcggacctggatggtgtagtggccgtctttggacgcgccggacacctgtacgcgcccacccgggggggaagcctgcaccgcgttcttcaccaggttgaccagcgccgcggtgagcaggctgccgtcagcttccagcaccgcgggggaggcgtcgatgtccaccacgacgtcgcgggcgctggcctcggtggtcatcagctcgcaggcgacggagagcaacgtgggggcctccacgggcgcgcgggccaggggctgctcgcgggcgaaggcgaggaagtcctcgacgatgcgctggaggtaggcgacctcgcgttggatgcgctccacgtgcgcgcccgcgtcggcgtgggcgccggcctggaggtcctccttcaagattccggagaagagcgcgatgccgccaatggggttgcgcacctcgtgggccacgcccgcgagcatcatcttcaactgacggtcccggctctccagggcgccgcgcatgtcctccagctcgcgcgcgaggacgccgatttccagcgtgggctccggtggcaccggggtcgtcaggtcgccccggccgattcgcagcgcggacgccatcagccgccgcagcggccgggccagaccgcgcgccgtcaccaacgcgatgacggcgagcgcgctcagcgccaccgcgcccatgatggcgtaggtgcgtgacagtcgctgcaggggaccgaagaaggcggcgctggcctccactcccacggcgcccaccacgcggccctcgtacaggatgggcgcataccccgtcttgtagcgctgtccgtccgagccggtgaagagcacctgactggcggcgcgctccccggcggagacacgggggagctccagcctgtcgggcgccagctccggacatttccgc

SEQ ID NO: 495 - DNA, 3077 bp, Myxococcus xanthus
gaagcgctcgcgttgcacgcgctcggagccggagcggcagtcgtacagcttgaggctccgatcatccgaagtgagcaggaacgcggcgcaggtgtacgtgcgcagccccgtctccgcgatttcgagcgcggcctgcacggcgccttcgatctccttcaccgaggccaccagccacttctcgtccgagctcatcccgctgaagctgtcctgcgtaccggacgacaccagccggaaggtgcgcgcccgctcctccacctcacggatgcgcttttgcaccgcgtcgctctccgcccggcgcgcggcggcgatgcgtgccgccagcaccaggtggtagaggccggagaacagcgccaggaaggccgcgtgcgtcaggtagcccgtggcgttgggcaccggaccgcccagggtcaccagcgcgtcgtacaccagcgccacgcccagcagcgtgaggcccgcgttgcgcggcaggaaggccaccaggaacgccatcagcaggtagacgatggggaacaagtccccgccgccaatggccaccacgacgaaggccgcggagatgagcgtgccgcccaggtccaggtcatcgcgcaggtcgacgattgcgcccaccgcgccacgcatggcccggcgccaggcggccacggcgatgcccaccaggaggcagcccaccagggccgcctcggtccaccccagggtgttcaacccccggaagccgccgcgcgccaggtggatgaacgtggcgagcgaggccgcggcgggaatggaccggaccgcgagacgcagcaaccttccgggagacggaaactcgggaagcgacgtcatggggactccaggtggaagacgagctcgcccggcttcacgaagccgagctcctcacgcacggcgcgctccagcgcggccggatccttgcgcagtgcggcaatctcattgcgcagggcctcattctgggcggacagggagcggttgcgggcctgcaccgactccacgtcctgccggagcgagaggtagcggcggaagcccttcgcgtccacgacggacacgaggctcagggccgcagccacccctaccgctaccaacaggaactttcgcctcgccgtcatgagcgtggaggaccgtaccagtggccccctgccccgcaagatttccgctccaggcctgtagcaatgccggggagctactcgggctgggccaggagcttctccacggccttcgccatatcggcgtgggattccacgccatgccagccggccacggcccggccccggcggtccaacagcacggtggtgggcaggccctggatggccccgaaggcgctgtggccctcaatcatcgcctggttcgcgaccagcaccgggtaacgcagcgcatagtggtccgcgaagggggccaggaccttctccccctccaggtccatgcccaccgccaccacctggaagccccgggggccatagtccttctggagcgcctccagcgtgggcatctccgccaggcacgggaagcaccacgtcgcgaagaacgagacgagcaccaccttcccgtccagcgcgcgcacgtcgtgcggcgtgggccctaccgacggcagcgccagcgcgttgaggaaggcgtaccccgcgtccaccggccgggtgccccggcagccggccagcgccaccagcgccacgacggcaccccgtagcagcacgcgggacatggagatcaggcctccgaggcggccgacccggcccgctgacagtcacgacacaggccgtacagctccatcttgtgcgacgtcaccttgaagccgtgcttgcgggccacggcgtcctgaagcgcctcgatgcgctcgttctcgaactcgatgatggtgccgcagcgcgtacagaccaggtggtcatggtggtcgcgccccgcggccgcctcgtagcgcgtctgcccgtccccgaagttgcgcgcgtgggccaggccacactcgctgagcagcttcatggtccggtaaacggtggcgacggacaccttggtgtcctgttcacgcaccttgttccacagctcctccaccgacaggtggcctcccaccgcgaagaacgtgtcgatgatgaggctgcgctgccgcgtgctcttcaggccgtgctgggccatgtagcgggcaagcccctcgtccttgtcgtggtcgtcgtggtgatggctgtgactgttgctcatgagaaatccttcaaagtcgccgcgggtccgcgccatgcctcgggcgcacttgggtggaggcccgcgctgcctcgccctccgctcttgttgtaaccaattcggccaactctcgcgacccggccatttcccaacaaaggcgccccgccggagaagaaaacgtcaccaacaggtgttggtctccggacgcggcgggcctgatactcccgtcccatcctccccgcaacgcttggcgtgcggccccggggaacgcctcccctcccgtccgctcgtccccgcgacttgcactcgccgtaggctgtttagattggaatcggactggctcattgacacttgtctgtgggcgaagatagaggcatcggccctcgtaaacgagcatttttccgcgacattcatgaacagtccctggcagagaagacgacagcccgacgacgtccccacccccgtggcggttgccgtctcggacttctgccggcgcgcgaaggcacccgccccggcacccgaggtccgcgaggcgctggccctcctggccgaggctgatgatttccgcgtccgcgcactgacggacggcgaacccgaggtgtcccccctggggcccttcgccgtcgtcgacatcctcaacggcacccagccctccgtggccgcgcagcgtcaggcgtgcggcttctacgaggtcgcccgcgagttggcgcacgtgcgcgatcagaagacgccgccgcccgcgccggctcccgccgagccctccctcaccttcgccccgccgcccgcgatggacgtgtccgccgggaagaagggcggcaaggccgcgaaggaggacctggaggccaccgtcaaggagcgcatcgccccgcgaaagcgcgcccccacggaggacaccctgggcttcgcccgccgactttcgccga

SEQ ID NO: 496 - DNA, 2988 bp, Myxococcus xanthus
gctgctgccccagctcccgccggagctggctggatacacgtggcacgccgtgggccgcctggacgtggattccacgggcctgctgctcttcaccaacgacgacaagctggtggcccacgccacgtccccggacgcgcacctgcccaagcggtacgtggccaccgtcttcagcaccgcgagcgacgagcgggtggagcctctgcgccggggcatgacgttggatgatggccccgcccgccccgcgaaggtgaacgtgcgggacgagcacacggtggaggtgacgctcacggaaggccggcaccaccaggtgaagcggatgctcggcgcggtgggccttcccgtgcgcgcgctgcaccgcgaggccgtgggcagcgtggacctggaaggcatccccgaaggcaccttccggctgctgacggacgacgaggtccgcgaggggcttcgctacgaaggacgcacgcccttcggcccctagggccttcgttccctccccacgaagcatggctgggtgccgcgcgacatgcgggcccacgcccccgcgtgcgaggagcgccatgggcaccccctggtggcgctcctcgacgcgaggctgaaggcgactcagccgcccaagttctggaagtagagggcttccgccttgacgatgttcgtcgagagcgcggtgatgagagccaccagattgccgcccagataggacaggcccatgccggcaatgatggtgaccgcggcctcgggctggaccgccacaatcgccgtgctgacgccggtgatgacgccgcccaggttggagcagacgtcgctgcaccaggtcgagttgcgcggagagccgaggatgtcgctgctgatggcggtgacgccgatgccagcgtcgaagcatgccttgatcgtgccacgcaccgcggcggagctgatgggaagcgccgtggagcccagacgcaggaggctcgcgacccacacgaggagccgcatctggtacgcagtgccctgcatcgcggagctttggatggggaagctgaatgcggcggcaatcccccccatggtcaggctggagaccagcaggcacttgccaagcgctcctttcagccgtgccgcatccacgctgactcgcacgaagcccatcagcgatgcgagccagccagcaatcgaagcgattcccgcgccaatcaccgaatagcgccgtgccgcgatgctggcctccttcttgctcgcgccctctgccgtgtccacctgcgtcatgctcgtccagaggtccagcggatccccagagaatgggcgcctggccgtcgttggcgagcttgtagaggtaggtatagggaaccgccaccagcagcgacatgaggttcaccgccgacagctcctccgggggggcttcgcccttcccgagcgcgctggtcagccacgtgtagaagccggagaggaacgggatgttgaccggctcggtcaacagactcaccacccacggcacgaggtcgagcaagtagtcgacgcaacccagcagcagtatctccagcgtgtcgatgatggtcttcgccagcccctggaggaaggtgacgatgtgctcgacggtcttcccctccccggtgaacacggccttcaggttctcccagtcctcttcaatggccttcacgaggacgaaggaggtgggaatcagcacgtcgtcgatgaacttctgcaccggcgcgggcaggtctcccacgggaccgccgcccaggagcatgccgctgtactgcgtctggtagctggaccagctcgcgatgggcgtgtcgaagttgatgccggggtgactctgctgcgtggccgcggccatttcactggggaccatggacgcgacgctcgctggcaccttcatgctcgcgaagttctcgcgggcgaagcccaactgctcggcgatgatgcgcgccatcttcttcttgagccgggccgagtcctcctgcacctccttggacagcgcatccagggcgccggtgagcgtcttcgcgatgacgaggtgcgtggcccagatgtcatcccagccgaacagttcgccgagccagccaatcagcttctccatgccaaccttcagcgccttgaacagcgccgtcaggaaagcgaagagctgctcgaagctctggatgacgaacttgatgacgcggccagcgacgttgagggtgatcttgatcaccgtctccgcgacctcgaacaacatgtggccaatctggtccaccacattgccgatgaactgcaccacgtcgcccacggtgtcgacgatccactcgcccacgtccccgacccgcttgagctgggacgcctcggcgcccgagtggtatcggaggagcccctgcggaccgaaggacagcgcgaacgcatggggcggccgcgccatgtgcgccccgctcttggcctgaggcgtgggccccacgacgctgatgacctcggtggggtaggactgctctggctggaaggccatcatctgggcgatggcactggcgatctggtcggccgtcacgccttctggcagcgtgggcggcagcacggggatgtccgcgccggtccgcacggcggccagcttcttgtagacgttgctcgcggggttgatccgcagcgtgtccgtaaaggcgctgctggtcagcgtgaaggtggagaccgccaggtcctggatttgctggatgatgtccagctcaccggtgacgttggtcgagacctccacgctcgcgccggcgtccacggtgtatttcaggccgttgatcaacaggctctggtagctggcgctggtcagggtcaacgggaggcgcgccgccgggggttggccgttgacgcggaaactgagcctggtgctgtagctgttgacctcctgcaccttgtcgctgctgtacagggggatggtctcctcctgccagagcgtggtggccgggtcctgccagagataatgaatggccttctgacgctcccagtcggtggtcaggaacaccaattcgttggcgcgggtagcgggattgatctttagagcac

SEQ ID NO: 497 - DNA, 3927 bp, Myxococcus xanthus
cggtacaccgtgggcaggccctcgttctggaagaaggtcgccaccgcctcgttggcggcgagcatgcactcctcgatgaggcggtggctgtccttgcgctcgcgcttgtccatgcgcgcgggcaggccgtcctcgtccagcaccaccttgtgctcgggcaggtcgaagtcgatggcgccgcgctccttgcgcatcttcatcagcgcgcgggccagcgacatcagccgctcgaagtggggcttgtgtgcgttgcggtgcggcacgtccttgccgtcgaggacgtcctgcacctcgttgtacgtgcaccgcgccacgctgcgcatcaccgccggatacaagtcgtaggagcgacggtggccccggcggtcgaacgtcatgtccgccaccatgcacagccggtcctcgtccgggcgtagagagcagatgccgttgctcagccgctccggcagcatgggcagcacccggtccggcaggtacacggacgtggcgcgacgcagcgcctccgcgttgagcgcactgccttcccacacgtagtgcgtcacgtccgcgatggccaccaccaaccgccacccatccgcccggtcctccacgcagacagcgtcgtcgaagtcgcgcgcgtcctcaccatcgatggtgatgaggggaatggcgcgcagatcgagccggtgctcgtcggggacctcttcctcggtcaccgtcaccaggtaggggtccgcctgggccatgacctccggcgggaactgctcggagaacccctgcgagtaggcaacgcccagtacctcggcgctcggagtgccggccttgcccagggagccggcgacctggccgtgcagcccccggtccgggtccagcatctgggcaccaatgcccaggtggaccttcaccaggtccccttcgcgcgccatctgcgtcagcggcacacggatggggccgggcaagctcgaatccgtggggtacaccacggcgtagcggcccttcacgacgtaggtgcccaccgccagctcgcgacggcgctgcaccacccggacgatccggccctccaggcgaggaggccgccccgagacggccaccaccacccggtcattgtcgagcgcgcgctgggcctcgtgcggcggcaggaagacgttgtccccttcccccgacagcggatgcacgaagccgaagccatcccggtggacgtggaggatgccttctagcaggccatcctcttcgacctcgctgaaacggccccggcggccgggccactccgcccgctcctgccggaagccccctccatgcttcgaagcgccccggcgctcacgccctgggccccgctcctgccagcccgcgctcttgccgcgcgcccccggctcatgccggcgggccgcgaagccaccagggcccgccgcgcgctgcccggcatgccgaggtccgcggtccggcccgccctcgcggggcccggcggcgtcgcgctgacgccacgccatgggagcgccctgctcccttgcacgcacgtcggcctcgcgccgcgatggctgccggggcacgaagcgcttgccgtccttgaggatgtcgccctgacggacgagctcgcgcagggcgcgcttgagctccgtctgttgtccggggtgcaggcccgcgagccggagaagctccttgatgcccagcgggtggtctgcttcagcgaggatctgcttgagaaggtcttgagaaaggctcacggtggggtcgcggctcggccgctacgggaacgggtaagcccgaagcggccggacgggaaccccccggcgaccggccgccccccggaacctgctccgggcgacgaccctcagggcttgaccgtgacgttgattttgaaggagcggtccaccaggccgggcgacagcgccttggccaggaagaactccacatcgaaggcgcccgggttgcgcggggtgaagaagaactcgcgggtaccaggaccgtcctcgggcgcgggctcgaagttggcttcgcgcaggcccacgcgcttggccaccgtgggctcgatggcccaggtgaagccggggtgctcgggcaggcgcacggtgaggccgtggttgaggcgcacgtccacggacgtggggacctctccctcgatgtgcaccagctccatctcgtcgcgagacacggcgcgcgcttcggacggacgcagctccacgttctccgccatgatgcggccgccccagccggacgtcttgtcgacgacgccctgcacctggagcgtgtacccgacgtgcttgcgcagggccttgccagcggccttgccctcgatgatgaacgatacctgctggcgcgtgccgccattggacacgacgagcacgaactcctcgcccgtcatctccaggttgccacgcacgcccgcgaagcccttgatgcccgcgcccatgccggccgccgtcaccatggagacctcaccgggcgacaggtagcgcagccgcgcctccgtctccgccggggcggcctccaccacctcggcatccggcttcttggccgagtacttgcgaacgtccaccacgccagcgtggttggtcgtcttacggatgagcccgctgacggagaccttgtggtccacgtaggccgggaggacttcctgatccgggccctggaggaggaaggtcagctcgcgcttgtcgcggccgacgaccaccaggtgcggcatgtcattggtgaccaccaggcggcccttgaggctgccctcgcccgtgacgccgcggccttcgccggccgtcagcaactgctccatttcacgcttggtgagcggctcgcccggaggcggcaacttggtggcgcgaggacggggcttctccaccggaggggcggcgggtaccgcgctcgccttcgccgccttggcgctcgcggcggacttcgccgcgggaggcgccttcgccggaggtgccttcggggtcttcgctgccgggggggcggccttcgctgccgaggccgtcttcccagcgggcgcggccttcttcgcggtggccttctcctgcacggccttcttcaccgcgctcttggcccccttcgttacgtccgatgccgctttcgccaatttcgtcgccgccttcgccgcccgcttggaggcgttcttgatcagatccagccgggcagcggagtccttcttcgcagcgggctttgcgccagccttgccagcgggagtcgtcttcttggccccggacttgggcttggccatcgacgcagtctcctttagagttcccgtgtcctttcaacgggttggcgaacctgcccagagggcaggcaagcctcgcgatcaccgttgcttgtaacgatgatcaggtaggctgtcaaactaacacttgattatctcacggactttgttcgtgaacgggttcaagccacaaagccacggcatggctataagccgggcatgaacgactccgccacattgctgccggaagaagaagcccggtcgcagatcctggccctgtgcgcgccccttccctccgagtggctgcccctggatgacgcactgggacgcgtgctcgccgaggatgtgacggcgcagcggacactccctccctgggacaactcggccatggacggctacgcggtgcgcagcgcggatctggcgggtcccctacccgtccggctcatcgtcggagagaccatctacgccggcgcggtgggccaccaggcgctggcctccggggtatgcgcccgcatcatgacgggaaactcccctccccgcgggtgcggatgcggtggtgatgcgagagcggacacggcccgtggtccagagcggcgcggatcaggtcgacatgctcgaagcggtggctccgggccagttcgtgcggccccggggcgaggacgctcgggagggacaggtgttgctggcacgctgcacgccgctgggcatccccgaactgggcctcctctgggcccagggccgacaagccgtgccagtctttagag

SEQ ID NO: 498 - DNA, 3069 bp, Myxococcus xanthus
gggctcgcctgtgcttcgggggcgattcggccatacacgcggggagaacgtgcggacggagggtaccgtgtcaacggagacttccggcaacatggtgctcacacgtggggtcgacgcgctggaggtgcgggtggacgcactgctcggcgagcacctggaggccgtgcgacggcgggtggactctcgcttcgccgtgctgatggtggggcagtggctggtcgccatcgcggtggcggcggtgctgtcgcccttcgcctggcaggggacgtcgcgggtggtgcatccccatctgcaagtggcggtggtgctggggggcctgctgtccgccttcccgctggtgctggtgcggctgcgggccggggacgtcgtcacgcggcacgtggtggcggtcgcgcagatgctctgggccgcgctcttcatccacctgacgggcggccgcatcgaaacgcacttctatgtgttcggctcgctggccttcctggccttctaccgggacccggcggtgatggcgaccgccaccgtcacggcggtgctcgagcactgcctgcgcggcatctggtggccggagtccatcttcggcgtgtcgaatcccgcgtggtggcgcttcctggagcacgccttctggatggtgttcgtcaacggggtgctggtgattgcgtgccgcgagacgctgggggagatgcggcgcgtggcggtgcagcaggtgttgctggagggcgcgtacgcgaacgagcgcgtggaccatgagcatgcgctggcacgcgtgcgccgggagatgagctcctaccgcgagcaggccgcgcgggtggagaagctggcggcggtggggcggatgacggcgacggtgagccacgagctgcgcaacccgctggccgcggcccgcaccgccaacgccgtggtcgtccgtcacctgcgcaagctggacgtgacgctggcggaccagcggctccagcgcttcctggaaatcatcgagcgcgagctggcggtgtgttcacgcatctcctccgagctgctggacttcgcccgcgagcgtccgctggagctgcggccctgctcgctgcacgcgctgatggaggaggtgctggacgtggtgccgggccgcgaaggcgtgcgcatccagaacagcgtccccctctcgctggcgtcaccctgggtggaccgggagctgctgcgcaaggtgctcatcaacctggtgcagaacgcggtggaggccatgccggcgggccgtctgggccgggtggacgtgttcgcggaaggcggcaatggcagcgccttcatcatccgcgtgtccgacaatggcatgggcatcccggaggcgatgcaggagcgcatcttcgagccgctcttcacgacgaagcccgcgggcacgggcctgggactgtcagtcgtggccagcacggtgcggcagcacggcggcaccctgcgcgtggagagccgggaaggggagggcagcgtcttcaccctctgcctcccggcgggttgccccgccgccgaggtcgccctctagctccaggacacctcgtactcgccgtccagcaggcccgtggcacgcccgcggatgtgcgtgtcgcgggcgccaatggcggccagcgccgcgcgcagcacgccctcatggtagctgtgcggcatgaagtcgcggaacatgttgaggcggccctggcgctcgcccacccactccacgtcgcgctcgccgtagctgacggcggtgctgtagccggacggcaggttgctgacgagccggcgcgggcagccaccggacaatgccaggaagctgcgccccaccacggtgctcaggaagtcctgcgcggaccgggcgccaatggtccgcatggccgcctcgaagccgcccagccgcggcgccagcaaccccgcggcgctgaaggacagccgcaggaagctggtgatggggtacaggaagaagggcacgaaggcgcgctcgcgcgaggccgccaggcaccgcgccgcggcggcttcccccacctccatccggaccacgtccagcgcccccaggaagaacatgccccgggcgcggtccttctcctccgcgcggctcagccgccgagccagctccgtcaaaggttcaggcgttccccgcgcgacctcaaacgcaatcatggccacccctgcgctgggaggcggcactcgacgcgcgcgcccctcctcgtgtggctacgaaagtgagggaaaccgagaaagtgtgaaagcccgcacggctgcaaccccggggcagggggagcgccattggtgaacagagtgggggctgcgtcagagggagcgccgggcttcagatgccaggaggcgtggccgcgggcggtgtgacctgaacatcaattcacggcggttggccgacgctccaaccgccgcgttttgaacgctcaggcctggaaggcttcgcgaaccccgtcgcgacgcaaggtgaagagcatccacacggccaccgggacgccaatgacgcagccgggagacaggatgtagagcgcggtgatgccgcccaccgtggccagtccgtagcccttcaggttgagcgcgctgatggcgccccaggcggacagcaccccgcagaggatgcccaccaggagcatcagcgccagcgtgggcgacagttccagcgtggacgcctccgcgcccgcggggacgaagggcgaggtcaccttcagcgccgccagcacgaagcccgcgatgttgtagatgacgttcagcacgcccacgcacagcaggaagaaggcgggcggacggatgatgttgaggaccttgctacgcgggtcgcttgggggcaggtggattccaggaccactcatgaacgggctctcagtgcgctcacgatcatccgcgtcgccggggacttgttgagcgtgtagaagtggatgccaggcacgccgcgcgacagcaactccatgcactgcaccgtcgcatgggccacgccgagctgggccatggcctccgggttgtccttcacccgctcgagctgcaacgccaggcgcatgggcacggtggctccgcacaggcgcgtgaatcgttgaatctgctcgtagttggtgatgggcatcatgccgggcaccatggggacct

SEQ ID NO: 499 - DNA, 2866 bp, Myxococcus xanthus
gggccagcgagcccggcacggtggacctggccgcgctgtcccgcgcgctggtgacggccgagcgccgcacggccacggactggacctccgccgcgccgtccaggcgcgccgtgctggaaggcgcctgggagcggctgctgtgggcgggctcccgtctgggcgccgcgggcatggccgactccgcgcgcaccctcctccagggtggcgagacggcggctccgggcaccgtgcgccaggaggccgcgcgcgccctgggccggctgggcacgccggggggcacgctgacgctcaccggacaggccccggcggccgtgctgacgaacgagaaggagcgagccgccgcggcggacacgctgcgcaagtcgctggtggacccggacgcgcgggtgcgggcggcggcggcggatgcgctggcgaagctcgcccccgagcgcgccactgcctgggcactggaagtgaagcccttcgacgcggtggccttcggtcccatgggggcccggacgtcacgggagctgctggccacctccgagggtcgccggctgtcggtgccgacgctgctgggggctcacgcgctggagcccctgaagtccctggccaccgacgcgaagccggagacgcggcaggacgcgtgggccgcgctgggccgcctgggcggagacgacgcggcgaagctgctgcacgaggccgccttcgacaagtcgcaaaccgaggagctgcgcaaggccgcctggcgcgcccacaaacgtgcacgccgggccgctgagcgcgcccggaaccggaaggaagggaacccgtcgtgacgaccgccacccgacaccccgtcgagctgcgctacgccaccgcgagcgacgtcgagtccggcgcggacgactcccgcgtccgcctggccctggagggctcgcgcggcaccgtgggcgtgagcggccgcgtcaccgacgccgccctcttccgcgacgcgctggccgccaccttcggcatcctcgccagcgacttgcgctaccggggcaaggaccgcaccgcgtacctcgcctacctgatgaagcagggcaagcgggcaagcgcgctcatctgggaggcgcagaaggcgttcctggacaacgcgctggacggcgagaagaagcaggacgcggtgctggaccccgtgctcacggtggatccagacagcgtgtccctggaggtcttctcccgcgacgagagcgcctacgcccggctgtccttcgacaaccgcctcttcgagggccgcgaggccgcgcacggctccaccttcctggacgtgccgccggagctgcccgcccgcgtggaccggctgcgcacctacgtgcccgtctccctggaggcgcacgtcgcgctggccacgccggcctcgcagccgccccgcgccccgcgcaacgtggaggtgccccacgcctggctgcgcggcttcctccaggtgcagtccgccgccacgctgcccgcgagcacctgcgagctggcgcccatcgacctctacaacctcctcttcgccctgcgcgctcgcaaggcgaagaaggccccccgcgcgctgcgcttcgagctggtgcccggcgccccgccccggctggtgctggagccgtgggagctggtgctggagtgccacggcggcacgtacaacggcaccgcgcccgcggtggtgcgcaccttcggccgtcagcgcctggccgcgctcgcgcgcctgctgccccacgcgaagtcggtgcgggtgcagctcatgggccccggcctgccggtgttctgggtcatcgacatgggcgcggccacgctcacgctgggcctcacgggctggacggagagcggctggtcctccgccgcggccttcgacgtgctgatgccccgcgcggtgccggacggattggcggagcagcttcgcaaccgactgcggaccgaaggtcccctgcccttcgacacgctcgccgccaatgccggcgcgcccaaggagtccgtgcgcgcggcgctccaactggagtgcctgcgcggacgcatcctcttcgacgtggcgcgcggccagtaccgtccgcgcgagctgatgcccacgccggtggacgccgccgtcatccgctacggcaacgagctggaagcacgggcgcaccgcctgctgggcggcgacggcgctccgggcgcgggcgaggtgaagctgaccaaggtgcacgacgtggtgggagagggcatccgcatccacggcgaggtggtggaccgcgaggccctgcgcagcttcttccccagcttcacgttggatttggaaggccgcgtgaaggacgccagctgcgggtgtccgcaccaccggcgctccggcctgagggaaggcccctgcgagcacctgctggcgttgcggctggcctacgcgcgccgccgcgcggaggaagaggcgctgcggcagacgcccgagggccgcaagctcatccgcgcggagacgcgctcctacgtgcggcgcgacgcggagagcggcctggagacggtgtaccgggtttccctggatggtcaggtggtggcggtggagtggggcccgcgcacgggctcgccgcgtcaccagcggctctggttcgactcggatgcggaagcgcgcggagcgtacttcgcgcgcctggagaagttggcggctgacggctacatcgacgcggcctcggcattggtgtaaacccttcaaccacggctcggccgccacgcgcggccggcaggacaggtgcgacgaagagacgacgacgtgcgcttcacgcgcgagcgccgagagggtccggagtgcatcagcctgagcgcctcgagcgcgggagcggcgttgcgccgctccggttggaatgcaggacactctccgcaaggtagcctgttcttggctctctccctcctaggcactacg

SEQ ID NO: 500 - DNA, 3113 bp, Myxococcus xanthus
gatttcgaagccgccggcctggagctcggcgagcgcgcggtcctcgaatgtgacggttcggttgaacgtcctgtcccgcagcgcacgttcgaacgcgccgtcgtggggccagtcacaggtgagccagggaatccgcttccccaggtagaagtagccgcccgagccccacaagccctcattgacgatgagcagcccccgcgcattgccccgggtggcggcgacaatcgcgcggaactggtctgcccgcaggtccccgggagggaagaaggcggccgcggtcatgctcgcggccagcgcgagtccggccaggccccaccgcccggttggccgagcaagctggacgaggcccgccgccacgggtggcgccgcggccagcacgcccagcaccaggccgggatagaggaagcgctcctccttgtgcgcggtggccaggagcacgccggtgtacacggcggcgcaccacagcggcagggacagggcgcggtgctggcgaagcgcggcgattcccacgggcacggcggcccaggcccagagcggcacggcggtgagtagcggcttcacgtagaagctgggtgcgtcagctccgaactgagccgcggccttgcccgaaaagacgttgaagcgggcataggcgataaaggagtggaacggcgagccccacgtcgcccagtccagcgcgccgagcgccaccgccacgcccagtcctccagcgcacgtgaaggcgagcagtcgccaccgcctcgccgccgccaaccacaccagcgccgccaggacgaagatggccgacgggtaacgggccaccaccgccagccccagggccatgccacccacgagtcctgcccttgagagctgcgctctccggtccagcgcctccacggcgacgatgagcagcgaggcggaaatcgactcggccatggtgcgccccgcgaagacgagcagtgggccgtagagccccacgagcaacgtcgacagcaggccacccgcggtccccgctcggcgctgggcgaagcggtacgcggcccagagactccaggcgtgcaaggccacctgcggaatggccaccacgacgcgataggcccgcggatgggtgatgcccagcaggtccgccagcttgaggaagcccgccaggacgccgggcacagcccagttgcggaggccgtcatgccactcccaggccaggacgccgtagccgtggactcgccaccaggcgggctccagcgactggtacacctcatccgggtggatgcggcccaactgcaccaccgcgatgaggccaggcagcagcgccactgcccctagcacccagcgcatccagttccggaccggcgcctcttggggcgtggccccgggcgtcagggacgtgggctcgggtgtcgggatggaatcagcgggcgtggcagggagggggacggacacaggcgcgaccgactcttcccgcccgcgttcccggacgcaaggtgtgaagcgttcgtctgcccgccctgggtccgagcccgacggggagtggaatcccacctcgtgggagggcaacgacatggatcattcacgccgccgtgtttagatgacgccccccatgagctacctcgttctcgcccgcaaatggcgcccacagaagttcgacgacatgaccggacaggagcacgtcgtccggacggtcgcgaacgccatcaagatagaccgggtcgcgcacgcgtacctgttctgtggacctcgtggcgtgggcaagacgacggccgcgcggctgctcgccaaggcgctcaactgtgagaagggccccaccgcccagccctgtggcgagtgccgtgcttgcacggagattgccgccggcaccagcgtggacgtcgcggaaatcgacggtgcctccaacaacggcgtcgagaacgtccgcgagattcgcgagaacgcgaagtacctgccccagcgggaccggcacaaaatctacatcatcgacgaggtccacatgctgtcgggagcggcgttcaacgcgctgctcaagacgctggaggagccgcccgggcacgtgaagttcatcttcgcgaccaccgaggcgcacaagctgccggacaccatgctgtggcggtgccagcgccacaacttccgggggattccggcggcccggatgcttcagcgtctccaggaaatctgcaaggcggagggcgctggtatctccgaccgctcgctgtcgctggtcgtgcgccagtccgaaggcggcatgcgcgatgcgctgagcctcctggaccaggtgctcgcctcgtgcggcgccaccccctccgacgaggaagtggccgatgcgctgggcgccatcgaccggacgttggtgcaggacttcgccgatgcgctcgtccacaaggacgcgaagcgggtgttggagcgggtggaggaagtcttcaaccgcggcctggacttgaagcgcctggccgaggagctggccttccaactgcggcatctcttcgtcaccaagacgctgggcaaggcgcccgacgagctggccgagtccgagcagaaggcgctgatggcgctggcgcaggacgcggaggccgcgcagctcacgcgcttgttcgacgtggtgcacggctgcatctgggacgtgtcgcgtgcggcccagcctcggctggccctggagatggcgctgctcaaggccatccagttgtcgccgggtggttcgattcccgagctgcttgcccgcgtggacaagctcgcggcggggatgggtgaaggttccgcgaagtcgaacgctggagcgccgggaggtcgctccagtcccacgaactttcgcgcctgagacacgactcgacacttccgtgatgcaggcggctgcccccaccccacgtccgtgggaagcgaggggtgcgcccgtggcgcagatgcctgtgcgcgccaacgagccgccagcgccgctggcggccatgcgccaggacgagccaccgcgcacgacgcctgccgccgatgaggttcgcccgcatgagcccttccaaggcagcgcgcatatgggagccacgcgccaggacgagccgcctcgttttgcacctcccggcgccatgcgtccggccgaaccgccgccgcccgggccccacatggacgggcctgtcaccggcagcgagccgccccctgtc

SEQ ID NO: 501 - DNA, 1951 bp, Myxococcus xanthus
agcagggagtccacgcccagcagggacaggggcttctgcggttccacccgctccatgggaatctggagaatggtggtgagccgttcgaccaggaacttctccagctttggctgccgggcctcgggggccagccccgacagatgtccgcgcagctgctccgcttcgctctgtgcgccaccctgggcactgcccagcaggtgtgacgtcctggcggacttgcccaggtgtggggcggcgcggcccagcttggaccactgcacgtcgaagaggcccaactgcggcgtgcgcaggcgcagcacccgcttgagcgcggtcaacacggtggcgggcgccatcgggttgaggccgagcgattcgaggtaggttcgcaccgcttcgtcctgggccatgccgaactcacccagcacgccccagtggatgctgatggccgccagccctcgcgcggcccggtgctccgcgagcgcgtcgaggaagctgttcgccgcgacgtagttgccctgacgcgggttgccaatcagcgcggcgacggacgagaacaggacgaagaggtccagcggccggtcctgcgtcagctcgtggagaatccacgcgccgcccgccttgggagacatgacgcgctggatgcgctcgaggttcaggtcgggcatcggcgcgtcgtccagcacggccgccgtgtgcagcacgcccttgagcggcgggtgcgtggcgtcgatgcgcgcgaacagcgcccgcatgtcgtccatgctgctgacgtccgcggcggccgcggtgacgcgagcgccggccgcctccaggtcctggaccaactgcttggcttccggcgtggaggcgcccttgcggccggtgagcacgaggttccgtgcaccctccgcgaccatccaccgggcgagcgcaaggccgaacccgccgaagccgccggtgacgaggtacgtggcgttcgcatcgaagagcggctcgtccgccgccggcgcgagcgcgagcggctcaccatcggcgaacgtcagcgtgagccgggccaggccctggtcccgcgaatgctccgccagccacgccggtgcctcctcggcgcgggtgacgggccaggactcggacggcagcgccggcagtgtctggaaccgaccgaggacggactggagccgcgcggcgacctcctggggacgctggcgcagcatggccgcgacgtccacgcgtgcgcaggccgcgccacggggccaggcggtggagaacaggccctccgccggagcgagcgggcccgcatcgacgaagcggccgaaggccccgagcacactggtgatggtgggctccgcgtcgcaggacgcgttcaccaacaggtccacgcccgcgccgtccgtccactccaggatgtcttccgggagggatggcgagcgccggtcgaagacgcgaacgccctctggcacctgccgcgtgtcgccgtccaggatgatgcccgtccgggctcccgcggcacggccgagttcgatcacggcggtccccacgccaccggcgtccccgatgacgaggagccgttcggaggcctggatgtggccatgcacatgaagcgcgtactccgcgcttaggaagggcagcagccgtccctgggacgtgccggcgctgacgaagtcccggtccaggcgcagcaccacgtgcgtgcccaccacgggcgcttcttgcgcgaccagcgcctgcaccacctggccggacgtgaagcccggggtggcctcgcctaccgcgacgaccacaccgcccaccttcagcggccagtgcgtgtcggacgcacgccggccttgcacggccgcggcgcgcgtcagcgtcacgtgggtgaccttgatttcgacctctccgcgcgcgggctgctggcgcgtggcgcgacgcggtcggcgctcggcgccgtcgaaggcgatttcgaacacctgctccacgccagccggcgcgggcgtgcccttcgtctggg

SEQ ID NO: 502 - DNA, 2260 bp, Myxococcus xanthus
cgcaggtccgctgagcgtttgtagggggctcgggcctgcctcacatggacgcgtctgctttcagcggtccgtccatgggggtgaccacgccttgggatcccgatagcggtccttccgggcgtcgaggtaggcgcggagcttcgcgagcgcggggtgcgcgttgtcgcaacgccagaccagggaatgtgggtacacgagcatcgggttgcggatgggaatgcggcggaggttgtactcggccggccacaccagccggatgtgttcacctacgagtgtggccaggctcgaggagccggcaatcacctccaggagcgcatcgatgccgaagtcgggaccgagggtgtcgatggtgagcccgaatctcgcggcgagctcgtcgtaataggcggcccactctgttcctgggacgatgaagggcatccagaccttgtgcttcgcgagctcggccggcgtcagcgaagtcgctgccgcgagtctgtgcgtatcgctcgtgaggaactccacggcgtcgtcgagaactcgggtcgccacgaggccgtcggtcagttgctgcgcgggccgggtgatggcgcgaaacgtcgcgtcgatcgtcccagtccgcacagcggccaacgcggtcttcgcgtcgaagagatgtgtgacgacgtcgatttcaatctcgggatgtgcgctgtggaaatcacgaaggatgcgtgcgctcccgaggttcggcttgaccacgtcgacacggagccgacggcggccggggcgcacggaatcggctgcccgctccgccgcttcgaggagccttcgagcgtgaggcaggaacacctgtccgtcgatggtgagctgaacgccgcgcggcgcccggacgaacaaccgcgccccgaggctggcctcgagcgcggcgatgcgcttggagacggcttgctgagtcagtgacagccttgatgccgcctcttggaactgtcccgtgtcggcgactgcaatgaaggtcctcaccccatcgaaatccacgctgcgccgcctccgttgctccagtgtcgtcaggggagggtaccgcacgggattgggctgtgccagggagcggcacaacccgcggttgtgtctcgggcgatatcaagttgtttgatgtctcggcgatgcactggctaaggtcctattcaacggcacgcacgtcttcaatggctgccgtcatttcaggagagccgttccatgcatggcgagaagccgttccttccccgggaggtgctgattggcacccccgaatcagaggtcatgttcagcaacatccggcgagcgatgcgcctgaccgtggaattgaacaagcgcaccttcgatgatgccgaggaaatcaggacgctcttcagtgagctgaccggccggaatgtcgacagcacgttttcgctcatcccgccgttctataccgaccatggcgtcaacatccgcgtcgggcggaatgtgttcatcaaccagtgctgcacgctgatggatatcggtggaatcgacatcgctgacgacgtcatgattggcccgaaggtgaacatcatcacgtcgagtcatcccctggagcccgccaggcggcgggcttcagcggtcgcgaagcccatcgtgctcgaacggaatgtctggattgcggcggccgtcacgattttgccgggcgtgacggtgggcgaaaactcggtggtgggcgccggagcggtggtgaccgaggatgtagcgccgaacagcttcgtggcgggcgttcccgccaagctggtgcgacacctgacttgaggagccagagggggtacgtctcggtgcccccctggcctcgctcaatgtcaggcgttggcgatggacttgggcggcagcttcagcacctgcccgaccttgattttgtccgggtccttgagctggtccttgttggcctcgaaaatcttcgggtacagcttcatgtctccgtagatgtccttggccagcttgctcagcgtgtcgcccgacttgacggtgtacaggccgtacggcgtctcgtgcgtgacggtgagcatgaccatgacctcgttctgccagttcgaatgtctggccttgatctggtcccacatccggtctcggtcccaggcgtagtccaccgtccccttgatgatgagcttgccgttctcctcgcgcgactcgaccttggcgcccacgttcttcgccacgtcgagcacgtcctggtaatcattcaacaaggccatggttgctccctttcgcctgcgcacgccggaacgggcgtggtgctgggcggggcgcaatgaaccgc

SEQ ID NO: 503 - DNA, 2582 bp, Myxococcus xanthus
acgttctccgcgtcgtagtgcatgcccagcagcaccgtcagcagaccgtagtcccggttgccgggctccgcggcgagccgctccaccacttccttctggagcgtgaagaccgcgcgcgagacatgggcccgctgctccagcactcggaagagaatggggctggtgaggtggtacgggaggtttcccgccaccgcgacgtcgggcgcgccagccacctgggcgaagtccaccgtggccgcgttgccggacaccacgcgcacgccggggatggcctccttctccagcaccatcaccatgtcccggtcccgctccacggcggtgacgcgggccccggtggcggccaggaagcgcgtgaggtggcccaggcccgggcccagctccaccaccggctcatcggcgcgcaggttcagcgcgtcggcgatggcctccagcgcgtcctcgtctccgaggaagttctgtccccagctgtacttggcgcgcaggccatgccgcttgaggatgtctctaggcgattccacccgtctgctcccctctacatgcgccaggccgggtcggcggcgaggcggaaatctccgcgcaggccgcggcggtacgcctcataccccgccaccgcaatcatggcgccattgtccgtgcacagccgcaccgggggcaggaacatgttcaacccccgctcctcggctcgcgcctgacacagtgcccgcagccgcgagttcgcggcgacgccgccgcacagcaccaactgcttgtggcccaaccggcgcgcggcggccaccagcttcttcgacagcacgtccgccacggcctcctggaaggacgcgcacaaatccgccagcgcctgcccctgcggcacgccgtgcttctgcacgtggtgcagcaccgccgtcttcaacccggagaaggacacgtcgaagttgtcgcccggcagcgcgcgcgggaagcggatggcctccgggttcccctgctgcgccaactggtcgatgggctgcccacccggatacggcaggccgaggatgcgagcggtcttgtcatatgcctcgccggccgcgtcgtcgcgcgtgctgcccaccagccggtactgcccgtaggcctgcacctcgtagaggctggtgtgcccgccggaaacgacgagcccaaggaacggcggctccggcgccacctccaacagccggatggccagcaggtggccctccaggtggttggcgcccacgaagggcttgcccgtcgccaggctcaagcccttggccacctgcactcccaccagcagcgcgccgatgagtccggggccggacgtgacggcgatgaggtccacgtcgtcgagcgtcttgttcgcccgcgtcagcgcctcgtggacgacgggcagcacctggacgatgtggttgcggctggccagctccggcaccaccccaccccaccgccggtggatgtccacctgcgtggagacgacatccgacaacgcgcggcggccgtcctccacgacggcggcggcagtctcatcacacgaggtttccagtcctaggacgagcaaggcagctcacttctcagggggccaatgatggaagtggggccgtccccgctcagttgcccagccccctgagcaacgtgcggacctcttcggcggaagaccccgtcggttccagcaacaagtactgcttgtaggcgtcggccgcctgggaattcttgccggtgaactgtagcgccatgcccaacgacagccaggcacgggcgttggagtcctcttccttgacgacttcctgcaacagcttggccgcctcgcggtaggccccgtccgtggtgaagccgttcaccagcgcgatgcccaggcccgccttcgcctccgtggccgtcggcttgagcgccagcgccttgcgatagcttcccgccgccgaccggaaccgctgactgacgacggccgccctcgcctgcttcaccagcgtggcgaactcgacctccggatccacggcgggctccgacggcgtgggggcctcggtgggtgtcgcctcgggtggcttcggcgcctcggcaatggccgtacccgcatccggtgtagcggcgggcggctccggcggagcctcgggggccttggccgtggcctcttcgagcggtggtgcctgctccggaggtggtgtctgcttggcgtcgtcgttcacgggcgcctgcgtctccaccacgggaggcttcgaaggaggcgcctccgacggaccgctgcccgtccccacgacaacggccgcgaccgcgccgatgaggaccaccgccgcgccgatgatgagcccggtgcgattggaacgacccgcgttggccacggctgcgtcactggtgtgagtggccgccggcttcctttcggccgactgcacggaagaaacgggcgtcgcgggcgcaaccggggcggcgtccgctgacttcacgggcgtgacgactccggcgtccgtgggcttcgcggatgcatccggggcgacctccccgggcgtcgcgggcgcggtggcggccggctcggcgggctgcgtctccacgacagccggagctggcaccgaggatgcgagagacggttcgaccgtgctggccagtggcgcccttggcgtggg

SEQ ID NO: 504 - DNA, 2946 bp, Myxococcus xanthus
tgcgtcgctgggcaccgccccggctgttgccttacttcgggctggaggggcatgtgcttcacggccccatgccgacgccggtggagctgggcccggagcaggcgctgctgctgtctcggtgtgatggttcggccagcgccgtgagcatcgcgcgggagctcacggccggtgattcgcccgccttcgcctcgcaggatgaaatcttcacggcgctcgaacaagcggtgggtttcggtgtcctgctctggggctgggaggtgccgctcgtcatccggcccgaggtggtgctgcgcggtgcgttgatggccatcgaggatgcagacgcgcgggcccgtgcgctggcgccgctggaacgtctggagcgcgcgcgggccgctgtcgaagccgcggctgggacgcccacggccctggatggcgcggtcgcggagctggaggctgtgttccaggaggtggcgggggcgccgccgacgcgcgcggcgggccagacgtatgcctcgcggacgctcatctacgaggactgtgagcgggatggcgcgttggtgctgggcgctccggtgattggccggctcggagccgtgctggagctggtgctgaccggagcgcggtggctggtgggggaggtgacacggggtacgcgcgcgggcctggatgcgctcttcaaccggttgtccgaaggtggcgcacctgtgtcgctcacggcgctccagctcgccttcgtccagggactcaaggacccggcctctgaagcggagctgatgcccgtggccaaggccgtcgccgagcatcgtcggcgctggcgtgagctctttgccctggatccggaggtccgccgccaaacgcgcactgtcgattcgctccggccccgcgtgctcgaggccttcggcgaggtgggcccggcgtggcgaagccgctggcatgcctcaccggacgtgatgattgacgcggccagcgaggaggccgttcgcgccggggactaccagttggtgctcggcgaactgcatttgtgcaacagcatctcctcgctcttcgtggaacagcacccagcgcccgaggaactcttcgcgctcgcggagcggtgtgccaccggggtcgacgtggtgcccgtgttcccgaagtccgagtggagccagcggacgctgccgtgcctcttcccgcgagacagcctctactacctctccgggcaggagccgccgccccagccgggcgctcgcgcgctccgcgtgggggacatggtggtggagcggcgtgacggcacgctggaggtcctcgaccgcgtgagcgggcgccgcttcgacttgatggagttcatggccgtgttcttggagcagcgctgcgccagcatcttcgacctggcgctggccgatgactactcgcctcgggtgacggtggatggcgtggtcgtcgcccgtgagcgctggagcgcgcctgcttccgagctgggcttcgccggactcacggacccgatgacgcaatggctggaggcccggcgttggcagcagggactgggcattccgcgctttgcgttcttcaaggtggcgacggagcgcaagccgtgcttcgtggacttcgacagccccttgctggtggagatgatggcgaagctggtgcggcgcacggcggaggagtcgccggcttcacgcgtccagttctcggagatgctgccggaccccgagcacctctggctcaccgatgcggctcagcgccgctacacgagcgagctgcggctggtctgcgagatgtcttgagcagcccgaggcctttcaacggtttcacccttgttcattgaaggagccgtacgcccatgagcgcgcccgagccgattcccggcggacaattctctccagaagtcaaagcgctgcacggtcagctttcccctgccgccgctgcgttcctggagttcacaaagcgcgtccccgaggccctttcgcgccacaagttcaagccgcatgaggcgtcgccgttcatcacctatgagctgcatgcgtggcccaccttcgtggagggcccggttgcacgacagatgcgagaggtcgccccggcgctctgccaactcatcaagcgagccccccggcgcctgctgggggccacggatcgcgcggcggcgttctacgggcttccgcatgagcgggcgcacgcggcgctcgatgccctggcgcggacggatgacgcccgcggagccattggccgtggtgacttcatccatgacggcacggccttcaagtgcgtggagttcaacctgaccgcgggtgtcgggggctgggagacggccatccacgtccaacaggtgctggcgcagcccgcgatgcagcgcttcgccatggagcaacggctgcgcgtccgtcagccgcggacgctgcgcgatttcttctccaacgttgtcgacaccgtgcggcgcgacgtcaactgggaaggggagtgcaacatcggcatcctcttctccccgagcaccttgccggaagcaggcccggcggagcaggtgagccggttcttcaccgctcagctccaggaactcctccagcccgaaggcgcgcgcggcgaggttctcctggccacctatggctcggtggaatcagagcccggcgcccacctcacgctccggggcaagcggctgcacgccgttgtggagtacgacgcgcgagacaggctggcgatggcgggagcgacctacgtcgcgcaggcccacggcgcgttcgaggcccggacggttagcctcctggacgggccggcgcaaggtgcgctcgacgacaagcacagcctcgagctgttctgggagcacgagacggcagacgagctgaccgaggcgaatcaggaggtggcccgctagaacttgccatggtcatgtcgtctacaacgaacccacattcaacgggacgggccgcagtacctggttcctgagctggtagcctcaggtcgcgagtccctgggactgataacgcgacgagacta

SEQ ID NO: 505 - DNA, 2802 bp, Myxococcus xanthus
gcccgcacgctttctacacgtgtctgtatgaagcggtgcgcggcggcaacgtggccgtccaccccgcggcgccgactccggcgcaggcgcccgccgtggagggcatggcctgggagctgctgtccgcggaggagcgctacaacctgctgttgtccctggtgcaccgggccctgcgcgaggccggaaaggacacggacctgctgcgcggcttcctcgacgcgccgccgcagggactggaggacgcgtacgccggggtgacgctggcggctgacgggcgcgtggacgtggcgcggctgagggccaacctctccacgggaggcgaggcggtgggccgggccctcacgttggaggccctggacgccttcgtgtcctatgcgttgttttcagcgcgcaacgtcctgcccgcggacgtggcggagcggctgtccaacacctaccgcaccctccaaggaggactggcctaggggttcgcacgtgcccacgttcgccgtcacggcgttcggggcggggagcgggcatggtcgcgattcggaagtgggtgtggggactcctggcgctgacggcggcctgcagtggcgctcgccaagcggtgaagcacgcggggaccggcggctccgggcccgccccatcagcggaggcggcgagcgaggacagccgctcgacgacgcgccgctacgtggacgaggacctgggcttcgaaatcatccggcccacggcggactggcagttggacgagacgaatgagcgcacgccggaggggctcgccattcccgtcatcctccgccacaacgtctccggagcgcaggtggtgttgcaggtggcgcccgcggtggcctctcccacgcagttcgcggagcggctcactgaagggctccgccagcacccgggcttcaccaccacggacccggcgcccattccgctgtcggacaccgcggtgggcttcgatttccaggtgggggatggcgtgcacggcaaggtggccgtgcgtgaaggcatccccgggcgcgtgttgatgatgctggccacctggccggcgcaggccgcggcggacgtgccccagagcgtggatgcgctcatccagggcgtccgcccgcttgcggggccggcgacggcgtggaaggtgccccagcgctgagggcgccccttcatcagggacgccctctggctggaagccgagctacttcgcgcgcttccgggccggcttggccttgctggccttggcctcgggcgctgcttctgcgggcgcggtgtcctgcgtctgcgcgcgcaggcggacgtactccaccagggtgcgcacgcccacgccggtgccgcccttgctcaggtagccacgctccttggggctgctcgccggacccgcgatgtccaggtgcacccacggcgtctcgcccacgaactcgcggaggaagatggcggcgttgatggagccaccccagcgctcgccggagttcttcatgtcggcgacctcggagcgcagggcgtccttctgcatgtcgctgatgggcatgcgccacatctcctcgcccgcggtgcgcgcggcctggagcacctgcgtcaccgtctcctcgtggtcgccgaaggcgccgacgatgtagttgcccagcgcgacgatgcaggcgcccgtgagcgtggccaggtcgatgatggcggccggcttgtgctcggtggcccacgtcaggatgtcgcccagcaccaggcggccttccgcgtccgtgttggtgatctccaccgtcttgcccaggcgcgaggtgaggatgtcacccggcttgtaggcgttgccggccggcatgttctcgcacgcgccgatgaaggcgtgcacggggaagggcggcttgagcgcggcgatgaccttcatggcgcccagcaccgcggccgagcccgccatgtccgtcttcatgtccaccatgccgtccgtcggcttgagcgacaggccgcccgagtcgaaggtgacggccttgcccaccagcgccagcggcggctgtttggcgtcgcgcgcgttcttgggcatgtacgtcaggtggatgaggcgaggctcctcggtgctccccgcggtgacgccgaggaacatgcccatgtcgagcttctcgatgtcgcggcggccgccgatggtggccttcagcccgccttccttcgcggcctgacgcgcggcctcggccagcaccgtgggcgtcaccgcgttgggcggctcgttgacgaggtcacgggcccagttggtcgcctccgcgacgcgctgcgccagcgtcagcgcggcatcgagctcgcgcgtgcgctccgtgccctcggggagcagcagggacaccttgcccagcttcgcggcgcccttcttctcctcgcgcgcggaggacttgtacttgtcgaagcggtagacgcccagcgccacgccttccaccacggcgcgcaccgcgtcctgcgtggactcggtggccggcagggcgaacgccaccgaggtgaccttgagccgctgcgccgtcttcgcggcgcggccggcggccagccgcagcacttccgggtggaagcgggcgcggtttcccaggcccagcagcagcacgcgctcggacgacgtgcgccccagggtgtgcatcaccaggctctggtccgcgcgtcccttgaagccctcctgggtggcggcgccgcgcaggcgtccttccagggcgccatccgccgaggagagggaggacggggcgctgtctcccagctcgccctcgaagaggggaatgacgagcaggtcgccgctcgtccgtgtggcatcgcgggagacgaagctgaagttcatgggccgtggaactcgtgaaccttagagca

SEQ ID NO: 506 - DNA, 2364 bp, Myxococcus xanthus
accccacgctcgggacgacggagacgctcatcgccgccctggaggccgcgggggtggatccgcagcgccgcgcggagacgctgactcccgaggagttcgccgccatcgagcgcgcgctcggccccctgacgccggctacgtccacgcccgcggagtagggcgccgctagcgtccgcgcatgcccagtgcctggagcaggccgccttgctgctccaggtaggcgaagaactcggcttcggggatgcgcatccgggcgagcacgccgcggaggatgtcctccacggtgccgtcctgtcggcgcttcagctccatggccgtcttgagcaacaccacgccatagagcggatccggctccacgggaggtgtgggcgctcgctgggtgggcgtgctctggcgggcctcttccagccgcaccactgtcttcgcccgctgtctgccgctcatgtccggagaccaccccgcgcacacgccaagaagtcgcgcggaccgtaggagatgcgtctcggagcgtcaagggacgcgggacgccgtggaaaattgccggattccagcggccgtgttgtgttatccgcccgcgtgcgtggccgcgccttcgcgcgatgtctcgcgcgcgcggtctcaaagcgcattccgcgggcgggaggcctcgggcggatggactaccggtatatcgtggtggaagggcccattggcgtgggcaagacgagcctctccaatatcctcgcggagcgtctggcgggacggcgcatcctcgaagtggtggaggagaaccccttcctgtccagcttctacacggaccggcagaagttcgcgttccagacgcagatcttcttcctgctgtcgcgcttccgtcagcagcaggagctgttccagcaggacctcttcagctcgatgacggtcagcgactacctgttcgccaaggaccgcatcttcgcgcacctcaacctggacgcgcacgagctggccctctacgagcgcgtcttcgaggcgctggggccccgcgtggccaagccggacctggtcatctacctccaggcccgactggacgtgctcctgcaccgcatcaagaagcgcggccgggagttcgagcgcaagttcgaccccacgtacctggaggggctcgtccactcctacaacaacttcttcttccactacacggacaccccgctcctcgtcgtggatacctccgacatcgacttcgtgaatgtcgaggcagacagggaagacctgcttgccaccatccggaaggcgaagccgggcacgcagcattacgttccgaaggcttcccgccggggctgaaagtcaggctcctggtgggacgtccgccttcaacctccccacggccggcgcggtggcgttagagtgcggtggcgggcccagggctcccggcgatccccggtggggacggcgaggcgcgaatgggcccgtcaggccgttcaacccgtagccataggaggtgaaccgtgaaggacaaggtcaccatccacacactgaagcgcttcaagcagatcggtcagaagatctgcatggtcaccgcttacgacgccacgttcgcccacatcctcgaagaggcaggcgcggatgtgctgctgataggcgactcgctgggcatggtcatccaggggcatgactccacgctgccggtgacgatggaccagatggtctaccacacggccgcggtggcccgtggcgcgcgccgggcgcacgtcgtggccgacctgccgttcatgagctaccaggtgtcgaaccaggaggcggtccgcaacgcgggccggctggtggcggaaggcggcgcgggcagcatcaagctggagggcggcgctgagttcgcggacacggtgcgggccatcgtccgcgcgagcatccccgtcatgggacacctggggctgacgccgcagtccgtccacaagatgggcggctacgtcgtccagggccgcggcgaggaccaggcgcggcagattctggacgacgcgctggcgctggagcaggccggggcctacgcgctggtgctggaaggcgtgcccatggacctggcgcgcacggtgacgcagcgcctgtccatccccaccatcggcattggcgccggcgtggactgtgatggccaggtgctcgtctgctacgacctgctgggcatgaacccggacttcaagccgaagttcgtgaagcgctacgccaacctccacggctcgattaccgaggccgcgggcgcgtacttcgcggaggtccgcaagggcgcgttcccggacgaggagcactccttcaaggcgaccaagaacatccggctggcgccgggggctccggctccggcggcccgggtggagccgtccgcgcccgccgaggctggcgagaagctgggccccgtct

SEQ ID NO: 507 - DNA, 2598 bp, Myxococcus xanthus
gtgctctacagatcgttctcattgtcgccgagcagcagccggacgggaacctccgcaaggccacccttaacgccatctccgccggtaagcagctcgcggagaaggccggtggtgagcttcacatcgccctggtggggaaggacccctcgaaggtcgctgacgagctcaagggttacggcgcgaaggccgtccacctgggcgccgccgccgagctggagcactacctggcggagacctacgcgcccgccatcgccgccctggcccaggagctgaaggcggactacatcggcatggcgtccaccgcgcagggcaaggacctgctgccccgcgtggccggccgtctgcgcgccgccatggccaccgacgtcatggccatcaacggcagcggcgcggacatcaccttcacccgtcccatgtgggccggcaacgtcttcgccgacgtgaagctcaccacgccggtgaaggtgctcaccctgcgcgccaccgagttccccgccgccgctggcggtcagggcgccgccgaggtgaagaccttcagcccgaaggtcgaggcctccaagacgaagttcgtcgacttcaaggaagtgaagagcgcgcgtcccgagctgaccgaggctcgcgtcgtcatctccggtggtcgcggcaccaagggcgacttcaaggagattgaaggcctggcggacgacctgggcgccgcagtgggcgcgtcccgcgcggtgtgcgacgcgggttgggttcccaacgacctgcaggtcggccagacgggcaaggtggtggctccggcgctctacatcgcggcgggcatcagcggcgccatccagcacctggcgggcatgaagagctcgaagaccatcgtcgccatcaacaaggaccccgaggcccccatcttccaggtggcggactacggcatggtggcggacctcttcaaggtgctgcccgagctgcgcgcggagctggcgaagctgaagtagtaccggagggcacggacgtgccctgacgcaaggggcgacgtggggacctcgccgcgccgccccttcgcattttcacctcacagctcgatgtcgcggcccgcgtcgcgcggcgccacttctccgggctccggggcctcgtccgcgtaaggcggctcggcgggcagtggcagctcggggcgcttgggcggttcggctcggagcagatcgatgagcgtgccgtcgctcagggcgacgatgaggtggctgaactgccaggggccgtctccgcgcttctcaccctgcgcatgcagtgtgcccttgccgtcgggtccctcgagcgggagggagaactgcgcgcgagagacaccgttgcggctctgcacggagctgcgccggggcaggccgctttcgatgggcgtccccagcgcgcgctgcaccagcgcgtcgccgctggcgatggccacggcttcctggtgcgcgtcggactgccccagggaggagaagcccaggtacgtggcaagcactcccaggccgatacacgaggcgagcagccccaggcatcccagcggaaggacccagcgccagtggcggctccaccagccaggccgaggcgccattgaaccttcttgtgctgcgtccatggccgcctcctcccacttcacgcgcggcctcctcttattcgctccggaggctcgcggggaacgcgcggaggccgtccggcaccgccagcggttggtgtgtgtaccgggcaacaggtagatttcgcgagtgctcccaagggccggggagcacgtgaggctgggtgcatgccttcgcgcagatcctcctccgcagaggtgttgttggacgtgctggaggcactgcctccggggcatcggctgtgggtgcgtggcgcggggcgaagcctgtttccgctgctgcgggctggggactcggtgcgagtgatgcgctgtggcccgggctcgctggcgaccggggacgtcgcgctgatgcggcaggggcgcgagctggtggcgcacgtggtggtgtccacgcggccgtggcggacggcctcgctgctggggccccaggacgccccgggaggcgtgacgctgggccgggtggtggccatccgcaggggccgctgggtggttccactgcccagaccgctgcgtccggcgctgcggctggcgcagcaggccgcatccacggcgtgggcctggcctcggacccggctagtgtctcggggtgtgtgggacttcctcttcgccggatggtcgctgccgcttcgtcgccgtctggtggggccgttggaggtgcggctcctgacggccggtgacctggacgcgctcctggccttcgccagtgagcggctggtggtgtctccgggcttcctgcgccgtcaactgcgcgagcgttggggcttgcaggacgcggagcgccggggcgcagcggcgggcgccttcgacgcccagggacggattcacggcttcgcctgggtggactcctaccggcaggagggcttgcagttggagggggtctgggtgcgctccctggtggtggcgccccgcgtgcggcgaatgggcgtggccacggagctgctggagtgcctgatggaggaggcccgacgccaggggcagtcgcacgtcttcgcggacgtggacgatga

SEQ ID NO: 508 - DNA, 2514 bp, Myxococcus xanthus
caggcgagctgactggcggccagcgcccctaccgccattcccacgatgccgaacagcaccgacgcgatgatgaagcgccggaccgtggtgtcgtcatagatgattcgttgctgatgcacggcttcactcctgggaagcggagggcggaggctcgggagcgcgcggcgccggagcggcgctgtcgtcttcgagcgggaagagcgagagccggtcggcgtgctcgtggtcgcggtggcgcacgctgtagacgaacaacagcaccgaactggcgacgagcatcaggctcacaaagacctggaggacgaggacgttcatgccggcacctcccgcagcggcggcgtgggcgaggcggcggcgcgctcacgtgaggcggacagccaccacaccgtgaagagcacggtggccagactggtggcgggcatggccacggcggcgcgcaggggcgtcatccaacccgcgaggcacacggcgacggccaccacgttgtagctcaccgccaagagcagcagccggcgcaccacctggcgcaaccgggccgacaaccgcagtgcctcgcggatggcacccaggccttcgcccaggaggaagaagtcgctcttgccgggcatcaccggccggtcgatggcgggcgtacccgcgcagagggctcgctcgaaggcgaggctgtcgttgacgccgtcacccaggtacagcgtgtccgccgcgtccagcttcgcgacagcctccgccttgtcctcgggacgctggccgctcagggtgtgctgggtggggatgcccagcgcggcggccatgtcactcacgcggccgtggctgtccccggagatgagccacacctcgcggccctctccctggagcgcctggacctcacggcgcgcgtcgggacgtaccgactcccggagctggaagaaggccactggcacgccgtcacgggtcagcaccgggcccgcggcgaggcccgaaccggagaggaggacctccacacgcccactcggcctggagtggcggctcgcggggctgccccccgcacacgacgcgccatccgtgggctcgcgctccggatgccctgtgtccaccgcctcggtggcccagtccgcgcggcccagccgccagcgcacgccttctcgattcagctcgagcccctggcccgcgagctccgacacacgcgcctccgagttgaagcgcgcgccttcccgagccagcgcggccgcgaggcagcgactggcggggtggttgctgcgcgacaccaggtcgaaggcgatgtcgcgcgacgcggccgtcaaccccgccacggcggcgcggtccaccaactccagccgccccagcgtcagcgtccccgtcttgtcgaagagcacctttcgcacgcgcggcagccggtccagcaggtccgtgctccggatgaagaagccgccgcggcgcaggcgcgcctggaccaactcgtaggccagcggcgtggcgatgccaatggcgcacgggcacgtcaccaccagcagcgccaccgccacctccagcgccttgtccggcccggcgggccaccacagcgcgagccccaacgcggagacgaagagcaccgtgacgacccagcggcgcgacacgcggtcccagaagcgggtgtgcagcgcgggcccccctgcggccgtgggcgcccggcggagcaacgccaccagcggagagtcggtgaacgcctgcttcgcctggatgcgcacggcctcgcgcccggcgttgaacgcgcccgcgggcaacgcccccccctgccccaccgcgcgctcgccgggctcgcccgtaatccaatccgtggacacgcgggcccccgaatcgagcagcaccgcgtccaccggcaccaggtcccccggcgcaatcaccagcacgtcgccgtcggccacctcggcggcgcgcacggtggcgagccgcgcgccctcttccctgcggacgaagagcccttccgccccgtcgtcatccagcaggaagcgccggttgcgctccaacacacgctgctggagccaccgtcccaccagcatcagcgtgacgaaggtgttgagcgtgtcgaagtacgccaggtcgccgcgccctccgcgcgcctgcgccagcgacatgccgaacaccagcaggatgcccagggcaatgggcaggtccaggtgcagcacgccgcgccgcaagccctgaagcgcggagcggaagaagggccagccgcccaccaccacgaccgcggacgacagccacagactcagccgtgtgaagagacggaagacatcgccatcctccggcgtgagccccacgtagaagctcaccgagaacagcatcacgttcatcgacagcgcggcgcagatgcccaggcggatgggcaggtccaggctcgtgcgctccgggcgcttgcggctgggtccgaagaggtagccaaagccctccccgccccgaaggaactccgccacgtcgaaggcgccgggccgccacagcatccgccccttgcctagggccgggtccaccgtcagacccgccccgcccggttgccggcggaac

SEQ ID NO: 509 - DNA, 2878 bp, Myxococcus xanthus
tgctctaaagcgccaccccttgctcaagctgcaggctggcgcggtgcttggctacgtcgacagcaggagcaaggccattggggatggcttcgtccactgggaaatcctggcgccatccgatccagggcagctcaaggccttcctcgacttcgcgaaggacacgctggggctgggagacttcttcaaggtcttcgaggaggcggaccagaacaatttcttcgacccttcgaagggagaactcgacgcgctgatgaagctggcgcccaagtcgattcacgctgcggggaaccccgaagaggagtgtctcgatcgcttcgagcagacgtatcaccacggcgcgctcaaggagattcttcgctcacctcgcgcgctcgcgttctcgtccgatgatgcgcctggtgatgccggcgagccttcgtttcccgcggagcttgtcatcaccaactacaaggacgcgctccctgaagggacctactggctcaagctgaccttcgagcctcccttgggcgaacggtacgtcgcttatgacggaaaacagagccgtctcaacgtgcgcttgccggctggggctcgacgaatcttcgtggagccggccgacggccccggctttctgctgcaggtgggcggcggtgctcaggatgcactcgaacaggaactccagcacttcaagaggctggcatccgtccgttggcgaaacgtggtgctcaggcatctgaacgagtggttgccggagagcatcgtcgttcaggtgatgaagcatctggagattcacggtcagcttcgaatggggagccagatcgccgacatccagcagccggacgaggccaagaggctgctgggacgctacgcggaggcagtcggattctgggcccacccggaggaagtgcccttcctcgggcccgtgggggacaacggtggcaagaaggcgcttttcgcagcggcgcctgacgtcgaccaattgcccgcgaaggggctggtcgacaacccgcacccagtcaccttcgcctggctcctgatgctcatggtccggcatggcctcgtccggttctcggagctgccggcctggcgcccgagcaactcgaaggacgtgctcgcggtggggtggctcccggcacgaagcgatcatcccgcataccgggtgggggaactcctggacgtgggggccgtggtgcgcgggagcggagacgacgaggtggagctgcatgtgctgcatgagggcacacgctgcttcctcgcgagcggaagttgcaccgagggtgctttcttcgcgcaggtggagttgccgggttggggggcctgcacgctcgacatgccgggtgcccggcttgtgggaaccgcgacattggaggtgctcccgccggtgttgctgggtgggcgcgagtcggcggaggctcttgggagccaggttgtttcctcggctcgatacgctcccgagtctcacaaggatggaacgttctcctggcgtattcccttcagggagaactgcccaaagcttcttcggggttgggtgcttctgagcgcatgggcgaaggccacgaaacaggaagggctgcacccggaggcacctgcgttcgatctggcccgtgtggccatccccgtacaggggcgggaggactccgcgttcaatgaggcctccggactccgcgtcgttgacggcttcattcaaaggggggcgctcaagaagctggaaacgtatgtgacgcggcacttcacctaccgcgccttcttgaaggccgctgcttccaagacagagcctccgttggcctgggcgctcgtggaggcggtggagcgtgtccagtgcgcgtattcagagaggcagttgctggcgttgtccgcgctggccgaggacggattgtccatcgtgctcacggccacgaatgcccggcgattgaaggatgccgccgagaaggttcgagaggatggctggttcaccgccttggaggacgcggccaagggggcgattcgcgtccgagtcccagcgccagcggagggacgtcatcctggtgaacttgtcatccggttcgacgccagcgctgctttctcggagctgcggaagggcatgccaggtacccatgaggtccatgtgaagttcggcgcgttcttcccgaacgggggaagcgcgcgggactcgcgtctggtgacggcggatacgctggggagccggtgtgaacctgtgacgctcgatgcgctgcggagcggcgccaaagcgggggcgctggaggtgtggtccaccgaggtgtcggaggtccttcacatcccttcgctcgaagcgcccaaggtcttcgtcaccgcccgggggattcagctttcctcgcggttgctgggtgggaatcggaccttctgggagaatgctcgacccatcatcaaggtgggccacagttccctcgatgaaaccgccgcacgtcagtccgtcatccagaatgggtgcgtggtgcggaccttcgggttcgaggatgcgcaggttcaggggcgaattctcatcccgaccgccgaggtggtgaacaagcatgtgctcctggggcacgaacggatcgacgtccagcccgcgaagggccgtgcttgcaccatgcagcgcaacgcgaggctcgaagctcggtctcactaccatgatgccttcagcctgaaggtcgccgtcacgacggaggccgtcccggtgagcagacccttccgactggaactcgcgagtccgtcgctgccaggcgacccgcccgggcttccgctgaagctcaagaggggcagcgttgtctacaaaccggaacgccaagggcaaggtctgacggatgtggaaggggtgctccatgcggacgtggatctcaatgacgtcgaggccgccttggagggcgccagggaatacgtgctccgtgtcgtccccttagag

SEQ ID NO: 510 - DNA, 3212 bp, Myxococcus xanthus
ggggcgccggcagggcgggcctcgcgggcgacgcgcaggagactggccgacctgtcgggcgctgcgcgaggagctggaagcgcaagtccgcctccgcgaggaagcggagacgctcaccgccgaggtggaggcccaggtccgccggttcgaggatgcctgcgcggaggcggagctgcgggccatcgacgcagaggcccgcgcggaggcagagacgcaggcccgtgaggcagcggagcttcgcgccgcggcgagcacgcaggcattgcaggcgctcgaagcgcgcctggagtcggaggccgcggggcgagtcgtttcggaggcccgcgccgaatcggagtccaaggcgcgtcagaccgcggagcgccgggtcgagtccgccgaggacctgaccgcggtgtcggaagcgcgcatcgacgcggaggctcgtgcccgcgaggccgcggaggcccgcgccgaggtggaggcccagtcgcggctcgaagcggacacgcgtgcgcagagcctgtcgcgagcccttgaggaagtagagactcgcgcggagctggcggggcgtgcacaggcggaggcagaggctcgcgcggagcaggctgcgcgtgcgttggcggagtcggaagcccaatcggaacggattgctcgggccctggctgacgccgaggcgcgcgtgcaggcggagaacggtgcggacgcccgtgtggagtccgtggccacggcgctggccgaggccgaggctcgagccgagattgaatccgcggcccgcgtggatgccgaagcacggctggcgtcagcggaggcggcgcttgccgaggcctccgcgcgagcggagattgaggccacggtgcgcgccgaagccgacgcccgggtggaatcggtcgcgacggctctgactgaggcggatgcccgggcggagattgagtccgcggctcgcgtggacgccgaggcgcgtctggagtccatcgccacggcgcgtgccgaggccgaggcccgagcagagattgaagcagcggcgcgtgccgaggcagaagcccgggccgagattgaggcaacggcgcgcgtggaagcggaggcgcgtgctgaagccgaggcgttggctcgccaggcggcggaagcccgagccgaagccgagacacgagcacgtgaggaagcggaagcccgcgtcacctccgaatctgatgcgcgcaccggattggaagcggaggcccgtgcgaacgcagaggcccgcgcgaagaaggcggaagctcgggctcagcaagaagcggagctacgtgcaaacgcagaggcccaggctagcagcgaggctgcggcccgggcggaggccgaagcccgagcggagcaaggcgccgctgtacgccttgaagccgaagcccacgctgagcgcacgacagctgcgctgaaagaagccgaggcccgagctgagagcgcagtagccgcattgcaagaagccgaagcccgagctgagagcgcagtagccgcattgcaagaagccgaagcccgagctgagagcgcggctgccgcattgaaggacgacggtgctcgagctgagatttcggccgtcgcgctgaaagccgcggaggctcgagccgagagcgaagcagcagcacggcaagccgcggaggcccgagctgaaagcgaggccgtcgcgcgacgcgaagccgaagcccgcgcggaaatcgcggccgaggcgcgagccgcagccgatgcccgcgccgaagcagaggtcgccgcacggtccgaaatagaggcccgcgccgagcgcgaggcgaagttgcgtgcggcaatcgaggtccgtgcggagagcgaggcgtcctcgcgaaccgacgcagacacgcgtgcttctcgtgagtccgaggcccgagccgcagccgaggcccgcgccgagcacgaggccacgttgcgcgccgaagccgaggtgctcgcgaaggcggaggcccaggctcgcgagaaggcggaagcacaggctaccgcggaggcggagcgccgcgcggaagccgaagcccgagccgaacgtgaagcgcaggcccgcgccgaagccgaagcccgcgccgagcgcgaagcgcaggcccgtgctgaagcggaatctcgcgccgagcaggaggcccagcagcgcgccgaagcagaagcacaggcaaggcgagaaggagagtccctcgccgccgagaaggcacgtgcccgaacggaagaagaacaccgcgtcaccgccgccgcccaggctgaatccgaggcccaggcacggcacgaagcggaagcccgcgccgaagccgccctgaagtccgccgaggaggcggaagcccgagccgaagccgaggcgaagcgccgtgccgaggccgaagctcgcgtccagcaatccgcccaggccgaagccgaagcgaccgcccgcgcgaaggccgaaggccgccaccgaacggccctcgaagtccgcctggacgcggaggcaacgcagcgagcgacgctggaatcccggctcgaagaagagtcccgcgcccgcagcgagtccgagtcccggctcctcgcggagaacacccgaatctccgaggaactcgccgagctccgcctggagcaccagcagtcccgagagaacttggcgaaagagcgtgaagcacgcgagtccctcgaacaatccctggaggcactgcgcaccgagtccgccgaacagcgagcccgctccgagcgcgaacgcctggagctggaggagcgcgcgctccgagacgcggaggaagccgctgcccaggcccgagcatccatgctgcccctggaagcacctcccggcagacccgagctggccgtggcccgcagtggcagcgtcacccaggatggcctgacgaagctggtgctccggctctgtgaggcccgcatggagatgcggttggagctgaaggtgatgaacgccctgcgcgtcctctggctgcgggacggggcgctggtgggggccgtctcctccgcgcaaggggagacgttggtcgaccgggcccgcgcggacgggctcatcgacgcgcggcaggaaggcgagctgcggctggtgcgcagcgccaccacggccgcgctgctggacgcactgcggggccggggctacctgcgggagtccgaagccgtgcccctggtccagcgctacaccgagcaggtcttcctggacgcgctggcggagccctcgacgctctaccgcctggtatcggagccggcgccgcacgaggtggcgcttgccgccgccacgcgtccgc

SEQ ID NO: 511 - DNA, 3548 bp, Myxococcus xanthus
ctgggcatgccccgccggtacgcggactacccggaggagttccagccgctgcacgtggcgtccaccgctggggcgtccctgctgggcttcggcttcctcatcgtcgccatctacctgggctggtcgctgcggcatggccgcgcggcggggcggaacccctggggcagcgagggctatgagtggctcagcgactcaccgccccccgagttcaatttccatgcgccgccttggtttcccaggccgccccacgactacgcgaaccctggcgccaacacggaggtggagcatgcggcatgaggcgagccagcgcccggtggagccccgtgccctccactttggagacgaggcgtcccgccaggacgccgcgcacctgggcatgtggatcttcctggccacggaggtgctgctcttctcggtgttgttcaccgcgtatgccctgtaccggctgacgtatcccggtgtgttccagcaggcgcccgcgcacatggacgtgttcctggggacgctgaacaccttcgtgctggtggtcagcagcatcctggtggcgctcgcggtggatgccatccggaatggacgcgacttcgccgcggcggcgttgctcgcgctgtcggtgctgctgggcatcgcgttcctgttcatcaaggccgcggagtacacgaagcacgtgcatgacggggcgctgcccggcgcctggtacgcctatgaggcgttcgcccttcccggcgccaacctctacttcacgctgtactgggtgatgactggcgtgcacgcggtgcatgtgctcgtgggggtgggcgtgctcgtcacgctggcgttgcggacgctggcgggggagttcggggcccgcttccacacgcccgtggagctgggtgggatgtactggcacctggtggacgtcgtctggttgttcctctggccattgctgtacctgacgtgaggaggcgcgcatgcggggcggggtccgggtgctggccgtcggagccgtgttgctggcgctggccacgctgtccttcgggctgtcgaggctgcacctgggggtgtgggcggtgccggtcgcgctcggcatcgcgctgtgcaaggccgtgctgattgccttcttcttcatgcacctggtggagcggcccggcgggccccggctcgtcatcggcaccgcgggtgtcttcgttggcatcctcgtggggctggtgttggcggaagccgcggcccgggcgtgccccatgttgccgccagggccctttccggtgtcgcggtttccgggccccgaacgaataggcccccctcgggtggagcagccttggcaggtcctgccctgatgcgccctagcagcgggctcagtacggcggtaccgggagtgtccggatcccacggcgcttcgcatccaggaggagcaaggccttccggacaggcgtcaggacgcccaggcacgcgccgaagaccaggtgcaggagcaggaacgcggcgatgggcggtcccgctcgctccagcgggggcgcggcccaggggacgaccagcacgggcatgacggcctggagcgtcaggcccgcgagcaggcccagcatcacggccgtcagtgccgagccacctcgaggcaccagcatcgcgaaggcggtggcgagccctcccgccgtcgcgaagtgcagggcgaagccgagcaccaccgccgcggtcccagcgggcgcgtccctgaagaccacgccgcccaccagccgtggcgcgtaccagaggtcgccctgggtgatgctgcccagcaacaaggccagcgcggccatgacccatgcgccgagcgtgcccaccagccctcccgcgatgagcacgtcccggaccaggctccagtgggccactgcgtccgcgtgtttcgcctggagctcccgctgcccgcgtgcggtccatggcgccaccttccttctgattcgtcccggcccatgacgggatgggccggggcctggcggcagtgttcctcgcgcgctcatgccgcgcgtagtgtctcccgggcgcgtcgttcgcggcctggcgggcattgtgccggtccagggggccagtagccccaggcgccgggcggagcggcttgccgtggcccggtggaccttggaggcacggcgttcattcctcgccgtcgggccccaggcgtggctcgtacggacctccagcggggtggtgttcctccaggtcgttctggtgcgtgcgctcccagagcgggatgccggcgcgaaacgccgcctgcgcgatgagcagcgtggccacgggcgtcatgacgaagacgaaggtgacgcccagcgccgcgcgggccaccacgctgacgtctcccaggcccagcgccgccgcgcccatcagcaggcccacgcccagcgaggacgccttcgcggccccgtggagccgcaggaacaggtccggcatccggaacaggcccagccccgccaggagcatcagcaacgcccccaacaccagcaacaccgcggtgatgatttccttcatggcgtgcccctctgcgcgctgtagaggtacctggcgatgacgatggtgcccatggacccgatgacggccagcaccagggccacgtccaccagctcgggctgtcccatccaaagggcatagacggtgatgaccgccgacgtctggagcgagaagaggtccagcgccaccacccggtccgtcagcgacggacctcggagcagccggtggagcgagaacagcatcgagacggagatggccccgagggccccctgggtgatggtctgcagccagtcgctcatcgcagtgccctcaacagtggaatctccacgcgctcgcggagctcctggcagaacgcctcccgggtggtggcgaacatgacgtggacgtagatggccttgcggtcctcggacacctccagggccagcgtgcccggcgcgaaggtgacgatgagcgtcagcagcgtgatctccgcgtccgtgcgtgcctccatgtcgtagcggtagatggcgggacgggtgaggagcttgggcgtcgcaatctcgtaggccacccgcacgttggcgaccagcacgtcccagcccacccccgccaccagccgcaccacgttccacgcctgcgtcccatagcgcgagggcacatgctgcgtgtcgatgagggccagcagcacgaagccgatgatgaaccccgtgaggaggttctccgaagtgacgttccccagcatcgcggcccagaggagcgccagcatcaggttccagaggaacgcggtcatgggcgtccccccagcaccgcccgcacgtactcctccgggtccagcaactggcccgcggcggcgtccgccagctccagcagtggctcggcgcccaggcccaggacgaccatgaacagtgtcatcgccatgcagggcccgagcacgccgtctcccaggctcagcggccgggtgggttcctgcggctggtcctccggcggcgccttccagaaggcctcgcgccagatcttcatcatggagaagagggtgagcaggcccacgacgacagccgttcccgcgatgatccagttttcggcccgcagcgcggcctggatgacggccagcttggcga

SEQ ID NO: 512 - DNA, 2384 bp, Myxococcus xanthus
gagacggccgtgcccgccctcctggggcaggtggcgcttcttcgggaggacattgcggcaccgcccgcgacaactctgacttgaaggcgcgccgtggtcgggtgaagagttgtccatggccacgacccgttcttccgccgccgctcagcccgccctgggcgagcaacagccgattgtcacctccgaggagcaggcccccgcggcagcgcccgcgaagcccgccacgcacgacacggtgccaccgccggccctgctcgacttcatgatgaagtcgtggaagccgcgctcgaagaagctgcccccgaaaatcaagcaggcggaggccttcaaagcccgccgccgggcgctctccaagctgttccccggcgagacgctcatcattcccaccggccacgagaaggtgcgcgccaacgacaccaacttccgtttccggccgggcagcgacttctactacctcaccggcaacctggagccggactgcgtcctcgtcctccagcccaaggagaagggtggccacaccgacgtgctcttcgtggagccgaacccgggccgcaccgacgccacgttcttcaccgaccgcgtgaagggggagctgtgggaaggcccccgcctgggcgtgaaggagagtcaggcccgctacggcgtggaccaggcccggagcctcaacgagctgccggccttcctctccggcctcagcggcgcggagagccgtcccacgcgcttgctgcgcggcctgtcgcccaaggtggacggcgccgtcccggcgccgggtgagaaggacaaggggctggcccaagcgctgtcggagatgcggctgctcaaggacgcgcaggagctgcgtgaactccagacgtccatcgactccacgcaccgcggcttcgaggacgtcatccgtggcctgaagacggcgaagacggagcgctacgtggagggcatcttcaacctccgcgcccgcgtggaaggcaacgacgtgggctaccgcaccatcgccgcctccggcgcccatgcgtgcatcctgcactggcaccacaatgacgggccgctcgttcccggcgacctgctgctgctggacgcgggcgtggagggccagacgctctacaccgcggacatcacccgcaccctgcccatctccgggaagttctccaaggagcagcgcgaaatctacgagctggtgctggaggcgcaggacgcggccttcgccgaggtgaagccgggcaacgacttcatggagcccaaccgcgcggccatgcgcgtgctcgcggagggcctggaggccctgggcatcctcgaggacgccgaggaggcgctcaaggacgagcaccagttctacaagcgctactcgctccacaacgtcagccacatgctgggcctggacgtgcacgactgcgcccaggcgcggcaggagacctacaagtacgggaagctccaggccggcatggtgctgacggtggagcctggcctctacttccagatggacgacctcaccgtgcccaagcgctaccggggcatcggcgtgcgcatcgaggacgacgtcgtcgtcaccgcgcgcggctgcaaggtcctctccgccgacatcccccgcaaggcgaaggatgtggaggcgtggatgaagtccctctgggcggcggacaaggccgcccggaagggcaagaagaagtaggcccggcgcgctacttcggcttcggcgcggcggtggcgggtttcgccgccgcggccgcggcccgctcctgccactccgacagcgccagaggcttcacgtccttgagcgtggacacggcgacctcgtagacgcggggcccggggttcgcatccggcccggcggtgaagttgagacggtggatttcgtgcccggcctccgtctccagcaccacgcgccacttgccgggcttcaggttggacgtcgtcgcgtagaaacggtagccgccgtccgtgccgttgctgctgacggtggccatgaagccgttgccgtacgtcgtccagcccttctgcgggtcgtcgaagtaccagcgcacgcggaccttgtacgactggaagtgcttcggcgcgaagatgcggaagaagtagtagggcttgtcccccggctgcatcaggaagtccggcccgccccacgtccacggcttgtaccaggcgccggagtccaccgaggacaggtggtagatgcccgggctcacccgctccacctggtggtagatgcccgcgaactgcacggccacgggcagcggcggaatcacgcccaccaggtacagccccagcagcgcggcctgcacgccgaagccagggatggccacgttgcgcagcaggtaccggttgtccggccgccagcgccggatgaggcgcatcaccccgaagatgctggcgcggtccatttaacggaaagcaggaag

SEQ ID NO: 513 - DNA, 3131 bp, Myxococcus xanthus
gtcgctcaagctcaacctggacatcgagcacacctaccggggcgacctgaaggtgacgctgacctcgccgtccggcaagagcgcggtggtgtcgaaccgcaagggaggttcgtcggatgacctgacgggcgccttcgacctgtccgcgttcaagggcgagcccacgaagggcacctggacgctggaagtgcaggacgcggcgcgcggcgacaccggcacgctgaagtcgtggggcctggacatcgccccgcagacgccggtgacggagcccgaggcgccggaagagcccgaaggtggcctgttcgagggcctgcgtgacggtgcgctgctggacgcgctccaggactactcgtccggcaagaaggtggtcagctacaacgaggcccgccggctgatgttctccagcctggacgtgaacgagaacggcaacgtcgtctgcgtctacacgggcgccgaagtcaaaggcggcaagattcccaacaactcggtgatgaacaccgagcacacctggccccagtcgaagggcgccacgggtgcggcgaagagcgacctgcaccacctctaccccaccgacagcaaggccaactcccggcgcagcagcttcccgttcggcgaagtggtcaacgtgcggtggagccagaacggcgccaagctgggcaccgacgcgcgcggcaacatggtcttcgagccgcccgacgcccacaagggcaacgtggcgcgcgcgatgttctacttctccgccacctacaacaaggccatccccaacgacgaggaggcgacgctcaaggcgtggaacaagctcgacacggtggacgccgccgaaatcgagcgcaaccgccgcatcgccaccatccagggcaactccaacgccttcgtcgaggactcggcgctcgcggaccgcgtgaaggacttctaggcccccgcggagcgcagttccccatcgcgcaggggcggcagcttctcgccccgcgccaccgccgcgacgattttcgccagccggtccacgccatccgacagggcggctggccccggctggaggatgagcgagctcttcacctcgtagagctggtcatccaccaccgcccggaccccggcccacccggggcgggcgacgattttctcccgcttcgccttgcgcccgcaccaactggcgatgacgccctccgggtcgcgccgcgccacctcttccggcgcgaagatgcggccctgcgccccctgcgacgcgcgcgactcccggcacacgtccacgccgcccaccagctccaccagctccgaacaccagcggatgccggagatgagcggctcatgccactcctcgaagaagatgcgcggccggcgtggaagcgactccgccgcgtccgcgtgccgctccaggttcgcggtcagctcggtggccagcgcctccgcggcctcgggccgccccaccagcgcgcccgtcagccgcactgactgcaggatttccgcgagggagcgctggttgaacaggtagacgggcacgccccgcttcgccagctcgcggccgatgtccgcctgcaagtcagagaagcccagcaccaggtccggcttcagctccaggatgcgctcgaagttcgcgtccaggaacgagctgacccgcggcttcttgcgcgcctggggcggacgcacggtgaagccggacacgcccaccaccagctcctccgtgcccagccggtagagcacctccgtcgtctcctcggtgaggcagacgacgcggcggggatagggcggcgcaccggagagcagctcggacaggcgggcattcatacggggccgcaccctaacgcggccaccgccgcgctacgtgtccgtagcacgcgtccatgcgcgtgggccgggctttcaccgcactcccagtcacggcacggcgcacgtgtgtcacctgtgaaacgttgtggcgcccgagccggattctcggccggtggcgcactgcgccaacccggcaggtcgcttgggaggtggacgattgcagtgttagcatctgccctcatgtgcgaccggcgtgtcacgtgcctcaccggtcggtgggggcagtcatgatggagagcaacgccccgacgaatggcgccccccccgacgtcgcggacccgatgctgggccgggtcctgaacgagcgcttccgcatcctggagacgcttggcgccggaggcatgggtcgcgtctacaaggccgtgcagtcaccgctggaccggctggtggcgctcaaggtgctcaatccgcagtacggagagggcaaggacccgggcttccagaagcgcttcttcctggaggccagcgtcaccgcgaagctgcgccacccgaacaccgtcaccgtcatcgactacggcaagacggaagacggcatctactacatcgccatggagtacctggaggggctgacgctgggccagctcctcacgcagatgggcccgctgccgtggccgcgcgcgctcaacatcacccagcagatcgcccgctcgctgcgcgaagcgcacaaggtcggcctcatccaccgcgacctcaagcccgccaacgtcatggtcctcaatcaggagacggaccacgacgtggtgaaggtgctcgacttcggcctggtgaagtccttcatcggcgacgcggcgcccgtgtcacaggacacgtccatcacgcaggcgggcatcatcctgggctctccgcagtacatggcgccggagcaggcgcgcaacatcgccgacccgcgcagtgacgtgtacagcctgggcgtggtgctctatcagatgctgatggggcggccgcccttcctggccgcgcagagcatcgacgtcatcgtcaagcacatcaacgaactgccgcccgccttcggctcgctctaccccaaccatggcatccccggagaggtggaggccctggtgatgaagtgcctcgccaagacgccaccggagcgctaccagtccatggacgaggtgatggaggccatgcgccgcaccatgtccacggtgggcgtcagcggcgccttcagtggcgcacgcttcgcgggcgcgggcatcagcggcgtcggtggcagcggccccatcagcgggccccacggaagcggcccccacggaagtggcccccacggcgcggccggctccggtcccgccaccgtggcgctggacatc

SEQ ID NO: 514 - DNA, 3393 bp, Myxococcus xanthus
atccgcggcggtccagccaagtcgagctgggacagccggacttccgggctgcccgcggcggcctccagcaaccggaggagcgagcccgacagccgggcgatggtctccgcgtcgaagagcccggtgttgtactcgatgctgcctcgcagcccctcgggcgtctcggtgacttccagcgcgaggtccagcttggtcgcacccgcatgcacgggacggctgcggagctggagcccgacgagcgacaacgccgcggcgggcgtgttgtgcagaatcagcatcgtctggaagacgggcgtgtggctgaggtcgcgcggcgcgtgcagcacctccagcagcttctcgaagggcacctcctggtgcgcgaacgcgtccagcgccgttcttcgcacccgccccaggacctccgcgaacgaggggtcgccggacaggtcggcgcgcagggccatggagttgatgaagcagccaatcagcggttcgacttcgggccggtcgcggcccgccaccggcgtgcccaccgcgaagtcgtcctgcccggtgtacgcatgcagcaggacctgccacgcggccatcagcaccatgaagggggtggcgccctccttccgccccaccgccaccagggcgtcggtgagggacttcggaacggcgaagggcagttgctcgccatcgtgcgtctgcaacggaggacgcggacggtccacggggagttggagcacggggacatccgccagcacgtcgcgccaccacgcctgttcggccttcagggcggagcctcgcatctgctccagttgccagagcgcgtagtccgcgtactgcaccggcagggcgggcaaggaggcaggccggcccgtcagctcggcctcatacagacgagccatctcgtgcaccatcacgcccgcggaccagccatccgagatgatgtggtgcagcgtgatgagcaggacgtgctcggtacttcccagccgcagcaaggtcgcgcggagcagcggcccccgctccaggtcgaagggacggcgcgcctcttcacgtgtccagcgggcgacgtccgctgcactggcgccctccaccgcctccagggagatggagacctccagcgacggcgcgatggtctgcaccgcctcggtgccatccatggagaacgtggtccgtagggcctcatgccggcgcaccaccgcgttcaacgctcgctccagggccgcggcatccagggcgccgctcacggtgaacgcgacggcgttgttgtaggcgacgttgcccggctccagccggtccaggtaccagagccgctgctgcgcgaaggacaacggcagcggacggccccgggggacccgggtgatggacgcgggtgcctcggacttcttcgccacgccatcccgagcgcccatcaccttcggtggtgtcggcctgccctccgggacaggtagggcgggcaacagctccagcgagccatcccgcttgcgccgcgcacgccggcccgtggccatccgcctcgcggcatccgtgcttccagcgaggatgcgcacgggggtggagtccggcgcgttccagagcccgagaggcacgcccgcgcccttcaccaccagctcaccgatgacgcccaccggcacgggctggccgcgcccatccacgacgtcccagcgcgaggcatctcccggctcggcggcgagcgcccaggtccccaggcccaggtcctgctgccggtgcgcgacacgccaggacatggcgcgcaccagggatgccgccgcttcttcggacgcgccttcgagccagacgtggcggacaggccggagcgcctccgccgcgtcggggagcgtcagcatcgagcgcgccagcgccgcggtgcagtgcaggtgggtgatgcccgcctcgcgcacgagcgccagcagggcctccgccgcacccgggccttcccgcagcgacggcatggggaccgcgagtccgggctccggggaatggcgaccgcgcaaggcgtcgaggtgccgcaacccctccagggtcgcctccacctccacgccgaaatccaccaggcaggcgatttcatccacgtcgagccgctggacacgctccaccatgggaccgcaagagtccggcgtaccgaagaggccgccgctctccacgtatcgctccacgccgtgcgccagcagcgcatccatgtccgcgggcgtcagcgaacgggggtccatgtcgagccccatgccggccatgaagcccgcggcgatgtccacggagctgcggaagtagtcgagcagcggctggcgcgccctccgccggacctcggccgggtcgtcgccgagatacgcatgcagcatcaagctcacgtgtccccgtcccgcatggccatgttgcctccatgcgtcgcggtacagcgccaccttcccctccaggtcctccaggtgctggcccatcaggttggtgagcacgtaggcccccagctcgcccgccagccggaaggtctccgggtttccggcagcggtgagccagatggggagcgtctgctgcaccgggcgtggccgcagtgagagggccacttcggcgcccgcgccgttgcgtcggcgcaccgtcccgcctcgccacagggtgcgcacctcctcgatgcctcggtgcatgacctccttccggcgcgcgtaccggtccggcgcgaacacgaagtcattcgcgtgccagcccgaagcgaaggacacgcccacgcggccatcggacaggttgtccagcacggcccactcctccgcgacgaggatggggtcgtgtagcggcagcaccacgctccccgcgcggatgcccaggcgctgcgtcaccgtggccacccccgcgcccaccaccgccggcctcggatacagaccgccgaacgcatggaaatgccgctccggcgtccacaccgcggagaagccattcgcatccgcgaacttcgcggcgtccagcagcaggcggtatttgcggccgcccagcgagtcctcgtcgttggcgaagaacgacaggctgaagtccaggcgccgtcgagcaggctccgcgccagcccccaccggcgtgaagcgcgcacgctccgccggcaacaccacccgcagcccgcgtgtcagggcccagaggacctccagcccagtgccgggaacctgcggctcctccgccgcgagccagacgccttccttcgtggtcgcatccgcgtccagacgaccgaacagctccgccacggtgcggtgggtgtggatggcccagagctgctcaccccgaggccctgtccacggctcgaggcagacccgctccgaggcggaagcccgcagcggcgccattgaggtgcctcggcctgaatctcctgtctgcgcgaacaccgtctcaacatggaggacgcgcgcggcatccaatgacacgcgcgtgcggaccttcgcgtgggtcaacagcagc

SEQ ID NO: 515 - DNA, 3343 bp, Myxococcus xanthus
cgctctcaaggccaccgcgggcggcagcagcacgggcatcgtctccgcgtacttcaccgtggatggcggcgcgcccatccccgtcatgcccgacgcgggcggcggctacgtcaccacccagcttcacctcacggaggggacgcacgtggtccggctgagcgtcgtggacgcgctggggcacgtgacgtggcgcgagcagacggtgtccgcggacttcacgccgccggtgctcgtcatcctgtcgcccaccgagcaggagaccaaccccgacccggtcgtctcgatggtcatccaggagcaggacgccagccccgccacggtggtgacccagggaatcgtgacggaggacgtgcccgcgggcagcaacgtgctgcggcacacggtgaacctggtgcaccgcgactggtcgctcgtccacgtccgggccacggacgccgcgggcaatacgaccgaggtggtggcgcgcgtatacgtggcgccctgagcgcggcgcggcccagggcgggagaatgacgctcgcccgggccggaacgtccacccgcgcggcgcgccgcgcgtccccgtgcttgacgggcgcgcgggcgttcgcctgggcgatggggccgagatcgcccgcgctcgccttcgcaggcccgttcagcccggagacgccaacccgagctggacgcccctgttcgtcacgaccaagggcctggtggctgagcagggacacgcaatcgtccgccggcccgaacgtagccgctccggaagccgccgaccggcttcaggagatgtcgcgatggattccgttctggctggactgcgtcaaagcctgcgctcgctgggccgcagccccggcttcacgctggggtgtgtactgatgctggcggtgggcatcggagcgagcaccgcgctcttcagcgtggtggaaggcgttctgctgcgtcccctgccctatccgcgccccgagcgcctcgtggagctctcccagcgcgcggcggacggccatccaatgcggttctcggaccccaacttcgaggatgtgcggacgcgcgctcgcaccgtctcggcgctggcccaggtgtcgggagcggcgagcgtcgccgtcacgggcgccgacgagccggccttcgccacgctggcgctcgcctcacgcgacttcttccccgccttcgcggtacggcctgtccaggggcgcctcttcgcggaggaggagcagcaggagggaggtgctcccgtggtgatggtgagccacgccttctggaagcgctatctgggcgcacggccgctgccccttccggacaccctcaccttcgaggggcgcgcttacaccgtggtgggcgtgatgcccgagtccttcgactacccggtgggcacgcagctgtgggttccgcgggagctggtgccccccctgcccagccgcaccgcacacaactggcgggtggtgggaaggctggcggacggcgtcgacctccaggccgcgcgagtggagctcacacacatcgcccgcgagctcgaagcccagtacggccaggacacgcggatgcatgacatcgccgtggagcccttgcaagagagcctggtgggccgcgtgcggtccacgctctacctgcttgcgggcgccaatgccttcctgctgctggtggcgggcgccaacgtcacgaacctgctgctcgcccgcgcggccacccgtgcccgggagctcgccattcacgtggccctgggcgcggggcccggagcgttgatgcggcgattcctcatggagtcgctcctgctctcattggcgggaggcgcactgggggcggtgcttgccgcctggggcgtgcgcgcgctgctcgcggccgagccgggccacctgccacgggtcgacgaggtgggggtgaacgccacggtgctcctcttctccctcgggctctcgctgctgctcgcactggggctggggttgctgacggcgctgcgcgcggcgcggcagcccccgggggccgcgctggcgggctcggggcgcacgcacagcggaggagggagcgccgagcgcacgcgccgggccctcgtcgtggggcagctcgcgctcgcattggtcctcctggtgggcgcggcgctgctcgggcggagcctgatggggctgctctcgctggacccggggtatcgcaccgaggatgtcgcggtgctcagcctcgtgctccccccggcaaaggacgaggcgcaggggcggcacaacgtgcagttgcaggagcacctcctctcgcgactggcggcgctgcccggcgtgcgcgcggtgggcgccgtgagcagcttcccgctcgagggaagcccggcgggagatggcaccttcatcgtgctcaaccgccccgacgaggtggggaacttcgaggacttcgggcggctggcgcgcgagcccgagcgcaccggctccgccgagtaccgcgtggcgagcgagggctacttcgccgcgctcggcatcccgctcgtgcgcgggcgtctgttcgatgcacgcgacaccgtcgacgcgccgcacgtggccgtcatcagcgagtcgctcgcgaaggcccgctggccccacgaggacccgctgggcaagctcattcagttcggcaacatggacggggacctgcgtcccttcaccattgtcggcgtggtgggggacgtgcgggagcaagggctggatgacgcgcccaggcccatgttctatggcggctcccggcagcgtctgcgggcctcctcccgcttccacctcgccgtacacgggccaatgggctccgctgccctggtcaccgcggcgctgccggtgctgcgagagcttgcccccgagctgccctcgcgcctgtccacggtggagggattgctcgcgggctcgctcgcccccaggcgcttcagcctcctgctgctgggcgccttcggtgcgatggcgctgctgctctcggtggcgggcctcgcggccgtcgtgtcctacgcggtggcgcagcgcacgcgggaattcggtatccgcttcgcgctgggcgcgacgacggaagacgtgctggggctggtgctccggcaggcggcgcggctcgcggggctgggaatcgtgctcggcgtgctgggggccctggggctcagccaggtgctcgcggggctcgtgtacggagtgagcaccacggacccgctcgtcttcctcgtggtggcgctcctcctgctcggcgtggcgctgctcgcgagctggctgccggcccgacgtgcttcgcgcgtggacccgatgaccgtgcttcgctcggaggcctgaagcgcctgtgcctgcccgaagtctggctgctgtgcccattcgcgcatcacggagggttcttctcatgtctcccgtcgctgtctcgcgcagggcccttagagcaca

SEQ ID NO: 516 - DNA, 3132 bp, Myxococcus xanthus
cccgtgtgctctaaagggcatgttttattccgcgagggcttccttcccgcctgctcactcgctgcacggccgcagggttccacgaggaacgcgccgtctccagcctgggggcgccgtggccacggcggggcggaacaggtgcggcccggtgggggccctacggaccggcggctcggccgcatcattatatagggggctgacacgggccctccgtggccccgttcgactggcaccccggcgcaccgcctccttatataaggaggcacacccggccagcctccaggcctcttccgggcacccgccaccggcctccaggtccgcgcaaacccccgagaagagagcagggaagcaaggctcgccgtgaatttgatccgataccaaaccgcgtgctagcagcgtggatcagcgcgcaaccgtgcactgcatcacgcgcggggccctggcctacggccggggagagagaggatgggccaccgtgggtcgtatcatctgcatctccaaccagaagggcggcgtcgggaagaccaccaccgccatcaacctcgccgcgagcctggcctccgcggagcgccgcacgttgctggtggacatggacccgcagggcaacgcgggcagtggcctgggcatcaagcaggacaacatcaccggcaccatctacgaagcgctgctcaatgaccggcccatccaggagctgctccaccccacggagctgcgctacctccaggtggtgcccgccacgccggacctcaccggcgccgaggtcgagctggtcaaccaggacaaccgcgagttccgcctccgcgacgccctgcgcccgctggctgccgaatacgactacatcatcatcgactgtccgccgtcgctcggcctgctgacgctcaatgcgctggccgccgcggactccgtcctcatcccgcttcagtgtgagtactacgcgctcgagggactctcgcagctcacccacaccatcgacctggtgaagcagggcctcaacccggacctgaagatggagggcatcctcctcaccatgttcgactcgcgggcgaacattgcccaccaggtcgtcgaagaggtgcgcgggtacttcaagaagcaggtgttcgaggtcatcgtgccgcgcaacgtgcgcctgtccgagtgcccctccttcggaaagcccatcatcctgtacgacatcaagtcgaaggggtgtgagagctacctcgcgctgggccgcgagctgatgaagcgggacacccccaagagccctcgcaggcgcgtggcttgagccgcgccctggctggagtcacgacgtggtgaaagcagacatgcagaagcgggccctggggcgcgggctgtccgccctcatcccccaggcgggcgccaccggggccggcaagggtgagcaggcccccaaggccggcgtcctcaagctccccatcgagtccatccaccgcgacaaggaccagccgcgcacctactttgacgaggagaagctcaaggagctctccgaatccatcaaggcgcagggcgtgctccagcccatcctcgtccgcaaggacggcgacggctaccgcatcatcgcgggcgagcgccgctggcgcgcctcccaggccgccggcctcaaggaagtgcccgccatcgtccgcgacgtgacggaggtccaggccttcgagctggccctggtggagaacctccagcgcgcggacctgaaccccatcgaagaggcggagggctacaagcgcctggtggacgagttcaagctcacgcaggagcaggtcagcgtgcgcgtgggcaaggagcgctccacggtggccaacgccctgcgcctgcttgcgctgcccacggacgtcaagggcatggtggcggatggttcgctcagcatgggccacgcgcgcgcgctcctgggcgtgccccggctgccggagctgcagaacctggccaagcaagtcgcggacaagaagctctccgtgcgtgacacggagcggctggtccagcagagtcgctccagcgggaagaaggacgcgggcaaggcggcaccgaagcagagcccgcaggtgaaggcactggtggaggagcttcagcggcgactgggtaccaaggtccggctcaccgaacgaagccccggaaagggcaccatcgaggtggacttcttctcgtacgatgacctcgaccggctcttgaagcttctcaggaaggagtaggacgtggcgctccttggcgggaaaaaagacgaatcatccagcaagcctctgttcaggcgggaggaggaatccgtgtcgcagcgttctggtgaggtccacacgctcctgggcaaggggagcgagttcgaagggaagctgaccttcgaagggcaggtccgtatcgacggcaagttccaggggcagatcatcaccaaagacgtgctcgtcattggggatggcgccaaggttcaggccgaaatccaggctggcaccgtcatcatcaacggccaggtcgaaggcaacgtgaaggcgacgcagatcatcgagctgaagacgcccggccgcgtgaagggcaacctcgagacgccgtcgctgtccatggaccgcggtgtcatcttcgagggctcgctgaagatggagaacctgggcaccgctggcgcccggccgcctccgcctccgggtggcgagaagaagtagacgtgcgttcctggaagcacatggcgccagcttcactgctggcgctcaccctcctgggcggctgcaagggctgtggccaggaggatgctgcttccggtaccggagaggatgacggccgtccgtcctccatccgctccggtgtgaaggtgccgctgccggatggctggtccgcgctggtcgcgccggatgagagcttccaggcgggcccgcccggccggcccgtgttgcgggtggacctgcggcgcggggacggcgagcagctgccctctgtggacaccctggtcgaccgcgtccgcgaggagctgaaggacttcgagctctcgctggaccaggaagaagagacggagcgctactcgctgctgcgcatcaccctggcgcccaagctggcggatgggggcgtgggcccggaagcccctggcttcttcggcgcgcggcgcgtgggcaacgacttgttcctctgtgccagcatgccgggcgcgtcccttagagaacg

SEQ ID NO: 517 - DNA, 2670 bp, Myxococcus xanthus
ctctgtcgacgtgaatcgcttcgcgcccctggcggagcggatgcggcctcgcacgcctgacgagttcatcggccagtcccacctgctgggcccgggccgtccgctgcgccagctcatcgagcgcaaggccatcgtgtcctccctcttctgggggcccccgggcgtgggcaagacgacgctcgcgcggatgatggccaccggtgtggacgcggagttcgtcatcctctccgccgtgtcggacggcatcccccgcatccgcgaggtggtggccgaggccgagcgcctgcgcaaccagtacagccgccgcaccgtcctcttcgtcgacgaaatccaccgctgggcgaagaacgtgcaggagcaggcgctgccccacgtggagagcggcctcttcgtcctcctgggcgccaccacggagaacgtcagcttcgaggttcgccccgcgctcgtcagccggtgccgcgtgttccagctcaaggaactcaccgtcgcggacatccagtcggcgctgacgcgggcgctcggtgattcgaagcggggcttgggcgcgcgcaacctatcggtgggggagggggcgctgacgctgctggcgaagggcggcgtgggcgacgtgcgcaaggcgctgggcgcgctggagctggcggccagcctcaccgcggacggcgcggagattacgcccgagacggcgcgcgaggcagtgggcaccagtctgtcccgtcacgacaaggacggcgaccagcactacgacttgctgagcgcgctgcagaagtcgtgcaggggctccaacgtccagggcgccgtcttctgggcggcgaagctgctccagacgggcgacgtggcgtcactgtggcgacggctcaaggtgattgccgtggaggacgtgggaatggcgatgccggaggccatcagcgtcgtgcgtgactgcgaggaggctttccacgccatgggcatgccggaggggcgcatctgcgtggcgcacgccgtcgtcctgctggccacggcgaagaagagcaaccgtgcctatgcggcgctggacgcggcgctggcggcgctccaggagcatcccaacgcggagcctccgcttcacatccgcaacgcgcccaccgagctgatgaaggagctgggacacggcaagggctaccagacgccctggaacttcaaggaccactacgtgcccgggcagacgtacctgcccgccccgctggagcgttccgtcttctatcgcccgagcaaggaaggctacgaggcggagattcacgagcgcatgagccactggtggcgcgaggacaaggcgtcccgaggcgagtagggcaggcagcccccgcgggctggattctgccgtccggtgcgcaatgctcctgggcagtagtgccggttgttcatccagagacgccctcccaacttgttgctcaatgagcacacggcggttcgccgtctcagagggggaatcatgatgaacactcgcaggtccacgttggtgcatggtgtgttgtccgcggcggtcgcggtcctcgctgttccggtcgccagggcggcaacgccgcccgcgcctccggctgactgctcagtggcgggcggctacacacaacgcaacctcgtggccaacagtccggcgcttggcgccgagcatgtcgatccgcacctcgtcaacgcctgggggctggccttcaacccgatgggcatcgcgtgggtggcgaacgagggcacgggcacctcaacgctgtatgacggcaacggggttcagcagtccctcgtcgtgggcatccccgcgccgccaggagtgactgagtcgggagagcccaccggcgtggtgttcaatggctcggaagcattcgtcgtgacagggacaggtgtctcggggcccgctcgcttcatcttcgccacagaggagggcgtcctggccgcctgggcacctgcggtggacgaggcctcggccaagatcgtggcggacaactccgcgatgggctctgtgtacaaggggctggcgatggccggcaccggagcggacgcgaagctgtacgcggcggacttccggaacggtcgaatcgacgtcttcaactccagcttcacgcccatgccgatgccgggcgccttcgcggacccgtctctgcccgccgggtacgcgcccttcaacatccaggacatcgagggcaccctctatgtctcgtatgcgcagcaggacaaggagcgtacggatgatgtccccggcgcgggcgcgggctacatcaacgccttcgacatgaatgggcagttgctgcggcggttcgcttctcagggcgcgctcgatgcgccgtggggaatggccctggcgccggcgggctttgggcagttcagcaaccacctgttggtgggcaacttcggggatggcgccatcaacgcgtatgaccctgcctccggcgcctgggcaggcgcgctcactcggccggacggacaccctgtcaaggtcgacggactctggtccttgcacttcggcactggtgtgcagggcctacccgccgagacgctcttcttcacggcggggcccgcggacgaggagcagggactctatggccggctcgacatgacgcccgtgtgtccgcagggcggcctgcccccgtggaaggcgcctcacgagcctgaggcgcagtgagcgggatgcgggcatggcggcgcgggccggagctgtagagcaca

SEQ ID NO: 518 - DNA, 3390 bp, Myxococcus xanthus
ctctcaagcaattggtgggcgccgctcgcgcccccgcagacgctggagtacgggccgcgtgagacggcgacgccggcctatgacgccgtcagccggacgaccgtcgcgctcacgcgggacgggttcgcccgcggcgtgggtcccgacggccaggtgaagtggaagtacaagacgggcagccgcttcaacgccggggcccgggtggtggacggcgtggcctatgttccgggcggggacggcgtgctgtacgcgctggacgcggcctcgggcgaggagaagtggaagtacgtcgcgggtgaggccctggccacggtgcccgtggtcgcgaatggcctggtgctcgtggcctcggagagcgacacgctcttcgcggtgaagatcgcggatgggcagtgggcctggcagtaccgccgggatccgcccaccggcttcaccgtccgcggcgcttcgcggcccctggtgcgcgaaggcgtggcctacgtcggcttctccgacggcttcgtggtggcgctcagtgtcgacgacggcggtgtcacctgggagcgctcgctgtccggcgctggctccgagttcctggacgtggacagcagcccggtgatggacgccgccgggcagctctacgtcgcgtcgtacaagagtggcatcttcgcgctcgagtcggagtcgggcgacctggtgtggaacaccgccgtggccggcatgacgtcgctgctggtcagcggccaggtgctcttcgccgcgggtgacggccgtgtggatgcctacctggcggagacgggacggctcctctggtcgcatcccctgggggaacgggcagccttcgctccggtgttcgcccagggaatgctgctcgtgcccacgtccagttcgctgctgttcctggagcccaagacggggcgctcgcgcgtgtcgtggaaccccgggagtggcatcaccgcgccgcccttcgcggcgggcaggcaggtgttcgtgctgtcgaacaacggctacctgtactccctgaacatgaacgggattgacgggtgatggttccggctcgcaggacggtccgcgtggtggcggcgctgattccgcggccggaggatggacgccagttcctggtgcagcagcggctccccggtggaagccgcgccttgctgtgggagttccccggcggcaaggtggaggccggggagacggacgcggccgcgctggcccgtgagtgccgcgaggaactggacgtggagctcgccgtgggccggcggctctgggagggccagcactcctatccggacctgacggtggagttggtgttgttcctggcccggattgtctcgggcgagccccggcccctgggcgcccacgcgctggcgttccacacgccggcgcagatgcagtcactgccgttctgcgaggcggacatcccgctcctggacgacctggtggcgggaaggttgggcgcgctcgattgatgctgcagcggacgttccagcacatcccaaatgtcggtccctggcgggagaaggatctgtggtcccgcggcatccgcacctgggatgactttccggaagctggccagggggtggcgctcaaccggaagtccgacgacgtggcccgggcgcgcatcgccgaggcgaaggacgcgctggcccgccgggacttgcgcaagctcgcggagctgcttccgggccgggagcactggcggctgtacccggagttccaggacgacgccgtctatttcgatatcgagacggacggccgggaggcccaggcgcccacggtggtgagcctgttcgattcgaagggccttcacgtcttcatccagggccggaacatggacgcgctgccggaggccatggcggcccggcggctgtgggtgacgttcaacggctcgtgcttcgacgtacctgtcttgcgtgactactttggccccgcgcgatttccggtgccggatgcgcacatcgacttgcggttcgtgacgcggcgcctgggcatgggcggtggcctgaaggaaatcgaagggaagattggcgccgagcgtccgccgcacatgaagggcgtgaatggctacgacgcggtgctgctgtggcgcgcgtaccagcgccgcggcgatgtggaggccctccggttcctcgtcgagtacaacctgtacgacgcctttcagctccggacgctgatggacgtggcatacaaccgcggcgccgacgacttgaaccaggatgttccccggctgccagtcttcgagcgtggcgacgtgctttacgacgtgagccgcatcatcctggagttggggccaaccgagcgcgatgctgcagacccttgctcgcgtccgggccatggagcagggcggctgagcgggcttggtgactgtgcccggttcaccgtcctggcagcggccgtgcaatcgcgagtaccggacggtgaacacctgtgcgtgcgacgtgtcgcggtttggtggaatgacctggggaggcgtttgtaggttgaagggtccacctacggaggaatgaatgaacgacccgacgaatccgacgccggccgaggttcccgaatccgctcagagctccaagagcaagacgctggccgtcgtcctggggctggcgggccttgcgttggtggcgtcgtatttcggtctgcggcgtcaggaatcactgcccgtggaggaggtgcccacgattccgatggagcctgttggcgagacggccgcggcgcccccggcgatgcccgaaacgtcgctgccggaacgggacgccgaggtccgcagcctggcgagccagctttcgcctgaccccgagctcgcgcggtggatggacgaaaaagacctggtacgtcgcttcacggccgcggtgaacaacatcgcggagggttcgagcccgcgcacggtgctcgggttcctggcgcccacgggggctttccaggtgacccaggtggacggcaccacggtcatcgatccggcaagctacgcacgctacgacaccgtggcccgcgtgattggctccatcgacacgcagtccgcggccagcgtgtaccgtgagctgaagccgctgattgaccaggcccacgcggagattgcgccgccgggacagacattcagcagcgccttgagcgcggccgtccaacatctgctcaaggtgcccgtgcaggaaggtccggtggaggtcgttcccgaaggcgcgctgtatgcctatgcggctccggagttcgagggcctgagccccgcgcagaagcatctgctgcgcatggggccccagaacatgcagctcatccaggccaagctgcgggaactgaagagctcgctgggtctgccgccggtcgcggaccgctgattcaaagccagtcccgggccgcccagcctcaacggcgtttcttcttgccggcgggcttgggcggaggggctggcttttccttttc

SEQ ID NO: 519 - DNA, 4219 bp, Myxococcus xanthus
  unsure (1)..(4219): unsure at all n locations
cacgctggcgcagttcgggggcttccacttcgtcacgaagctggagccctctgcgccggtggtgcgtgatgcgacgccggctccggacgcgcgcttcgtgccgctggggagcccgctgcgcgtgagcttcgaccggccgctggacccggccaccgtcaacgcgcggacggtgggcgtcgagggcgtcacggggctggtcaactacgagtcctccacgaacacggtggtgttccggcccgtgccgcccttcgcgcccgccacgaactacacggtgacggtgaaggacgtgcagacgccgcagggggcgggcctcgcctcgccgcacacgtacacggtgcgcacggtggctcccggagtgagggtgagcgcggggcgtcccggtcagccggggatgcccgtgttcgccacgggcccccgggggacgctggccgtgtggaacgaggacacggggacagccatccaggtccgcgcggccttcgacagcggctcgggcttcggggactccgtcctggtgggggaggggcgctcgatgacgctggcgccgcaggtgtccgcgtggggcgagcgcttcgtggtgggctggtcggaccgctcgctcgcggggggcgccgtcgcgctcttcgatgggacggacttctcgcccgtgacgcccggcatcagcggccggcttttcggggtggggaaccatctctatgccgtcaatgggaagaccttccgggtccatgctgggacgcagtggtcggaggtcttcacggcggcgaacctggggtcgcccgtgttcctcctgcagaatggagaccgggtgctggtgtcgtcggggcggaacacgacgttggaggtctcggtcgtgttcgacggggtgcggtggctggagtccacggtgtcgtcctcggtggacgcacagtacatccgggtgggggacagcttcgggcgggcgtgggtgtccaaccagggagtggagttcgcgctcttcaaccgggacacgcgcgagtgggggctgggggagctcatcacgtccgagcagatgacgagcctgcgcatcgcctcggatggcagcaccatcacggcggtcctcggcgatacgggtgggcttttcgcggcggtgcgcgcgaacggggcatggcaggccccatcgctggtggacaacctggcggttcgcgacatctgggcggtggtgccccaccgaggcaactacgtcgcgttgtggaccggcatcaacagcgccacgctggtgcgcgccgtctcgcagacgggaggctcgtggagctcgacctcgaaggccgtggtcgcgtcggggttgagcagcgtgctcgacgtgcgggcgtcgggggatgacctgctggtcctgatgcagaagaaccagccgtcgtccacggctgaaatctggggcgcggcgctcacgtagcaggggtggcagccgagcatacagcttcgtggacgggaggcgacttcctcggtgttggtgccggtgggggctcgcacgggtgcgctcttcgtgcagccggggcggctcgtggtgcgcggctatctgggaggcggccagtgggactcggggcttgagctggtgacgccggcgctcgtcggcagcgtgcgggacgtggccgtccacttcgagtccgacggccatggggccgccgcgtgggagcagttcgacgcgggggcgtggagtctcttcctggcggagttcgacgggacggtgtggatggagccggtgcgtgtggggccggcgggcacgaaggtccgcgtggcggtggacgacaacggggtggtggtggcgtatctccagccgtccacgcagacggacctgatggacatctgggtggtgtcctccgaggcgggggtggtgggggcgccgcaactgttggacagcgtggcggccacggacccggacctggcgctggtgcatggccccagcggcttcatggcggtgtggggcgagtgggagattcgcggagcgcggagcgtggatggggtggcgtggcgggacctggcgaccctcatcccgagggtgttccaggaggcgcgttggtacaacacgcggctggtcacggtgggtgagtccttcgcgctgtcggcgcagcgcaacgagctctacctgaacatgagcatccacaccgcgggcgtgtggcagcccatcgcggccccggtcatgcccagtgacgtctacgagttcgtcgcggcgggcaactcggtgatgttgatggcgcccttcgacgacgagttccgctacatcttccacaacggcatcgcctggtccggccagaacatcgtcaaatcgccggcggacggccaaggtgtgctcgcggcgtctccgagcgggttccggatgcacaccgacaagagctggtggcggtggagcgggacggagtggctgaaagaggcgacggatgtcagccgtccctattgggggggcagcctgcgctgtgacgcgaagggctgcggtctggcgacgggaggcgcgttcaatatgccggtgaacctggcgctgtcctatgcgccgggcacgcgctctttctggacgggggcctcgcccgcgcagggagacttccccgtccaggcggggagtgtgacgtgggacttcgtggcggacacctaccgcgtcacgtggcgccagcccgtgcagcagggtgtgctcgcgctgcacgccagcacggccctgtgagggcctgagtccatgaggagggggcggtggatgtgttcccgctccgtcctcgtggcccgaagtccggagccgggtgcttcacctggggagaggtgaggcggtcccaagaggaaacacgcatcacaccggggcgcctcgcgggccccggcgttgacgtgtcacgagcccccgcaaacgcgtcaacgcgccccatcgcaagcggacccatcggacacaaagccgcagaatgactcgaaccacccgcgaggctcaggtggcacgcgtcctgctctggtgacgcactgcccccccaacaccagaccttcgcatggcgcgaaggtatcaacgaggacgtttcacatgtgcactgattatctggtcgagaccgaggactcgagtgctgtcgtcgttggccgcagcatggagttcggcatcgacctcggttccaagttccggttccacgccaaggggcatacggtccagtctccgggttccctcacgcacctgcatggcctcaagtggacgacgaagttcgactacgtcggcctcaccgtcacgctctatggggtcaccgtcatcggcgatgcgatgaactcggaaggcctctccgccggagcgctgtggatgcccacgtccacgtatccccaggccgccaaggacccgtcccggggactggcgcccgagctcttcgtggagtgggccgtgggtaacttcgccaccgtggacgcggtgaaggaggccctggcgaacggagacgccgagctgtggcacagcgactggatgtcgagcaagattccgctccacttcgccctccacgacgcgaagggcaacagcatggtcgtcgagttcaccgaccggcagatgttcctgtacgcgtcgacgggtcatgacaactcgccgctgaacatgcacaaccccgttgctgtcctgaccaaccacccgaccttcccggaccacctggagaacctcaagaactacgcgaggctgtcgtcccgtggcgccacgcccgtgaagctgggaaccggcacattcgcacctcacggctgcggcagcggcctcttcgggattcccggcgactccacgcctccctcccggttcgtccgggccgtctacctccgtgagttctccgagaagcccaagaacgcggccgaggcccgctccctggcgctgcacctgctcaacaccgtcgacatcccctacggcaccagccgcgacttgaacgaggccacgggcaaggactctctcgactacacccagtgggtcgtcgtgaaggacctcacgaaccgcacgttcggcgtccggacctacgacagcctggggctgcagacgctggacctgcgcacggtcgatttcaagaaggcggatggcaagacgctcgccgtctccccggtggattcgcagctcgacgccaacaagcagctggcgagctgagtcactgactccccctccgtgggcngggccggacaccatgctgcaaaaggatgccgcgccccttggacgatgggttcactcccaacgtcgggcgcatgcacgcaatgctctccccgagggccgtcgtgaagggctcacgcctggttc

SEQ ID NO: 520 - DNA, 3345 bp, Myxococcus xanthus
ctctcaaggatccgctcatctacggcgcggtgctggcgctcctgatggccattcgcgtgggtgaagccatgcgaaaactccgggcccgcgccgctgcggcggcccggaacccggcgtgagtgaagcggggcccagacgggcgcggcgcgctacttgcgcggcagcgggaggatggtgtccaccagcgtcatgagctgcgcgcagctcaccggcttgcggacgaaggcgctgatgccggccttctgacccagcgcgcgcacctccgccacgttcgggtcgcccgtcatcatcaggatgggcaccttggccagacgcgggttggcgctggcgcgaatctgcgcggcgaagtccgcgccgttcatcccatccatgtggaagtccgtgaggaccaggtccaccggctccgcttccgacaccttgaggccttcctcggcggactccgcttcgaggaactcgaagttgcgagccatgaggtagatcttcagcagcgtgcggatggagcggctgtcatccaccaacagcacgcgctgcggagccgtgcccgtggcggggcgcgcgcccagggggcgggtcgtctccgtcgtgctgcggagggggaggggctcggggagggttccggccttcatcggatcatcaacctcaattggggcagttccccggggaacggcgatcatgttggcggatggagcgtccgaagtcaaagcaccgccactcagggaacctccaggaagaaagcctgactttccacagcaggaagccccagtccagacgcgagggcgggtgccagttcattgggcacacgccatgtctgtccactgggttggatcaacaccaccgcgtagcgacctcggggcagctcacgcagcggcacggggttggtaggtacccgggcatccagtgcctggggtcgcacttccaccaccagctccggaacgacggcgccttccatgcgagggttgccgttctcgtcggtgagcgcggcgctgatgctgtctggcaccaggcgcgcgttgagcacgacgacatccggtacgccgtcctgggaaccatcggcgcgggcgtagtccacgccggtgtcatccgggacgccatcacggtccaggtcgttctcgtccaccaggttgctggcgtcgtccgccagcttgcgcacgaccacgcgcggccagaagccatcgggggtgccgtcgttgtctgcgtccaggtagctgacggcgaagccttccgggcgctggtccaccgcgccgtcgtggagggacagcggctggaggcgcagctgcttcaccgagctgcccagctgcccgtcaccctgcacgacctggaacgtgggccggtccctcacgacgcgcgcggtgtcggagaagctcactgccacgccggtgaggggctgcggctggccgtccgcgtccgccacgacttccaccgtgagcggtctgccggtcgcgtccaccgctgcgccacccacgtcacccgcgttgggctcgctggtgacgccgtaccaggggttgaagtcggaccggcggcagtccgcgcccgcatccgagccgcagccgtccacatcgatgaagccgcggagcatgtagcggccctcgggcaccaggctgaagctgaagggcgcgacgaaggggccgggcgtgtcacccgccagcgccggcccgaagagctgctcggcggggacgacggtgaaggtgatggggcggccggtgccctgcggcggcggaggccggtccgcgtcgtagaggaacaccaccgcgttgccacgcgcgcgtgactgcaccaccaggttgccgtcgatgcgcgcgttgcgcgtgttctgccgcacgtcggcggtgggcaccacgggcggtgcatcgcagccgagtccgatgacggttgcgagggcgaggccaccagcggctcgcttccaggaggacagggtggggcggctcatggagtcaccgtcagggtcgcgtagacgcgccgctcgatgcgattgccaaaggggtgctgggaatgcgcgccgcccaggtggctgcccaccagcgcgacggtgacggtgtccttgacggccatgtagcccacgcgcgcgttcaccacggtgtaggcgcgcagcgggttggacaccagttcgatgcgagtggggtccgcggcggcgggctcgcgctcaatccacgtggaggcggaggtgtaggccgcgtccacgccgaactccaggtccgcgcgtgagcggtaggtgaggccgccgtacagccggaactgcggcgcctggttgcacgggccgcactcggccgccgactcgcggtccgacgtcacgtcctgcagcgacgcgctcaacttcagtcccaggccgtccaccggcgccagggtgacgcccgcttcggcgccgcgcgcggtgtagatggcgtcctcgttctggaaggacgaactgcccagcaggtacgaaccggtgcccgggtcatacgactggcccggcggcagccgcgacaccccggacagaccgatgaggtctctcaccgtgttctggtacacggccacgtccaggtcgatgcccagctccggggcctcgccgcgccagcccagctcgaaggcggtgaggcgctcgggacgcagttgctgattgccggtggtgagcgtgctgacgccgttgatgcccggcacgggcaccgtcagctgcgtgtagctctccaggaacgtgggctcacggaaggcggaggccgcgctcgcgcggaaggcgtggttttcgaaaggcttgaacagcgcggagatgcgcggcgagtgcgccaggcccgggctgcccaggttgagcagcgggtgccggtccacgcggtagctggccaccagcgccagcggctccacgatgcgccactcgtcctggacgaagaaggccgcgtgcacctgctcgcgcagcgggcccaggtagtctccccagtccacgcgcttgaggcggccctccacgccgatgttgagctggtgcgtgcccgcgagctcgaagtcgcgcgcgaagagcagctcggcgttgaagaggttggagttgagcgacgtcaccagcgaccgctggcccgtggcttcatactggggccctgcgtcgctggagatgtggttccagaacgtcttcagcttcagcggccccagctccacgtcgcccttggcgaaggcgttgacgccgtcgatgaagtagttgcgcagcaggcccggcggatagatttccgtggtgaagcgattcacgccgccggacaggcccacctggcgcccttcggcgaaggtgtacacggcggacagcgacgcgcgcgcgccgcgagcgcccaggtccgggtcggggccgcgcagcgtcacgtccggcaggccgctggcgtagtcccgactccactt

SEQ ID NO: 521 - DNA, 3373 bp, Myxococcus xanthus
acgcgcacgtgctcaagcgactggccaaggcccaggtgctcatcctcgatgacttcggccttgagccgctcggcgctccggagcgcaaggagttgctcgaagtcctggaggaccgctaccagctcgcgagcaccgtggtgacatcccagcttgagccgaaagactggcacgccgtcatcggcgacgcgacgctcgccgacgccatcctcgaccgtctggtccacaacgcccatcgcatcaagctgggcggagagtccatccggtacgtggagacaaatttgacgaagggccgcaagcaggccaagggatgaaccacccagcgtcgctgacgctccgaccgctcgccatcagccggaatcgctgctcggcttgagccggaacgagtgctcaccatgaccggaatacgcagccgtagtagcggcgggcaatcacgcgctcgctacgaagccggaccaggagcgcttcagcctccagctgaggcagagccgcttcgggttgtggatcaaccaggacggcgccgtgcgcggccaggtggagctgggcttcgtggacttcgccaaggccacgcccaccgtgcaggccctgccgcgactgcgcatcgcgcggacggaaaagccgcgtgggcgtgagcgcgctggccacccggctcaccttcgcgaggactgagggctccgagggcggtgaggcgctcgccgcccatgccgacctcttcgccgagcgggcgcaatccccaagcgccgcgctccgggtgaagcaggcgttgtgccgagcctggcgcagccacgccccacaactctctgccgccctcctcaagcaaggcggccagggacgtcagcgcgcccgcgttctggcggagggcttcttcgcggtgctcttcttcctagccgaagcgaccttcgccttcgcgactgccggcttcccttcgccgcgcggtgccttcgcctttgcggccgcctccatcgcttttcgggcttcggtcttctcgcctttccgcaacgcgagcgccgcggagatccaatccggtgcgtagctcgaagtgcatcccttcggaatcggtcgcgggtcccagcgaccgaggcgctcgccgatggcgatggcctccgaggtgtacgcgggcaggtggaggccgatccagaccaggcagaagttgatgccctccttcacccggtatggtgcatccggaagctcacgctcgatgcgctcgagcgtcgcgcctacgtcgagttccttctcaaggcctctcgcaatgcgcccagcaagaagcttccatccggcgcggcgagggagctccttgctgccgtccatccacttctcctgaagcttcggggcgacgggcgcatgtacaagcacgcgaccgacgagttcgtcgaccagagtcgggttcgagagtggctcgaggagcccgcgtgcctccttctcagtgagcgccgcggggtcgaggagcatgcacgcgaggatgcgcgcatcgtgattgccggtcccccacagctccagtccgagcccgtggttcgtccccaacgtcgctgccaggccacggatttttccgagcagcacaccgaagacattgtcgaccaccccgtcgcgcacgtagcgctggcgcaccttctcgtcaccatggccctcgagcagcttcatcacctgggacagcgacattgttttcggcatgggcaacacctcgacgggcggtggcttgagagcggccggaagggtggcaccacaggcgccctcggtcgagaaccacttccgctcgctgccaccgcgcagcttcggaagcgagggtgcggccatccggatgtggcaccgtagccacgggaaccgaaacgatgccaccaggcgcgcgtacccagcgcgtgtagaggcccaccgccgggaaatcatcctggcgagcgagcccccccgccgctgtcgccactcaaggcggaagcgaaggacggacaggcgccctggcgaggttcggggtcgccaatcgccacccatgcgattggtctttctccttcctggaactgttctccgccctcaggcactcgatcctcgtataggagtacgagatatcgagcagatgcccgccaccatcgaactgttggaggtggcccccaccacctggagttctacgagccgcaggagtacgagcggctggtaaaggcggcggcgaggcggggctgcggaaccggggaaacttcaccgtgagcgtggaggacagccgcaaagatgagggcgacgcggagccccgcaaggtcaagcaggcgttcagccatgaagaatccgttccctcctgcagggaattccaggtcctgccctccgaaatgctgtgagacaacggcaaggaatgcgcctgaaccatggatgaactacttgcactgctcgggcgctacgctcccggctccagcggtcaaatcgaaggctacccagactttatcgtggatgaattggaggacgtcttcggtcgtccgctcccagccgtctaccgtctcttcgccgaggtcttcggttcgcgtggagggccgctcctggcccatgtgcgctccttcgaccccatcctcgatgtcgccgaactctatcgggtcgcgcccaagggagagctgccccccaggcgttttctcttcatcttcggagaccccgacccgctggccccccatcattactggctcgatctggagtccccttccgaagaaggagactgtcaggtcgcgcgcatgccctttggtgcggacgcatggaagacaaagctgcaccgggaggccatcagcttccgggagctgctcttcctctgcgccatggagcacgtccacctgcccaccctccctcatcaagccagctatatgcgtagggaggggcactcgactcccagcgccgaggacctcgcgcgtctcatcgagaagatgggcttcacccggctcccctatccccgctacagcctactcttcgagcgggagggggccgcagcacgactgtaccgccctcctgatagcccccacttcaaccttcgcgtgggcatgcagtgtcccaaggagctggagcgattccagatgctccttgaagacaacacggacctgcggaagtccccattctaacactactgcgtcaggggtaggcagaagggagagtgggcgacggagggctgggcgggcaggccctcattgcattggccgccatccgccccactcatgaagcaggtatggactccttcatgaacgccgccgcggtgcagcggcttgagaggtatttccagcaaatcggcgaggtactcggcgaggagagccgacgcggctcgttcgccctctacgccatgggtctgctgggagagggggagcgaaagagcgtggagcccatcgccgctcgcgcgtgtccggaccccgagcgagtggatgccatg

SEQ ID NO: 522 - DNA, 2813 bp, Myxococcus xanthus
tgaacccccaggcccggggccgaccctccctgggcctggagtccttcaaagctcagctcttgttgtgcgaggagccagacgagttcgccgcggggttcccccccgtcgagttgttcccgctgttgctgctcccgccattggggttgttgcccgactgccgagggctgttggggttcatttggttggagcggttgtcctgcgacgccttgtgcgcggggttgttgggattcttggagttggcgcgctggtcgttctggttcttgccgctgtccttgctcatggacctacctcgggagtccccaagcgaaagtgccggggaggcctgaaactaggaagcggcccaggtggaaacactcgtgcggaggtgttcgtccggtgtcgggaagcacacgacatcgcccggcgtcggacacggaatgcgcgagccgcggctttgcaggatgcggcggcgagcaagggtgcctacctcgtgccccaggaggtgacgcggcgtgaggacggtcacgtacgagcgcagtgggcgaacgaacacgggcgcacaggcgctccggctggaaggaatgaagcacctgaaggtgctggagcagggtgaggtggtcagcgagcgagacctcacgggagcggaaatccaacgtctgggcccgctcttcgaacaagccagccgcgcccccgcccccgtcgtcatggttccgcaggcaggtgggccagacggtctcgcggtgacgctcgcgttcgaggacgaagagtctcctcgcgtgcgcatcgcggccgagcggcttccggcccagggcgctggccccctctatgacgccctgcttgaggaactggaccgcctgctcacgaccgagctgcatgcctgggctccgcgtcgcgcacacgcggtgctgccgcaccagttgcgcgaagaagagcagtagcgcctcagggcccaacgcctcgtgcgacccgcccaggtaagccgcccctcgggcgggcgggagcaagcccgcagccggggttgctgccgagctcggcttctgtgaagacaggagcatgaggcgtgtgcagttgtccgtgcatcgcacggtgggagaagcacggcttctggcgggtgcgctggaagccatgggagttgcggtagaggtacgcggagaagcccttgccccgttgagcggcgagattccgagtgcggagacctggatagagctgtgggtggagccgcaagacctcgagcacgcaaaaggcctcctggcggagctcctggagaatcaagagcacgccgagcggtcggtggagtgtccacggtgccgcgaagagaaccccggcaacttcgagctgtgttggagctgtggcctggagctgccctcggggctacgtccaagactgcgggcagtgtagtagcggggatgcatgatgaggcggagcgcgcctccaggagaatcggaagtgcaggaagcagagggagcgcgtcgccgcaggctgaaccgggggacccgaagcctgctcatcgtgtgcaccgtggtgacgctcatccacctcattccgcttttcatctcccggaacatgcccgagcagcggctgtccatcgcacgggccatgtcgagcgtgtcgcagcgtgtccctttcctgcggccgatgaaggacgacgccaaggccacgccggcggagctgagagaagccgcgacgctgctgctgaatggggcgccagatgacgcccatgcactggtcttggaggcggagcgccggaatcccctggaggtcgaaacccagctcctgctggcgagaatctgcgacgtcgagcggatgagccggtgtgtgagcacggccctgtcacgagcagagacgctggccccacgagacgcgcggccggacctgctccgagcggagctacaagagaaggacggtgacgtcgtgggcgcagccgaagcgatggagcgggcgcatgaaaaggcgcccggcgacccgctggtcggactgcgctacgtccacctgctgagcgcggcgaagcggggcgaagaggcgctggccgtcctccaaaagcttgaagggcgcctgccgcatgccaggttcctggtggaacaaggcagggtgcatagccgggaagggcacgacgccgaagcggtgaagctcttccgcgcggcggtggccgaggacccgaagctcagcatgggcttcttcgagctcgggctcgcctggcatcggctgggccaggtggacaccgcagaagaggctttgcgccaagcggaccgactggaccgggcagaccccaaggcgctggcggccctctgcgcgattcaggtcgaggagcggcgcatcgacgatgcccggctcacgcgaatggaccttgagcggcgcttttccggccagccggagctgattcgaaagtcctgcagcatcccctgacgcgaaggggccggagacctactcccgaggctcgatgccgcggatctgtcggagcatgcgggcggaggccttcacctcgacgtccacggctccatcgacgcgctcggtgcgcacgacggcctgcaggtagggaaccgcctccgcatcacgcccttgatggaagagcaactcccccaaagcgaagcgagcccgcgtcagcaggacgatgtcctcggcggcgatagcggcatcaatggcgtcgctgagagcggactcggccatctcgggctggttccgggcgagcagctcacgagcacgctggatgtgttcgtcgacgttcatgcggagggagcaaggttcaacctggtagggacgcagaccgcctcgccgggatatgggtgagtgcccatggacgagaagcgaatcgccgagctggaaatccgctacatgca

SEQ ID NO: 523 - DNA, 3798 bp, Myxococcus xanthus
cgttgcttgatgctggcgaagccatcccccgccgagtccggaatgtaggggaagaggacaaccttcaacggccgtggggcctcgggttcggggtccgagcaggcgcccagggatagggcgagaacgcagggcaaagctctccattgcatggtgtggctccagtggattgagggagccgccccgcgcaacggcgggagcggtatcaagggtcagtctaccacgccacactgtccaccactcctcactcgctccggcctgcgcctggccttgacccgacgcggccggcccaccttcgcaaaccagacaataccaacactccaccactgtccctcaatcgacatgccaaaccacaaccacaaaccactcccacacctcagccactcaatgccatatacagacaaagccatccagcaacaccagagatgccccgggccccgggtggccgcatccactcacgctctgagtgactgacaggacttcacgaccgagaggggttcggactcccaatcgcgaacgcaccaccacacaacgaggaacgcagacatgatcggaaccctctctaaagtcgtgggattggcgtcattgctccttgtggccagcagcgcagacgcagccattcaaaagaagctcattcacatgaccgtctacagcgagaccggcgagagcgccgcgttccgcgccatcgatggacagcccgtcagcgccaccaacgaaacgctgaagctgtcctaccgtatcgtgccagaggtcatcgcccccgacaccgttcgctacaccatctacaatggctatgacctcgagtcggccgctcccatcgaggtcatcgaggcccgtgcggacggaaagatccaccaggggctccgcgcctccttcaaggtctccgtgacgaccgtggaagaccgagcgatggacatcaacccgctggaagccccatctgacaatgacaaggccctcaagtgctgtgtcacctgcggcggctggcgctactgctgtacgcccgccgcgggctactgctgcaccgtctccacggcgtgcggcctcggctgccgtgtctgcaattgagccggcccatcgaacctgaaccttgaacagaccatccgcgtgagatctctcctctcacgcggatggccatttcatgcaagcctaccacccagcgggagcagccaggaagccacgctgcaccagcgaggagagatacgtcgaaatcaacgtggcatccacggtcggacacgacgtccctgttcctcccagcgccttcagcgtgtgcccgctgtcgcagaccaccatccgcggcccacccacgctccggtcctcgggcggcacctgctggaggaacaggagcaggtctcccagctcacggtcggacggcgccgcgaggccgagctccgcgagccactcgtcataggggagcacgcgcagcccgtagccaaaggctcgcatgtggctccacatctcgtccgctcgcacgaactgcgggttgaccaggtggaaggtctgaccaagggactcgggacgcagggacaggtccacgatggcgctgctcacgtagtccaccggcgtcacgtccagcagcgcgtccacgctgggcgcactccccagttggacgcagcccttgagggtcctgcacaccaggtcgtccgtgttccacgcacccgtcctgctgtgccccgtcacccgccccggccggtgaatcgtcacagggagtcctcgctgcgaggcctcacgcacgagcttctccgccacccacttgctctgggcataaccgcccaccaggctcgcagccgcttccagcggctcatcctcgcggaagggaagctggcgccccacgggcagcaccgacaccgtggagacatagtgcagcggcttgatgcgcgtgcgcacgcacaggcgaagaatctcccgcgtacccagcacgttcgccgcgcgcatcgactcgtaggggtagatgaaattgacgagcgcaccgttgtggtagacggcgtccacctcctccgacagccgctggaactccgcttccgacaggcccagcaggggctggccgatgtcccctcggacagggacgattcgcgacgccaggtcgtcgcgccacagcgagtagctctccaggttcttgcgaatccgctgcatcccctcctgctccgacttggagcggaccaggcaatggatgcgcgcctgcgtcttccggcagagctcctcgagcaggaatgcgccgaggaagcccgtggcgcccgtcagcagcacggcgcgcgcgggcccggaggtggacggaagcgccgttcccggcagcagccctgcctccagcacggcgtccgcctccagctccgccaccacgtcgtggaccggcagcgagcccgtcttcgcggcctcgatggtgcgcgccatctcctccagcgtcggcgactgcaacagggccctcagcgggatgtccgcgcccgacgcggcccgcgcgaggacgagcacccggtagagcagcagcgagtggcctccgagctcgaagaagtggtcgtgcacgcccacctgctccaccccaagcacctggcgccagatgtccgccagcgtggcttccccaggcgttctcggcgcgacgtgggccttcgccgtcccggagcccacacggtccggcgcggggagcgcggcgcggtccaccttcccgttcggcgtgagcggcaaggcctccaggcccacgaacacgaagggcaccatgtactcgggcagccgggacttgaggtggtcgcgcagcgcacccggctcgggggccttcccgtcgcggcccaccacatacgccaccaactgcttgtcagcgcccgggccttctcgcacgacgacgaccgcgtcgcggatgcctgggtgctcctgcagcgccgcgccaatctcacccagctcgatgcggaagccgcggagcttcacctggtggtccatccggcccaggtattcgagttgcccgtccggcagccacctcgccaggtctcctgtccggtacaagtgcgcgcccgcgtccccggcgaagggagacgtgacgaaccgctccgccgtcagctccgtccggcccaggtagccccgcgcgacaccatgcccgccgatgtagacctcgcccggcacccccacgggcatgggctcccggttcgcatccagcacgtagacctgggtatttccaacgggccggccgatggtcggcgtctcgccccggttcacacgggtgaacgtggaataggtcgtcgtctcgctcgggccgtagaggttgaagacatctctcacgtggcccagggcgtagatggagtcaaccagcgctcccgccagcgcctcgcccgccaggttgacgatggtgaccgacgccggcaccccgccccctcgcagcagcgcgcccatcgccgagggcacggtgttgacgagcgtcacctccttcgccgcgggcagttcgggcagctccagcgcattcttcgcgacgatgaccttcgccccacagcacaggggcgtgaagatttcgaagacggacaggtcgaagcagatggacgtcgacgccagcgtccccgccaacgactccggcgagaagacactctgggcccactgcaagaaggccacggcgttccggtggtcaatcatcacgcccttgggcttgccggtggagcccgaggtgtagatgagatacgcgagcgaatcgggcgtcgtgacacgcccggggttcacctccggctcggcgccgagggcggcggcatccgcgtccagacacaccacgcgtgcctcggtggcggcaagcccccggagcagccgttgctgcctgagcagcacaggcaccctgcg

SEQ ID NO: 524 - DNA, 3550 bp, Myxococcus xanthus
gttcgacacgctcttcaacttcatccacttccacgtcgcgggagggctgtcccaacagaaggggctgcgcttcgtggacgagatgctgggcgcagcctggatggaactcccgctcggagtcaccttcacccaggacccggacacctcgtcgctgtcgatttccatctccactacgggcactcggcacgaagcggagcggacgcgggagttggggcagtactacctgcgcgcactggaagccgtggccgcgggaccaggtggccgctacgatcaggcagcgctgctcccaccggccgaccgcgacacgctgctgggggcgtggaatgccacgctccgagaggtcgcctgggaaggatgcttgcacgagcggttcgaggaccgtgcagccctttctcccgattccctcgccgtgctcgacgatgagcactcgctcacctatgccgaactcaaccgtcgggccaaccaactcgcatgggccctgcgtactcgaggcgtagggcccgaagtccgcgtgggcttgtgcatggagcgctcggtcgacatggtcgtcggcgtcctcgccatcctcaaggcaggcggcgcctacgtccctatggatccggcctatcccgcccagcgcctggcctacatggtgagcgactcaaacgtcggctgcgtgctcacgcagcagcgcgtcgcggacaagctcgccgggcacaaggtggaagtcctctgcgtggacgacgccgctcccacgaacgagccgcggtccgaatccaatccaccgaggctcagtgaacccgaacacctcgcgtacgtcatctacacctcaggcagcaccggcaagcccaagggcgtcatggtacagcatgcctcggtgatgaacctgcgcgcggcgctggcggccgccgcttacgcaggcatggacaagcccctacgggtcagcctcaacgcgtcactgtccttcgacgcctccgtgcaacacctagtgcagctcgcggacggacatgcgctgtgcgtggtgccgcaaaccgctcgagaggatgcgcgcatcatgctggcgtggctggagcagaatgacgttgacgtgctggactgtgccccgtcgctgctgcgcctgctgctggacgagggcctcgcggcccaccggcccttgcgagtgttggccgggggcgaagcactggacgaggcgctctgggcccggctctccgcccatccccgcatcgagtgcttcaacgtctacggccccacggagtgcaccgtggactccacgctgcgtcctgtgcgcggagcatccctgcctccatcgctgggcggtccgttggcgaacgctcaaacctacgtgctggacgcgtacctgcagcctgtaccggtaggtgtgccaggtgagctctacattggtggagcgggcttggcgcgtggctacctgaatcgtcctgagctcaccgccgaccggttcattcccaatcccttcagcacggcctccggcgcccgtctctatcggacgggagaccgggctcgctggttgccccagggcgaactcgagttcctgggccgcatcgacttccaggtgaagctgcgcggcttccgcatcgaactgggagagattgagtccgcgctgcgccaacaccccgcggtgcgcgacaccgtggtcctggtccgagaagacacgccagggctgcagcgcttggtggcatacgtggtcgcggagcccgcggccaccgtcgactccggtacgttccggccgttcctcaaggaacggctgcccgagcacatgatgccctcggccttcgtcaccctggaggctctaccactcaacacgagcggcaaggtggatcgcagggcgcttccgctacccgaggaaacgtctccgcggcatgaggtctacgtcccgccgcgcgacgcatacgaacttgagttggcgcgtctcttcgaggaactgctcggtgtctcgccaatcagcgcgaagagcgacttcttcgaactgggcggtcactcactgctcgcggtgcggctgctgtccatgctgcgagcgcgaacgggtcgaacgctgccagccgcggcgctcttccagacccccactgtcgaggggctggccgccttcctacggcgcgaacccgcgctttggacgccgctcgttccgattcaacgcagtggctcgcgactgcccttcttctgcgtccaccccgtgggaggcaccgtgttctgctacaccgagctggcgcgcaggctcggccctgaccagcccttctacggcttgcaggcccaggggctggagggaacactgcctccgctcgagtccatcgactccatggcggccagctacgtggacgccatccgcaccctgcaaccccagggcccgtaccgattgggaggatggtcactcggagccgtcatcgccttcgagatggcgcgcctgctccaccagcgtggtgagacggtggaggtccttgccctgattgagcccagttccacctcgctggcccaaggtgtcaccaccaacgacgactcggccgctgcaacgatgttcgcgctggacctggcgctcacggcgggtatcgcgtcagcaatgaccgtggagggggcagtgagtgacccgcaggcactggtggaacgcgtgctccaggaggaccgcgaggcgggtgttttcgtcccagacgccggcatggagcacttccacgcgctgcttcgtgtcttcaccgccaacgtccgtgcgctccaacagcacacgctgggcaccttcccaggctccctcacagtcctacgcggcagcgacaccgaactggagccttccgaggcggaagaccgcggatggagccgccatgcaactcaactggcggtgcacgtcgttcagggagatcactacaccgtcctgcgactccccggggccgatgcgctcgcacgcgtcctgaccgagcttctggcgcgcgccgatacgaccgagtcagtatcccagtagcctctgactgaagttgccccggcctggagctgctgctctacctccagcgaccgggcatggagttcgagtgtcccttcgcgtccagccgggtgcgcatgtcggagccccgggtggaccacgtccggctcggcagcatggtggccctgcgggatgtcacactcgacgacgtccggatcgacacggagcgcaagccaggagacgggcctcctgtgcgccttgctgtcgtcgagcgtcggggccagctcgcgcggctcggcggcgagccgtgtggatgccgacgctgtgcccgcggaggaggcccgagcgacttcccccgcccccgccgctgcgccccctgagcagctggccgcggacggcacacctcccagattgcgtctctaccggggcggcggccatccatgacgtccgctccgcaaggagcagcgcaatgaatccctggaaacgtttccccttggggctggcactcctcaccggctgcggtcccatgtccaccgatctggagggtccagtgaatgacggcgccgcgagcgccgcctacagacaggctggggcgccgctccggccctgctgagagacatctagcgcggccccatgggctcggacccgctggag

SEQ ID NO: 525 - DNA, 4199 bp, Myxococcus xanthus
  unsure (1)..(4199): unsure at all n locations
gcgagctggcggagtcgctgtgcgcgctcgtggagcaccatcctgaccgggacgacctgccgccccgctgtgcccagggacaagagcaatgcgccactgcccggaatgtctgcgcgcgatgcggcccctgagcggcacggcccgggtgcacagaagcaggctccgtgtttagactgcgacggttcccgctgtcctgaacgaggtcctcccgtcatgtccccccgctccgccctgctcctggtcacctcgtggctcgtcattcccgggcaggccctcgccgccgacagcacggagctgactccggagaaggtggcggaaatccgccgcgacgaggcccaggccctgtccgaggtcaacgcggagtacggcaaccgcaagtcgtcggagatgagcaccgcggagcgccgggaggccatcgacaagcagaaggccgcctccgcgtcggtgctggagaagcacggcgtgtcgggcaaggacttcgcgcgttacgaggcgcgcatgtcgccggcggacaacgcccgcgcgaaggcggaggagcagcggctggcggaggccgccaaggccgcgaagcagcccgcgcccgcggccgccccggaagaggtccacgtccagcagggcttcagcgaccaggacccggtggagttggaggccacggagggcgcggagccgtccatcgacgtcggcgtaccgaaggacgccgaactgccgcagtaggcctcttctgaacgacaggtgcgcggtggcgagccccccaccgcgcacgctgctcagcccttgcggtagccgtagcgcggggcccgctcctgccacacgccgtcatacgggcaggtgcagtccgtctcctcgggttccgggtacgtgaagcgctcgcccttgtagttgcggaacaccgtctcctgcgctccgtactcgacggcgtaatcgggctggagcgtcaccttcccaccgccccccggcaggtccaccgcgaggtgcggcacggcgaggccggtggtgtagccccggagctgctggatgatttccagccccttggcgatgggcgtgcgcaggtgctcgcagccctcggcgacgtccatctggtgcaggtagtacggccgcacgcggctgcgcagcagcaggtgcgacagctccttgatgatgcgcgcgtcggagttgagctgccgcattcaacacggcctggttctccaccggtacgccgtggtccaccagccggtcgcaagcctcgcgcgcctcgggcgtaacttccttcggatgattgaagtgcgtgacgaccaagacgggcgcgtagcgccggagcgttttcgccagggcgtcggtgaactcgcatgggcagacacacggggacgcgcgtgccgatgcgaatcatctcgacgtggggaatctcgctgagcggcgcgagcaactcctccagccgggagtcgctgagcatgaacgggtccccgccggagatgaggacgtcgcgcacctcgggatggctccggacatagtccacgccccggcggagctgttccttggagagctccgccaccccgccctgcgtgatgcgccgccgcgtgcagtgacggcaatagacggagcacgtatccagcgcgaggaagagcacccggtccggatacttgtgaacgatgcactcctccgggcgcgtcttgtcctcacccagcggatccgcgagctcgcccggacggatgcgcgcctcggccctcaccgggatggactgcatgcgcaccgggcagaacggatgctccgggtcgatgagggacaggtagtacggactgatgccgatgcggaacagtgcggacgtctcctgcacgcccgcgcgctcgttggaggtcagcggcacgtaccgctccagctgctccaggcctcgcaccgcatgccgctgctgccaacgccagtccgcccactccgcgtccgtggcgttgggaaacagccgtttgcgcccttcggcgctgagcgacgcgcgagcggccgtcggctccggcgggagacccgccggaagcactgaggtatccattacgccgccttctgctgctcccgccaccaggcctgccccgcctcggacagctggtcgatggggtcgaagtattcgtacttccggctgagcgcatccgcatcgttcagttcgatgccggtccggtagttcttggtccagtacgagatgccgcgctcgcggtcatactccgccacctggtgcacccagcgcttcccgacgaagggcacgtcacagacgatgcgcggcgtggcgaagcccggcatgtagcccatgatgtcgtgctgcagctgctgcgcatgagccaccgacaggcgccaatgctctctgtaggggatcatgtcgaacatgtacaagtagtacggcaggaacttcccgtggtcgaacaagtgaagtacaggtccagcagcgcctgcgggctgtcattcacaccgcgcagcagcacgccctggttgcgcacgtcacgnaagcccatctccagcagcttgcgcacggccttgcccaccagcggggtgagctgctgcgcgtgattgacgtgcgtgtgcagcgccaggtccacgccgcgctcgacggccttcttcgccagccggtccagcccctggaggacggagtcctggaggaaatgctgcgggatggccatcagccccttgctggccaggcggatgtcccggatgttcgggatgtccatcagcgagctgacgaacggctcgagctgctggatgggcaggttcgcgatgtcgccacccgacaccaccacgtcgcgcaccgtcggcgtgcgacgcagatagtcgagcatctgcgcgtagcggtccttgggcccgatgccaaatttgtgtttgctgacctgcggcacgtcattgcccaccaggtccatgcgcgtgcagtgaccacagtactgcgggcaggtcggcagcatctccgccagcaccttggtgggataccggtgcgtcaagccttccaccacccacatgtcctgctcgtgaagactgtcacggctggccttgggatggttggtccactccgtgaggcggtccgcgtaggccggtagcatgtaacgacgcaccgggtcacgccacaggtcctcaagattcatggtgttgagcatctgcggaggcacgagcagcgacatcgtcgcccgctcgcgctggtcgcgctccatgctctcagccaggtcatccgggagcagagcccccagcgttgccttgagttccttgagattcttgatggtgtgcttgcgctgccagacggagttctcccagtcggcggcggacacgtccttgaagccagggatccgccgccaatcgggctcgatgaactcccggcggtgaggatacgtaaaaggctgttcagcggggccagcctcaggcttggcccggatgggcgtcgtttgcatggcgcatcacctctaaattgctcgcgggcgaggcgtcataacgcgcccatgccccacttcggtcaacaatcgaagggggcatcggatgcccgccttctcactcgatgggaacattgaccagcttggctacattatcttccgtgatgtcgaccaccacgggcttggtcgtcttgccgttgagcttgaacgaaatcttccgcttgcccaccggtagcatcaacggactgccaagtgtcaccggcgtctggcgattcgtcttcttcccatcgacgtagatgtccgcgcccgccggctttgtgctgcaggcgaacttgcccatcaccttgggagccctcggcggcttgggggcaggcggaggcttgggcgcagtctggggcggcggccgcacgttggccacggtgggctcgggctgcggctccttcgtcatctcgaacgcgaccgtgacctgcttgctgctgccgtcggccttgaactcaccggagtacggcttgtagcccgcgagcttcgcggtgaacgcgtaggtcttccccacctccaggttcgccatgcgcgcgtctggaatccgccccaggcgctcgccattcacggcgatctccgcgccgtcatcacccttgaagacagctgcgacctgaacgggcgcgggagccggatccgtggcgggaggcggcgtctgcccattgtcgacaggcgcgttctcaggtgcctcgtcgccgcccggatcctccgcgggagcggcgggctcggtggtccccgcggcaatgacgacacccgtgttcgtcggcggtgccactgggggcttgttctcgggcggcgggg

SEQ ID NO: 526 - DNA, 3247 bp, Myxococcus xanthus
accagccccaccaccacggagagcaggacccccgccagcgcgccgaagcgcacatcggtccgctgccagaggggcggcgccacgcggagggtgaacggacgcatctcgacccagtcccggcccgggctgcgcgcgcgcagccgcagcgagtgctcccccggcgggagcgagtggaacgagagctgattgcgcgtccccagcgcgagccagggctcctccgccgtgaagcgataggcgtactccacgccgttgcgcgcatagtcgagcagcgagaactcgagcgagaaaggctggcgccaggggacctccaggccagggaggtcccacaccggctggctcgggagagcgtccgactccaacccctcgatggaggtgagaatgagcggcggcgatggctcgcggggcgggcgcaccgaggggtccaggtccacgagtcccttggagctcccccagtagagcctgccgcccaggagcgtcaccgcctccgggttgaacgcgtcactgggcagaccatccgaggcggcgtagttctcgaatgcccccgtggccacgtccagccgtgacaggcccgcgcgagtccccacccagatgcccccgtcgggggcgcgcgccatggccatcacgttgttgtcgatgagcccgtcggtgctcgtccagaggtccacggacaccggcagcccggagtcgtcgagagacacccgctggaggcctccgcccacggtccccacccagatggcgcccgaagggtcctccatgagcgtgctcacgtagtagtggctcaggtgcagcttcgagtcagcgcccagacgcatgcactccaccgtgtcctcgctggccgagcagacgttgagtccgcccgagcgtgttcccacccagaagcgcccgcgccggtcctccaacagcaccgtcacgaagtcatcggagagggagcgaggattcgagggctcgtgacggaaggccacgaagtcatcggtctccggccggtagcgctgcagcccctgtcccccgctgcccagccagacgtggccacgagcgtcctgcagcagcgtgttgacgaagccaggatggtcgctcgccccgcgttccgtacgacggtagaacttgagcaactgacctgtcaccgggtccaggcgataggcgcccatcgagatgccaacccacaactccctgtcgcgggtgcgcaggaggctgaggacgcctcgagtgtcgacgccatccaacacgggcccaggcagtgggacggcctgccccgagcgcacatccacccggtccacgcctccgccgaagctgcccacgagcaggtggctgtcgccatccggaatcaccgcccacacgtcctcgttcgtcagcccggaggccgagttcccggcctttcctcgcagtgtcctgaaggtctcctgccggaagggcgcgtagaacaaccccatcccgaacgtgccgatgaacaggttgccagcggcgtcgaaagtgagtgcgccttcgtcgatgcggtgctcgtagccaggccccgcggacgggagacgctcctcacgcacttcgcccgtcgccgtgtccacgcggaggagtccacctccgaaggaaccgatccacagcgtcccgtgtccatcgggctcgagctccgtgacgagctgcaccttctgggcaacctccggtggagacagccgggcgcggcgcaggtaggcctcgtcgcgctctacccgatagagcccgtcacgggtgcccacccacatcccgccgtccgggtccgccgcgaggctgaagatgtccctggagccagggcctcgctcttcggaagagatgggctcgaacgtcgtggcgccgggcccgcgtcggaacagtcctcgcgagagcgtgcccacccagagcgcccccgtgcggtcgtgcttcagggccatcacgaactcctggcccccgccaggctggagcggaatccgctccgccactcccgtctccggatccaacagcgcgagtcccctgtgggtgcccacccacaggcgcccatcgtcggcgtccgccagggtgaacacgccgtcatgggggatgctggcggggttgctggagtcgtgacggaagtgccggaaggaccagcgagcccggtccacgaggctcaacccacccgtcatcgtgccgacccacagccgcccctgggcgtcctcgtggagggtgcgcaccgcgttgctcgccagggaagcagggttgcccagctcgtactggaacttgcggaagcgctggccgtcgtgaaggtagaggccctcgcgagttcctatccagagcagccccacccggtcgtagaggacctcggtgatgtactcggcctggaaggggcgcgcgccgcccacctgcatcaacccgagttcctgggcccccagcgcgacggcagggcacaacaggaggaacaagaggactcccagccatccgggagccgtgcgcaaggagaacctccgcgacgagctcacgcgcgcaccagggccacccttccggtgaattcgtccaagtcgagacagccttgcctcacgggaaacgagccgcggaagaaacgaacgtgaaacgacccgaagagattcctatgtcagccagaaggagcgccagcgacggggagtcgggcccgaaggtggcgagctgagtcgagtgtcacggtgacgtcacgtcgcccgcgcagcgtcacgccctgcctggccaggtgtcagcggcacgaggcgccgagcaggagctccgggagccttggccgcgggctgctcgagttccttgaggattcgggcagcgtcggcgttcttcgggtcgagctccagtgagcggcggtagcgctcgattgcgtccgcgaggcggcctgagctgcccccaacctcagtgccctgaggaagggtcatcgtcctcagcgttgctttggcgccgcatccatcgcggcgccgtcggcgcatccgacgcaatgcatttcacatacaccccaatcggctcatctccttgagtccgagtttcgggcagccatccgaggagcggttgccaactctgtcgctgcgctcgccgcagcggggactactccgcttcagccagtcccgcggggcaggagaaggcggcgggcatggaccacagttggaaggagttcgtgtcgtcgacggcgcggaagtagatgcggttgcccaggagggtgaacgcatcggggacggaggagcccgctccggggcggatctccgcgagctggccggtggtcgccgggctcccctgggtgaaccaggggctcgatgcccga

SEQ ID NO: 527 - DNA, 2725 bp, Myxococcus xanthus
gtgctctacaggacacgggtgctgcgtcctcatccaacgtgatgtcgatgtccaccagcaactccacgtcgtcgaccagcgccgcctcgcgctccgccgcgcgggcacgcgggtccatgcagcgcgccagttcctcgcggaacgcgcgggcatccgggaagcgctcggcgggccgcggcgccagggcccgcagcagcaccgcggacagcgcgggcggcacgctgggattgaggacatgcggctccggaggcgccagctcccccgcgcggccgatgccgaagggcagcctcccggtgagcagcaggtagcccaccacgcctagcgcatacacgtccgcgcggccgtccacgacctcaccggaccactgctcgggtgcgatgaaggccggcgagcccaccaccatgccgcgcgcccgctcctcgggagacaggctggagctgaggatggcgctggcgccgaagtcgagcaccttcacccggcgctccccccgcgcatcccgcgtgaggacgaggttgtccgcggacaaatcccagtgcatgagcccgcgcgcgtgcgcggactccacggcctccagcgtctgccccagcagctccaccgcctccacgggcgccagcggcatgggaagacgggagaaggactcaccgtcggcgtactccatcagcaggcacggcagaccgccgggccccgggcgcgcgtccagcacgcgggccacgtgcgggtggaccagctcgcgcaaagcatgcgcctccgcgtagaagcggcgctgcatggccggctgcgccgccaggtgcgggtgcaaaaccttcaccgcgaagcggtgccccgtggggagatactccgccaggtacaccgtgcccagcgcccccgcccccaaccagcgccggaagacgagcggcccgtgccgctgtccctccaggcagctcgctgacacggcgacgccgtcatgcacctccgggcaagacgccccggccggatggtccacgtcacaccgcatgcaggccataccccaccaccctctgtcgccccggagcggggcaagcggtggtggccttgcaaccggcgtgcagaggccccttgtccactcatcaacagagcaagcccccaactgaccgaggtcaccggtgaatcaggggttcgcggccggtaattcttccagggtaggaaccgggcgtttctccagcgcacccggccccacctggacgcctacaggtacttcgtcagcttgcgagccttgagcgcctccaccaccttgcgcacgtcctggctcttgtccttcggcaccacgagcaccgcgtcgccggagtccaccaccaccatgtcggtgaggcccaccacggacagcgggcgcttgtcggccagcaccacgcagctgtggcagtccaccaccaccgcgaggttgccggacaccacgttgccgttggcgtcggcggggcgcacctctggaatcgccgcgaacgagccgacatccgaccagccgaagtcccccggcagcaccgcgatgttggaggccttctccatgacgccgtagtcgatggaggtggagggcagcttcgggaacaccttcttcagcaccgcgccgaaggtccgcttgcccgcggccttgcgcagggcgtccaggcccttcttcatctccggcatgtgcttcgcgaacgcctccaggatgacgtccacgcggaagacgaagatgccgccgttccacaggtagtcaccggaggacatgtaaccgcgcgccgtctccaggtcgggcttctccttgaaggcctgcaccttgcggccaccgccctccagcgcctcgccgacctggatgtagccgtagcccgtctccgggcgcgaaggcttgatgcccagcgtgacgatgtgccccgcctccgccaggtccgccgcgtccgcgagcgtgcgcttgaagccgggcacgtccgccacgtggtggtcggaaggcagcaccaccatgacgcccttggggtcgcgcgcggccacctgcaccgccgccagggcgatggcgggcgcggtgttgcgcgccaccggctccaccaggaggttcgccttgggcagccccttcaccagcttcgccgcggccttcgcgtgcagggggccacagacgatgaaggtgtccttcaccgaggcgagccccttgaggcgcgcggacgtgtcggtgatgagcggcagcttggaagccagcggcaggaactgcttgggccgcgcctgacgggacagcggccagaaacgggtgccggaacctccggccatgatgacggggtagagggccattgcgggtgttgcactcctgaaggccccggacccagccggcggccatggcggcgcaccataccgtttcagcctcgccgggaaagagggactcgcctgcccgccctccagacggcaaagccacgaagggaggtgagagttttgacccgccaccaaaaagccagtctcatgccgcgctgttggacttactcaaggccagatccaccgggctgacgctcatcctcaccgtcgcactggcgttggggctgtcgcttgccccggtcccagacgccctccggcccctcccgagtctccagcggggtcccctgcccgagaagctggtggcgctcgtcctgccgacctcgctgtcgggcggtcgcgccacgcgtccgcccggagaagtgatgacggcggctgcgggcgccgccaaacgcccgccggcagagacggaagaggcggagcccgccgacgccggtgccct

SEQ ID NO: 528 - DNA, 3538 bp, Myxococcus xanthus
ccatcagagtcttgccgtccacggtgctggggttgtccgcgaaggtgtcgttcggctcgagctacaccatgtccggcgtgtatttgaagttgggccgcgtctcgtcctgctcgcagcccgtgacggtcagactcaggaccaccacgcccaggtgcagccttctcacgacgccacctcctccagcaggtccgtcgccaccgcgccgtggcggcgcatcaggtcctcggccgcgtccagctccgagggggcctcgcgcggcgtcaccgcgatggcgaaccggtcatccgtgacacgcgggagcaccgagcggcggctcccggggaagagcttcgcccgcgccaggaaggccgccaccgtcgccagcgccgcgaacagcaccgtcagctcgaaagtcacggggatgaacgccgggaacgagttgaagggcttgccgcccacgttgagcggccagctcaccacgctggtgtagtactggagcgacagcgccagcgtgcagcccagcaggcccgcgccgaagcacacccaggtgaggcggctgggcttgaggcccatggcgtcatccaaaccgtgcaccgcgtacggcgtgtacacgtcgtggaggacgaagcccgcctcccgcaccgcccgggtggcgtcgagcacctgcgcctcactgtcgaagtagccgatgagaaccggggcactcatacaggtgcatcctttcgggtggcgatggccagcggcaccggcgacgcgggccggtgggccacggggtgcggctcctcggcgacgggcttcgcgggcgggtgtgactgcgccgcatggccatcacgcgcgaagcccagcacgctcttcacctcgccgatggagatgatgggcagcacgcggacgaagagcaggaacagcgtgaagaagaggccgaaggtgccgatgaaggtccccacctccaccatcgtcggcgtgtacatggcccagctcgacggcaggaagtcgcggtggaggctggtgacgatgatgacgaagcgctcgaaccacatgcccacgttgatgaccagcgacaggacgaagatggccgcgggcgaggtgcgaatcttcttgaaccagaagaggtgcggcgacaccacgttgcacgtcaccatgatccagtacgcccaggcgtaggggccgaaggcgcggttcatgaaggcgaagcgctcgtaggggttgcccgagtaccaggcgatgaagaactccgtcgcgtacgccagcgacaccaggccacccgtgacgatgatgattttcgtcatgttctccaggtgacgcagggtgatgaggtgctcgtagcccagcaccacgcgggtgatgatcatcagcgtcagcaccatggcgaagccgctgaacaccgcgcctgcgacgaagtacggcgggaagatggtggtgtgccagccggggatgaccgatgtggcgaagtccatggagacgatggtgtgcacgctgagcaccagcggcgtcgccaggcccgccagcagcaggtacaccgtctcgtagcggctccacgtccggttcgagcccgtccaccccagcgacatcaccttgaagacggccttgcgaatccccgccttcgccctgtcgcgcaccgtggccaggtccggaatcaggcccacgtaccagaacaccgccgacacggtgaagtacgtggagatggcgaacacgtcccacaagagcggcgagcggaagttcacccacaggctgccgcggtcgttcggatacggcagcacccagaaggccagccacggccggcccatgtggatgacggggaagagcgccgcgcacatcacggcgaacagcgtcatcgcctccgccgcgcggttgatgctggtgcgccacttctgccggaagaggaagaggatggcggagatgagcgtgccggcgtggccgatgcccacccagaacacgaagttggtgatgtcgaaggcccagccaatcgtcttgttgaggccccacacgccgatgcccgtggccacctggtagccgacgatgccggcgcccgtgccgagcacggacaccgcgatgccaaaggccacccaccacttccacgtgggggcccgctccatgggggcgcagatctcctcggtgagctggcccagggagcgcggctcggtgacgagcggttcgcgcagcggggacagatgctggttgctcatgtgccgcttcccgacccggtgttccggatcttcgtgaggtaggtgatggacgacccgatgttcagctcctccagcagccggaacgcccgcccgtccttcgccagtcgcgccacctggctgtcggggtcgttcacgtcaccgaagtggatggccttcgcagggcagctctgctggcacgccgtctggatgtccccgtcacgcagcggacggccttcccggttcgcggcggccttggactcctggatgcgctgcacgcacatcgagcacttctccatgacgccccggctgcgcaccacgacgtccggattgagcaccatccgctccaacggctcggcgtgctcgtagtcgaaccagttgaagcggcggaccttcgtggggcagttgttggcgcagtaccgcgtccctacgcagcggttgtagacctgctgattgaggccctcgctggagtgcaccgtggccagcaccgggcacaccgtctcgcacggcgcattctcacagtgctggcacatcatcggctggtggacgacctggggattggcttcgtccccctggtagtaccggtcgatgcgcatccagtgcatgtcccgccggcgcagcacctcgtcgcgccccacgctggggatgttgttctccgcctggcacgacaccacgcaggccgagcaccccgtgcaggcgctcaggtccaccgccagcgcccaccggtgccccttgtactcgtgccccgaccacagggagagcgagtgccctcccccgccgtgccccgcctgcacctcgttgcccgcgcgcgggttggccaggaaggcggccagctccgcttcgcgcacgtgcggccgtccctccagccggtggtgcgtctgcgtcagcgccaggggctgctgctcgcccgtggcctgaaccgtgacgccgggcaccgtgcgccgcgcgcgtccgtccaccaccgccgacagcgggtagccgttgacgccgatgccatccgcgacgcgcccggcctgcgtgcggccgtagcccaccgccaccgcgatgacggaggggtgcgtccccgcctgcaccagcacgggcaccgacagcgtcgtgctccccgcgcgcacctggacgacgtcgccatccttcagtcccagcgccttcgcgcgggccggagcgatgcacgccgggttgccccacgtcaccttggtgatggggtccgccacctcctggagccaggcgttgttcgcgggggcaccgtcacgcagcgccaccgtggggtacagcaccagctcccactccgcggcatgacgggccacgctggccagcgccttcgccagcccctcctcgcggaaggcgggcgcttccgccgcggcggcgccgagcgtcaccacgccccgacggaggtagagcac

SEQ ID NO: 529 - DNA, 4353 bp, Myxococcus xanthus
cgtgttggccacgtcctgcgcggaggcgtactgcacctggatgatgcgcatctcgtcgttggcggcgcgcgtgtccagctggtggatgatgcgctccaggcggtggatgttggagcccacgtcgttgatgatgatggtgtcgggcggatacggaatcgtgtcgccgtccttggacaccagctgctggagcacgccgcgcagcggctccacttccacgttctgcacgcggaacagcttggtcaccatctgctcgttggtggtgtacggctcaccctcctcgacgatggtcgggatggggttctgcttcgccgagcgcttgtcgacgatcttcatgaaccggccgtactggtaggcggcgagcccgttggcgtcgagcgcggcgaggaaggcggagtagaaggcgtccgcgttgacctccacccggccattctccgggccgatgatggagatcttcccgcgcacgttctccggcaggatgaaggtgcggcaggtggcgtccgcgaccgtctggaccagcttctcgatctccaccttgtcgaagtagatgccgtaacgggcattgcggcgggcctcctcgcacgtcggcgtgcggcggggacccgcgttggcgtcaccagcgctggtagcgccagggccttgcggggaaatcttccgctctccggcggaaccagagggcggtgagcggcgctgggcctgcgcgggaacggcgagcgcgaggcacaggcagagcatccaggacgggagcgtcttcatggaggagcgggcgctgcggaggtgattaacggacgttgtacgacttgcggatcggcgcaccgttgcgctcgatctcgatctcgatgcgggctgcgtctttcatcttcgaatagacctccagcgctttttccgggctgttgaggtcgaatccgttgatgcgacggatgacgtcaccattctggacgccaatcttggagtagatggagtccggacggatggagaagagcttgaagcccaccgcctgaccgtccttgaacgcgggcacgatgcgcgcctgcatggcgacgttgttgaggttgttgagcgtcttgtcgatttccgcgcgagggacttcgtactcgttctcgctggtggcgcggatgccactgccatcactgggcggagcggtgttggcctgggccaccgggggcgagggcggcacgaaggcgccgtcacccggattgccgtcgatgtactcgcggcggccgccgttgatgatgatgacgcgctcgcgctcgatgttctccacggtggctccctgcaaggagttgcccaccatgtaggtctgcgaacgctgcgtcgtcatgtcctggatggaggcgaaggaccagtcggggttgctcgccaccaacgtgccgagcagcttgacccgcaggccgctcttcacgggcgcggcgttggggtccacctccgccgaagcgccgccgggctcctgaacctcgggctcgggttcggggagcttgatgcccgtcagccgtgacagacggtccaggtcgagcatcgccatcgccgtctcgatgcggcgcggctgtgaaggcgcgggggcggacgaccccccggtgggaaccggggagatggcggactcgacgaacaggttcaccgtgctcgccgccagcaatccgacgagcaggatgaacaccaggttcaccgtccaaaagtattttcgaaagaagagttccatcacgcttccgggagaaagccgggccctcattgagcaagccaggtgccatcgcgggccaggcgggcaagacaggacctacggccaactacttggaattattccggaatagcaggcgcccctgacgcgtgacgggccttccgaaaccccgccagacaaattgtcaaaagcaggcggggggccgtgtgacgccctgtcagtcgtcggtgtcggggccagggggcgcggcggtggggccatccccggtggactgctcgcgctccagcttgcggtagatggtccgcgcagcgatgcccagcagccgtgcggccagcgtcttgtctccgcgggtgtgacggagcgtctcatggatcacccggcgctcgatttcctccatgggcgtcccaatgggaatgacgagctgtccggctgagcccagcgggcccttgcgcacggattcaggcaggtcactggcgtccagcacctcgccgcgcgccagcaccaccgcgcgctccaccgcgtgctccagttcgcgcacgttgccgggccaggcgtaattctccagcacgcccatcgcctcctgcgagaagccgcgcagcaccttgccgttcttggcggcgaagcggcgcaggaaggcgtccgccagcaggggaatgtcctcgcggcgcgaggcgagcgcgggcacgcgaatctccaccacgttgagccggtagtagaggtcctcgcggaagcggccttcggccaccttcttctgcaggtccttgttggtggggcgaggaggggctatgtcgacctacactgtttgcgagctcctcatccgctggatttggccctggctcagcgcccgtagcagattcgcataggcgggcagaggcatctcacaatcttcgtccaggaacagggtgccaccgtgggcacgctagaaggggccctatcgcgtgtccaatgcgccggtgaatgggccacgctccaagccatagagttgcgcctccagcatgttcaccggaagcgagcaacagttgccggcagcgaagggcccgcggacccgctgggagaactcgtgcacggagcgcgcggccagctcctttcccgtgccggactcacccagcagcagcaccgtggcggtggagggggccgcctggcggatggtgtccagcatggcgcggaaggcgggggactggcccaccatggagcgcccacccgccgcgttcatctccgccaacttcgccttgagcgactggttctccgccaccagcgctcgcttctccagcgccttctggatggccttcaccagcgcgtggcgcttgaggggcttggtgatgaagtcgtaggcgccgtccttcatggccgccacggccgtctccaccgtgccgtaggccgtcatcagcaccacttccacgtccgggcggatggcgcgcgcggcgcgcagcagctcctggccgtccatgttgggcatcatcaggtcggtcaccatggcggcgacctccggccggcgcagcagctccagcgcctccgtaccgttggcggcggccagcgtggccatgccctcacgctggaagatgcggatgaccgagtcgaggttcgcgcggtcgtcgtcgacgaccaggaccgtgggggatgtcatgttgggcgcaacctcctgcaaatcgtgttcccttaagcggattcctcgtccggctccagcggcccgccgcccatccggccaatgtcctcgcgccgcaccttgtcgacgttgaacttccgggcgctggcctgcatccggtccacggtggcgtcgaagtccggcttcccgccatccttgcggaagcgcaggaagttgatgcgggcgacgacgaagttcttgaggtacgggctctggaggccccgctccttgagggcgtccaccacggacaccacggcgtcgtccagctccagcagccgccgggcccgggcctcgcgcaggggcagggcgtcctccaggggcgtgtcgaggaagtcctcaaccgccttcacgaaggggtggtaggcgcccgcggagaagcgggggcgctgctcgtaggcggcgcccagggtgatgaaggcgggctcctcgaagaggtgggcgaaggccgtctccggccccttgcgctccgcgcccaccaggccgcggtacatgcggatgacctccagcgagcgctccttgaggttgtgggccttctccgtgttgagggccagaatctggtaggccacgtcctcttcgggcagcaccagggcgacaatggccttggcgcccaggcgccggctggcgttgaggcggtggttgccgttgggcgtccagtaccggccgtccttgcgcacggcgatgacggggtccaggaagcgatccaaccgctccatggcgttggccagacgcttcacgtgcggctcggacacgtcgcgctggtagggcgtgggctccaccttgtcgatgggcagcacggagaacaccaccgggtggccgcccagcgggtcgcggtacacgccgagcacctcgccgccgtcctcgcgcaccgcctccagcagctccgtggggtactcaaccgagtcgctggccacctccgcgggggacaggccccgggacttcggctccgccttcttgcggcggggcttgcgcggcgtggccgccttcttcgcggcgggggacttgcgtgcggacttcgctgccatgggcgcacccttctcgtgct

SEQ ID NO: 530 - DNA, 3391 bp, Myxococcus xanthus
gagagctctaaagagctcgtcctgagctacgacgagtcggagacccatgccacgctggcggcgctgacggagacgggcacgaagacggagcacccggcggacttcgcgctggaccccaagcgggtcgcgcgaggcctggcgcaaatctccctgacggacatcctggcggatgaagtgcttgccgccctcttcgcggacagctcggagctggggccgctgctggcgcgcagcgagcgcatcaccgggtggatggacgccgctcctggaggagcccaccgtgtgtccctgacctggccgctgcctccgcagtagacgctcgaatctggagcggagggacgaggtggcgcgccgttgcgagcctccgtcgagatatgggaggccctcaaagcacgagggggaaaccacgccatgatgctgttcctgcccctgggggtggacaacaccgagctggagcggctgcctcgggtgtccatcaccatcgcggccatctgtatcgtggccttcttcatctcctgggtcattccgtccaatcccctgggcgtgggtgagaacgagctgcgctccctgctggagcagtcgctcgagcacccggacctggagttccctcccgcgtgtgcggagcggctgctgtccgattcgggccggaggctggtgcgcaacatgcaccaacgcgtcgcggaatccgacggagcggagagcgtgacgaaccggcagcagggactgaatgagcgctgcgaggagctcatcgcccagcacgactcgagcctgctctcgcgcttctccctggtgcccgcgcggggactcgcccagcccggctggctcacgtacatgttcctccacttggggtggatgcacctgctggggaacctgctgttcttctacgtgaccagcctgctgctcgaggatgcctggggccggccactcttcgcgggtttctatgtcgtgggcgggctcgtggccggcgtggcccactatgccatcgacccctcatcggagtcggtgatggtgggcgcctccggcgccgtggccgcgtgcatgggcgccttctgtctgcgcttcgcccagcgacgggtccgcatcggctacttcgtctggctgctgaaaatcttccgcggcaccttccccgttcccggctgggtctggggcggcctgtggttcggcaacgaggtgctgaactactacctcctgggcaacaacacgggcgtcgcggtgatggcccacatcggcggtttcgtcttcggcttcgcgggcgcgtcgctgctgcgcgtcacgcagttggaggaacgggtggtggcgcccgcactcgccgcgaagcagggcggctgggtagccgacccgcggctggcggaggcccaggaggcactcgacaagggagaccgcacggccgcacgcgcgggcttccagcgcttgctgaagacccagccggaccacaccgacgcgttgctgtcgctgggccgcatggacctggaggacggcaagacgcaggccggcacggcgcgggtggagcgggcgctccatacgctcgcgggccgcgcctccacggacgcactgtggttcgcgatggagccattggtctcgctgctgccccatcgacgcgctgcggcccgccttcgcgtggaagctggcacaggcgctggacacggaagacgcgccgccggcttcgttggagacgacggaagccctgtacagcgtggcgggcgggggcgcgggcatcatcgcggtgcgcgcgctcatccgcgcccacggagctgcgaatggcgcactacaaggacctcgagcgggcagcagactacctcgcgcgcgccaagccgctgctgacgggagaagccgcgtctgcgggtgaccgggtccgggagctggacgccgaaatcacgcgggtgctggaagagaacgcatggaagaaacgggacgctgcgccaacgcccaccgtggacgcaccacccgcgccgccgcgcgtttttccctgccgcatcgtgggcatgacggccatggccctcaccgtggaggcagccaatggccagcgccggacgatggccatgacggaggtgctggcgattgccgtgggcatgctgcccgtcgccgggccgccggggacgtcgccgcgacaaaccgtgctcaccgacctggtgctctcctgggggagcgccaacgagggaccgcgggtgctgcgggtgaacgtcgcggggctcgcgctgaaccacttctatccgggtgtggcgccgcgtgaggcctatgcgcgattcctggcggacatgctggagcgcaccaacgccaacgcgcttccggacgcctcctccctgaagcaagggcagtacccgcgcttcaacagcgaggcggaactgagccagcactactacggcgggagcgcggcagcggcctgagcgcggcgaaggggccccacccacgacgccttgttgactggcttcgaagccaggcatggcgcccgtgaagaatcagctccttcagcgcgactgagagcctgtccgaatgtgacaggcaactcactccatgtcttccagggccaactcggcctgctcgcgatagaggggcacctgctccaccgcgagcacgtcttccagtagcgcgcgcgcgccagcggcgtcgcccgcgtcccgaagccggcgggcccccgtcagcgcgcgcatgagacgttgcgagccatcacgaatgcggcggcgagtctcgtgaagaagcgccgtcgccgtggcaacacccgcgacggcggcatgtgcatcctcttcgggaatgcccacctctcgtgccgagcggaggagcaaggcgcgcacctcggccgtcagcgacagcgcctcaccggcctccacgcgacgcgccagttcacgcaccgggtcccaatcaatcgactcggccatggactcactcgcctcccttgcgacggcggcacttatccacgggccattcgtgttgcccttcgcaataccggaagcagtcgtaacaagagcctgaccaggcctgctcttgacactgggcataggcgtcgatgcacacctgcttccacccggggatggcttcttcgctggcctcggacgcggactcgacggccttcatcggaaccaggtacttgctcgcctccgaggccgtcagcccgcagcgctcaggcgtggccgggtgcatcttcacgcagcaactcaccgtcgaatccatggggccgcactgcgcctgggccaggtacacgggctgacgggccgcggtggaatgagcgctcccgccacaccccagcgccgagagaacaatggctgccagcgggccccacatcgcgcaacaatgcaaggatggctcgttttccatgaatagcagcttacacacgcctcatgcatggacaaccctcctttcacgcagccagcctccgggctcgcccacggcgatctttaga

SEQ ID NO: 531 - DNA, 4113 bp, Myxococcus xanthus
tccagcaagtgttcgcgcggcacaccgcgctcaggacctcgttcgagctgacgcgctactcggagccactccagttcgtccaccgccaggtggagcccgtgctggcggttcacgacctgcggcacctctccaccgaggagcaggatgcgcacctcgaagcgtggctcgaggaagaccgcgcgcggcccttcgactggagctgcgcgccgttgatgcgagtcacactccacctgcgcacgtccaccaccgtgcagctcagcgccaccttccaccacgccatcctggacggctggagcgtggccaccttcttcaccgagctgctcgcggacttcgtcaccctgcgcggtgacaggtgtccggagcggacagcaccggcgctccccttccgcgagttcatcgcgatggagcgagagacactccagtccccagcggtccaacagttctgggcgcagcagttggacggaatggaggtgacgtccgtcacccgaaccttgccgcccccgcccgatgcgccagcacgggggctctcccaacatcccgtgcccctggccgcgtcgacgcacgccgggctccagcggctcgcgcgtctggccgccgtccccctcaagagcgtgctgctggcggcccacctccgcgtcctcggcgccgtctgtggcaccaccgacgtggtgacgggcctggtcagcaacgggcgccccgaggtgcgcgacggcgagcgaaccctgggcctcttcctcaacagcgtcgccttccggcagcgcctgggcggcggcacctgggtcgacctggtccgcgagacgttcgccaccgagcggcgcctgctgccccaccggcgctaccccctgagccggctgcaacacccgcgcagcggacaaccgccgttcgaggtcctcttcaacttcgtgcacttccatgtgtaccagggcctgctgggcatcgagggcgtgcggctcgtcagcccggtccgctccattgaacgcctggacctgccgctggccgccatgttcggcgtcgatccggtgacttccgagctccagctctcattgcaccatgacccacggaggctggacgctggccgcgtaccctggctggcggagtgctacgcgcgcgtactggacgccatggcggcccagccccaggagcgccacgagcgcgtctgcctgctctcccccgccgagcgcgagcgcgtgctggtggattggaacgccacccgggatcccctgcccgaagacacctgcgtccaccacctcgtggagacccaggcctcgcacacgcccgacgcaccggccgtcaccttcgaggagcgctccttcacctaccgccagttggacgaacaggccaccctgctggcccggcgtctccagtccgtgggcgtggggcccgacgcgcgtgtcgccatcgtgttggaccgctcgctggagatggtggtggcgatgctgggcgtcctgaaggcgggcggcgcctacgtgccgctcgatcccgcccaccccaaggcgcggttggaagccgtgttgcaggaagcccacccggcggccgtggtgacccggcgtgagctggcgccgaacctgccggttcgagaggtcccaacgctcctcgtcgaggacgcccccgagcacccgctccctccgctgacgcgaggcgtggcgccgcgaaacctcgcctacgtcctctacacctctggctccacgggccggcccaagggcgtcatggtggaccacggcaacctggtgaatcacttcgtcacgctcgacgaacggattgaggcgcggcccgcgggcacctggcttgccgtcacgccctacaccttcgacatttccggagtcgagctggtgtggaccctgacgcgcggcttccatctggtgattcaccccgaggaacgtcacgcccgccgttcggtggccgagcagatcgagcaccacgccatcacccacctccagtgcacaccgtcgcgcgcctcgctcctgctccaatcccccgggatggcccgcgcgttggcacggctccgggtgctggtgctcggcggcgaggccctgacgcccgcgctggcggcggaactgcgcacccggctcaccgggcggctgttgaacatctatggccccaccgagacgaccatctggtccaccacccacgcggtggaggcgagcggccccaccgtccccatcggccggcccgtgagcaacaccgaggtgtacatcgtggacgcgcacggcacgcccgtgcccatgggcgccgcgggcgagctgctcattggcggagagggcgtctcgcgcggctacctccaccggccggagctcacggcggaacgcttcattccgaatccgttctcgtcccgcccgggcgccaggctctaccggacgggcgacgcatgccggtaccagccgggcgggcgtcctcgagttcctcggccgcatcgatcagcaggtgaagatccgaggctaccgcatcgagctgggcgaggtcgaaaccgtgctccgggagcaccccgccctcccggaggccgctgtcggggcgagaacccaggaatgacgacgcccggagactgggtgggtacctcgttccgtcccagcgggacactccgctcgagaacctccaagcgctggtggcgcacgtccgcgcgtttctccgggaacggctgccggagtacatggtgccctctgccttcgtgcccctggaggccctccccctcaacgccagcggcaaggtggaccggcaggcgcttccgcagccctcgtcatccctggccgagcagcgccccgcgtacatcgcgcccgcggggcagctcgaactcgacatcgccgaagtctggcgccaggacctgcgcctcgacgtggtgggccgcgacgagaatttcttcgacctggggggcaactccctgctcgccgcgcgcatccaggcgcgactgacggagaagctccagcgcacggtgacgctgctcgacatcttcacccacccgaccgtgggcgccctggcgcggcacctgtcggcgatgcccgaggccccggccatggccctggaggcgcaaacccagcggcagaaggagggcctgggccggctcaagcgcctggcgaagagggtcaaaggcgatgagtgacacgctggagtccgtccccgacggcatcgccatcgtcgggctcgcgggccgcttccccaaggcccgcgacatcgaggccttctgggagaacctgcgagcgggcgtgcgcggcatctccacgttcaccgacgcggagctgctcgcggcccacctgccggcggagcacgttcgtcacccccggtacgtgaaggcgcgcggcgcgctggaggacaccgcgatgttcgacgcggcgttcttcgacttcaacgcccgcgaggcggagctcacggacccgcagcaccgtctgttcctggagagtgcctgggaagcgctggaggacgcgggttacgactcgcggcgctacccggggaggattggcgtcttcgcgggcgccagcatgagcacgtacctgctggatgccctgcgcggtggggcggccctgcctgagggactgctccagttggccatcggcaatctgagcgacttcctgtcgacgcgcctctcctacaagctggacctgcgcggccccagcgtgagcgttcagaccgcctgctccacgtcgctggtcgccacgcacctcgcgtgcctgcacctgctcgcgggccaatgcgacatcgcgctcgcgggaggcgtgtccgcgcgggcccgggaggtgggcggctacctgtatcaagagggaggcatcttctcgcccgacgggcattgccgggccttcgatgcccgagcgcaggggacggtggagggcagcggtgtggggctggtggtgctcatgcggctggaggatgcgctggccgaaggcgcgcacatccgcgcggtcatccgcggcaccgccatcaacaacgacggccgccagaaggtgggctacaccgcccccagcatccagggacaagcggaggtcatcgccatggcccaccggatggcgggagtggaggcccgcaccatcgactacgtcgaggcgcacggcacgggcacggcgatgggagaccccatcgagttcacggccctggtccaggccttcggtgaggacgcgctccctggcgcct

SEQ ID NO: 532 - DNA, 2630 bp, Myxococcus xanthus
ctaaagctcgccggcgatgacgaccaccgtattggccgggcgatacacgtccttcagccacgcctcggcttccgtccaggacacctgggccaggtccgcgccggtggcctcgcgcgcaaagggatgcgtgccatacagcgccttctggaggtgacgctcggccaggagctccggattcgagtccaccgcctggcgccagggcagcacctgctcgcggtagaagcgcaccacgtcctcggaggtccgcgtggagtcgagctgctcggccagcatcgccagcatgttgccaacgttgccggccgtgccggagatgccgacgcgcaggtggtcgcgctggaacgacgaggtcgaatgcaggccccagtcactggggcggccctcgaaccaggactcccggaaggagccccagttggccaggtccgccacccccgacttcgcgccgtaggacgaaccaccgcccagcgccgcgccgatgcggaccaccgggaggcccggacgcggagcgagcagcacctccatgccattgtccagcttgagcacctgcacgggcgaatcgagcgccgccgtcatggacggcgtcacctgctcggcgggcgtggtccagggctcctcgtccgcggacagcgtggcggccgccgtcgccgcgcccggcacctcaccgggacggacgacaatcattcgcacccggtcccgctgtagccactggtaggagaagtccgtcaccttgccaccgccgagccccatcagcgccacctgcgagcgggtgtaggagcgcacgtcctgcgtgaagtgggtgagcaacgcccggcgctcggtgcgggacatgaggtcctctgactccagcaccatgcccgtcaccacctgccggcgcgtcgcctggaagtcgaactcgcggcccagcacggagccgggctgaatctcctggacccacgcgttctgcacctggtccaacaccttccccgccgagcgcgtcgggtcgtcgccccggctgagccgcacccgcaccaccagcagcgaggcgcgcgtccccggaatcaggttggtggagatgtccgcgatgtcaccgtcgttgcgcaccgcgcccaaaaggttttgcccgaaggtggcgcgcacgaagtcctggaccgcgctggactcgtcgaagccgcgcggcagcacccaggacagatacacctccggcgtgggcacggcggcagtgaacacaggcaccgacttctgggcgggcgtggtagccggggccgccggctgcgcgggcagacgtgcctccagcgccaggggtgcgcctgtccccacccaggcctcgggcaggtttgcccgaagcgtggcctccacggccgccaggtccacgtcaccggcgatgaccagcgtgacgttgtctggacggtagtgcgcccgggcgaagcgctgcgcgtccgacaggctgagcgcggacagcgactcatgcgtcccggcgagaggacgcgcgtaggggtgtccaccggggaaggccgcggcgttcaaccaactgaagacctgtcccacgtagcccgtctcgttgcgctggcggagctcgttgcggaccacctcgcgctctaccgcgaacacctccgggctcacgcccgcgagcggcgcggccaggcgctggccttccagtttcaggagaacgggcaaggcctccttggggcccagcgtctcgtaggacgtgtaatccaaactggtggaggcgttgtagaagcccgcgcccgacgcctccaggcgccgccacaccgacggactacccgcgtggcgggaacggaacgccaggtgctccacgacgtgcgccaggccctccttgccacctgggtcactggagccccctgctcccaccacggcgaccaccgccaccacgggagagcgggcatcctgctccaccaccacgcggagccccgaggggaagcggaagtcccgcaacgggaaggccacgtcacgcatgacgatctgcccacgctggggcagcgtggcgcacgcgctcagcagcagcgtcagggcaacgacggcggcacggggccgccagacggaagggagggagacacgcgggcgaaacatccaagctccaaggacgaacccgggagcggcgcgctggggcacgccccaccgcctcccccgagcggaagtgaatctcgacagcgacgaggcgaaggccgtgtacgaaccgcgctggccctggacgcaaggccagacggacgcaatgctcataccatccgcgggaagacaggccaagggccgggacttccaggcgcgattgccacatccaggcacctccgcaattctggcaatccacaacgcgacaggaccgtcttcgcgacgggggaggcatcatgcgagcaacgtggatgggcgtggcgctggccacggtcttcatggggacgggctgtggcggcatgaacccgggactggacgaccctgccggcacggacgaggcgcacggatccgaagtccaggcactgaccacctgtgaagactgccataccacctacaccgcctgcattcgccaggcccttggggacccccaggagacacaggtttggatcgaccagcggcacgagtgcgcgctgcaatactgtccgtgaccgcgcgcgccgaacgtattggcgctgacccgcggggtggga

SEQ ID NO: 533 - DNA, 2459 bp, Myxococcus xanthus
tgctctaaaggcggaacgacagcaagtcagcgaaggtgcgctcgtagaacgcttgcgccagggtgctgatgcgcgagtaggtgacctccgccgcggcttccaaatctccccgcagcggctgcggcaccggcatgagcagcgtcagctccaggtccggccacaccgcgttcttgatgaggccatagagcaccaccaggttgggggcatgggcctcacgggccaggaactcgaagagcgtgtgcggctccacaccgccggtgatgttgaagaaggcgctttcatccagcaccacccagatgccccggcgcgccgcctccgcgacgatgtcgcgcagcacggacaggttggtgcgctcccccttctccaccgtgagcagcaccatcttcacgtcgaacgcggacaacagccggcgaatctccgcgagcgacgtgtgtgtcaccgtggcgcgcacccccgccttctccagcgcacgggcgtagagcggatggaggttgcgcgacaccagcacctcgtcacccgcgtcgcaggtggccatcagcagcgagtacaccgcctgctcgcgctcgggcgcgacgaagacctcctcttccgccagccgcagcccgaagtaccggtccaggtagcgcaccacctgccggcggaaggacgcgtcacccgcttcgtgcgcgtagggcatcagcgggccccgcgccagccgcgccgccaggtcggcgacgaagcccaactgctccgccgacgcggcgcccaggtccagctcctcctgcaacgcagaagcgcccagcgcgcgcagagcggcccgcagcgccagcgtctcgcgaggcagcgccagccgcgcctcccacaccgccacctcgtgccacaccggattcccggcctggagccagcccagcgcggtggccgcccgcagcggctccgggctgcgcgcttccatgaagaactcgaactcgcggccggttcgctgctccagcgccaccaaaggacggatgtccgtgtccgccgcctgcatcacccggcgggccacccgcacgtgcgtgtcgaagccgcggcgggtgaacatccgctcgatgatgacgcgccctggcctgcccgcgaggttgagcagcagccgtccggtgggcgacagccgctccggcgcttcgtccagcaatcgcgcgatgagcccgagcccgaagtggtcctcgtagacgttctgcagcgtgcagtagttggacaagtcgtagagcgcctgctcgtcggcctgggacagctcggatggcaaatcctcctcgccccggaggacctgcggaatacagcccaccacgaagtcccatggggcatccgaaggaatcccgcgcaacaggtcgctctccccgaaggacagacgcgacgccagcgcctcgtctccgttgagccacgcgttgcagcgcgcaaccacgggcgaatgcggattgaggtccgcgccatgcacgtgcgccagccgggtgaactttgccagcgcgatgcaaatccatcccgagcccgcgccgacttccaccagccgctttcccgcgtactcatccagcgggacgctcagcagtccctccaggaaggtgtaggcccacgcctccggagcgaagatggatggcagcaggaacaactccaaccgctcctgcgaagcgcccaccgtcaccgtcaccgtcaccagccgcagtggcgcggattcgggttggtggcgagacagctccgccagctctcggagctcggccagcgcgcgcgggcgcctgtccgcatgggacaggtcctcggacagtgcgcgcagcaggtgaaacgcctcacggggtgtggaggggtaggtcggcatggcgcggggactgtcccgagccccccgccccctgtcaacgctgggatggcgcccggatgaaaccctttggcgccgtggggtgagtcaaggaaatgccgactcgccgtaataaagggcagcagcaacgaggcccgccgccgccgcgccgggtgggctcggaagcagcacgcgcggtaccgacggagcagcatccatgtcgctcatgcctgtggatggaccccgtagtggagagggggcagtgatggagatgaacgtctcgaggccggtgcttgctgggggattctggaagaagaagcgcacgcagccggtgaagcgcgccaaggacgcgtcgctggtgcgttgggagtcgcagccgtggcgccgccagttacgcgacgcggcggaatacgagcacccggtggcgcgtgccgcgctggtgcaggcgctgctggcggaaggcctgacgatggacgcggacgcggcgcgcttcgcggggaccagcgaggaccgcgactgcatcagcatcgcgcaggtgctgcgcttcgccgactcgctcgtgctgcgcatggcgctggcgtgcacggatgaccacgtgctccaactggtgcatctgcgccgcgacgccgaggacctggcggagcggatgattgagtgggccaac

SEQ ID NO: 534 - DNA, 4234 bp, Myxococcus xanthus
gtggctgttcgtggaccacgtggatgagacgttcacctcctggcccgcccccacgcctcggggctggattgccctggtggccgacccggcgctcgcgcggcggatactccaggacgcgcaggcccgggggcacggagacgcgaagctcttcgccggcctgtcctgggcgtactccatacccgcggaggcgagcatcgccgaggtgctcgacaaccccggactgatggacgccagcgccgtggcggcactggaaatcgacacgcaactctccatcctccgcgaggagacgggcctcacggacgctgacatcatccgcgtgcccttcctcttccagaacgcgtcagacggcgtgacggcgtaccagcccgccacgctgaacctgctgtcgttgacgcccacgcaggtcatcgcgccagacccgcatggaccgctcctcgatggggaggacccgttcaagacgcggttcgaggaggcgctcggggcccatggcatccacgtgcactgggtggatgcgtgggcgccgttccacatcgcccagggccaggtccactgcgccacccagagcgctcggcaggtgcccgacgtgaagtggtgggagggtggacgatgagacgcgcactgcttcgcggcatcagcgccgccttgatgctggtctccctgagcgcgggtgggacgcagacgccccgcccgggtgatgactggagggccggcttgaagacgaacatctcccgggcccgccaggagaatccagcgacgttcatccggttcgacacggccgccgcccaggtggacgcgctggacgcgaagaagcggggcaccctggccgcggtgtcaccggggcttcgtgcgctggggccggaggcgctgtggcccatggtggagcggctcgccttcccaccccaggagacaccgcggctcccctcgcgtgagtccgcgcggctggccttcaaggtgggcttggtggaggccacgggggcgctgcgcgacctccgcctggcccccttgtggaaaagccttctcgaaagtccggacacccaacctcaggtccttcgcgcggtcgcgggagcgctggcgcggctggagacattggacgcggcgaacacgctcatcgccgcgtcgaagcagaaggacgcccggggcgaggccgcgatggaggccctgggcctgtgccggcggctcgtggcgacacgggcgttggcggatgcactggacgcccggccggaacgcgaagtcatgcgacggttggccaaggccctgggggatgccgggtccgcgtgggcatggaagacgtccggcgtgaaggcgcgctcggaggaaggcgccatccgtctcgtggcggccgaggcgctggtgcgggcgtacgtggacacggacggtgacgtgcggcgcgccgtctccaacgccctgctgcgcgtggatgcgccccagacgcccacgctcatcgacgcggcccggctgagcgccccgcccgcccaacaggcggcgctggacgccctggctgaacggctgcgccacaacccgctgcgctgacgtcaggccgcttcgatttccatccggtaccccacgccgcgcaccgtctggatggcgaagcgggacgtgctgttccagcccagcttcttcttcaggctggagacgaagttgtccacggtgtgcgggtccacgacgacgtcccggccccacactgcgtccaggatttcgtcgcggcgcagcacgcgctcgcgctcgcgcaccaggaaggcgagcaggtcgaactccgtccgcgtcagctccaccggggcgcccgccggcgactccaccttccggcggtccaggtccatccggtagcccgcgaagcgcagccccttcaccggcgccgcgccggagcggcgcaccaacgcgcccacgcgcgccagcagctcgcgcagccggtagggcttgcccaggtagtcctgcgcgcctgactcgaagccccgcaccacgtcatcctccagggtgcgcgcggtgagcatcaggacgggcgtcgccacgccttcttcgcgcagcgcgcggcacagcgtgtagccgtcaccgtccggcaacatgacgtccagcaggatgagctggaagtcgcgccggcccaggtgctcgcgcgcctcccgcacacaggtggcttcctccaccgcgtagccgccctggttctccaggttgtcgcgcagcgcgagccgcaggttggtgtcgtcctccaccaggaggagcgccggaacggatgaggtcatgtcgtcaccgtatgaggaaagcgaagctcgaaggtggtgccttccgggctggaggccgccacgcgcagggtgccgccgtgcacgcgcatgatgcggcggcacagggccagtcccaggccactgccgggtgcatcatgtccctggccaggcaggcgcacgaactcctcgaaggcgcgctcccactgcgtctgggggatgcccacgccgttgtcggagaagcgcacgcggccatctgacagcgcctcgatgcgcaggcgcaccgggctgcgggtgttgtaggcacaggcgttgcgcgccaggtttgagagcagcaggcgcaggagctgtccgtccgcgcgcaaggagaactcccccacgtccgcctccagctccacggggaccttggaccagaactccaggtccttgcgcagctgcgccaccagctcgtccaggcgcaccggcgccagctttggcacccagcgccccttgtcgatgcggttgaaggacagcaggttctccaccaggaagcccagaccgtccgcttcccggacgatgcgcgccgggtagtcgcgcgcgtccgtgccctccgccagccgccactccagcgtctccgccaacagccggatggaggccagtggcgtgcgcagctcgtgtgacacggtcgccacgaagtcgctcttcagttccaggaagcgcaacttgcggtgctgggccacgaaggccagcgcggcgatgcccagcgccagcaccgcgcacgcggccaccatgcccgtcttcagccggtagcgccgctccagcgccccttgggcccgcgcccactccggcgtatccaccgacagcggcaggtcggccagcggcaacatctccgcgtccgcgagcagccgcacctgtccgtccgcctccagcaacccgcgctcgcgcatctcccgtgtcagcgactggagcagcgcgcccgagtccaccgccacgcccctcacgtgattgccgccgcgcggctccaggtaccaccccgctcgcaccagcgcgggccccggaagcgtcctgggcaatggcagcggttcggacgcgagctcggcggcgcgggcctcgaagtcggccaccggcacgcctgccttcgtggagagcgccacgatgcgctcgcgcaggaagtcgaagtcctccttcgtgaaacgtgcgcggcgcagcaggagcagccgctgcaatccatccaggcggccgctgcgcccgtccgccaggccgtcacgcaccagcgcgtgcatcaactggggaacggggtcaccccgctccgccagcgactccaacaccaccaggaagcccggcacgtcgcgcgtggaggccagcacgtactgcgcgcggtgttggagcagcgccatcagtgccacggtggatgcacggcggtcgccgcgtgacagcgcccggtccacctcgcgaatcagcgcgagccgctccgcccacgggtcctccgcctcgtccgcccgctccgtgccggcgcgcaggcccgcgtagcgccctttcgcgggcgtgtcttcgccggtgtcgtggagggccagccggggcagcaactgcgtgccccgctctctcaggtagaggcccgtcgcgggggccagcggatccagcgcggcggcctccagcgcggggcgcgccgcttccaggcggtctctcagggattgcgccagggaggcacgcgcgtactgctccagtgcctcccggcgggaatcgagcgaggcctgcgcgtcatcccgttcggtggcgaagatgcgctggagcgagcccaggccccaggccagcccggcgaagcccagcaggagcgcgatgagggtgggcagcaaccggcggagcatcggagcggctcagtttcccagggagggcacgtcgtcgaagtccgagcttccgccgggcatcaggcgctcgaagcgctccttgcgcgtgtccagcgactgggccttgcggatgagcgcccccagctgcgccacgtccttgggggttcgcagcggctcgccgatgccttcccacagcgtcag

SEQ ID NO: 535 - DNA, 4019 bp, Myxococcus xanthus
gctcaccgccgtcgcggcgatgcccaggaagcgccggtccaccttgccgcgttggatgagcaggctggcaatccacgccgccgtggtggcgctcaccgcgaagccgataccttgcgcgtagggcaacaccagcgtgttgaggcccaccacctgtcctcgcatgttgagcagcggccccccggagttgcccggattgatggcggcatccgtctggagcatgccctccagcatgacgccgtcgggcaggctgatgctgcggttgatggcgctcaccacgcccagcgacacggactgttccaggtggaacgggttgccaatggccatgacgagctggcccacgcgcaccgactcgggctcggcgagcggcagggtggggaagtcaccgccctccgcgcggaccacggccaggtcggtgggggcgtcgctgcccaccagggtgccacgcagttcctctccgttggagagctggacggtgagcttgcgtgagccgcgcaccaccacgtggcggttggtgaggacgtagccgtccggtgtgaggaagaggccggtgccgtggccgcgtgcgtgctccacgcccacgacggcgggcgaggcacgcgccaccagcgactccaaatcatccgagaagtgttgcagcagtttcacggtggcctcccttcacgagcgcttgcccacggtgatgggcacttcgcgaacctctccggcgcgcagcacgcggacctggagggtggtgcccaccttctcgtcgctcagggctccgagcaggtcctccacgccgtggaggggctgacctcccagactcaccaggacgtctccgagcagcagacccgcgtcatgcgccgggccgttcgggtccacggagaggcagatgaggccgtgttcgttccccgtgcccaggtgtgggggcagacgcacggggtaggcgcccacgcccaggtagccacgccggatgcccccgtgttccttcagcgatgcaatcacgcgcgtgagcgtgtccgtggcgatgacgacggcggcggtgcgagagaaggcggcggtgagcagaccgacaaggcgtccctcggtgtccaccagcgcgccgccggagaagccgggcgggaggtcggcatccgtctccaggtagcgctccacgcggcctccggcatgggtgcgccagccctcgccgtgggtgctgaccatgccgagcgtcgcgcgagccgtgcggccagggcggcccacggcgatgacgaggtgaccgaccttcacgtcatccaacggcgcggaggtcagcggcgcgaggccggtggcttcggccttgagcagggccaggtcggtgctggcgtcgcggccgacgaactcggcggagacggtgcggccatccggcaagccgatagggagccggccctcgtgctccacggcctggctggtggtgaggatgtggccctcggcatcccagacgatgccggtggtgccgcgcctgcgccgcgtctccacgcggacgatgccaggcgcggtgcgctcgacgatggaggcgagggagtgggacagcgactggaggaggccggtggacatggtgtgttcctttcgaggcacaaggtaaaggcctcgaaaaggcgccacatcggcggaccggtcaggtcgggaacctccccattcggggaggtcacctcgtctttggttcagcctgtcatgcggaaacgctcgtagcgcgcttccaggtactcacggcgcggccggtgggcaggagcctccggcaggatgctcagcgcctttccggcgaagcccttgagcccgtactccagcgtggggccgtcgcgctcggcgagcagccggggcgcgatttcgatgatgccgtcagggcggatgcccagcaggtccgtgtcgaaggccccgtggtggagtttgcagagcgagaggccgttggagatttccggcctgccacgctcgtcccggtccgggaggatgtgcgccgcgtccagcagctccggccgggggaaccggcataccgcgcaccgctgcgaataggctcgcagcacatgctgacggaaggcggcttgatggagccgcttcttcatctggaccgtggcgtagcggcgctccaggttcaagagcttcgggtccgccgcgtggagccccggcgccagcacctccgcatccggtgcggcggagacgacggtgaagctcagctcggctgggtttgcctcggagatgtagacgggccagatgggccgataggcgcccggctcgataccgtagaagtagatgagcgggacatcccattccatgccgcgcacgaggcgccggttgtcacgagacgcaacgtccgttccctggaaccggtactggaatccctcgttcgagcggaggtcgtcgtagcgcgcctctcggccctggcgaggcacggtcgtcttgatggacagcgccgtctcgcgcatgtgtcgaggccagaagatgccgcgtgcgcggttggcgaagttcagcgtctcgccctggtacgtgaagcctcgtgcaatgacgtcccaggacagcacctcgccatgctggcgcaccaggtgttgcagcgcgttcatggcggcgacccggatgggccagtcgaggtcctggttcgtcaaccccgccaggctaccaggtccggggcggatgcaagggctcacgggtacctctggcgaggtacatacaaggcgcgtgcctccatgcatctttcatcaagcaacggaacgcgtccgctgctcaatgaggaggtagcaacatgatctacatcactgcggtgaggctgtcgggaggcaacaggcttgagcacatcacggacttgaagtgggagaatcgggccactagcgaaagtggctcaagcacacgggctcaaatcgttgcttggattgaccaaggaaacgaagcccgcgtccaggttggttacagtgagtcgaaggtcgaggttgttcgggcagatccgccgtatctgcggtcgagtccgaacaacacgacggtcgacaacttgctgtccttgccaaggttctaagtgcgtcgaagtccttatcgactgggttgaccctgggggatgcgagctgggaacttgctgttcggaaatgtcgggggcaccccaaatgttccgacatttccgaacagcgcggtgtacgaccgcgtcggagaggcagggcggaagaccggattctcacgtttgctatctggctgcggacagctgcctgttgtggcaaccaacccgccaagggagcggtccacgcaactccagtcctgctgcttccccctggcccgcgcgtccctacgttctcctggaacttcacgatggcgaacgaaaggtcagcctcatggaagagacaggcgagcgcacgatgggacagccgcagggtgtcgtccagggagaccgccgggagttcgaggaactgctgaaggactatgacaccgccctcctcaccacccggggtgcggacggacactttcacacgcggcccatggcggtggcgaagaagcataagtccggcaccgtgctctggttcgccacctgggcggacacgcagaaagtgcaggacctggagtcggacccgcactgctcgctcgctttccacgcgtcggaggacagcgccacgtatctctccgtgtcgggtgtggcggaagtcgtccgcgaccggagggccatccatgacttgtgggagcccggctggaagccctggttcccacagggcccggatgagggtgacatcgccctgttgcgcttcacgcccgagcacgctgaatacgtccacccggcaggcggaaagctcaaggtgctcttcagcaccgcgaaggcgttggtgacgaagcagcgccccgacatcgcgcccaagaacgtgttggacctgcactgagcctgggcgagcccccggctaccgccggtccagcaacgcgccacccgggccgaagcccagtgtgagacacaacacgcgcgagtggttcgccagccgggaatcaccccgcgcgggctccgtggccagctccgcgtcattgaggcaccagcgcggtcccgggggcctggttccccatggccg

SEQ ID NO: 536 - DNA, 3084 bp, Myxococcus xanthus
agctctacagcggagtcgcgtgatgtgcacctcaccgtgaacaagggacgcctgtccgtcgaggcctcgcacacggcgcgccaaggattcatggtggaggtggcgggcctgcgcgtctccgtggtgggcactgtcttcacggtggagcgcacgaaggacggcgccgccgtggccgtcgcggaagggcaggtccgcgtcgaggcggaaggtcagccgccgcggcgggtcggtcctggcgagcgggtggaactgcacgcggcgacgcacacgctgaacccgcggaagatgtcgaagccggacctgcgggccatcgcggagctccgggacccggtggacgaagtccccgtaagcccgccccgccccgtcagcgcccggcccgcccccagccagaaacccgagccgaccgacgcgcccacccccatgacgccaggcgcggtagcggcggtgacgcccacgccgcgggagcccatcggtgaagccccggcgcccgagcccgcgccgccaccggcgaatgccctggcccccgtggccgccgcgggaagtaccccgaccgcgccaccggcccccgtggacccgaaccacgagttcgcgccctaccccgtgccgtcggtgaacggccccaggccgcccgcgccggagccccagccgactccggaggccgtggcgaagcaaacaccgaagcagcgcgagccgttgattcccatggcgctgatgtccaaggacgccgacgagcgattcctgggctacgcccggctcaaggtgaactcgcgcaagtgcgagagcttcctggtaggcctggacgagattgcccagcgcagcccaagggcgtcccaccgcgagcaggcgcgctaccttcgcgcgcggtgcttcgaggagaagctcgaatcgcaccgggccaaggacgaataccgccggtacctcaacgacttcccgcgagggcgctacgccaaggaggccaagacgggactgctgccctgaggcgggcgggagatgacggcctcatgtgcccgcccgcgacgcacagcacggacggtaacgggcctcggactcagctacccgtgcgaggcagcttctgaggcggctcggtggcgttgccgcgagccaccagctcgcgcaccacggactccagcgcacgaatgcgccggcccgcgcggcccggggcccactgcggcaactccggcccctgcaacagcgtcatcgcctgctccacgccgcccgccttgcccttcagcgcgcgcgcggtagccaggcgcacgctgctcgccggacgccgggtgatgccgcctcgtcacagcaggtccagcgcgaacgtggtccacaccgccagctcgtcatcggggcggaggaaggcctcgaagcgcttcatcgcctcggcccggggctcgcccgcgcggaggatgtcctccgacaactccacatgcagcggcgtgctgtaggccaggggctgctccggcgcgatgatggcctcgaagcgctcgcccgtggccggacggcacgccaccgcgtgcaccagctcggtgggaatctcctcgccgcccgcggggtgcgcgttcgcctccccgtagaagacgacgagcttctcgaagcgctccgccagcgtgcgcagctccagcggtggacgccacggcccgaagtagatgcggcgccgattgggtgaggtgcgcgccgattgccgttccaactgcgtatccaccatgtactcgaaggcccgcagcatcgtgtcgaagcgcgcggggtccccttccaggatgcccagcatctccaccaccgcctcgatggtggacacgcagtggtccgcgggctccgcgcggatgcgatagttgctgggccggcgcggcacgaagccgatgcgcggcagcccggccagcaccgggttgcgcgacacgaccttcttcgcctgcggccaggtgccgtccacgacgatgagcgtcttgggaggattcagccgcgcctcctccaccgagatggcgtcctcgcccgggaagagcaccgcgacggagtcccgctgcgcggccagctcctcgattcgccggtggccggagaagtccacgccctcatgcagctcggagttgctcagcgacaggtgggccatgcgcgcggtgccaatggccacgcggctctcgcgcgggtgctggaggaacacgacgcgcgtgcgagtctccaaccggggcggcagttgcgcgcaataacacgcgctctcgggacggcggcaacgcaggcagaggttacgcacggccaccgcctttacggcacgctccgagcaggggcaagtcccaccacgggagggccgggcaggctgggtgcccgggggccggcttccccggggcaacagcggccgggcaccgcccccctggaccgaagattccccaagcctccaggcgacggagtacagaggcccggtgaacctgctgctcctcctggacgaagacttcctgcccgacggcaccgcgcgcctcaccggacggcgggcccagcacgcccgcgaggtgctgcgcgccgagcccggcgagtccctccgcgtaggacacctgggaggcctcaccggcaccggcgaggtgctggagaacagcgccggcgtgctgcacctgcgcgtcaccctcaccgagcctccgcccccgcgcgcgggcatcgacctgctgctggccatcccccgccccaaggcgctgaagaaggtgctgcccgcggtggcctcgctgggcgtggaccgcatcgtcctgctcaacgcggcgcgcgtggagaagagctacttcgattccaaggtgctggaccccgcctttgtccacgagctgctcatccagggactggagcaggcccgggacacgcgcctcccagaggtgctggtccgagagcgcttccgtcccttcgtcgaagacgagctcgacgccttcttcggcccccagacgctccgcctgctcccccacccgcccgcgaggcagtcgctccgagcgctgggcgtgggtctggcccagcgcgtcgtactggccattggaccggacggcggctgggtgcccttcgaggccgacctcctggaagcccatggtttccacccgttttcgttggggccccgcattcttcgcgtggaga

SEQ ID NO: 537 - DNA, 4341 bp, Myxococcus xanthus
gttgctcgatgagcgcgatgttcatcgcgttccgcttctcagggcggttcagtccaatcttccgcacgaacccttcggtctcttccgtgatgaagttgctcatgagtccctcgttgggtggtgaagtcacttcgtctgttcgagccaatccgccgcctccacccagacgacctcgggcatgctggagcggaaccagccgaagtggccgatgcgcttcatgccgagctctgcgggcgtgcggtgcaggtgctcgcgtgtcgcgttcgggtagtagtccagcaacgcacgcgcggcggcctccggcgcgatggcgtcgtcggagaagctgtagagccgtattcgtgcccggacgcggtcgttgtacggcctcaacggcgcgccgttgtcatcggagacgtagtgtcggttgcggcaccagcgcgcccactgcttcgcgatgcctcctggcaggtcttccgagcccacggcgcggcccgggaagtagcccagcagcgcgacggaggcgggcagcgcgacgtaccagatggcggccaaagccagcccctggcggagtggccagtgccgccaccagccgtgctgtgagccaatcagcagcacggactggatgcgcgaggcgttctccgccagccccagcatctgaccgcccgccgagtggcccacgacggccagccggtgcgaggggaaccgagccgtcacccagtccagcacagcgggcgtgtccagctcgccccagtcctggaagcgggcctggttgcgcagggacgcgtcgacgaccgagtcccccatggtccggtagtcatacgtgacgaccgtgaagccccggcccgcgaggaaccgggcgaacgcgtcgtagtacctgcgcggcacggccgtcgcgggattgatctggacgaccacgccattgtcctggagcccctggtacaccgtcgcggccagtgggagcccatcccgggcgggaatccggacgacctccggtgaggccgtcgcgacgggagcgggcaaagcgtcatcctgcatcatggcaccttcctggagggggctgtctctggacgcaggcatcgccaggcggcatctgcgaggaccttctcgatgccggccttgagctccacttggccgttggcccaggcgcgcagcaattcctgggcggggccaagcatcagcggcatgtagacggccggaggcagtggcagcagctcgcccgcctgggcatgggccttcatccggctgaagccttcccggatgaagtcgcccgtcgcggattggatttcctgttcggccgcggccacggcttcctcacggcgcatgcgcaggagatagcgggcggcctccgggtgctcccgggaccaggcgatgtggtgggtgacgatggtgcgcacgaaggcttccgcgtcgtgcttccgctccagccgaccccgcaacgactcctgatggaggcgcaggcagtcgatgtagagcgccaccgcgatgccttccttcgccccgaagtggtggtagacgctgcccacgctggcgccgctgaccttgcggatgtcctcgatggtcgtcgccgcccagcccagccgggagaagcaatccagcgcggcatccaggatggcacgacggctctgctcgccggtcgcgctgcgacgtttacgctccatgactagaatctgattctagagccagattctagtcaagcggccggccgggccggccgatgttgtctggaggtcagaacgctggcactggcattcctgtgtttacagggtcgcggcgcggacgagccgcaggacgaccgtgaagtggagccccgcaccgaccagcgtcagggcgtggaacaactcgtggtagccgaagacgccgggccggaggttcggccgcttcagggcataggcgagggcgcccgccgtgtaggcgacgccccccgcgaggatgagcgccaggttgctgcccgtgagggcttgccgtgcttcatcgaagtacggcaccagcgtccagccgaccgcgacggccaacgccgccgtcaccaccttgggcgcctgtatccagaacagcgactgaaggactccagcgagcgcgcctgcccagatgaggagcagcaggcggttgcccgcggccccggagatgcccagcagcgcgacgggcgtataggtgcccgcgatgaggatgaagatggaggcgtggtccatgcgccgcatccacgtcctgcctcgcgtggaccagttcacccggtggtaggtcgcgctgaccgagaacaacaccaccaggctgacggcgaacacggcggcggccgtcgcggcccggtcggtcggggccatcaagacgaggaccaggcccgctcccagcgcacccgtggcggcgaactgatgcaggaccccccgcagtttcggcttctccgcggcctgggcgctcaggaccggccccgcgattcgaggacggcgaggacgttgagctcggctgtgtcggacaagacggctcggcgagagacgggatacatgaggggctccaactccaccggagagttaccagttggtaggttccggttgggtaagttactgttgagtaggttagaggtcaacgtggcgacgaagaagcgactgtcgggtgccgaccgccgggtccagttgatggcggtggggcgaggcgtgttcgcctcgaagggttacgaggcgacctccatcgaggaggtggcccatcaggcgggcgtgtcgaagcccatcgtctacgaacacttcggcgcgaaagaggggctctacgcggccatcgtggaccgggagatggatgacctggtgacgcgcgtgtcggagagcatcgcctcgggcacgccccgcgaacggttcgagcgggcggtgctggccttcatgacgtacgccaaggaggagcccgcgggcttcgcggtgatgacgcgcgattcaccgctggcggctggacggcgaggcctgacgcgcgtcatcgacgacctcgcgctgcgggtctcggacatcttcaagagcgagttcgagcacgctggctacaaccccaaggtcgcgcccatctatgcgaacgcgttggtgggcatggtgacgcaggtggggcagtggtgggcggaggatgggcgctccttctcgattgaccacgtcgcgcgccacgtcgcggcgctcgggtggatgggattgaggcacctgccgaaggaaccggctgcttcgaatgggcggcgtggcgcgaagcgacgcggcggttgagtcccgcggcgcgccttcgcggcccggttcgagcataggaaactggtggagcgccccgacttgccggaacgcccgcgcccgtctcaatgacagctggctccaccggcgttcacgctcaccgcgcggtagacgagcaccgccgccgccaccagcggcaccgcccgttggagcagcagggacatccacttcgggcggtgcttccacagcgccgcctgaagctgtgcccccagcagggcgggtaggccgtcaagcgcgaacgcggagagcaccagcgctccgcctccgaacgaaccgctcgccagcgccaccgcgaagacgccatagaggaggccacagggcagcagcggtgtgaccgcacccattgcgctcgcacggcccgtccacgaaaactttgcgccccagcgcgtgacatgtctcgcgaggttcgccatgcccggcagcgggcgcaggcgcttgcccagctccagtgcggacgcgaccagcgccaccgccatcagccagggaaggtaggggcgggtggagaccgccagcgcctgggtgacgcctccacccagcattcccagggcgccgcccacgagggcataggcgcccaggcgcgctccctggtaggcgacgacggcccggcggcgctcggggcctggaacgccgggtaggcccgcgcaggccagcggtccgcacatgaggaggcaatgcacgctccccgtgagccccaccacgaaggcgcccagtgcgccggcgatgacggtgggttcggaggtgtgcagcagcgaggcgagtgcggccggttcaggcgacatgaacgcggtgcatcgcaacaggcatgccgttcgcaaggtgacatcgtgaatgcctgcctccacgacatcggagcctgctccgaccgcctgtctccactgcggcagccccgttccttcggggggcgcggcgcgcgacttctgctgtgtggggtgcgaggccgtgcacggcctgctcgtggagcaggggctcacgcgctactaccagctcgcgcaaggaaagacggcgcccgcgcctgagccgcgcaaggaacgcgcgttcgcgtggctggagccgctcatgagtcgcgcggagtcgactccaggccccttgtgcgcgctcgaactggacgtgcagcttgagagca

SEQ ID NO: 538 - DNA, 2936 bp, Myxococcus xanthus
gtggccccctgggcaccagggccccagcgcgacgaagtcctcgtggcctggaacgacacggccgctccctaccccgcggacaccaccgtccatcagcgcttcatggagcaggcccggcggacgccggagcgcgtggcggtgaccttcgagggtcgctcgcttacctatgcggagctggatgctcgctccaaccaactggcccggcacctggtgtccctggggctggagctggaggcgcgcatcggtgtgtgcggatcccgcgggctggagctggtcatcggggtgctcggtgcgctcaaggccggtggctgctacgtgccgttggacccgtcctggcccatgaagcgcctggagcacgtgtcctcggcggcgcgcctgtccgcggtgctgacgtggcagtcgctgttgccctcactgaaggacggcccctggcacgtcgtggcgttggacgcggatgcggcggacatcgcccgccagtccacggaggccgtgcccgttccggtgttgcctgatgcgctggcgttcgcgacctttacctcgggctccacgggaacgcccaagggcgtggccattccgcaccggggcctgttgagactgagcgagggcactcgcttcctgacccagtcccccgaggaagtcacccttcagctctctcccttggccttcgacgtctccagcgtcgagctctggggcacgctgctgcacggtggccggctcgtcgtgtacccgcccgggacgcccgagctggacgcagtggcccgcctcatcatcgagcacaaggtgtcgtggctcctcctcccaacgtcgctcttcgggttgatgcagcagcaccaacccgaggcgctgctgcgcgtgcccaacctgatggtgggcggcgaagcgcttccggcgcctcggctgcgggagcggctggcgcagggcggagccctgaccaacgcctacgggccgacggaatgcagcaccatggtcacccggtacacgctgtctccaggggacaccgtggggctctccgtgcccatcggccggcccatcgacaacaccgaggtctacgtgctcgacccggcgctgtgccccgtgccagtgggcgtgccgggtgagctgtgcctgggcggaccggggctcgcgcggggctacctgaaccgcccggacctcaccgccgagtgcttcgtgccccacccgttcagcgccgtcccaggcgcccggctgtaccgcacgggtgaccgggtccgttggcgcccggacggcgtgctggagttcctgggccgcctggaccatcaggtgaaggtgcgcggcttccgcatcgagttgggtgaaatcgaagccgtgctgcgcgcccatcccttcgtcgccgaggccacggtcgtggtgcgcgaggacggctccgggagcaatcgcctggtggcgtatgtcgtgcctccgcagccggatgtggccccgctgcgcgagtatctgcaccagcacctgcccgactacatgctcccgtccgcgttcatcggactggacgccttcccgttgacgccgaccggcaaggtggaccgcaaggccctgccggctccggaccttggtctgggggcgtcggacttcgtggcgccccggacggaactggagcaacaactggcggccctgttccgcgaagcgctcgacatcgagcgcgtgggcctgaacgacgacttcttcctcctgggcggccattcgctgctggccacccaggtcgtgacgcggctgcgcgcccgactgggtgtggagctgccgctgcgaacgttcttcgaggcccccaccgtggcgcgtctcgccgcgcgactggagtcggcaccgcgaacgggcgcctggctcccgctggagcccgtctcccggcccgccagtggcgaagcgacgttcgacgtctcgtccgcccagcgccgcctgtggttcatggagcaactccatccagggctcgccgtcaaccacatccccgcggcgctgcggctgacggggcggctggacgtggaagccctgcggcgcaccttcctggaagtcgtccgccggcatgaggcggtgcgcaccaccttcgtcacgcgcgggggccatcccgcccagcgcatccatccggtgccttccgagtggccgctgcctgtggaggacttgagcggcctggagcctatcgcccgtgacgcggccgtgcaggcccgcatgggcgaagaggcccaccgcgcctttgatttggagaggggcccgctgctgcgcacggtgctgctgtgcaccggcccggacgcgcatgtgttgctgctgtgcatgcaccacatcatctcggacggttggtccatgggcgtgctggtgcgcgaagtcggcgcgctgtacgaggcgctggcccaggggcgcgagtccccgctgcccgcgttggtggttcagtacgcggactacgcagcatggcagcggcgcctgctggatgacccggcgctgacgccgcagttggactggtggcgatcgcgcctcgaaggcgctcccacgctggagttgcccaccgaccatgcgcgccccgcggtccatggcgccaagggcgccacgtacttcttctccctgcccgcggagcaggtcgcgggcttggagcgggtggccttggcccacaatgccaccttgtacatggtgctgatggcgggctggcaggcgctgctcgcgcgctactcgggtcagacggacttcacggtgggcacgacggtcgccgcccgaagccggcctgagctggaggggctcattggcgtcttcgtcaatccgctggccttgcggtgtcggttggacggcaacccgaccttctccgaactcgtgacccgggtccgcgaggagtcgctgggggccttcgcccatcaggaagtgcctttcgagcagctcgtggacgccctgggcggcgagcgcgacctgtcccgcacgccgctgttccagacgctctttgtgctcatgag

SEQ ID NO: 539 - DNA, 2112 bp, Myxococcus xanthus
tgtctctaaagcccgagcccgctgccaccaccttcacccgcgccaccgtgggtttcgcctccgcgaggtcgacgatggccacctcgtccgaccagcaggcgatgtaggccgtgcgctcgtcggcggacaggcgcaccgcgtgcggcgcggggcacacctccaccatggccttccgggtcatcgtccgcgcgtcgatgatggccaggttcgcgttcatgtccgactcggggcggccctggcgcgccatctccgaaatcttgagcgtgtcgaagtgcgtctggtacagcgtgctcccatccgcgctgatgatgacgtcgccgggattgggattcacacgcaccgagcccacgagccggttgttgcgcgcgtccagcttcaggcagtagccgtcatccgcgcccgtgccgtgggcaccatgcggccccgagccaccccctggcacgtagttggagatgccgacgtaatagaagtcccccgcgggcgacacggcggtgtggtgcggcccctccagctccaccgggttgagtcccaccggcacgcgcgccagctcgcggaagtccggcgtgcccacggtggccagctccaccaggctgagggtgtcatccaggctgttggtgaccaggatgcgtccgccggggcccggcggtggaatgaacgttccttcccgccagggctcctcgtgcgcgtagtccagcccgtccggtggcgtcacgcccaccacccgcgccgagttctcatcacagccggccatcagcagcgccagcgcgggcatccaccacggtgtccggtggctcatcgcgaatcctccacgcggatggtgcgtggtgactccaggcggtacggaccttcacgcagccggttctggaccaggtaggcgctggtcacctggacgcggaggtcctgacccgaggcggcacggagcgtgtcccaggtcgccgcgtcgagctgccactccatgttcgatgtcagcagctccaccggacatcgccgcccgggcacggtgacctgcacccagtagaagtcgccggtgacgggcggcagatgcgcctgggcggacggcagcagcaggttgcccagccacgccatcatggagtggggcgtctcgcgcgaaggaagccgggaggccagcggagacgtccaacgccaaatgggcggcgccgcatccatcgcataggtctggcccgggacgggggactccagcgtcaccgcctgggagctgtcagtgggccggccttgcgcgtcgacgaaggtgcgccacgcctcgtcggtggcatcgccgccgtagaggggttcgccgcacgcttcgtcccgtggcgcgtcctcgccgtcgcaggcggtgcccaacaccagaagcacggccgcgcagggggcccacagccgctttcgaatcggaagtgtcatcagaagcctatcgatgtggacgccgtgggccacggcgcctcgggaggagagaggacagcagcaacagcaggggcagggcggggcccgccgcggcggcgcagccaccggacttcggctcgggtgggcgctgctcgggcggctgttgccccgcgtcgggcgtgcccgcgtctggggtccccgcatccggcggcggcggctcctccacgccaccatccgggtagagcggagcgcccagttgctccgcgagctgcggccagcgggccgggcagaggtcccgcacgggggttccacgtgggcatagctgcgtgccctggatttcgtacaacgcgaagatgtgctcccacgtgcgcccctggtccgtactgcgcgccagagcccagtcgtgcagccaggtggagccgcagccgtagagcgtctcgccgtcgcgcagcacgcacgcgttgccggtaggcaggggctgcttctccagcgggccggtgctcgagcccatgaagaagtagttgagggtgcccacccaggcggtgccgccgtcggaggacaggtccatgttgatgaacgtgtcatccaacacggtcaccggcgtcagcgtgcggcccccgtcatcgctgcgcagcaggtgcgtgtagccctgcgcggagacgcgcacccacaccacgtccacggcgacggggtccaccgccaccacggtcagcgcgtagggctgtagagcac

SEQ ID NO: 540 - DNA, 3059 bp, Myxococcus xanthus
tgtgctcgacgcggacaaccagattcccgacgggaagctgcccggaaagtcacggcagcgccgcacgctggtgatgaactggtggggccaccgtcccaccgacatccccgcgtgggcggacacgcgcctctaccgggcgctggcgcgctgagcttcctcgcgggctgtctcgcgcaggcggtgggtgacgcgctcggcccactccggctcgatttccaggcacgcgggccgccggcccagccgcagcgccgccgacggcatggagccactgcccgcgaaggggtccagcaccgtgtcccctgggcggctgtacgtgcgcaccagcggctccaggacggagaagggcttgtggtgcgggtggccgccccaacgctttgcttcaccttcatcgtcatagccgccgactacggcccagacggtgggcaaatctcctggcgccagcggcggcgcgggcgtgcgggcaatcacgagcgcgacttcgtagacgcgcagcgtctgctcgttggcgttcttgtcggtggtgcgcttgccccagacgtactcgccgcgcaggtgcgggtagcccagcccgcgcgcggcggtgaggatgggctccttgcccagcaggttcgtccagatgatgagcggcgcgtccggcgtcaggtgcgcggtggcgctcgacagccaggcctcggagaaggcgcggtagtcgcgcaccgtctcgaagcggacgatggggttctggtcgatcttcttgtgcgcgcgcgtgtctcgcaggtccccgcccttgcgccgccgggtgagcaggcagtacggcgggtccgtgtggagcaacgcggcgcgggtgtcgcccaacgctgcgcggtagcccgccggctcgcgggaatcggcgttgatgcagcgaagggactcgggcggggaaatggaggtcatcggcctgagcggcaccctacacggcggggcgcgaggctcaagtggcgcgctcaccgcgcctggaaaccctccaacttcaaggtccgcttgcggccctcgtcccacagctcgagcgtgtaccggccgaagtccgcggcctccggctcctccaggacgatgatgatgggcgagctgcccgcggcgtccaagggcccttcctgccagggagggagcgtccgcatccggttgccctgggcgtcggtgagcgccgcgccggccgccatccatcccttcccagcctccgagggcaacaatgaaagccgcagcgcggcccacccgggggacagacggacgaggctcgcgcggcggacgacgaagtcacccgtcaccttccggggcgcccagtgcctgaacatgacggtgctctcgtcgaggatgtccgccaccagagactcgcgcgtgtactcccctcccgtgcgggagcgctggagttgctgcacctggcgctccagccggagcatccccgcacggagttcctccacctcctgccggtaggacgcggcggaccgggcatggcggtagatttccacctggcgctccggccgcgtggcatccacgacgaggtccaacacggcccgatccggcacggcgccatcatggaaccggacctccagccgcagccgctccccctcccggaacgtgggcgagggcaccagcacgaggtggtcctccgtcacgccgaaacgctggaaccgctcacggccttcgagcgccagttgctccggacggatgcgcgcatcgaagaacagggtggtggacagaccggggctgatgcggacctccggcggcgtggccagacctcccgcctgcacgtcaattcgccgcaccacggcggcacccgcgggcgcttccacagccgcggactccgccagggtggcccacaacaagccccacgcgagcacgatgaaagtgggcgaaccagtcaaggccgagcaacctccagcaaggacgcctccacaccatgacaggtggagggctacctgcggtgccccatttctccaagaacctgggagatcgccaggttgacgcccggaaacatcatcggtctgccgggagtgctggaagggtcatactccatccccacggcttcccgggcggcgctgtccacgatgttggcgcagatggggatgcgccggccgtccgggtactccacctccgtgaaccacccgtagatggccgtcttcccgtggtacaccgtcccatagaagcggctccccttcgggaggcggccgctccaagcgctccggacctcgtcgatggcatagagggtgatgggctccccgtctggcggcacgggcaccggacgcacggaaaccttgggcgtcatggagagcgtcaagtcgttgccaatcatcttgggcgggtggaagcccagcttcgccatggagtccaacacctccgtcgggcactggatgcgaggcggcatgtcccgcacctggggcccgctggcgcacgcggccgagaggcaggccacggcggcggccttacccagcgcgcttcctggcgacgggcgcttcttcaacggtgacgcgtgggctgcttccccctccgcgtcggaggaagccacctgcgcggacacttcgtcctgcgcgtccgtgtcgtggaccgcgcccgcgtccggagaggacggcaccgcctctaggaggggcatctcggagggattcgaagaacgactcgtcactgcgtgacttcctttctcaatgggaacaggcggggcaggagccggggctcccgcgatgggcatcgcgaggcggctcaccccgaacaccaccaaccccacgcccagcagggcggctcccccccaccccatgacggctcggcgcctcgaacgcggtgctggcggcgcgggcgtctccgccacgggcgccgccgatgcgggcacggcgggcgcctcgaccgcgggcactccgggcggctctgagggagtgacgggcgcattcgcatccgccacgggcacatcccggggctccggattgaggggcagcaccgcggcgacctcggacggctcccgagaacggacgggccgcgaggacgtggaggcgtcgggcaccatgcgcacccgcggcgcctccgcgtcggcgccctcgggcgggcggtccaacgacacc

SEQ ID NO: 541 - DNA, 4009 bp, Myxococcus xanthus
gcgcttgtcatgaacgaggtgcgcaaacaactggtggatcgccaggcacagcagggcgcgccgtcccaggcctgagtcggcacgcctctgtgcagcgtgaagacgggcggggcctctcggggggagaggtcttccgccacgtcttcgtttcagctcaagacctgcaccttgccgtggtcatcgcagtggccgtcgtgcgggtgatgcaggtgaccgtccacgagatagtccatgtggtccccgtgcggcgcggccgcgtggccacacgaggggccgtggcggtgcgtggcttcatgggcaccacaggcatgctgcggcgtgcattgcgcggggttgcgcgcgtcttcggcgagcgtgcactcgtccgtgtggtccgagtgcgggtggtgcaggtgcccgtcgtgcagatagtccacgtggtcctggtgctggatggcggggtggccacagcccttggcatggacgtggtcatggcgctcgtgcgtcttgtgattcatggcagcctccctggcggcggtgtccctggatgacacagcgggacggtcgccatcccggaaggccaggacaagcgccgccaggacgagctccgactgccggaccaggccgtgtcacctgtccgccgtcaggcgcctgcctgccgtgcggccgctagtgctcctggggcgcggcgaggaacgccttcagttcggggagcacgcgctccggacgttcctggtgggggctgtggcccgcgtccaggcgcaggagccgagcctggggaaggcgccgtgccgcctgctcggcgatggagacgggcagggtgtcctcgtgctctccccagacgagcagcaccggcgccgttatggcgtcgagcttttccgcgcgatgaaagacaggcccggccacgggcacgagccggttgaaagcccgcgcggcgtcggggctggcgcccgggcgggtgtgaagttcgtactccagggcgcccagccgctcacccagcggcgtcgggggtggcggcatcagctgggcccaggcccatggccccagcgagcgcgccagccgttcgggaccggcgcggaagaagaggcgggcttttcgcgccatctccgggcccaggcccatggcatccaccagggccagccgttccaccggtacccggccgcgcagcgcgagctccagcgccacgagcccgcccagcgagtgacccaccacggccaccgggcccggggcgagctgggacagcagcgcctcgatgggggcggtgaagaaggccgccgcgtcctcgccagtggccagcgggccttcgggggtggacgacatgccaaagcccggcaggtccaccgccagcacgcggtggctccgggcgaggaccgtcaggtaggtgaaccactgggaggccgcgccgcctcgcccgtggagcagcaccaccgtggggccggcgcccgcctccaggacccggagggccccgccgcccggcaaccagtgaaccgtcgcgaccaccgccggggccagctgggccagcaacgcggcttccaccggccccaccgagggagccttcatgccgccttcctcgacatcggcgtccgccgggagtggaacaggggttggcgtggcggctgtgagtggtacatggggaggacactccaggaggggcggacgggcgggcaacatactggaatgcgcggccctcagcggtgttgagccggataccctgtaaaccctaggctgcccgccgccagtccgacacgaggcgacatgaacaccgacattcgcgcgctcaccgaacgcgtgcagcaggaaagcagcttcgtcgaggtcctcaaccaggaaaccagcaaggtcatcgtcgggcagcgctacatgctggagcgcatcctcattggcctgctgtgcaacgggcacgtgctgctggagggcgtgcccggcctcgccaagacgctgacggtgcgcaccgtggcggattcgctcagcgccaccttcatgcgcatccagttcaccccggacctgctgcccgcggacgtggtgggcaccatgatctacaaccagcaggcggcgaacttcaccgtccgcaaggggcccatcttcgccaacatcgtgctcgcggacgaaatcaaccgcgccccggcgaaggtgcagtccgcgctcctggaggccatggccgagcgccaggtcaccatcggcgaccagtccttcccgttgccctcgcccttcctggtgctggcgacgcagaaccccatcgagcaggaaggcacctacccgctgcccgaggcgcaggtggaccgcttcatgctcaaggtgaaggtgggctacccgacgcgcgatgaagagaaggtcatcatggaccggatgtccggcggctcgtcgccgcgcgcccagcgggtcatcgacctgcagcacctggtccgtgcgcgcgagctcatccaccacatctacatggacgagaaggtgaaggagtacatcctcaacgtggtgttcgccacgcgcgagcccagcaagtacggcctcaaggacctggcggactacatccagtttggcgcctcgccgcgcgccaccatcgcgctggcccaggcggcgcgcgcgcatgccttcctgcgccaccgtggcttcgtcacccccgaagacgtgaaggccattgccttcgacgtgctccgccatcgcgtcgccatgacgtacgaggcggaggcggaagacctcacgccggagaaaatcatccagcgcgtgttcgaccgcgtcgaagtcccctgacccttcttcctcgagcccgccaggcgccccgtgcttcccaaggacctcatccgccgcattcgcaagctggagattcgcacccgcaaggtggtctccgacatgctcgccggccagtaccattcggtcttcaagggccggggcatggccttctccgaggtgcgccagtaccagcccggtgacgagattcgcatcatcgactggaacgtcaccgcgcgcatggatgaggcctacgtcaaggtcttcaccgaggagcgcgagctgacggtgatgctggtggtggacgtctccgcgtcgaaggagttcggctcgcgcgagcgcaccaagtcggaggtcgccgcggaggtggcggcgcagatcgcgttcagcgccatcgccaacaatgaccgggtggggctggtcctcttctcggaccgggtggagaaggtggtgccgccgcgcaagggccgcacgcacgtgctgcggctggtgagcgacatcctcacgttccagccgcaggggcgggggacggacctggccgcggggctcaactacctgacgcgggtggcgaagcggaaggcggtgacgttcctcatctccgacttccaggcgcgcgactacgagaagccgctgcggctggtggggcgcaagcacgacctggtgccggtggtggtggcggacccgatggaggaggccttcccccggctgggcctggtggacatggaggacccggagacgggcgagcgcttcgtcgtcgacaccagcgacccgcgcgtgcgaggccgcttcgcccgggccatgcaggccgcgcgtgacgagcggcgcaagctgttcaagaagctggagctggaccacgtggagctgcgcgcgggtgatgaccacggcaaggcgctggcgaacttcttccgcgcgcgggcccggaggatggcggcatgaaccggcttatccccctgctggcggtgtggctcgtggtggcggcgctggtggtggcggctccggcgtgggcccaggctccggcccctgcaccggcgcccgcgacgacggagcaggtcgaaccgcggaacctgtccgtgcggctggagccgcagcaggtccgcatcggtgaccccttcgtctacgaggtggtcatcacccatccgaaggaccaccgctacgaactgaaggtgccccaggagacgggggacttcgagttcctggaccagacgcgccagcgccaggacgggccggactcggcgaccaccacgttccgggtgcggatgtccgccttcgccctgagctcggtggcggtgccggcgctgcccttcgacgt

SEQ ID NO: 542 - DNA, 3443 bp, Myxococcus xanthus
cgacacgggcagcattgcctacaaccacccgctggcgctccagctcacgggcgcgctgaacctgcccgcgctccagcgaagcttcgacacgctggttgcccgccacgaggtgctgcggacgacgttccgcatggaaggcggcgcgcccgtccaggtcatccacccgccctctcaggttcccatcgaggtcttggacttgtcgggtgaggccgtcgcccatcttcgtgaggcggagacgctgcgacgggtccaggaagaggtccaacgccccttcgacctggcgaagggcccggtggtccgcggcatcctgttgaagcagtccgcggcggagcacgtgttggtgctcaacatgcaccacatcgtcaccgacggctggtccaacggcgtgatggtccgggagatggcggcgatctacggcgccttccggcaggggcagccgtctcccctgcccccgctcccgttccagtacgcggacttcgcggcgtggcaacggaagtggctccaggggcaggtgctggaggcgcagctcgactactggcgtgggatgctcgcggacgcgccgccgtacctggagctccccaccgacaagccgaggccggagcagccgtccttccagggcgacaacacgcccatccaattgccggcggccctgagcgacgccgtggacgcgctcgcgctgaaggagcgggcaacgcccttcatggtgttgctctctgccttccaggtgctgctgaatcggtactccgggcaggatgacgtgctggtgggctcgcccatcgccggccgtcgccacgcgcagacggaggggctcatcggcttcttcgtcaacacgttggtcctgcgcgctcgcttcggtcaggacccgacgttccgggagctgttggcccaggtgcgtgacaccacgctgggggcgtacgagcaccaggacctccccgtcgagcggctggtggaggacctccgccccacccgtgaggagggccgcacgccgctcttccaagtgatgttcgctctccagaacacgccggttcccgagctgacgctcccggagctgtccctccggggcttcgagtcgaagcacacggtcagccgcttcgagctggagctggtcctgtcccgggcgaccgagggctaccagggcgggctcgtctacagcaccgacctgttcgacgcggccaccatcgaccggatgatgggcaacctgcgtgaactgctcctgggcgccatggccgtgccagacgagcgcgtctcccgcctcccgctgctgtcccaggcggagcggcagcagtcgctgctggcgtggaacgacaccgccacgccccgaagcccgggcctctgcgcgcatcacgtcttcgagcaacaggcggcacggacgccagacacggtggcggtgtccttcgagggacagcagctcacctaccgcgagctggacgcgcgggcgaaccagctcgcctggcacctgaaagcgtccggcgtgggccccgaggtccgcgtgggcctgtgcgtggaccgctcgctggagctggtggtgggcatcctgggcatcctcaaggccggcggcgcgtggctgccgctggacccgtcgtatccggtggagcggctgacgctgatgatgcgcgacgcggccatcccggtgctcgtcacgcaggagcacctggcggatgagcttcccgcgctcgggctgctggtctgcctggacacggactggccgctcatcgccagccaaccgcagacgccgctcgcggtggagatgtccgaggacaacctcgcgtacatcatcttcacgtcgggctcgacgggccgccccaagggcacgctgctgacgcaccggggcctgtgcaacacggcgctggccgccatccaggcccaccgcgtccacgagaagagccgcgtgcttcagttcgccgccttcggcttcgacgcgtcggtgtgcgaggtgttctccacgctgctcgcgggcgcgcagctctgcctcgctccccgggaggccatcatgcctggcgcgccgctccagggcctgttgaccgcgcaggagataacaggcgtcacgctgacgccgtcggtgctggcgcagttggagccggagacgttgccgaagctggagtccgtcgtctccgcgggcgaggcctgctcgccggagctggcgcgccggtggctgaagtcccgccgcttcatcaacgcgtacggccccaccgaggcgaccatctgcgcatcggtggacgaggccctggacaccgaccggctgggcatcggccgtgcgtgggccaacgtccggctctacgtgttggatggccagatgcagccggtgcccgtaggcgtaccgggtgagctgttcatcggcggcgcgggcgtcgctcgcggttacctgggccggccggacctgagcgccgagcgcttcgtgccggacccgttcgcggtggagcccggaggacggctgtaccggacgggagaccgggtgcgctggctggccgaagggcgactggagttcctgggccgcctggaccaccaggtgaagctgcgtggcttccgcatcgagctgggcgaaatcgaagcggcgctggccgagcacccagaggtgcaggacgccgcggtgctggtgcgggaggaggcaccgggccgcaagcaactggtggcctacgtcgtcgctgacgatgaggagcagccgcccgaacaggacgccctgcgccgggccctggagtcacgcctgcccgagtacatggtgccgtccgccttcatcatgctgaaggccatgccgctgacgcccagtggcaaggtggaccgcaaggccctgccctcgctggcgcaggagcaggtgaagcgcgagcacgtccacgtcgcgccccgcaacccagtggagcagacgctggcggacatctgggcgacggtgctgtcccgcgagcgcgtcagcatccacgacaacttcttcgagctgggtggcgactccatcatcagcatccaggtcatcgcgcgagcgctggaggccgggcttcacatcagcccccgtcagttcttccagtaccagaccatcgccgccttggccccgcacgtgggtcaggcccaggtcgtggagagcgagcagggaccggtgacgggccccgtcccgctcacgcccatccagcactggttcttcgagtggcagctcccgcacctccatcactacaaccagtcgctgttgctgggactgcgtcagcccgtcgccgcgtccgttctccaggacgcgctgcgggccctggtcgcgcaccatgacgcgctccgcctgcgcttcgagcggacccccgatggctggcgccaggagagcctggggctcgacagcaccgtgacgctgcgggaggtggacctgtccggactggacgaggccgcgcagcgcgccgcattggaggaaaaaggcctgcgtgcccaggcgggcttccggctgggggaggctccgctggtggtggccgtgcgct

SEQ ID NO: 543 - DNA, 3760 bp, Myxococcus xanthus
  unsure (1)..(3760): unsure at all n locations
cgctctcaagccgggatgacttcttcgaactcggaggccactcgctgctgtccgtccagctcgcctcgcgtgtccgggagcggttgggcgtcgagctgcccgtggccacgctgttcgccacgcccacgctggcggcgctcgcggcccgtatcgatgcgtccccgaaggtctcggagcgcgtggagtccatgccccagacgcggccggagcacatccccgcatcgttggtgcaggagcgcctctggtacgcgatgcagctcccggaggcgccgcccttcgtcgtcgtcgccgcgctggtgctcgacggcacgctggacgtcgtgtgtctggagaccgccttggaggccgtgctggagcgcaacgccacgctgcgcaccaccttccgactggagcacggagcggtcttcacccgggagcatcccgtcacccggccggtgctcgtccagacggacctgtctcacctgtccgccgccgaggccctggacgccgcgcgcgccatcgccacccggcatgaccgcgagcccttcgccgtagaccagggcccgctgtaccgcttcgagctggcacggctggacgccagtggcacgcgccatgtgctcgtcgcgtccatgagccatctggtcaacgacggcatcggaatgggggccttcctggaggaactcgcccaggcctgggccggaaccacgccgctgatgcatcccgcggcgcggacgtatgcggacttcgcgctctggcagcggagccccgagcacctgctcgaggtggacgccgccgtggcctcctggaaggccgcgctggcacacgcgccgtccgtcctcgacctgccgctggacttccctcgccgcgcgcccgcgctgaacgcgaacatgcggccggagcccctgtccctcagttccgaggcgatgacagcgctccacgcgctggcccggcgcgagggcgtgtctcccttcaccgcggtgctcgcgctgatgcaactgtggctgcaccgcctcagctcgcagccgcacgtcgtcgtcgcgtcacccttctcgggccgcgttctgccgggcgccgagcggcaggtgggctacttcgccaacgtgctcccgctgtgcaccgaggtggcgggcacgccgtccttccgtgcgctcctgcgccgcgcctgggatgtggtggggcacgccacggcgaaccaggaagtccccttcaagcgcatcgcggacgcggtgcagccggatgcgcctcgcaccgcgccgccgctggcccaggccctgctgctgctggacagccccgcgtccctgtccttcaacggactgggtaccacgtacctggacggcgagagcatcttccccgcctacgacgtggtgctgcacctcatcgaacggcccgagggcggaacgctgggcttcctcgccaccgacagcgccctcttcacctccgccacggcacagcacatggcccgcgccttcgagcaactgctcaccgaggccgtgcgcacaccggacgcgcctctggcccggctgtccctgctgtcctcgcagcagcgtgcgcaggtgctggccacattggatggaggcccgcaggacattcctgagggcgcctgcatccacacgctcttcgaggcgcaggtgcgccgctcgccacacgcccccgccgtggcccatggcgattcgacgtggagctacgcggagctcaacgcccgcgccaacgcgctggccgcgcgcctgctctcccggggcattcagccagaagagcgcgtgggcgtggtgatggagccctccaaccagggcatggccgcgctgctgggcatcctcaaggcgggcggctcctacgtcccgctggacgcggggtggccggagcctcgcaagcgctcggtgctgacgcgctcaggggtgcagcggctgtgggtggatgcggaagcgctggaggcgcacgcgggcctggtgcccgacgtggaggttccgccccagcccgcgcacatcgccgaggacctggagcccggtccccggcacgtcgcggcctcgcaagtggcgtacatcgtcttcacgtccggctccaccggcgagcccaagggcgtcatggtggagcaccgcagcgtggtgaaccacaacgtcgccctagccgcgcgcttcggcttgcgcccgggcgacaggatgctccagttcgcgccgctcagattcgacgcggcggcggaggacctctatccgccgctcgtggtgggcgccacggtggtgatgcgcagcggactggtgcccgcgcacgtcatgacgccgtacctgaaggagacggacatcaccctcatcagtctgccccccacgtacatcgaggagtggattcgccagatggaatcccacggccagcgagtgcccgcgcggctgcgcctgctggcgcccggtggcgacgtgctcaagcgcgagacgtatgaagcctgggtgcgcgtgggtggtggccatgcgccgtggctcaacgtctacggccccaccgagtgcacgattacctccgcaacctgtgacatcccgggcgccgagggactgggcaccgacgccaccttccccatcggtcggcccatctcgcgcgtgcgcatccacctgctcgacgagcacctggagccggtgctgccggggctgcccggacgcgtgtacatcggcggcgcggcgccggctcggggctacctgggcgctccggacatgacggccgagcgcttcatccccgaccccttcgccaccgagcccggcgcgcgcatgtaccacacgggtgacctggcccggatgctgccggacgggcggctgcgcttcctcggccgcgcggaccatcaaatcaagattcgaggcttccgcgtcgagctggccgaaatcgaggcctgcttgcgtcagttcccaggcgtcgaggaagccgtggtgctggcccgcgccggcggttccgggcagacgcagctccaagcgttcctccaggcaccggcccagcatgtgcgcgcggacgcgctccgtgagcacgtcgcggcgcggctcccgtcgtacatggtgcccgcggccctcgtcgtcctggaggcgctgcccatcaacgccaacggcaaggtggaccggcaggcactgccagacctgtccgcgcagcccgccgtgccgcctgcgcaggagactccgggcgagcacctggagacgcccttccgcaccacgctggagatggcgatggagcggctgtggcgcgaggtgctgggacgcacggacatcggcgcgggcgatgacttcttccaggtgggcggcgactccatcctcgcgatgcggctgctgagccggctggaggaggagctgggcgtgcccgtccccctggccacgctcttccagtatccggtgttccgtgagacggccgatgccgtgcacgagctgttggccgagggccctccgcgctccagcgtggtgtccctatccggcaagcagacgccgaagtccgcgccgcccttcttcgtgttccaccccgccgacggcgagctgcactactaccggaacctcaccccgctgctggagcccggcctgcggtgctacggcgtccaggcccccgagacgcagtcgaagcacggccacgccaccttcgacgcgcgcatcgccgcgtacgtgcgggacatccaagcagtgcagccacacggcccctaccgcttcgcgggctactcgttcggcggctacccggcgctgggcgtcgcggcggcgctggaggcgcagggcgaaaccgtggagctactggccctggtggatgccctgcccgcggtggaagggcctcangggtcggc

SEQ ID NO: 544 - DNA, 4514 bp, Myxococcus xanthus
agaaaggccagggccgaagtctatggctttggagccgctgcgaggctcggggctgacacccagcgcccgcatgaacgacagggattcgagagatgcggtccgccagcaagcggttgatgccgccctggggccagcgctggggctcggcgagctcctcgtagccgcgctgggcgaaggctcgcagcaggttcagcgtggcggaggactggtgataggccttgagcagccggcgcgggtcgggcgttcgcgcctgggcgtcgaactccatgccgttgatgatgtccccgcggtagctgggcagggtgacgccgcccagcgtctccatggggctggagcgcggcttggcgaactgcccggcgatgcggcccaccttcaccaccggccggttgccggcgaaggtcagcaccatggccatctgcaacagcagccggtaggtgtcccggatgttgtcggtggtgaactccttgaagctctccgcgcagtcaccgccttgcagcaggatggccttgccttcggcgaccctggcgagccgggcggtgagctggcgcgtctcgtccgcgaagacgagcggaggcaggcgggacagctcggcttcggtctggaccagggcctgcgcgtccggatagtcctccggcatgtacttgacgggcttgtgccgccaggagtctggcgtccaggtggggttcgtcacgggagtgccgtttcggttggaaggcgggttgcgggcacgggcggcagcaggccccgcgcaatgcagtagtcgaggtatcggtacagcagcgcacggtccgtgggcgggcaggtgatgcccgttccctcgagcgcttgatggacccgctcacaacggatggggcccaggccaaacgcgggcacgtccgtgcccgagcgcaggtcgaaaaaggcgagcgtggattggttctccccggtgccggcgcgctccgccacgcggttgcgccactcacccacggggcagtgctccacgaggtagccgtagtcacggacccaggcgaacagctcacggagcttcacctcgggcgtgggacacagattgaacaccgtgggcgggcgggcatcgcgcgccatccggacgatggctcccgccacgtagtccacgggcgtccacacctcggcgacgtcgagctggggcagcgcgcccacgggaattcccgccagcaggatgcgccacaccaggtcctgcggattgacgatggcgctgtcgggcgcacccaccacgcggcccagtcgatacacggccacggggagtccgcgcgctccggcctgctcgacgagccgctcggcgatccacttgctctgctggtagccgtcgcgcaggcccgggtgcgcgggcaccaaagcctacggcacgtcggggctgaggtcggtctgcggcgccacggccagggtggagacgtagtggaagggcttggcgcggaccgcggcggccaggcgcagcagctcgcgggtgccgcgcacattcacgggctggaggctgccgtattcgcgcaccacgctgaccacggcggcgttgtggatgacggtgtcacactccgaggccagcccgtggaagcgcgcctggctcatgcccagccagggctgggtgaggtccgagggcagcgccaccacgcgctccgtcaggtgttcgggggagagctgctgggacgccagcgcggcctggatgcgctccagggcgtgcgcctcgtcgcgagcgcggaccaggcacaccacgcgcgcgtccgtctggcgcaggagctggtggagcaggtgcgccccgacgaagccggtggctccggtgaggacgacctgacgcagccgcggagactcggcggaagccaccgtgagcttggggacgacgtcctcggacagcacggcgtcggcgagcatgctctcggtgaggcccccggcgtcggaggcgccgtcggtgccttgctccagcgcctgggccagtccggccgccgtcgggtagcggaagacggtggcgacgggaatctcgcggcccagctcgatgctgagccggttggcgacctggatgctctggagcgactggccgcccaggtcgaagaagtcatcctgcgcggacgtcgtcgtcacgcccagtacctcttcccagaccttcagcaccacacgctccagggccgtggttcccgctgtggtggtcgcggactcttcggtgggcagcaggcggggcagctcggcgcggtccagcttgccggtgctggtgcgtggcagccgctccgtgaacacgaacgtaccgggcaccatgggggcaggcaggccgttcagcaggtgctgccgtagctccgccacggtgggcgcgggctgcgtggtgacgacgtgcgcgcacagccggcgcgaaccgctggggagcacctggccgacgacggccgcctcgcgcacgcccgggtggccgagcagcgccgtttcgacctcggacgggtcgatgcggtggccgctgatcttgaactcgtcgtcgacgcggcccacgaagacaagttggccgtcctcgcgcagtcgggccttgtcacccgtgcggtaggcgcgggggcttcccggcagggcgtcgagcgtgatgaagcgcgttgccgtcagcgcctcgcggcccaggtagccccgggcgagcgcgccgcccagcaggtggagctcgccttcctcacccgtggggacgatgcggcccttcgcgtcggcaatcgccgcgcgcacgccaggcagggggcgtccgatgggcacgtcttccccggcgggcgtcacgtcgggaccgccgctgagcgtggcgacagtggccaccacggtggcttcggtggggccgtaggtgttgagcagccggaccttgggaccggcggaggcccgccagcgggcgacgcgctcgggcaaggcggcctcaccgccgatgatgacggtgcgcagcgagggcggcagccgggccgcgcccgtggacatgctgtaggccagctcgtgccagaaggccgtgggcaggtccagcagggtgatgccatgtgtggcgcaggcttcgagcagccggggcaccgactggagcatctcgtccgtgcgcagcaccagtgtggctccggcgcacagggagacgaagatttcctccacgctggcatcgaagtgcagtggcgcgaactgcagcaccctgtcttcgggcgtcacctcgtagcggaacgtcgcgcccgccacgaagtgggccagtgcgtcgtggtcaatctgcacgccgttgggctggccggtggagccggacgtgtagatgacgtacgccagcggcgcgcccggctgggtcgccgtggtcggcagctccgggtcggcgcgccggtgcaccgcgagctgcccgggtgtctgcggaggcatgccggccgtgaggtccttcacggcgctgctcaccgtcagtcgtggcgcggcgtcatccaggatggccttcgtccgggattcggggccgaacgggtccacggggaggtatcccgcgccggagaagaggacacccagcgtggccacgatggcgtcgatgcttcggggcagtgagacggccaccagcgtgtcgggccgcgcgccgtcggccctcagccgctccgcgagcgcctgtgcggactggagcagcgccgcataggtgaggtggtgctcgccatgctccacggcgatggcatccggccgcgcacgggcctgctccttgaagagctccagcacgggccgttgcggaatcggcaggggcccgccatccacgacggagggccgcgcgggggcaggtgccgcgcgcacgggctgctcgggcgaggccaccagtgactccaacaactggaggaagccgagctggtgggcgtccaggacgtcggggctgtagcaggcggggttcgcgtcgaagtccacgcgcagtccgctgccatcggagcgggcgtacatgccgatggacaggtcctcgacgggacccgcggagaggttgtgggcgaaggccggcatccccgcgaagcgcagggcgtagtcgaacggcatgatgttgaccacggggccgaacagccgccgctggccgcccacgcgcttcaagtcgcggcgaagctgctcgtagcggtagcgcaggtgcggcctcatggcgcgcagctctgccgccacgtcacgggccatggcgaacaagccggcgtccggacgcaccgggacgcgcagcggaacgatgttcatggccatgcacggcacgcggatggcggccgagcccaggcgggccatcaccggcagacccagcacgatttcgggcgcaccggtgtgctggtgcagccaggccgccgtcgccgcgagcaccaggtccggccacgtgagcccggcctgcttcgcggcggcctgcatccgctccaggtccgcgggcgacaggtgccgcgtctggcgcacgaatcgcggcgtcatgggcgcgggctccgcgagcgtcaccggcgtggggccatgggtgaagcgctccacccagaaggcgtggtccgcggcgtgctgcacgcccccctggtaggcggcgtcctcatcgatgacggcgcggagggagccga

SEQ ID NO: 545 - DNA, 3453 bp, Myxococcus xanthus
gatgcccgcacagccgttcaatctctccgcggggcccttgctgcgcgccacgctgctgaagctggaaccgtccgagcacgtcctgttgctgtgcctgcaccacatcgtctcggacggctggtccctgggcgtgctggtgcgtgaggtgaccacgttctacgaggccttccacaacggacaccccgctgccctgcccgagcttccggtgcagtacgccgactacgcggtgtggcagcgcgggtggctccagggcgaaacgctgaaggcgcagctcggctggtggaagtcgcagttggccggtgcgccccatgcgctggagttgcacaccgacaagccccggcccgcggtgctgcgtcaccacggcgcggcggtgccggtgcaactgccccaggagctcgcgctgatgctggatgcgctggcgcagcgtgagggcgtcacaccgttcatgctgctgctcgcggcattccagtcggtcctggcccgtcatgccgggcaggacgatgtgttggtcggatcgcccatcgccggccggcgccacgcggagaccgagccgctcatcggcttcttcgtgaacacgctggtgctgcgcgcccgcctcacgcccgcgatgaccttccgtcagttgctggcgcaagtccgtgacaccacgctgggcgcgtatgagcatcaggacgtgcccttcgagcaactggtgcgcgcagtgggcgtggagcgcagcccggggcacgcgccgctcgtgcaggtgatgttcgacctgcaccgcaccgagctgtccgccgccagtggcttccatgccctgggggcacggcgcgtccccatcgagacgtggacgtgtgaggtcgacctcttcctcaccgccatcgaagtgggcgagggcttcgaggtctacttccagtacagcaccgacctgttcgagcccggcaccgtggagcggctgcgcaaccactacgtgcaactcctgtcccacgcggtggccgcgcctcgcacgtccgtgggtgagctgtccctgctctccgccaccgaacgcgagcaggtgctccaaggcttcaacgccaccgagcgccccttcgactcggaggggaccatcgtgtccctcatcgaggcccaggtggcccgcacgccggacgcgccagcggtggtggcgccggaaggtacgctcacgttccgggagctgcacacccgggcgtcgaggctcgcggcacacctgaccgccgcgggcgcggggcccgaagccgtggtgggcctgtgcctggagcgctcgctggacgcggtggtgtccctggtcgccatcttcatcagtggagcgggctgccttcccctggaggcgtcgcatccaccggctcgccgcgcggcgctgctgcgccaggcccgcgcacggctcgttgtcagccgcccgggactcttcgcgggcgtggagcctggggttcccctcgtgtcgcccgacgtgcgtggagacgtggtggccgtcccccgccccccgcgcgccgagcacctcgcctatctgctctacacgtccggctccactggcgagcccaagggcgtggagctcacccaccgcaacgtcgtccactgcttcgcggcgttcgacacgtactacgccacacagccgggagactgctgggcgtcgtcgggaagcctgtccttcgacatccacctggaggagctgctcttcagcatcacccgtggcgcgcgcaccgtgctgcgcgaagtgggcccacttgggctgggccgcgacatcctcggtcacggcatcacccacgtcgtcatcacgccgtcctcgctggccaccgcgctggaggagccccgtgcggcggaggcgttccgctcgctcaaggtgctcgtgactggcggcgaggtgctgccagacccgttggtgcggcagctcgcgctcacccacacgcggctggtcaacacctatggccccacggagacgagcatcaacgtcgcggcggaaatcacgctgcccgaccgtcccgtgcgcctgggccgtccgctggaccggtgccggctgtacgtcctggatgcgaacggcgctccggtgccgccgggagtccctggcgagctctacatcggaggtacctgtctgggccgtggctaccgcgaccggccggacctcaccgccgagcgattcatcccagacgccttctccggcagggagggtggccgcctgtaccgcacgggtgaccgggtgcggtggaacggtgatggctcgctcggcttcctggggcgcaccgacttccaggtgaaggtgcgcggcgtccgcgtggagctggaggaagtggaggccgccctcctgcgccagcccggtgtgaggcaggcatcggtggtggtgcgcggcactcagcgagatgcacgcctggaggcgttcctcgttctggaaggcacggctgccggcgtcgagtcccggctccgcgaaggactgtcgcgcgcgctgcccgaggccctggtgccctcgcgcttcacggtgctgaccgccctgccgatgacgaccagtggcaaggtggaccgcaaggcactggcggccctgcccatcccggacatcgagccggaggccgcgcccgaagcgcgtccccgtggcgccgtcgaggagctactcgccctgctgttctgccaggtgctgggcctgctgcaggtgcggcgcgaggacgacttcttccacatcggaggtcactcgctggccgccacgcggctggtggcgcgagtgcgacaggcgttcgacgtggagttcccactccaggcgttcttcaccgagcccaccgtcgcgggcctcgcgcgcgagttggagacgcggcgtgacggcgcggccccgctccccgcgcccgtgccgcgtccagcggacgccgcgttggtcctgtctcccacgcaggagcggctgtggttcgtgcagcaactccatccgggcaccagcgcctatcacctcgcggaggcggtggagctggacggccctctggacgcggcggcgatggaagacgcattgcgctggctggtgacgaggcatccggtgctgcggctcgccgtgcccgcgcgcgacggccttccggcgcccgtgctgtgccccgtgcctccgcgcgtgctggaggtggaagaagcgccgtccgcggcgcagtgggcccgggacgcggttcacgcatccttcgacctggcgcgcggcccgctctatcgtttcaggctgctgcgcacggcgccggagcagcacgtcctgctgctcgccttccatcacctcgtggtggacgggctgtcgctggatgtcctggtgcgcgagctgggcgaagcctacgcggcgttccatcaacgccgcacgcccacgctgccgacgccccggctggagcatgcggacatcgccgcgtggctgcgcacccctcctgctcgggaacgggacgaagcccagctcacctactggaagcagaagctcgaaggcgtgccccggcgtgctacggctgacccagtagagca

SEQ ID NO: 546 - DNA, 4142 bp, Myxococcus xanthus
gctctaaagccgcccgcgcccagccccacctcggaccccaggcgttcgccgcccggtacgccaacccgtccgtgtgtgaagccgccgcgcggcgcctccagggcgcttcgcgggatgaggcgtgggatggcctgaaggcctgcatcgagcacacgcccttcacccagctcaacgcgctactgggccgcgcctgggcgcaggacctgagggtgcgtcccgaaggcgcgaagctcattgcccgcgtggtggcccagcgcggtggcagcgtgacgggcgagctgcgctacctccaggagaagcagatccccatcttctcgttggcctccgccatggaccggccggacacgtacaagggccgctacgtgctgctgcgcgcgcaggtcgcggaccagcgctcggaaggtgagcgccccacggtgtggctggtggagcaggccctcagctccgtccagacggacgaggtcgtgggctatggcgagcgcatcgactccgtcaccacgtactcgggtgacctggccgggcagtccgtgctcacggggccagggcggatcgggggctcggtgagtacgtgcgaacgctccgggcgaacaccacgcggcgcttcgtggagaacatctccgatgagactggccgcgaggccctcggccgtctggcgagcgcctacccggtgctggagacccggcgcgactacgtcatcctcgcgcgcttcgacggtgtccgcctcacgtctggcggcgcggagacggatgacgaagcgccgcgcatcccggtgctgaccatcgtcagctaccacgcgccgcaggcgctcgtcgtctactgagcggccttcgacgcggactcgtcgcggaaggccggcggcgtgcgcacttggtgcctgggtgacacagaaaaaaacgaggcgccggggaacttgccccgacgcctcgccctgggaaccgaccccgcgccagtccccacgtaaccgtgtgcaggtcgcgcccgcgctactgctgggtcgcacccgtaatcgtgaagtgattcgccacgtcgcggcccgaacccacttccaccgtcaccggctggtcgggcgtggtggaggcgctgacgaaggcgggcggctcgaggtgcaccgtgaaggtgcccggaatgaggaacttgaagaccgcctcgtaggtgccgtcgccgtcctcgtcggtcagcgccagccgctcactgctgcccgcctcgttcgtcatcaccgcgttgaagtcgcccagcgtcacctggtggccgtcgaccacgggcagtgtcaccgtcgcggccgtgtccgccgtcacgcggatgctgccggaggccgtcacctcggcggacttgatgaccggattcatcacccacttgcccgcgttgcccgcttccttgccaaagctctggccgacgtcgaagtccacgagcagcaccttctgctcgccttcgatggtcagcttctcggagaacttcaccttcagcccggacgtgccgtagctgggcatgtgaagttggccggccacctgcgtgcccgcgggcaggccggagtagtcggctgacgacgcgaacacggtcgaggtgccgtcctcattcgccacctcgatgtagccaccggtgatgacgaagcgaagctcggagtagtcgccattggggaccaccgcgtcagacaccagttcagacgtggagttggcgagctccagcaagctcacggtggcgggggtatcacgcagcaccacgcggccacctttgccgtcgccgccttgcagatagatttcggagatggtgacgacagcggtgcggatgtcgtctcccggcgcgtcggtcagaagcagcgtgaccttgccctcgttgccgccacacgccatcagcgggagcagggcgatgggtagcagggccaacagggtcgagcgtaggcgtgagcgaagagtcatggtcggcacgtcccggaatagggcccgctggaataccgggccgttcgacacgtaatgacccggcccggaaacatccggccacgcgaccctgcagatgtcgccgcgaaagcagggggcttggaggcccacacccacttacgccggtgacgtgtccaggccgtgcttgcgcagcagcttgcgcaggtacacgcggtcgatgcccgcctcgcgggccgcgcgggacacgttgccctcgcagcggtcgatgagggcgcgcaggtagtcgcgctcgaagccttcgatgatgcggtccttggcttccttgaaggggaggtccagggagatggggcgcgtgctctccgggtcgtccgaaggcggcggcagggtggtggggtcctcggggggggaaggcaggtccgggatgtccggcagcgcctcgtcgcccaggttcaccacccggtccaccacgttgcgcagctcgcgcacgttgcccggccacgggtactgcgcgagcagggcgcgcgtctggtccgacagtgcgctgggaggacgccccatccgctgcagcaccgtatcgacgagcagcggcacgtcttccagtcgctcccgcagcggcggaaggctgacgcggagcaccgcgagccggtggaagaggtcaccacggaagcgcccggcctgcaccgagccctccaggtcctggtgcgtggccgcgacgacgcgcacgtcgaaggtgcggtagtcgttggagcccacgcgcttcacctgtcggcgctccagcgcgcgcagcaggcggggttggacttccagcggcagttcgccgacttcgtccaggaagagcgtgccgccgtgggcgcgctcgaaggcgcccgcgcggtcggagtgcgcgcccgtgaaggcgcctttcacgtgtccaaagagctcgctctccagcagcgaggggggcgatgcccgccaggtcggcgatgacgaaaggcccccgggcccgagggctgtgcgtgtggatggcctccgcgcacagctccttgcccgtgcccgtctcaccctggatgagcacgtccgactcgcccgcggacagccgctccagcagcgtgaagagctcccgcatgcggcggctgtttcccaccagtgagccgaaggcgctgcgcgcggacaagggacgcgcccggggccgctcgctttctggcatcagcttcagctcggaggtgcccagcttgaggaccgcgcccgtgcgcacctccagctcctggaagcgcatgccttcgcaataggagccattgcgcgagcccgggtccaccgcgcgcacgccgctctcgttcacatcgaggatgaggtgctggcgcgacaccgcccggtccgacaggaggatgtccgcatcccggcccgaacccacgcgatagcgtcccggcatcaacggccagtcgcggccagcgtccggacccgacaacaccaccagccgggtacgtacccgttggacgcgaatggccggcaacgcatcggtgcggaccagctcgtcgtccccatcctcatctcccagactcgccacggcgcggacgatatcacagccgctttgcggggttggtcgccgcattcccgggttatgcggtaaagtttgaaagggggtgtcacccgcgatggcaagcgcgccgcgagaacgattcggccggtatgaacttcaagagcgggtaggccagggcggcatggcggagacgtggcgcgcccggctcctgggtgcggcgggcgtcaccaagtccgtgctcatcaagaaggtgctcccggagtacgccaacgacgaagccttcgtgtccatgttcatcagcgaggcgcgcatctccgccacgctgtcgcacggggccattgcccaggtcttcgacttcgggaaggtggacgggcagtacttcctggccatggagctggtggaaggccagccgctgaaccgcatcctgaagcgggcgctgcgttccggctaccactccctgccggtgcccatcgcggtcttcatcgccatggagatgtgtcgcggcctgcactacgcccatactcgcagtgacgagaagggcgagccgctgggcatcgtccatcgcgacatctcccccgacaatgtcctcatcggctacgagggacaggtcaaaatcgtcgatttcggcatcgcgaaggcgcgctccctgcgcagcttcaacaccgagcccggcgtggtgaaggggaagtacctgttcttctcgccggagcaggcgcggggggaagcagtggatg

SEQ ID NO: 547 - DNA, 4617 bp, Myxococcus xanthus
tggcgtacagggcgaacgacccgcgtcggctctcctcgccgagtacctacccgatctgctggaaatacctgtcaagccgctgcaccgcggcagcgttcatgaaggagtccatacctgcttcatgagtggggcggatggaggacaatgcaatgagggcctgcccgcccagacctccgtcgcccactctcccttctgcctacccctgacacaatagtggtattcatgggcggtcaaccagcgtaggagcctgtaccacaccaagcatgtcgggctgactgttcagctgccgtgccacgcgtgggcggatgacgccacactctgtctgtctgcccggactgcaccttggctgcgcctgccacagtcgactccttgtcgccagagggtcttaggtaaccctggtaccgtaccggtgacggcgctcggttatctgctcggtctgcattcccggagccgcttcttgggagctcggaaactaggataatgtggaacagacctgccaccggggggctggcttctattgctcggggctaatacgcgctccggggggcctgccggggaagacgagggagcgttgcgcaaggttggcgaagtcgtgtcggaggccgactacgagattgcagagccgcgggcgtcgtccatgctcgaggcgcttcgggcagtgggctatagcgtgcagacggcgctggcggacttgatcgacaacagcatcacggcgggagcgcgcaacgtctggctcaccttccactggggtggtgaggactcgcacatcactctgcgggatgacggccgcgggatgtccgaggctgagttggcggatgccatgcgccctggcaatcgcagtccgctggacgaacgggcgccgaacgatctcgggcggttcggtcttggcctgaagacggcctccttctctcaggcacgccgtctcacggttgctacgctcaaagccggaggcaggtgggccatccggcgttgggacctcgattacgtgagagacagcagggagtggcgcctgctcaagacggaggccccaggctctgcttcccgtctctccacgctggacgggcagcggcagggaactctcgtgctgtgggagcagatggaccgcatcgttgggaaggtgcgcaaagacgatgcccaggcccagagccgcttcctcgcattggcgcgcactgtagggcggcaccttggaatggtttttcacaggtacctcgaagtagaggacggtcggccgcccttgcgcatatatctcaatggccgcgatgccgactcgctggttcgcccatgggaccccttcctctcttctcatgtggccacgtaccagtttcctgaagaggcactgaagctccggaaggagcaggtacatgtgactggctacatactgccgcacaaggaccgcatgagagaggacgagtatgaggctgctgccggcccggggggctggaacacccaacagggcttctatgtctatcgggagcgccgcctgctggtcgctggagggtggctcagtctggggtatgcgaccgaggaacactacaggctcgccaggttgaaggtggacatctccaactcgacggatgccgagtgggagatcgatgtcaagaagtcccgagcccggcctccaacggaactggaagagcgcctgagggagcttgcggatgcggtccgcaagctggctcgggaggtgttcgtccacaggggagctcgagtgcggacatcaggtgttcgcgaaatcgatgatgcctgggagtcggtcaccacccgtggtcggcttggctatcgcgttcgtagggagcatccgctcgtgaagttcgtcatcgagcgccagggcagtgatcagaagccgctcaaggcactccttcgtctgctggaggagacggtgcccgtccagcgaatctggctggatgcgtccgagaagcccgaagcccacgctgaagccttcgaaagcgagccgcccgccagggtcgcggaggtgcttggggaactctttaaggctctgcgcgcagatggcgaaacggaggagtccgctcgggagcgcatcctctccatgcgtccattcgctcagtacgcgaaggccatcaacgaattgggctcgaagaagcgctgagtcgcgccaagcagcagctcatgaaaggaatgagcagatgaacaatgcctacgatagcgcctggagcattgcgcagattctcctcaggggccaagtgcagcaaggccaggtgctgacccgggacatgattgcagcgaaggtcgaccttgcgctgcagatggatccgaacagcaagagccaagttgatcgcgagcgcctcgtcgcggacctggagtcctcattcacggtgtggatgggcaacgcagtgaccctcgagcacaacgaggaccacatcgcatggctgaacagccgcaagtcggacatcgattggaagttctggaagcgctaccagcgcctcctccagcagaagcgatgggctgccgcgagcctcgagaagctcgatgaactgacctatgaaacgctcggcaggctcgaagacccgaaccgcaaggggatgtggagccgccggggcttggtagtagggcacgttcagtcgggaaagacagccaactacacggggctcatctgtaaagcggcggacgctggctacaaggtcatcatcgtcctcgcgggtattcacaagagtctgcgcagccaaacgcagattcgcttggacgaaggcttcctcgggtacgagagcaaggacgagtccgttgaagggtcaatctcaaagcatatcggcgtcgggttgatcgatcccagtattcgcgcgaacaccatcatgactcgagctgacgacggcgacttcaagatgagtgttcgacgaaacttccacatcgggcctggaggcatcccgcttctcttcgtcgtcaagaagaacgcgcgagtgctggcaaacctgaattcgtgggtcgagcgcttcgcgcagaagacgctcacagtccgtgacgttgagaggcgtgtcgtgcccaatgtgcctctcctggtcattgatgacgaggcggacaacgcatccatcgacacccgggcccaggagttcaatgaagaggggcggccggaccctgaccacgatccaaccgccatcaacaagcagatccggaagttgctccatctcttcgagcggaatgcctacgttggctacacggccactccgttcgccaacattttcatccacgatgctggccagaccgacgagcacggtgcggatctgttccccaggagcttcatcacgaatctccccgcaccttccgattacgtcggcccagtacgtgtcttcgggttggacccggacccgatgctgaacgccgaggagagggagccactcggcctcatacggcacatctccgaccatgccgactcgcccaaccctggagagcgaaatggttggatacctcctgttcacaagaaggaacacaagccccgtttcaaggggaagagtgagctcccaccgtccctgcgaacggcgctgcactctttcctgctcgtgtgtgcagcacgccgcgcgcgtggacagctcaacgagcacaactcgatgctcgtgcacgttacccggttcaccgatgtgcagaaggaggtcttcggccaggtgaagcgtgctcttaaggaagtgcaggaccacctggagttggggacggcagcgggagttacaagccttcactcggagctgcgtcgcctctgggatgaggacttcgttcctaccacccaatccatcaatgatctgtcgctgccagttctttcgtggtcgaaggtttcgttacacctcaaggccgttgtcgctggcatcaaggtcaagcagatcaatggcacggctggagacgtgctcgattacgaagagcaccgcgcaacggggttgagcgtcattgcggtagggggggacaaactcgcgcgcggcctgactctggaagggctctcggtaagctatttcctccgtgcctcgcgcatgtacgacactctcatgcagatgggccgctggttcggctacaggcccggctatctggatctctgccgattgtacatgaccgaggaactcgatgactggttccagcacgtgacgatggccggagaagaactgcgtcaggaatttgatcggatgtccgccgtgggtggctttccggccgactatgggctcaaggttcgctcacactcaacgttgctgattacttctccagtcaagatgaggaacggagttgatcttatgatctcgttcgatggagatatcatcgaaacgaccaacttcgacccccggcgggaggtgctggaacacaacttggccagcacggtcaggtttcttgagaagcttggcaggcgtgctccaggttggattcagtctcgtccgagtgggtcagaggagtgggtgacttcctacgtatggccagaggtgtcggctgaacaagtcgctgagttcttggccacactccatgtgccgcaaagctctacaaaggctgtgggggtcttgctttccgagtacatcaagaagcagctctcccaacgtgagttgagtcagtggactgtggtgctgttcggcggtggcgagggagtgaaagaaaatatcgctgggttgcccatcgggctcacgaagcgacaggccaaaaaca

SEQ ID NO: 548 - DNA, 3346 bp, Myxococcus xanthus
gggaaagtagcccggtgaggagcgcctggtgcaggacgtacccgcgcgccggggcgccccggcccttgcgcggtatgcgcagctcgcggacggtctcctcgagctggcgctggacgtcccgccactcgcgcacccgcaggaaggacaggaagttgtcccggcacacgcgccgcagatgggacgtcccccggccctcggcctcgcgcacgaacgcccacagcttgaggagccccgtgaagtccgagtgctcgtcacggaagcgccggtgcagctcgtccgccttctgcgcggactcgcgtggtcgctcgcgagggtcctgcaggttgagcgccgcggcgacgatgagcacctcgtccaggcacccgtactcggcgccggcgagaatcatccgcgcgatgcgcgggtccaccgggaagcgcgcgagctgctgcccgagcggcgtcaaggtgcgctccttgccctcgatggccccgagttcctcgagcacccgccagccctcggcgatggccctcggctggggcgggtcgaggaaggggaagtcctcgacgtcaccgaggccgagggacttcatccgcaggatgacccccgcgagcccggtgcgcttgatttccgggtcggtgaaggcgggccgcgtggtgaagctcacctcgtcgtagaggcgcacgcagatcccctcgcgcacgcggccgcagcgccctttgcgctggtcggcgctggcctgggagaccggctcgatgtgcaggcgcgtggtgcccgagcgcgactcgtagcgcgacaggcgcgccacccccgtgtccacgacgtacacgatccccgggatggtgaccgacgtctccgcgacgttggtggcgaggatgacccggcgctgggggatggtggcgaagacgcgcgactgctcggaggccgacaggcgcgcgtacaggggttgcaccaccgtgccgcggagctcgcgcgcgttcagggcattctcggcctcgcggatttcccgctccccggggaggaacacgaggacgtccccatccgggtcgagcgagatcacgttcgccaccgcatcggcgacggagtctgcgagctcggtgtcctcgggaggcggctcgtagagcacgtccaccggaaaggtacggccctccacctggatgaccggagcccccccgaagaactgcgagaagcgctcggtctcgatggtggccgagctcaccaccaccttgaggtcggggcgcctggggaggatgcgcttgagccacccgagcaggaagtcgatcgtgaggctgcgctcgtgggcctcgtcgagcacgatcgtgtcgtagcggcgcaggagtgggtcgctgtgaatctgcgcgagcaggaccccgtcggtcatgaacttcacggccgtctgccgggacgagcggtcctcgaagcgaatctggtagccgacgtccgtgcccagctccgtgccgagctcgcgtgccacgcgcgccgccacgctcgtcgcggcgatgcgccggggctgggtgacgccaatctggcgcgggcggccgcgccccatggcgagcaggactttcggtagctgcgttgtcttccccgagccggtggcccccgcgacaatgaccacctgatgggcggtgatggccgcggtgatgtcctccacccggctcgagatggggagctcgggggggaagtgcagggtgggcaagccgccgggggtggggacgggtgagtcgccggacatggcatcatggcctatcactgaagcgcacgttctgcccctgccgaatcgtgtgggcgcctgcgcgcccggcgttcctggagggattctctctgcacgccgatacgtacctgcatgcgctcgtaggccgtccgcggacggaagagcgccatcagtcgccgcccggtgtcaggcgagcgcgtcggcgagcgcggggagcttgctcgctttgcgcgcgtgctcaggttctcgacgtagtcgaccgtctcgcccggtcggctcggagtctcgccgccggcgaggggctcggactcgcgaaccttcagctccgtgctggctgagtcgcccttgaagccctccttcgtccggatgacctcgacttcgagcaggtagcgcccgccgcagcctgcgcggtggcaatcttcgtcagtgcgttgttcacgttacgtgggtccttcggcttggggtgcgccagcggcgaagtgcgctgtcccacgtcaatgtgtgcggattccgggagtggttcagggcaggaatgaggaaggcagtcaggtggcgagatgtgtcgtgctgccgtgtaacaggcggcgctgacgtgtcagtgcctggggctgacacgtcaacccgcacgctcagaacgggggatggccgcgcatctccagagaaacaaggaagtcggaatggcacgagtgttgccatggggctgcctgcgcaataaggggcgaaccaataaaatcccccccttctgagcctctgtagcttgttgtccgttcaatcgatgcgaggaacctcaagaatgaaagcaaccctcttgctcgttgtattcgtcgccttctctgccgctgctcaaagcaagacggcgaacgtcacccccaaacgctgcggaggatcctctggtaagacgtgtgtccagggggaggtatgtgctggagaaaagacattcaaagacggtctcggtgtctgcgtcatgggtgcattttcaaatcaatgcgccaacgccttgggcagccgctgcccgaatagcacggactactgcattgaagacccgcgtaacgccgattgcccgcctggggttatggattgcggtaatgggctttgtattcagaagaagatagttgaccagattggggtgaaatgagagggcggcgcggagtccccgcttggccaatagatgttagggctcaagccaaaggcccaggcccctccgcgcgcctttggggttctctgatatcagcacggtgtcgacatatattgagagtacctcttgctcaaactgctcagccgaaatttagcttctgcggcgtgccttctgtctcttcgatgaaccgggcgaagttgcgggccttctggaaggctccgactggttcatcggtgtgctggtacagctcgaccaccacttcgtcggcgagcggcccctgacggtgacaccggccgatgcatcgggagtccttgtgtagcgaggccggttgacgtgtcagtttctgcggctgacgtgtcaactggcatgctccacaggggttttgcacctgttatctgtcttgacgctgtcgaaggcggaacggcatgatcttcgcttcgtgttactgatgtcatcccaggagtgattcaatgaaaatgcatgtcgtagtaagtgcagtgttctcgaatctctttttctcg

SEQ ID NO: 549 - DNA, 3707 bp, Myxococcus xanthus
gctctacagtgaaatacataaatgtctggatagggctttgacgctcccgccaatcgcagaaatgtctcgggcggaaatgccagcaaaggggctggctgcgcagctcctcatggaggtcatgtaatgccgcaccgagtccttgcaatggatggtacgtctatttccggcggtgaagggtatgtcaccgcgggcttgctcaagtcgttgaaggagacgctgaccagccgcggaggcgggcagagcctgctgaacgacgtggagctgttctccggcacgtccgcgggctccttcaacgccgcgttcttcgccacctacgagaaccccgatgacgccttccccaagatcctcgacttctggggtgaggtcgtccagatgaaccgcaaggcggtgtcgctggggcggaccgccatggcgctgacgggcaacgccgcgctgctcgactccagctacatgcgcgacttcttctgcagctacttcggcgccacgttgcgcctgggagacctgaagcggaaggtggcgctgccgtccttccagctcgacggccaccgcaagtcgctgcggacctggaaggcgaagatcttccacaacaccggtccggacaacgactccgaccacaacgagctggtggtggacgtgctgatgcgcagcggttcgcctccgctctcctatcccgtctaccagggcatccgggagcagggcagcggctacgtcgacggcggcatcttcgccaacaacccgtcgctggtggcgctggcgcagatcatcaacaacatcacccgcaagagccgcacggagaaggtggagacgctggagacggagccgcccgacctgacgaacatcctgatgatgtcggtgggcaacggctgcatgtcgtcgtacctcacgccgcacttctgtaagggcgtggccaactggggcttctccaagtggctgctggacttccacgaccccatggtgctcgtgaagatgatgctggaggccggctcggacgcggcggactaccagtgccgcatgattctgcggaagaagtacttccggctgaatcccgtggtggaccagacgctctccgcggcgaacctcaagcaggtggagtccaccgtccagagcctgctgagcacccagtccaccgtctcgcagctcaaccgtgcgcagacgtggctcgggaagtcgggctgggtgtctgacgcggccaaggcggcctagcgcgagaggtggattgagatggccaggatcattcttgtctccggtaccggcggttccgggaagaccacggtggcggccgcgacggcgctcgcggcttcccgccggggtctccggaccctcgtgctttcgttcgacctgtcccgcggcctcagcgccgccatgggcgtcgagagtccgctcttctccggcccccggggcgttcccgtgggcgtcaacgaccacctgtccttccacgaggtggacgttggcgaagagctccgccggggatggaacgggggccagggtggactggccgccctcgtggatggcgggccggagcgcgtgaacgcggaggaggtggcgatgacggtcgaggcggcccacgtcgtcatgctcctccggttgggcgagtacctccacgagcagcagcacgacctcgtcatcgtggattgcccgtccacccgcacggccctgcagttgctcaacaccgtgccagcgatgagctggtacgcacgccagcagcagacccccacgcaggcggggcgcaaggcacgcctgctggcggcgagcctccacggcgcggacgcgagcctggaggttcgcgaccggctgaacgccgtggacgcgctgctgcacgacccggaggtgacgaccctccggctggtgaccaccgcggacacggtggccggacaggaggctcagcgggcgtacacgtacttcagcctgctcggcctggcggtggactgcgtcgtcatcaaccgactcgcaccggaagccgccgacgccggctccgacccgatgcgggcgcagcagtcacacgtggagaagctccagcgcgccttttcgtcgctgctggtgttgaaggtcccgcaccaggccatggaggtggtgggggagaagccgctggaggtcttcgcggagcagctctaccagggcgaggaccccgtccgtctcacggccccgcagcctgccctgggcatccgcaaggacgcagtggatgcgtactcgctggaggtgcggctccccttcgtggcgaagagcgatgtcgagctctcccgccgcggcgcggagttcgtcatccaggtcggggccgtccggcgcaacgtcgtgttgcctcggatgattgcactcctcccgacgtcgggcgcccgcatggagggtgaccggctgatcgtgagtttccagaaagaaagaggtgtttgatgtccacgcaagatgatcgttatccgcagggttcctttggcgcttcgccggagtacggcgctcggttcgccgagctcaccaacgccctgattccgggcgggcgggggctggtgcagcagctcttccgcgcgaagcaggaggcgctcaagggcgtcgcgcaaatcctcgatgcgcagattcacgagctgcagcacatcgacgcggccatcgaggaccgggcgaagcaggcgcacacggctccggcggcgggtcagccgaaccggtccggcgtgtcgtttggcgacgtgctccagaaggcgggggacctgatcctcgcgaagcggccgaaggggacgacgggttccgaggctggcgcccggcccagtgaccgccgtgcgcctccggagagcgctacctctccggattcaagcagcccggcctctgcgtccagctctgcaccggaaccgctggaaaagatctccatcagctagtcgaagcgaaaggggtgggcagtgtcggatgagtccattcgagtgaggatgtccaacgaggagaatgctctctcgatggagtcgatgacgcccttgcaacgggcggcattggccatcaagaccctccgggcgcgcgtggatggattggagcgcgcgcgctcggagcccatcgccgtcatcggcatggggtgcaggttccccggcggcgcgaacgacccgcgcgcctattgggagctgctgcgcggcggcgtggatgccgtgagcacggttccgccggaccgctgggacgtggacgcgtactacgcggcggacccggacgcgggctggaagatggtggtccgtgagggtgggttcctcaaccaacccatcgccggcttcgacagtgagttctttggcctgtcgccgcgcgaggcgaactacgtcgacccgcagcagcgcttgatgctggaggtgtcgtgggaggccctggaggacgccggaatcgccccgggctccctggtgggcagcgacacgggcgtctatgtcggcttcctgagcagtgactacgggcgcgttcccttcaacgcggtgcagacacgggacctgccgtacatggggaccgggaacgagctgagcttctccgcgggacgtgtgtcctacgtcctgggcctccaggggccgtccatggtggtcgcgaccgcgtgctcctcggcgctcgtctccgcccacctggcctgccaggcgctgcggcagggggagtgttcgcttgcgctcgcgggcggggtgaacgtgattctccggccggacaacaacatcgtcctgtcgaagatgcgggcgctggcgccggatgggcgctcgaagacgttcgatgca

SEQ ID NO: 550 - DNA, 3326 bp, Myxococcus xanthus
ccggggacgggccgtacaggcgggcgacgttgggctcgcagcgtccctcgtcgctgcagcgctgccgggcactgtcgaagtcgtagcaagcgcccgcaccgagcgccgccacgagcgccgtacccgtggcgccgagcatcctggtcttccgcatgactctcctcgaattcaaggcaacgtcccggacaggcccaccatgcccccaccggggaccacggcggcggagggctgtaccttcgcgggcagctcaccgggcagcaggaacatcaccgcgcccgccacgagccccgccgcgcccagcccaatggccacccggctcagcgtctgcgcccggcggcccgacgacgcgagcccatccgcgttgtccagcggagcgtccggcgcgccgcccttgtcgagccgcgagtacttgtcgcccgcctgcaggtagaagacggtgcccacgccggccagggcgacaccgcccgcggcgggcagccacgcccagcggcgcagcgggcggatgggctcgggctccagctccggggccagcggcttcgcctccaccacggccacgggcggtgggggcggctcggcttggggcggcgccggcggcgggccgcgcaaggccgtctgcgccacgggcagcaccgcgtcgatcgattgggtgagcgagtccagtaactggtcctcactcacgccggggatgaggtgctcggtgacgagcgcgccgtcgttggcggtgtagatgcgcgcgcccgtgcggtagccgctgagcagttggcccagctccgtcaccaggacgagctccgtcttccccgcggcgcccaacgaacggatgcaggagggcgccgtgcggttgcagcgcagcagcgggcggcgcttggtcgcggacagcttgcgggtgatgtcctcgatacggaccaccaccagcccacgggcccggagctgctcggccacgtgttcctgcgcgaactcgacgacgtgggagggagctcccgccgcgtcaggcggtgcgaccaggacggacaggggcggcgggggggccgcggcgggtgcctgggtggccagggtgagcgcggcgaggagggagatccacacccaatcactttccccccgaccggacctcctcgcaaggtcgggaatcaccgctcgtgcttcgggtgaaacccgccggggcggagcgcgtgtggtgggagggcgccccaccggcccggggtcgtttccgacgcgccgggccgggacatggcttcagcgccggggccgctccgacggggccgggcgaatctgggtcttctcggagccgccattcgagccctgggtgctgtcgtcgtcttcatcggactccggcgcggggcgttacggcggagggcggcgcgcgcccagggctggccgtgctccggtggccaagttgggcgagggcgccctcgaaggcggcgtgaagggcggcggccggcgcgggggcaccgtgctggtgccgtcatcctccgtgagcaggtcctcggagacctccaccttggcctctgtggggatggcggtgcgcgtctcctcggaggcctccgcgaaagggttgcgcgtgggcggcggcgatgcgtctgcctccatggctggcggcaggcgcggctgcatggcggcagcgggccaggccacgggcgttgcgggcttcacggccgagagaggctccagcagcctgtcgctctcctagggcggcggggtggggtgactcgcgggcacctgcacctgcacggccggcgcgggaggcggaggcggcgcggcggcggccttgccggccttcgcgtcgcgggcgtcctgcttgaggcgctgctcgaaggcggcccactcctgcttgaagtggtccgggtctggccttccctgctcgcggtgcttcagggacggggcccagcgcaccgagtacgactcgcccgcgtggaaggtgggcggcggcggcaggccgtaggtggccgggtcgaagaaggactcgtccaggtcgtggaagccgtacgcgcgcgccttgctgacgaagttggggatgatgccggtgggcgcgtggtagcccaggatgtggtcgtcctcgtccttggtgacgggcgtgaagacgaagatgtcctgggtgcggtagtcgcccttctcgttgaggggcagcacctccgacagggcaatcgtcttgcggctgccgtcgtggaggcgctcgcagcagatgatgaagttgatggcgctggccacctgggcgcgcacggccaccatgggcagctccacgccggacatgaggcacagcgactcgatgcggcgcagcgtgtccgtgggcgtgttggcgtgcgtggtggccagcgagccgccgtggccggtgttcatggcctgcatgaggtggaaggcctcgccgccgcgcacctcaccgacgacgatgcggtcggggcgcagacgcagcgcggagtggagcaaatcgcccatgtccaccgcgcccttgccgaacttgtcgggcggccggctttcgaagggcacgacgtgggactggttgagctggagctcggccgagtcctcgatggtgaggatgcgctcctcgtcggggatgagcgacgacacgatgttgagcagcgtcgtcttgccggagcccgtgccgccggccaccagcatgttgagcttggtggcgatgccggcctcgatgaggcgcgccatctgcggcgtgagcgacccgaacttcatcaaggattggaccgtcagcttctccttgaagaacttgcggatggagatggtggtgcccttgcgcgcgatgggcggaatcaccacgtggatgcggctgccatccggaaggcgcgcgtccaggcgggggcgctcttcgttgagcatgcggccgacgaactgggccatgttgcgcgcggcgccgagcaggccttcgtcggtgaacgatgcatccactttcgtgagccggcccttgcgctcaatccagatgtcggtcgggccgttgatcatgatttccgacacggcctcgtcatccatgtagggcaggacgggcttgaggaacgcgcggagtgactcggtgtacatcgtcatggcgccacccaggctagcgcgctctggccccagggcccaagaacccgccccgcctgtccggctgctttctggggcaggggccgcccaccggcggtttccagcgtggccgggcggaaaagcagtgggcgctcccgatgcccggtgtttcaatgccgccgccgtcggaaaagggaggcgttcgtgctcgcggaagggctgccggaagactggaagcaggagctgcgcgcggcgttggcgtcgccgtcgttccatgagctggagcgcttcgtcgaatcggagcgggggtaggccaccgtctt

SEQ ID NO: 551 - DNA, 5304 bp, Myxococcus xanthus
catgcgccggttcaaccaccgtcagcgcgccgtggcgccgcacgagcagcttcaaccagtccacgttccggtatgtgtccgggtccttccagtccggaggaacgaggtgcatgtagaggctgtagaacgtaaaatgccgcgacggctggccctccgtcttcgctacctcttcgacatcgtgccggacgaggacgaaggagttgtggttgcccgtgaattcccgagccaactcgtgcgcctcgggtccctcctcgacacgctccttttcttcgaggggagcaggcaggccatgggccagccggacggccaccacgtaacctggggcaaagcagcgaacctctcgcacgccggacccggctgcggagttcgccgtcccctctcgcgccgagaaatgcgacgcaggcagatggagtcccgaatgaagattccggcgcattcccaatgggaagagtccaccgggcggcatctccgtctccgtgagggcgtagcagttgatgggccggaaacgggtatccccgtggtcaaacggatacgcgaccttgcgcatcacgttggtttcgagaaaaccagacgggacgacggtgggacggagcgagtagagaaaggctccgcccttgtgttcgtcgtggcggtagtccatgaacaagtcgtcaggcaccgcactataggtgttctcctcgaacagcttgcgggcacgaatcaggactacggacgcctgcgcattctcccagtcacctctgcgcacccgaagaagatcgtgctcacccgtgacctgcttctttgcaaccgcattcagatccgttccatccctcgatccagattcaggagggaagaaaagaccgcttcctttcttgtcaccaatctttttgttctgtgtcgccggatcagcaaccgccagccagagatgacatccggaagcatccaccagccaagcgaatccgacaatcagaacaagatgaatgggctcagccttgttcgcagagaatcccgaataaaagatgaccgggttattggcaacaagcgccttgagaatcagcgacaacttcccctcaatcaaattcggatcgttcgcaattctcgccgccatcctgcgccgttccttgagcgagcatggcagaacatggtcgtacgcaaaaccaagcaccttggaggcactataatcacccgcctcgaactcatacttgtcatccattccaaactgcggaggagacacactcaagacagggacaggaacagggctgcgattcgagaccgaatacccactcagattaacattgaagggtggggctgtgggcttcgtatggaacgctcgctgcccaccaggatatcgcagatccacaaactgccccggcttgcctccgtcccagtgcgtcacgaagcgagaagcaaaatcgcccccctgaaccacttggtaatagttataggccattgcactggctgtccgcccgcaccaatctcccggccctttcgggtaatgctgcccgagcaatggcaccttcaagatatgatattcatccagcgcagacaaaagctgcccagggacctcatagtcccacaaggccggatatcgatttttccgagacacaacgcgccccccatgagtgcgttcactcaatccatctctgtgcactcccccagtgcaccagatcaattccttgcttcaaacatctcgacggcagctcaaagtcgtgaccgactctgcgtcagggaccaccttccagacactcccccccagtatcgggatacttcgaaagcgcatatgtgtaggcgggctttcccaagaacgcgatgtccgctccgggctccggcagtttgaagcgctcttgacgcacgtgccgcccgtaaaagtcttcgagcgtcaggtcgaggctgttctcactcttcgatgcagccgtcacccaataccgctccaagccgccacctggtccctcgatgacgacgagcacccgcccatgaatgtcacgcctcaacaacagcttgtagggtctcttcaggcaagcgttccatcgcaccctgggaacgccatcctcactctccaacgtcagcaacgcccattcagatgaaatttccgcaacgaactgtgccgcagcctcgctcaacacgtatcgcccgaaggctggccacaactcgttcttcgaaggcattgcggcctctgagaagagagccctatcgagggaatgggtgattgcggaggtcatctcctccagaacctcaccctgaacatgagcctcctgagtcctctcgaagtgcttgttgtcgaatcggaaccgaccccggtagaccgtcaaggtctccgccgtgccaaacgcgatgacaaacagattcttcttcgtctcggcccgaaccttgacgccgtcgacgaagagcgcgctcgtaccccggaggcaccgagccggatcattcaccgtgcagtcaaactcgaacggcctccgcaggctcggtttcttcagccgcgcgacggcctccaggttgcgctcgaagaacaacgtcgccagctctctcttgaggccggcgtcctccggagccaacgtggcggcacgcagagcgctctcctctcgctgcagcaacgtccgcttcgggtccttggcctccgcggcgagcttctccgccgacggcttctcggggcccagaaacgcccccaccacgaagccttccgcctctccgcagcgcacccgggcccagcccccctcaagggactccagcgttcggcactccgtcccgatgggcagcttctggaggacctccgccgtcttgtcagcttccttccgcagattcaccgaggaacccagcacgtatgccggcggcggctctcccccagcggcggccaccagcagacctagcagcatcgtcttcatgccctgtacccttccccctcggttgaagacactcgcatgccagtccgacgcaggttcatgaggagttgttctactcagtgagtcgaataagaccgcgacgtgggcttccacaccaccccatcaacaagggagactacgcagcgacgctcctttcttgggcatttcaatcaccatgccgaagacctttctgctgctgggactgggactcgctctgtgggcaaggcctgctgcctcttccgagcccaccactgtcgctcccgctcccacatggcccgctccgggtgcgcccctcaccgtttccgaggtgcgcttccccaaggactttggaaagcgacgcatctacctggacgcggggcacggcgcggaggggaacaccggcaacaaaggcgtcacctgcgaggacgaggagacctttaccctccgagtggcggaagacctggcgaagcgactggaggcaaccggccacttccaggtgcgcctgagtcgcaggccgggggagcgcgtcccctatcccacccgcgtcacaggcgccgagcggtggcgcgcccatgccatgctcagcctgcactccgactcgcgtggcaccgccacgctatggtctccaaatccggaccaggagtgcaaccggcaggactccgcccctggcttcaccgtgctctggtccgagtccgcggaagccaccgcgctcctccacgccggccgcgcgggcctggcgcgctcgctggcgcaccggctgggccaggcgggtttcccgccctatgatggcgtggactacgaaggcctctacgccatcgactccgagcaccccggcgtcttcgtggcccgagagcccacgcacaggcagatcttcgtacttcgaaagccgcgaatcccctccgtcatcatcgagacccaccatgcgctcgacttcgaggaggccgcacggtggagcgagcagcggacgctggaagccttcgccgccgccgtggcccagggactcgtggatgcgctcgcgcccgaagcgcccccccagccacgcacaacccgcccccgctgaaccccagccgcaccgtcccgtggcatgcctcaggccatccaccggacctcgtggtggatggctcgccattcatgggtgagcgggcatcgtggctccgccattcaggtggagtcctcgatcacccctcgcgttgctgccccgccgcctcgtgccgcccagtggcggcaccgacgtgttcgacaaggcggcgcgccagcgtctccacctgcggctccctgagcacactgtagtggtcccccggaacgtcctccacggtgagacccgatagcccccagcgggcccacccgtgggacggctccaccgcccgggagcgttgcgcatccttcgcacgcagcaacagcacggggcaccgaacggggccgggacggtaggccgccaacgcccgcaggttcgcgcgagtcacatcacgccaggcacggagcgttgacgcctcgacctcgggaggcagccacccggcctgtcgcgcatgctcgacgagggcggtgaattgctcctcttcggtcaggcccgagagcatctccggacgtagggtggactcgacacctgccgtccgtgccaggtccatggccattcccgcgagcagcaacgccgcatcgggttcccgcgtaggcgcgttctcgtcgggagcgaagctatccagcaacaccaggagcgccacggactgccccagacgctccagctcgcgcgccatctcgaaagccaccacgccccccagggaccagccgcccaacacataggggccctcgggctgacgctcgcgcattgcttcaacgtagcggcgggcgagcgcctccacctgctccagaggaggctcgcgtccatcgagccccgcggcctgaaagccgtagagaggccgctcgcgtcccatgcgccgagccagcgcacgatacggccccaccgcgcctccgacggcgtgcacgaagaacacaggcgtgccggtaccttcgggctgcaatgccacacagtcacgcgcggcccccgtcgtgtccgagccttgcaaccagaccgcgagccgcaacaccgtgggcgcctcgaagagcgcgcgcagcggcatgtccacgcccagttccgtacggacacgcgccacgacctgcgttgccaacaacgagtggcctcccagttcgaagaagtcgtcatgaagaccgacacggggcacacccagcacttccgagaagatgcccgccagcgcgtgctcggcctccgtgcgcggcgcgacgaaggactcgatggcaacgcgcgactgcaggtcggtagcagccaatgccttgcggtcgaccttgccattgggcgtcagcggcagtgcctccagtaccaccaccaccgacggcaccatgtactccggcagcttctgcctcacgtactccttcagggccccttcctcttctcccggagccaccacgtacgccttcaccc

SEQ ID NO: 552 - DNA, 3344 bp, Myxococcus xanthus
cgtcacccggccagaggcctgcaaccgctccaccgtccgcgccgagccctccaccacctccacgatttccgccatcttccgcagcgcctggcccaccgccgcgccaccctcgcgcgccacctggccgttgtccgccgccgtcttcgccgccgtgcgcgccgcctctgctccctgcgacacccgcgcgctcatgccctgcaccgtctgcgccgcgcgctggagtgagtccgactgctcccgcgtcgtcaccgacaacgcatccgcggaggttcggatgcgctccgcgtccgccgccgtggcgcccgccgcatccaccagcgccgccaccacctcgcgcagtcccgtcaccatggtgttgaaggccgccgccaactggcccacctcgtccgtggagcgcacctccacccgggcctccaaatcaccgcgcgccacccggtgcgccgcctgcgccagctcccgcaccggccgcaccacccggcgcgacagatatgcaccggccatcagcgcgagcgccagcgcgccgcccaccgccaggaggatgcgctggcgcaccgccgccacctcgcgctcgatgtcctccacgtacacgcccgtgcccagcacccaaccccagggcgcgaagagcttcacgtagctctccttcggaatggcctccggcgagcccggccgcgtggcttcgtaggacaccgagccctggccctgggcccgcgccagcgtgacgatgtccacgaacaccggcttgccgcgcacgtcgcggtagcccttcaggtccttgcccagcatgtccggcaggtgcggatgcatgacgagccgcgtgtccaggtcgttgacccagaagtactccacctgtgagtagcgcagttgctccagcagcgccgcggcctgcgcctgggcctcctgtcgcgtcagcgcgcccgaccgctcacgggcctcgtagacctccaacacgccgtaggccgtctccaccgcctgcctcagtcccaggatgcggtccgcgcgaagctgctcccgcagctgcggcaagacgaaccccaggatgacgacgagcagcggcagcgccaccacgcccatcgccacgcacagcttcaccagcaaattccggccgaccgccatcggcccgcagcgtatccgccgcatcgtcaccgcgctcgttcacctgagtctggaaatacccccggtatcagtcctgtcgagggttcgcacacccggtgaggtctcctgcgattcatcaagtcctgtatttccagatagatatgaagcgcggtgaaccgcttctgcgcacgttgaaaacatgaaccaaccctagagggcgggacagcgtgcaggactcgacggaaccgtaggaaagtcgccgcacaacgtgtcaggtcctcctgcgacccaggtgactgcatgggtccggaaggcatacggaggcctctcactcgacgttttccgtcgagaaaaggcatcggccgcgcgtcgtggatggactcgcgaagtccaccgcgtgcacagcaaccctatgggtgaacaattggaggctgacccggcaagttctgtctgtctgcccccatacgtcctatgccagcggccaaacgttccgggtcggtaaggcatggacaagaaactcgcaaccacaatcggagctgccgcgcgcgttgctcgcacccgcctggagctcacccaggcggacgtggctgagcgtatcgatgtggccaccgaggtctacgggcgcttggagcgcggcgggatgctgcccagcgtgcatacgctgctgaagctgtgccacgagctccacgtctcagcggatgagctcctggggctctccgcgaacgccgtcaacgggggcgcgcgtcccggtgagccgcccacctcgccgcaggagcgccccgaggtccggcgcctgctgcgcaccgtgcgtccgctggagcccgcgaaggtgaagctgttggggctggtggccaacgcgctgaaccgccgctgagcctccgccgcttcaatccctcacagctcggagaggattcggtccagctcgtcaggcttcacgggcttgaccagatgccggtcgaacccggcgcgcagtgcctggtcccgtccatgggggctgccgtagcccgtcatggccaccagccggatgccgttgcccacctgggcgcgcagcgtctgcgccacccggtatccgtccaaccctggcaggccgatgtccaccagcgccagctcgggcggctgcgccatcgcgagcgccacgccctggaggccgtccggcgccaccgccacctggtggccccacagctccagcaggtcgcgcatggcctgacgcgcgtccgagttgtcctccaccaccaggacgcgccggccgcggcggaggtccaccgcgtcgcgcgcgggcgcggacttgcccatcgtgtggtccaggggcagcttcaccacgaactcgctgccgtggccggggccgttgcttcgcgccgtcacctcgccgccgtggagctggatcagcttgcgcaccagcgtcaggccaatacccaggccgccgcgcgagcgctccagcgaggtgtccgcctgcgcgaacagctcgaagatgtgcggcagcacctccggcgggatgccgatgccagagtccttcacccgcaccaccgcctgggccgcgccgcccacgccttcctgttccgcgcgcaggtggacgccacccgcgtcggtgtacttgatggcgttgtcgagcaggttggtgaagacctgctccaaccgcgtggcatccgcctgcagccagagcggaccggaaggcagcgagacgtccaaacccaacccacgcgaatccgccatgggctgcacgatttggagcacctgccgcagcacgggcaccaggtccacgctgccggggcgcagctccaccttgtcgcgggtgatgcggctgacgtcgagcaggtcatccaccagccgcgccaagtggtttgtctggcgttggatgatgccgcgcatccgcgcttccttgtcatcgctggtgggcctgcgctccaggatgccaatggctgtcatgatggcggccagcgggttgcgcagctcgtgccccagcatggccaggaactcgtccttgcggcggtccatctccgccagcgcgttggcgcgttggcgcgccacctgctccgcgtggcgcaggcgcaacagcgacttcaccgtggcgatgagctccgcgccctcgaagggctgggtgaggtaggcgtccgcgccgccgtccaggccgcgcaccttcttgtcggaggtgacgaatgtggcggaggtgtgcagcaccgccatggccgcggtctggggattggcgcgcagccgctcgcagacctcgtagccgctgatgtccggcagcttgagag

SEQ ID NO: 553 - DNA, 4955 bp, Myxococcus xanthus
ggtgatgtagggctcgaagatgcgcgctcgcagctcctcggggatgccgggaccccagtccgccacgtagagggcaggggaggggccctccatcgtgagcaccaccttcacccggccgcgcccctccatggcgtcgcgcgcgttgttgagcaggttcagggtgagctgttcaatgaggcgcgcgttgccctggatggtgatgtcctccggggcttccacctccagggagatgcgcgaggagtccgggttgatgctgaagtgcttcgccgccgcccagatgggggccgccagggagaggcgctgttgggacgccggtcgctcgctcgacaggcggatgaagtcggagacgatctgctccatccgctccacctgggccagcagcaggcgcaggggcccgggggcggcgccgtcctccgcgaggagttgggcgtaggccttcacgccgagcagcggttgtcgcagctcgtgcagcacctccgccgccagctgagaggtgtgcgctcccgcacgttgcagcgccgccgccgctgttcgcgcggccgtcaggtcccctgcctccacggcctggagcagttgggcgagcggcacgggtgtttccatgtgacgagcatggcggaggcaaccgcttgtacgcaacgcacctggagggaatccgttgacccggaccgtgccggcacggatgctggccgcgttctcatcgcaccgtccggaaatccggatatcgcgacaccggcctcgggagggccttcatgccgcagaccaacccgttccactcgctggtcccccgcaagatgacggacaccgagctggcccgctccatccgtctcaacatcgaggcggagctggacgccatcaacctctacgcggcccatatcgacgcgacggacaacgaggacgccaaggccatcctccagcacgtcatggacgaggagcgcgagcacgccgccctcttctgggagctcatcgcccggttggatccagagcaggccgcgcacgcgaaggaggccgtggagaagtaccggctcattacctccggcgcgtcgcacgaggccgtggaggccgtgggcaaggagggcgcggcgccgtctccggcggacgtcaccccggagaagcgcctcaccgtgggcagcctgcgccggtagccgtcaggacgcggagtgggcctgccggcgctcggccggtggggccttcaggtccttcgcccgcatgtagacgacgttccgcgagccccgcttgccgcggtacatggcccggtccgacaggtccaacagcgtggccttgtcctgggcgtgctcggggaagctggccacgccgatacacgtggtgagcttgagcgacaggccttcgcgcgccaggaagttgtgcgtctccatggtgcgtcggatgcgctcggccaccttgagcgcgccgccggagtcggtgttgcgcagcaccaccacgtattcgtctccgccgtagcgcgcgacgacgtcgtggtctctcacgcagcccttcaccacgcgcgccgcctccaccagcaccttggagcccacgaggtggccatgggtatcgttgatggacttgaagtggtccaggtccaggaacagcaggctgaaggtgcgctgtgactggagcgcgtcctggacctcgcggtccaccaccaggtgcaggtagcgggtgttgaacaggcgcgtgaggtcgtcgacgtacgccaggtcctccaccgcggcgaagcggccgaggttgcgcagcgcgagcgcccagttgcgaaccaggaagctggccgtctcgcccgcccactccgcgcccgtgccgccgaagaagagcaccgcgtgtcccagcacggcgtcaccctccagcgcggggaaggagattgcgcgaggaaagggcgcgtccatgccgtccagctcgcgcggaccgcgttcgttcgtcaggcgttcgatgagctcggcgatgagcggctcttccagcgcggtggacaggccgctggtgccgtggcgccgcagcgcgaaggcagagtcgcgctccagcaggaccacggcgctggcggaggccatgctctgcagcgcgctggcggtggccgaggccagcttctcgcggtccagggtggtggcgatgcgttgccccgcctccaacatggccacatggcggcgcagcgacgcgttctcctgcatcaggtcgcgcgtggtgagcgctcggcgcacggcgtgctgcagggcctccggggccaccggcttgacgaggtactccgcggcgccgctcttgatggcgcgcacggcggggtccaccttctccaggccagtgatgaccaccacctccacgcccgggtgatgttcccgcacgtgccgcaggacctccatgccgtcaccaccggggaggatgaggtccgtcaccaccgcgtcgaaacggtcgcctgcgagtgcttcctttgcctcttgtagcgtgcccaccgccgtgacggcgtgtcccacggcggtgaggtagtcgccgtacagggtgcgggcgatcttttcgtcgtcgacgaggaggattcgcgccatctcccatcggcttagcaccaaccgatggaaggctgctagggtcggcccccgtgtcccccttgcaatgcggccgtcggctctgccttctcgttgaggccggggaaacccgttacgccgtggaagcgacgtctgtcatggaagtagcgatgccgggcgccaacggcagcagcctgcggggtgtgctggaggtgaaggacctctgcgcgctgctgggcgggccgcccgagcaaggcccgggcatggtggtggtgctcgacgtgagtcccaccctggcggtgcgcgtgcgctccgtggtggaggtggcggacgtggcccgcgcgccgttcttcctgctgccaccgggattggcggactcgctggctccgctgagccggggcgccgtgctgcacaagtcgcggctgtacctggagctcatcgcggaggcgctgccgcaccgggtggggtcgatgtcgccggcggttgccgcccggcccgtgcactgggcggaggcggctccggaccgcgcgctcgtcttcgagtctcagagtcgattgttcggagtccccctgggtctggtgtcgcaggtcatcagccggggagaggccttctgcgtcctgcccgtgccgagtggaccggtggctggtatttttccgcatgatcaggtgctgtggcccgtctgctcggtccccgcgttgctgggggaagcgcccgtgccggaatccttcatcgtcctcacggaactggccgggcggaacgtggggctgacggccacgcgggtgctcggcgtcatgcaacgattcgagccggacgacaccgcggggagcttccgtgctcccgggttgagcgagcctgtggcgttcctggacctgcaacgcatgttttcttgatcgtcccagagggcaactcgtaagctgccccgcttgtcagactgccgcgagtcaaccctcgcggcgggaatcaccaacgaattcaggggagtggatgctccccgaggcccgaaccgatgcccaagaatctgctggtcgccgatgactcgctcaccatccgcaaggtgatcgggatgatcttcgcgaccgaggactttcaggtgaccgcggtggacaacgggctggacgccatctcccgcacccgcgagctgcgtccggacgtcgtcctcgcggacgtcatgatgccgggcaagagcggctatgaggtctgcgaagcgctgaagaacgacccggccacccagggcatcccggtggtgctgctggccggcacgttcgaagcgttcgacgagaatcgcgctcgcgccgcccgcgctgatgaccacgtcaccaagcccttcgagagccaggtgctgctcgacaaggtgaaggcgctggtcggccagaagtccaacacgatgcccgcgtcggccgccacgcaggtgcgccacgcggctcctcagcccgccgcggcgcccgcgcccgttgccgccgctgctccgccgggggcccgtcccgcgcctccgccgggggctcgtccgggtgttcctccagggccgggcgtgccgcgtccgccgggcgcgggtgtgccgccgccgggcgcgcgtcctccgggacctgggatgccgccaggcatggcgcgtcctccggggccgggaatgccgccgccgggtgcgccgggcgcgccgcgtcctccgggacctgggatgccgccgggcatggcgcgtcctccggggccgggcgtgcctccgggcgcgcgtcctccggggcctgggatgccgccgggcgcccgtccgggtgtgccgcctccgccgggtggtcccgcgccgggccttccgccgcgtccgggaatgccgccgggcgccgtggcgcgtccgggcgtgccgcctccgccgggtggtcccgcgccgggtggcttcgcgcgtccgccggttggcgcgccgcagcctcctcctggagcggcgccgcagcccgccgcgcggggcagggatccgttcgggttgggggcgcccgcgcccgccgcggcccagccgtccatcagcatcgaggactcgctgcccgaccagggtgacgcggaggagatctcgctggacatcgccacccccgcgcccgtcgcggccaggccggcgagcgcccgtgcgcctgccgcggatgggggcgaggccctgctgcgcgaggcgctttcgaaggcttcccgcgaggtcatcgagaagattgcctgggaggtggtaccgcagttggcggagaccatcatccgtgaggagctcgagcggctcatcaaggaccgagagacccagcactgaggcgcctggcgccgtaacctcctgacctttgccggccccggtctccggggccggccgttttcaatgaccgataccactgaactttcgaaggcctacgagcccaccgaggtcgaggctcgccgctacgcgttctggctggagcgcaactacttccgcgccgaggcgccctccgacaagccgccgctttagag

SEQ ID NO: 554 - DNA, 2976 bp, Myxococcus xanthus
gtcgtcgtcgtgcatcagccgggcgaacacctccacccagcggtagctcccgtcgcgcgtgaggtagcgcatctcatggcgcacgaactccacttcccccgcgaacagtttctggagcggctccgggtcgcgctcccggtcatccgggtggaggaaatccgagaaggagcggcccaggctctcctccacgctgaagccggtgatgtccgtccaggccgggttgaggaaggtccacgtccccgccaggtctgtctggaacaccacttcccgcaggctgtcgatgacacctcggtaacggtgctcgttggaggtccagtcaggcgtggagtgcggcttctgcatgatggaactcgagaaagtgggccgcgcgggtggacgcaaggtcacccggatgcgctacaaagggacagagaatctggatttccgggcaggcaagcaagggggcttcgatgaccctggcaggcgcgggatggggacggcgccccttctgctgttctgtggaaacacggaggctgcccttcgtccggggaaggagacatgcctccatgttgcctctgctcgcgggaagtccctcatggcctgtgaaagcgccccgctttcgatgacgcatctggactccgaagaggcggacgccctgctgaaggagggcgtcctccggttgctgctcgagcaggcgggcgaggcgctcgtgttggtggatgtcaccgggcgtgtgctcgccttcaacacggaggccgggtgtcagttccgtatgagccggcccgaacgcgccgagcagggttggttgcccggttgtgtatgtacgcgtgcggaggatgcgtccatgtcggtggaggtgccgcccctggcgcgcgcgctcacgggcgagtgggtggcggaggcccgctggcgggtgcgccggccggatgggacgcacgtcctgctgcgcgcctccgcggtgccgctggagcacgacgcgggcccgacggctggagcgctgcttcgcgcatgtgaggtggcctcggccgtggggttggacgcggtgggctcggcgcggctgctggcggaggccggtgcgctgctgggcgccgcgttcgacgatgaggccgcgccgcggttgctccgcttgctggtgcccgcgctcgcggacgcggcggtgctgtacctgggccagcccggcgggccgccgcgcccggtgacggcgctgcacgccgagccggagcgccatggcctgctggaggagatgctgcgctgctacccattgccgcctgagcgcgtgctgccgttgttcggcactggccagtcggagcggttgcgggtgacggaggcccacgtggaggccaccgcgcgggacgcggagcacgcgcggctgctgcgggggctgggcctgcgctgctacctgggcgtgccgctggtggcgcgcgagcgcgtcatcggcacgctggccctcttccgcgcggatgaagcccgtgacttcagcgcggaggagctgcggctggcggaggaggtggcccgccgcaccgcgctctccgtggacaacgcgcagctcctccaggaggcgcgcgaggcggtgcgcctgcgcgacgagttcctgggaatcgccagtcacgagctgaagacgccgctgacgccgctgcacctcaaggtgcaattgctgcagaagcaggtggatgggatggcggcccacaaccagccggtgtccgccgagcgcgtgtcggagacgctggaggtggtgcagcggcaggtgcgcaagctgacgagcctggtggacaacctgctcgatgtgtcgcgaatcaccgcgggccgcctgcggctggaagtggaggagatggacctggccagcgtggcggcggaaatcctctaccgattcgcgccctccgcctcgcagttgaagtgtgagctggagctgcacgcgccggtgcccgtcatgggccggtgggaccggctgcggctggagcaggtggtgaccaacctgctgtccaacgcgctgaagtacggcgcgggacaccccgtgcgcgtggtggtgaaggcggaggggctcaccgcccgcctgacggtgcgcgacggcggcatcggcatctccacggaggatttgccgcgcatcttacagctcttctatcgcgcagtgtgtgacaggcactacggcggcctgggcctggggctctacatcacccggcagattgtggaggccttcggcggcacggtgcgcgccaccagcgagccggggcagggctccctcttcgtgctggagctgccgcgcggcgacatccccgaggaatggctgacggcgcacggcgcgccggagccgtcgtcgtcctgacgcgctaggccgcgctcgcggatgccgcgggctcggcgcggcggggcagccgcacgtggaagctgctgccgcgctggggccccgggctctccgcccagatggcgccgccgtggcgctccacgatttcgcggcagatgaagaggcccagccccagtccgccgaagtggcgcgcctgggcgttggacgcgcgcgcgaagggccggaacaggtccgccacgttctccggagggatgccgatgccctcgtcgcgcacgctcagcagcacgtgcgtctccgcggcctccaatgacatgcgcaccgcgccgccgtggggggaatagcgcacggcgttgctgaccagattggtgagcacctgctccagccgcagcgcgtcccagtcgccctccaccgggtgggcggggacgtccagctcgaaggtgacgccggactcggtgcgcagctcgaagcgctccagcacctcgcccagcagggggaccaggtccagacgcttgcgctccagctccagccgcccgccctggatgcgcgcggtgtccagcaggtcatccaccagccgcgtcagccgctccgtctgccgggccatggagcgcagcgccttgagcagccgctcgcgctccgggaagtctccgctcttctccaaccgctggagggtgagcgcggcgaagccctgagcttagagc

SEQ ID NO: 555 - DNA, 3653 bp, Myxococcus xanthus
gtccaggcgggccaggacgtctacgccaccctcgaaacgaaccagggcgccatcgtcgtgcgcctcttctccaaggatgcccccaagacggtggccaacttcgtgggcctggccacgggcgagaaggcctggacggacccgaagacgggccagcgcgtggagggcaagccgctgtacgacggcgtcatcttccaccgggtgattccgggcttcatgattcagggcggcgaccccacgggcaccggccgcggcgacccgggctaccgcttcgaggacgagttccagagcggccgcaccttcgacaagaagggcctgctggccatggccaacgccggccccggcaccaacggcagccagttcttcatcaccacctccacgccggactacctcaacaaccgtcacaccatcttcggtgaagtggtgtcgggctacgacgtggtggagaagatttccaacgtgcagcgcgacccgcgcgacaagcccctggagccggtcgtcatccagaagatcgcgatgagcgaccaggccccggccggcagcgggaactgacgatggaacgcgccctgcgccacgtggccacacggttgggtgagctggactgccacgtcatcgacgcgctccccgagggcgcgacgcccgaactggtcgtcgtcctctcccatggcctgggcgcgcccgccaccgacctggtgcccctggggccggagttgatggcgttccagccggcgctggcggaccgcgtgcggttcgtcttccccggcgggcccatggcctgggcgcacggagggcgcgcctggttccccctgcccgacgcggtgatgcggggggagcagcgcgactgggagcagttcgcgcgcgacgtgccgccgggcatgcccgccgcgcgcagggcgctgatgagcaccgtggacgcgctgtgcgccgcgatgaagctgccctacgggcgcatcgtgctgggcggcttcagccagggcggcatggtgtccacggacgtggccctgcgcctggatgagccgcccgccgggctgtgcatcctctccggcacgctgacgtcggagccggagtggcgcccccgcgcccagggccgcacggggctgcccgtgttccaggcccacgggcgctacgacccgctgctgccccttggcagcgccgagcggctgcgggacctgttcgtggcatcgggcctcaccgtggacttccacgcctacgacatgccgcacgccatcgtcaccgaggaactggaggccctggccgcgttcctcgccgcgcggctgggaggacgctgagccatgttccacgcgaaggagctcacggtgtccagccggggccgcggcttcaccgacatcaccgcggacgtccagcgcgccgtcgcggagagcggcgctcgccaggggctgtgcaccgtgttccttcatcacacgagcgcgtccctgctgctgtgtgagaacgcggacccggacgtgcgccgggatttggagtccttcttctcgcggctggtgaaggacggagacccgctcttcgtccatgacgcggaggggccggacgacatgcccgcgcacgtgcgcaccgtcctcacgcagaacgcgctgaacatccccgtgaaggacggccgcgcggacctggggacgtggcagggcgtctacgtctgggagcaccggacctcaccgcaccggcgccgcgtcaccgtgtccgtggtgagctgaccgctacggcgcgcccccctgcgtcgcggcgaccgccaccctgcgcggcttgcccgtcggccgggcctgaccgcggatgcgaatccacgagcccggcgcgtcctccgtcgcgtggaccatggaccaaccgacgggcacctgcggcgcggcccaggcatagagcgcacgggcgtccttcggcgacaggttgacgcagccatggctcatgggctggccgaagcggtcgtgccagtaggccgtgtgcagcgcgtagtcgtcctggaagaacatggtccagggcaccgtggccacgcggtaggtgtcgttgccggcggtgccgctgcctgtcatgtcggcctccgcgaatttgatccagatgcggaacaggccctccggcgtgtccgtgccctgcttcccggaggagatgagcgtcgcatacaccggccgctcaccttcgtaggccaccagcacctgggcatccaggtccacgtccagccagcgagagccgggctccacctgcggcggcgcgtgtgagaaccaggcgacgtgcaggtcgtctcgcgccacccattggtcctccgcgatgctcacccagtggccgtcctcggacagctccttcactgccaccagcgtgcgtggtggcagcaccgtttcgcgggcggccttcgcgtctggcgctgtccgtacttccacggcggcgaaggggcgcgtgcgggactgggcccaggcgaatgtcggcggcagctcggcgatggcctccgcgttcacgccttcgtaggaggacggccggtactcgcgcagcacccgcgcttccaggtactggccgtcggtggtgcgccagtacgtcctgcggcggatgcggacctgcccgcggagctgtacggatacggagcccttcagcagcacgccctttcgccgggcgcgcgccagggcgaggctgggataggcgcgcacgcgcttgcctacgacacgggcgtagatgccgggcgtcagctcgccctcgcgcagcttggggagttcgcgcacgcggggctcgcggaagttgggctccaggtagcgctcgcagacccagccgcgcggttcaatctgaatccacgcctcgcagtccgggccgcgcaccgccgtttcgccctgccagcgcacgcgcatgtcctgcgccacggtgcccagtgccggtgcgtcctgccgaggctcctggcggaccacgatggagcggcgcacccgcagcgagcccgcgtccggagcgaagggcacggcgtacgtccctccgtcatccgcgccgctcacgggctccagtcctgggtcgacgtcttcgagcaccaaccccgtgtcctcgagcggctcgccgtccgggccgagcaccagttcctcgcccgggtgcagttcatccgggatgaccgtgagctgctcgggcagggggagctcctctccgcccggcgtgtcctcttcctcctcggactgggcaaggtcgtccagcgcggggtcgatggtcagcgccggcacctcgtcgcgcgcctcggccgccccatcgtcatgcgtgcggagcggcggagacagcgccgcctcggccgaaccatcaacgccgccgtcagtccccccatccgccgcggtgcgctgccacgccgcgaacagcgcatccgctgccgtgcgccgggcatccgcggggaggtccccaggagcgttgctatcggcgtgaggtgcgcggacctccacgccgtcccctggcgtccctgggccagcgccgccgtcgaacaccgcggccctggatgccgacacagatacactcggtgtgttaccgcgttcctccgcgccccggggcgcggccactctcgccagagaggcatcgggcgaggtgtcctccgggccgggaggcggcgtgcaggcaattccaggcagcagcagaacgagcggaagccaacggcgcatggacctaacacggtacggaggaacggcggcacactcaacgtcggc

SEQ ID NO: 556 - DNA, 3761 bp, Myxococcus xanthus
ctccaaatcctggtcgctcaggctctccgggtgaaggtgggcgtcgaagatggccggtggggtgggcactgctcaatcctgtcccagggcggcgccctcgttgcgcgggtcactcgcggagaagcgcagccccgtcttcgggtcgctgtagacggcctccgcgtcgccccactgctccacgcggcgcaccttgtggcccttggcctccagcacggacagcgtcgccggctccaggccccacttgtccacccacagctcgtcgggcaggtactggtgatgcacgcggccttcattcaccgctcgcgccacgtccatgccgtggtccaccacgttgctgatgacctggatgacggtggtggggatggtggagccgccagggctgcccaccgcgagcatgacgcgccgggggtcttccttggagaacaccagcgtgggggccatggaggacagcggaaccttgcccggtgcgatggcgttgggctcgcccgtcaccaggccgtacgcgttgggcacgcccggctgcgcggcgaagtcatccatctcatcgttgagcagcacgccggtgcccttggccaccacgcacgagccgaagccgtagttcaccgtggtcgtcatcgccaccgcgttgccgtccttgtcgatgacggagatgtgcgtggtgttcttcttctccggctcgggcgtcagggtggtgggctcgtccgtcagcgtggagccccgcacgccttccttcggcgccagcagcgacgcgctgggcgtggccttcttcgggtcgatggagcccgccaggtccgcgacgtggccgggtgacaccagccgcgccaggggcacgtccacgaaggccgggtcccccaggtacttcgcgcggtccacgtaggcccgccgcacggcttccgcgtagaggtgcagcgcctccgcgtcgcggaacgtcacgccctgggggcgcagttgctccatcgcggtcagcacctggatgacggccacgccccccgcgctcggcggcggcatggtgaggatgcggtggccgcggtacgtgccctccaggggcgtggcgctccgcgtcttgtaggccgcgaggtcctcctgggtgaggatgccgtcgtcagcctggaccgacgtggggatggccttcgccaccggccccgcatagaaggccttggcgccccccttcgcgatggaggacagcgtacgtcccaagtcgggctgggggatgacctgccccacgggcgggggttcccactggccctgggcattcttcaccaggaacacgcgtgaggcctccgcgtcccggctcagacaggccagccggccctccgccatggtgcggtagcgcggcgtcacccacatgcccttgcgtgccgccgcgatggccggcgccagcaccaccgccggcttcaactttccgtgcgccttgagcagctccaggtagcccgcgacggcgcccggcaccgccacgctcagcgcgccgtccgtggacaggcccggcaccaccttgccgtccttcacgtacatgtcgcgcgtggccgccttgggggccacctcgcggaaatccagcaccttcgtgtcgccgctcttggcgtcgtgcaccaatgcgaagccgccgccgccaacgccggagtggtagggacccaccaccgccgccacgaaggccgccgccaccgccgcgtccgtggcgttgccgcccttctccagcatctccaacgccgccgcgctcgcctgcgggtaggccgtggccaccgcgccgccccggtagggccgcgccgcctgcgccacacacgccaccatcatcaccgcggccagcagccctcgcttcagcaccgcaccgcggaagctcgtgtccttcacgggttcagccctcctcgcgctgtctgaacagtccatcgctggctttcgtcctgggtgatgtgttacccgggcgacaaaagcctaccctccagtccggcgacgccaggggaccagacggactacatgtgtcccggtatgcacgaaccgtatggtcaggaccaggatttcagcctgacaacatttttcctcttggattgttctccggcggcgtgcatcctggtcccatcatgaatcgcgtccgggggagcgtatgagcacgcaagccatacccgagaaaaaggccctacctggcgccgcgcccaccgcggccgaggtgacggtcttcttgaagcccagcttcggcatcacgattcagcgcaacaccctgtgcgtctcggtcagtgcgaaggcacggccggtggacaccgtcacgccttctgatccgcgcgcggttgacgactcgattggctgtccctaattctccgccgcatgagcgttctggcggcggtggtgctgtgcgcgggcaagggcacgcggatgaagtcggagaaggcgaaggtccttcaccccatcctcggtcgacccctttgcgcgtatcccctcaagcgggcccttgaactgggcgccacgtcggtggtccccgtggtgggccaccaggcggaagcggtggaaaaggccgtccgaggcctcttcccggatgcccccctgcgcttcgcgctccagcgcgagcagcgcgggacggcggacgcggtgcgctccgcggaggaggccctgaaggggtactccggacgggtcctcatcctttacggcgatgtgccgttgctgcgccgcgagacgctggaggcgctgctggccgcccatgaccaggcgggcggcaagctggccatggtgaccaccaccctggaggaccccacgggctatggccgggtcatccgcgacggtggcaaggtgacgcgcatcgtggagcacaaggactgcaccccggagcagcgcgcggtgcgcgagtgcaacgccggcatctactccgtggacgcggacttcctctggaaggcgctggctgaaatcaaaccgcagaacgcccagggcgagtactacctcaccgacctggtggagatggccgcgaagcggggcccggtgggctcggtggaggcggacgccacggagacggccggcgtgaatgaccgggtggagctggccgcccgcgcgcgcgtgctgcagcagcgcatcaacgaggcgcacatgcgcgccggcgtctcgctacaggaccccgccaccgcctacatcgaggaaggcgtcaccgtggggcccgacaccgaaatcggtccctccgtcacgctggccgccggcaccgtggtgggcaagggctgcaccattggccagggcagcgtgctgcacgcctccaccgtggcggacggcaccgtcatcaagccttactccgtgctggaagaggcccgggtgggggagcgcaacgtcattggccccttctcgcggctgcgcccagggacggagctggccgaggacgtgcatctgggcaacttcgtggagacgaagaaggcccgcatcggaaaaggttcgaaggccaaccacctcacttacctgggggacgctgtcattggttccgggtgcaacgtgggggcgggcaccatcacctgtaactatgacggggtgaacaagcacctgactgagctgggggatggtgtgttcatcggctccgacacccagctcgtcgcgcccgtgaaggtcggcgacggctcgtatgtcggcgcgggcaccacggtgacgaaaaatgtgcctccagggagcctcgctgtgtcccggacgccacaggtgaccaaggaaggttgggtggccaccaagaaggcgcggcaggcgaaggcgcgggcgggatagtcggcgcggctcttgcttgggtaccaggcagagcgcggcccggcagg

SEQ ID NO: 557 - DNA, 4140 bp, Myxococcus xanthus
ccgatttggtggccctagtggcccacggacatgcacgtgggctggacggacactgatcccgagctccgggccattacctgctccgtgcgcgggttgatggatgacatccgccgcggactgggctccggctcaccgtgctaccagcgctacctgcgcaccctgctgcgcgaggccgccgtcacgctgccggacgcggagctgcgcgacgccttcgcgcgggagacagacccggtcatggccgaacacctggcggcggcagctggtggcccgcgcggaacgtgaagcggacacccaggccatggacgtggtggcacagcgcgcgttgcacgacgcggacccgtccgtgcgcgccgccacgctgcgggccatgcggcgcaccagcgcgctggagcgcaccggtgatttgtacgagcgcatggtgcgggacgagtcgccccaggtgcggcaggaggcggcgaccaacctcatcgaggacaacgcacacgtgtacgccggccagtacggcccggcggcggacacggcggtgacagccgcggtggcctccacggacccggcggtgacggcgcgcatcctggacaacctctccactgagaaaatcagcgccgagtccgcggaccgcatcacgtccctgctgcgcagcgatgacgcgagcgtgcgcaaggccgccgtcaacgcgctgggcggcgtcccggcggagcagatgcagggcgcccgcgagtccctgctcgccatgtaccgcgaggagacggacgagggcgtgcgcaaggcgctgctccagagcgtcgcgcagctcggcttcgagggcgcgattcccgacctccaacgcatgcgcgccatggacccgcgcctggcgcaggaggccgacgcgtggattcaggttctcggcatgggccttcaggagtggagcctgctcctgagggagaagcagcggttgcagcaggctccgtgacaggcagtccattgaaaggaacacctcatgcgtagcagcacctggaagaactccctggccgcgctggccgcgctggcgctcatccccgcgtccgtgacggcgcacaccgtcaagggcacccacaccggctcggtgacggccctgaccaactacagcagcggcacgttccacggcgcggtggacatcggcgcgggcggccgttgcaactactggggcgcggagacgggcgtggtgggctccgtctactgggcggtgaccatccgcaccaccggcgtcgtctgcaacggcaacggcagcggcaaccagaacgaggcacgccacgcctgggcgagcggctggacgttccgtcagtggcacttcatcaagacggcggactcccgcagccgcacgtgtgaccgctgccaggtgggcaacatcggcggcaccggcaactccaccggtccccacgcgcacctccagcaggacaagctggggacgaaggacacgtcctggtacaagggctacgtcagcgtgggcaccgccgtcacgcgcgcgaagaccatcggcgttctggactgacgcacgggcccacctgggccgccaggaggcccggacacgtccccatcggaaggtccgggccttcgacctcgcgcgaggcgccgctcagcccagcttcatgcccttcgggcgggccagcagccgttcgatgtaggcctccagcgcgggacgccccgtctggctgccgaagatgcgcatccagatgaacatcgaacccaccatcacgtccgccgcggtgaagcgctcaccgaacaggtagggcccctgtcccagttcgccctcgacgacgttcagcaccgtctcgaagtccgtccagccccgcgcgggccccgtcggcagcttcatcaggtggtcacccatggagggctccagctgcgacgtggagtacaccatcaacgacaggtagcgcccccagtccttgtcacccggcttcggcgcgagctgcgcgtccgggaatttctccgccaggtagagacagatggccgcgctctcgaacagccgcgtgtctccgtccaccaaggctggcaatttcccagcggggttgattttcaagaactcaggcgacttgttctccttcttctcgaagtcgatggggacgatttcatactgcgcgccgcactcatccagcatccacttggcaatgaccgcgcggcttctggggttgaaatagagtttcatcgtcggacctgacctttcggatggaggacagcgttgcctcctaccagaacaccggcacggggcacggcatcatgcgcgtgaagaaatccgccgctgggcgctcgcccacccgtcagacttcgatggtggaatccccgccgatgagacacgcacccgaagactgggcccgcttcgcgagcacgcactgggagcagtcccccacgcggctgcggctgggcaccccgctcattccgcccgagcaggccttccaggggctcgtctccatcagcgcgccattccgcttcggtacgcgctttggcgccctgcccgacgtgcgcttcttcgcggacaccgcgcgtatgcgcgcgcccggcacgctcctgcccggagagcaggacgcggacgccaccgcgtatctccagcgcgtcggccgcgagctcggcgcggcgcgcggcttccagtgcttcgtggaacagccgctcatgctggactacgcgcagtgggagcgggtgcgcgccttcgtcgacggcgtgctggcgcgagtcggcgtgcccgttctgcccatcatcagcgacctgtggctgggacgcttcaccgagccgccgcagggcgccgcgcgccgggaacaccatgcccgcttcaccgcggtgctccacgggcggctgcgcgtgcgccaatggacgaaggacgcccacaaggcccggacggtggaggcccaggcgggggacgtgctgtatgcgccgtcccacgtctggcaggaggaggcgagcgacgagggcgccctggtgctgcggctgtggattccggtgcgcggcagcgagcccctggaggccgtgaaggccctggcggtgaagctcctggagaaccagggtgaggcggatgacgccgtcccgtacctgccctttcccgggacgcgtggacgcacgcccgtgccacgactggcgcacaccgcgagcgcgctgcgggccgtgacgcacggcccggacctgcggcaactgctgcgcatcgcgtgggcccagcgcgtcagcgcctccgcgctggagccggtgcctccgccgcgtgcccacgagcccctggaagaagacgcctacgtgcggaagacgccgccgggccgcgtggtgcggatgctggacagcccggggcagtggctatgggccgtcaacggccacgcgttcgccggtccaggccccttcgcggcgcacgtactggacgcgctggcaccgggcgtccccgtgcgggtgggcgccctgtgcggcctggggcgaggcgcgtcccaacgcgagcaggtgcgggccttgctggaaacccttcatgcgctgcgcggtatcgagcgcgtgccgtcgaaggaggcatgacggatggcccgcatcgacctccagcgccggttcgactgggacaccttcgtcacgcgctactggaaccagcggccggtgctctaccaggcgacgggcatcaatcccttcatggacacggacgtgttcgacgcggcgctcggggcctcgcgcggcgccatggagccgcccacggcgctcgaggcgcgcacggacgtccagttcaccatcgaccaggggcagcccgtccaactcgggccctggcttccccgcgacaccgacggctcgctggacggctacgactcgcggctcgcggacgcgctgggaacacgtcgctacgcgctcatcatctccctgctgcattcccacggcttcggactctggtcccgcgagcgggccttcttctccgacctctggcggcgcgtggggctgcccctgtcaggcggcatcaccacgctgttccatgggaactacgagcacagtccggtgggcgtccacctggaccgcttcaccacgttcctcttagccatccgggttgctcgactttgtggcatggtgcgcgtagactggccggagcaatgcccgtcaccaccgtggtgagactacgcgccctatctgaacgaagtccttcaccgcggaggtggggcccggcgacatctcactaga

SEQ ID NO: 558 - DNA, 3549 bp, Myxococcus xanthus
  unsure (1)..(3549): unsure at all n locations
tctcgttctgacccgctatcgggcaggttcaggtgcgctcttgcctcagggcgggctgggtcgataatgttttgagcgctgctttggcatttttgccgaaagcgattgaggatatttgcagtcttgctgggagggattgatgggatggcttctacatagcgtgcgattttttcgatatcaaaccgagtattgagggatgatgaggccaggactatctggagggattggaattcagacagtaggtggagaagcgatctgattggtttgaggcgatcggtttctgtttcgtcattaagtgtgcttgttccggcgaagcgttcaagatcctcgatccagactacgattgttaggttgatggcggatgcagcttggttgtaatcctccaggattgctgaaggatctctcgttcctttgagtaggcgcccccaggatccgccggccgcttcgattgcgtttatgtattcatctgagagccccgacattggcgttgtgttgatgtgctgacttagtgttttgtttattttttctagaattgctcgaatcgcggcttcgacggtgtcgaagggccatagacttagtctggctacagagatctttgtgtctaggagcctcaaggcatgtagttcgtgcgtgactaagttgaagaccgaggtttttccgcttccgagtgtgccgattagagctagtgtgggtcgctttgcgcttggtgagaagagtcgctcggtaattcgctttgcgatgcgcgcgtgaccaaacgcatctagcctgggatgcgagattggttggtcgttttcaatccaggggagcagatcgttgtagtcgaaggcgatggcgtttggtgggagggcttgagtggttgtgcggtctgtggtgtctctgggcgggttgcctgtgttcaggacttggggttctgattgggctcggtgggtggtgcgtgttgcccagtagatgcttgccttcctgccaatgagagtcgtgaatgcgcctgctgttagggctagtaaaatgccgaacttcccttgtgatgccatttctcgaagcagagggaagtcaatccccttgcagctaacgggcgccgcttcggggggaattagagtgatgtacgtagataagagggcgaagcccagtagggctgctagccaagtcggtgggtgactagggaagtgtcgaaatccagaccatgctgatagtcggcctttattcgatgttgaaagtagaatggttagtaggatggctccaggagggaacgcccattttgatagatgcgatagctcagggtgggcggggaatgaatggaggaggaaagtcgctcctgcggcccccgcgatggaaagaagtacgatgtcaatccatcttttggtggtagcacttgttctaatgatcatttgtgctttaatgaatttgtcgagttacgagaggcccagcagccggggtaccttctcctccagcaggtcgatttcttcccgcgtctcgcccaggtacgagaggagctggaggtcctgccgctccaccgcaccgccgtggaagatccacgcccgcgtccggagcaggcggtagagcttcaccagcttgcggtcgctgatgaacacgccgtcctcgcgcgtcagcgtctgcaccacgcggcggaactcgcgcagcaagtcatcgcggaagaacaggtcgcggtcgcgcagctcgcggccgtccgggcccgtctcgcgcttgcccatcatcagcgtcaggtagcgatgggccttgagcacgtcgtccagcgtggcgtgtccttccgcccagggcttctggttcatctcccggtgcgtctgcgaatccaggccggagtccagcagctccaggaagtagcggtcctgcaccggacggcacgcggccttgaggcagaagcggtccttgagcgcgcccagctcggcgtgttcgggcagctcgttggtggcggcgaagagcaccttcagcttcaccggctgcggcgcgccgtcctggtagaatttgcgctcgttgatgacggtgagcaacgcgttgaggatggcggagctggccttgaagacctcgtcgaggaagacgagccgggccgtgggcagcttgccgccttcgcgccggatgtagcggccctggcgcagcaggttgatgtcgatggggcccagcacctccgacggctcggtgaagcgcgtcaggaggtactcgaagtaatcctcgttggggatgcgcagcgcgtcccggaacttgaggaccaggtccgacttggccgtgcccggtgggcccacgagcagcagcggctcctgcgccaccgccgccaccgtcatcaggtccaccagcgtctgcttgcccacgaagtgacggcccagcgccaggcggaagcggttgaggcgctcgcgaaggccgtgggcctcgctcgagagcgcgtcgaacgtcagctcggagatggcgggaagactgctcatgtgcgctcctccagctcccgatggatgcgccgtcgcaccaggaattcgtcttcgtcgagccagcttcgtgcacgctctccggtgccttgcgccacctccacgtggccctgcaccagtgcgtccgccagctccaccacggagaggcagaagtggctgttggtgttgtagctgtccgtgatgattggcagcccttccgagatgcgcgccagccccggaagcgccagctccacgggggcatgtgccagtgcgctcgcgaggctgcgcatcagcgccagccgctcagggagtccgcccttcgccgcgcccagtgactcgaaggcggcgtcgaacacgtcgacggcctcggccgtgcgcccctgcatggacaggcccgccgcgacgccgagccgcgccgtcagcggtgtcttgggtcccgtcaggcgttcttgcgccgcgtccaccatctcggcggcttcgcgagacaggccgacccggcgcaggccgcgcaggctcacacccaagatgccctggccccatgcgggcgacgtgggagccagcgcagtgagcaccttgcgcagccgtgccgccagcgtcatcgcgtggtccgcgcggccgaagagggccgccagcgtcagggcatcccccagcatcacggcctgggcttcaccgggaagcgcctccatcgatgagacaagccggttcaggagtggaagcgcacgcgccggcgcgacgcggggcagcgtgtccagcaggcctccgatgagccgttgccgttcctcggcgggcagcgtcgcatcggtggcccggcccgtgagggcttccacctgcgccgccacgtgcgccgggtccttcaagtcgcggagggcggcgaactcctctccgcgcaagtccctcgcgccgcgcccgaaggccctcgcggggtcgagtcgctcgcttggctccaacagcgccgacgcctgccgcagccgatccaccttgtaccgctggaaagtccccagggcattcagttcggcggcgatgtcggagggcagcggtgtntctggcggctgtcccctcagggcctgggccactcgcgcgccttacgctcgggaaaggaagccccctctggatcccctaggaagaggtgcctcccccgacg

SEQ ID NO: 559 - DNA, 3771 bp, Myxococcus xanthus
cgccccttgtcctccagtccgctgtccgcctcacccaattgcaccagctccagcagcagccggttcgccagcaggcgttccgagggcttcagcggttcgtagacactgtccgcccagcgtgccagcgaaccgagcagccccgcgctggcgttgaatgcctccaaggtcatcgcgccatcccgcgacgcctgccacaactgcgtcagcgcgacctccagcaacggaagcacggtgacgcgagcgcccgcgccggactccgcgcggaactcctcctgcgcggcgagggcgatggagtccaccacctcgggtgggtcgaagcgcaggcccacctcccgggccgggccggcgatgatgtcccgcagctccgagggcgtcagcaccgatggcacctgcacccggtgctcaccgagcaaggtgcgcagcctcggcgcgcgctcggacagcaccgcgtcgaagccctcgcgcagcgccaccacgcacgtcactggcagagactcatccgcgagcgcggagagctgctggaggaatcgttgctgttgcgccagctccgcgctgcttccgcgaaggagcacgtcctccaacgagtcgatgaccagcaccagccgcttccctggctccggattcgcggcccgccacgcctggacgcgcgcgaccaacccctctccagcgggcaggcccgcgccatccagcgcggcgaatggctccagccccgggcgcagggcccggacgtcccagtgctggctgcccggaatgaacgttccgtcccgcagcgcgggaatcagccccgcgtggagcagcgacgacttgccactgcccgaagggccagagacctccacgaatcggggcagcctcgcgagcagcggcagcaattgttcgtccagcacccgcccgcgtcccttccagaaccgcgcgtccgattcacggaacgacgccaggtcccggtaggggcagtcctccgaagcacgcagctccggacagcgcgcgagcagctgctccgtgggcgtcgcgtacgcctcccgcgcctccgaggccacggccttgaagcgcaccacccccaccacgcgccgcgtctgctcatcgaagaggggcgcgccgctgaagccctcccggatatccgagccgtgcagcagcagcttgcgaaagtcgccgtcccccgtcgcgtagccgatggtgccgcgggcccacgtgcccgtgtcatcgaagccccgtggaaatccgaacgtggcgaagcggtggtccgcgctccgctccgcactgcccaggggcagcggcgtggacggccctcggagcgggcgcgtcagcgtcagcaccgcgaggtccgccacctccgtggggctcgatgcatcgagccgcagccgcgccgtggccttctcgtggctttgcagcacctccaggcagatggcgtcgcgctcgctgtcgctgagcgtgtcgagcacgtgccagcacgtcaccaccaggcgctccgtgacgaggaaccctgtcccgaggacgcgctgccgatcccggctcaacacgcgaacgacgccttcccggaggtcactgcctttcatgatgtgcgcgaagctagcacgcgcacccggcgctgattccaggcgcactcaagaggtggattccgtctccgtgagcgcttgcacgattcggcgggcggcccgccccagggggatgcccgagtggtggtggagctgggggcggaatgcgtgggtggcgtcacccgccagcttcagggccttcagctcgccccggcgcagctcgcgggtggccatgtattcgggcagccacccgaagcccagcccctccaggatggccgccttcttcgccgcgaagtcattgagatgcaccgtggagcgtgcctccagctcgccggtgctgagctggagccgagggtccgagccgcgcaccgtgagcaccaggtgctcggccagatcctcgtccttcaacggtccccgccgccgggccaggggatggccccggtgggccaccaggatggccttgagctccggcaggcggtacgtgcgcaggcccggcacggtgggcggcagcagcgtcaccatcaggttcgcctcctcgcgcacgaaggccgcctccacgccggagaggaactccgcggagacgtggaagcgggtgctggcgccctcggcgcgcaattccttcagcacgcgcagcaggggctcggcggggaagatgccgtcgaagacgatgcgcagcgcgggctcccagccagcgcgaatctccgcgcacgcggcatccaactcgcgctcggcggccagcagcttgcggcagtgctccagaatccgttccccggcgggcgtcagccgggtgcggtagccgcgccggtcgagcagcgtcagctccgtctgcgcctcgagcgtgcgcagcgcgtacatcaccgccgtgtgtccctttcgcagggcctccgccgcggcagtgaaggtgccatggcgggcgagggcgtccagggcgcgggcatgctccaacgtgacgttcatgcccgacattgtgcaatcttcagacagatgcaggcagttctctgtgctcgtgccgcgtcctctgcgctgggctggctgcttcatgacgcatgacgcagcgcgccttatgccgggtgtgagagccgccctacagtccctcacagtgaggtgctccgagcgcacccacctcgacggaggggaatatgacgggaaagctgtctagggccctggctgtggtgtcactgctggcctccacgagcgcgagcgcgcaggaggaggcgcaggcgctggagtcctccgcgcgggatgagcgcaggggcctggagctcaccgtgggtgtcggcttccaggtgggcgccggctacgtctaccgggagggtgcggggctggaccggcaggtccgcgacctgaagctcagcgacgcggccaatggtggcatcgccttcctgctggaggcgggctaccgcgtcaactcgcgctggtacgtgggcgcgttcggccagtactcgcacgtgctgacgaagacgaacccgtacacgtgcccggaaggctacgactgctccacgtcgcaaatccgcttcggtcctcacgtgcagtatcacttcgcgccggacgcctcgttcgaccccttcgtggggctgggcgtgggcatggtcctgctcaacaacaaggtctccggtcccatcacccagcccgcgcccggaacggtggagattgacagccagtcgcgcggccctgaattcgtgaacctgaccctcggcggcaagtggcggctgtcggattcgctgtcgttcggcccgtacctgacgggcacgtatgcccgctacaccacgcgcagcggcacctcgacggtgaacatccccgccgtcaatctcacgcaggagacgccgctggagcaggtgggtgatggcccctatggcttgctcatgctcggggttcgtgggacctggaacctctaatccggagtagccgggtttgtgtttcacgcgcagtctcaagtgacgcggtgccaacacgccgcgtcacatgtttccctaccagggacgtcgtcgttcgggattctcaacgcctgctggctgcgtagagtgcgggcagagattttcatcccgaggagtcgcccatggttcgtcgttggcagcggtggagcgcgtgcggagtcctgggtggatgggcgctgctgagtcttcccggggcctcaatcgcgaaggcgcctccgttgcagcaggtcaccagttgggtgcaccagtccggcggcccgcaggacgaactggcacaggccgtcaccacctccggcgacctttagagc

SEQ ID NO: 560 - DNA, 2886 bp, Myxococcus xanthus
aacactgcgccgggtcgacgagccgctcgcggacgcttcggggaccgccccagggccacagggacgtattcggaggcggattgttgattctggccatcgtgataccgaacctcactccagatgggtgggggacgtccagcccccctagcgcctggcagccgcggccgcctgctcacgttgtagctcgtagacgaagttcaggacctcggccacggcgtcatacaactcctcggggacctcctggcccacctccacgcggtagagcgcattggccaggttcacgttccgcatgagggggatgttgtgctcgcgggcaatctcgcgaatcttctccgccttgagccgcatgcccttggccaccacgcgcggcgcgccgtccttctccttgtcgtacttcaacgcgatggcgatttcggcgtcgtcactcatggaaggccccgttgtccctgcatgatagccacacccggcctcctcacgcgcggccctcgggggctggctgaccggacttcaagccgtagacgaagttgaggacctcggcgaccgcgtcgtacagctcctccgggacttcgtgccccacctccacccgcagcagggcgtgggccaggggcacgttgcgcagcgtgggcacgtcctgctcgcgggcaatggccttgatgcgctcggccttgaagtcgatgccccgggccagcacgcgcggcgcgccgtccttctcccggtcgtacttgagggccaccgccacgtggtccgggttggtgacgatgacgtcggcctcgcgcacggcctccatctgcgccccctccatgatctcctgatgcatctccttgcgcttggccttgtggtgcgggtcgccctcgctctgcttgtactccttcttcacctcctccttcgtcatcatcatgtccttcatgaaggacttgcgctgccaccagacgtcgaagacgccgaagaggacgaagaggagcgccacccgcgtggccacgcgcgtcaccagctctcccatgatggccatgatgccgcgcgtgtcctgccgcaacgtttcggccaccatgggcatggagtcgcgcaccacgccgtagacgacgtaggcggtgactgagattttgatgaggttcttcagcagttcaacaatcgccttcttgttgaacaggttcttcatgccttggatgggattgagcttctccatcttcggaatcagcggatccatggtgaagagcgtccccacctggaggtactccatcagcccgccgacaatggctccgcccgccagcaccggcagcgacaccagcaccaccgcgcgcagccccaggaagagcagctgcccggtggccaccgacaggtccaccgggttcgtcaggtggtcgaaggagaacaggaagagcgacgtcagctctgtctccagcatgtcccagctgcctttgacggcggccagccccaccaggagcacgcccacgccgctgaggtccttgctcttccagacctgccccttcttgcgtgagtcatccagcttcttctgggatggctcttctgttttttcgccgctctcgtccgacatggcgcgtcccggatgaagaggctcaggacaagagccgcagggcttggttgagggtccgcagcatgacgaccatctccccctgcatgcggtccatcagggcgccgagcaccaggaagacgagcagcacgctcaccaggggcttgacggacatggagatgaagaacacctggatttgcggcgccacgcggttgatggcgcccagcgccacgtcggtgaggaaggtcgccagcatcgccggagcggccagcgccaggctcacccggagcaggtccgcgaacacacgaatcatcaggtcgaagaagggccacggcccgtcgtggaagcgcgggaagccgtccagcggcaccgccaccaagctgtccgccagcgcttcgatgaccaggtggtgcccgttcagcgtgaggaacaacaccaccgccaactgcaccttgaagctggagaacagcgtcacctgctgcccgagctgaggcacgtacagctgcgcgttgttgctgccggacatggtgtccaccaggttgccggccacgcgcgcggcttcgaacaacgtgttgacgacgaaggcgatggtgaagccgacgaacacctccttcgccatcagcgcgatgtacggcaaagcgctcagggggatggacgtcaccgagcccgcgatgagggggtagaggacgattgagagcgtcagcccgatgcccatcttcagctcggtggggaccacctcgccgcccaggaaggggctgaagatgagcacgggcatcacccggcacatcaccagcgccaccgtgaagatgacggccgagacgttggcccgggtgcccagctctgcgacgaggtccgcgacgttcatttgatgagcgcggggaacctgtcgaagacgtggaacgtgaagcgcaccaactggcttccaatccaggggccggccaatgcgaggacgccgaacacggcgacgaccttcggcgcgaaggtgagcgtctgctcctggatctgcgtggtggcctggaacagggagatgatgaaccccaccaacagactcatcagcaccggcggcgccgacgcgacgagcaccaggaacagggcctcctgggtgatgaacgtgagctgattcatggagccctctccctacaggtagccgacgaccaggcccttggcgatgagataccagccgtccacgagcacgaacagcagcagcttgaacggcatggagatggtggtcggcgacaacatgtgcatgccgagcgccagcaggatgttggccaccaccatgtcgatgacgatgaacggcacgaacaagaggaagcctatctggaaggcctccttgagttcggacaccacgaaggcgg

SEQ ID NO: 561 - DNA, 3487 bp, Myxococcus xanthus
ccgccagcggcaccgtgccgtgcgcggtgaggaggatgacgggcacgtccggccagccgcgcgccacctccgcgagcacctgcaggccatccatgcccggcatgcgcacgtcgctcaccaccacgtccaccggcttgcttgccagcagcgccagggcttcctgcccgtcgcgcgccgcatgcgtcgtcaggcccgcctgcgtcagcagggcgcccagcaccttggccacggcggggtcgtcgtcgaccagcagcaccgtgcctctcaatgattcgttcacgcggcttctcccacgcctgcgccgcccaggctcgcgtccgtgacgggcaggcgcatccggaccaccgtaccgcgcccctcccggcttgtcaggagcacctcgccgccatgcgcttccaccacgcgccggacgaaggccagccccaggccgctgcccgaggccttggtggtgaagaagtcgtcgaaggcacgctcgcgtgttcgagcgtccatgccctcgccggtgtcctctacctccatggccacgtcggcaccgtcacgcagcgcgcgcacggtgagggtgccacctcccggcattgcttcgcaggcgttgcgcaccaggttctccagggcgttggccagcaggtcctggtcccccgcgcaggggggcaggccggcggccagctcccggatgatgacgaccttgcccgggctggcgaagacctggagcgacagcacgccctccaccagccggcgcaggtccaccggctttggcaggggctccacgcgcgccagccgctgatacgtgtccaccacccggtccaggcgctccacctgctccagcagcaggtccaggaactcgccttgcccgtcccacgaacgcccgcgcgcgtgctcctccttgaggtactgcgcggcgcccttcatcgcggcgatggggttcttgaggtcgtgcgccatctgcgcggagaagcggcccagcgtggcgagccgctccagtcgctcgcttcggctgacgtaggcggtgacgccccggcgggtcgccgccaccagggcgaacgtcaccgccgtggtgcagatgatgagcgtgcccgcctgcgcgacgaagagccgcaccacggcgagataggccagcacccccagccccgcgatgcccgccgcgtgcagcgcgagccggggcgcacccgggtcgtctccgaagaggccgaagcgcagcgccgcggtggccatcaccggcaagcccaggagcgtgcccacgtggccgagccgcaccacctccaggcccagctccgccgccagctccgtcatcagcagggccaccaccagcgtgagccccaacagcaccaggcccgcgcgggcgcgctcgtccgggtgtcgcgagtgcagcacgtggaatcccaggagcgcgaagcctccaccgaggatgggaatggccagcgcggagacgagcagcccgaagcgcagcgtgagcaggtgcgcctccagcgtgggggcgcccaacgccaccagcatggcgagcgccaacgcgccgaagagggcataggccccgtacatggcccaggcgaggcttcgtcgccgtcccacgaaggacaggatgaagtgcagcgcgcacggcaccgtcatcaagcccgcggtgaagcccaccagccgccagccgtcctcgtccgcgcgcaccagcgcgaagccggagaagttccacgtcgacagggcgatggacagcagcgacagcggcagcgccaacggactcttgcccacgcgcaccagggcaaggcccgccaaggcgagctggcccgcgcaggccaggaggctgatccacatcccacccgtcatggggcgctccgatgcaggggactagagcatgcccagccgacgcgcgttggccggctccaccgccgcggactcccagcggcgcaccgcctgttcacgctcggcttcgggggcatccgcgtagtagcccagcgtgtcgtgcagcgcgcggctcagctcctcgatggccgccagcctcacgtccaactcccggtggcgcagcgcggagacgagccagtccgcgcggcggcggctgcgattctccgcccaccacgccgaccactgacgcgggtccagtcccagcgtggcgcgcgtcacttcccgcagcgcctccgccgaggcctgggcgcacatctcgtcgtcgccgcccgtgagacggatgaggccctcaatcgcgtcgcggtcatgcagcgtgcccagggcgcgcgcggccagcgagcggcgcagcgggtctcggctgctcagctcgtggcgcaggtcgcgcagggaggcgtccagccggggcaactgcttgagcgcggcggcggccacgcgcgcggcgctggagatgtccggctccaggtcgaacagaccgcgcagcacgccgtccaccaactccacgtaggggaggttgccggcggtgagcagcgcgaagtagcgcgtgtccgcgtcctgggagtccagcagcggcgacacggcctgcgcggcggggcggcccagccgggacagcgcgccggggatgggccccagctcgtccgcctcgggcagctccaccacgggcagccggctccaggccgtggggccggggaagtgctgggccagcacccgggcgctggcctcgggcgagcgcgccagctccgccatggcgttggcgcgctgcgcggcgtccggaccggtgaggcggcgcagcagcggcgcgaagtccggcggcgggcgctcctcttgtgactgcgcgcgcggcggcagcgcggcggcgcggcccatgttgccggtggcgcctcggccgaagaaggggctccagcccaggccggcgaccaccgcgggggcaggcgcgggcgcgggggccacgggcaggtccacgtcgatggtgagctccatctcgtccggcgcgcgcagctccgacacgcgctgcttgcggaagaggatgagctcctggaaggccgccggcaggtcctggcagaacaggatgtagtcggacaggcggcgctggctgatgggccgctggccacagtcaccgtagaggatggccaccagccggcccttcacctcgaccgggtacaggaagacggtgcgcggcgtctggcgtccgaacagctccaggtagtgccgcgtgagcgcgtccgggggcagcgggcccgcgtagctgccgcgggtgacggccaccgtgcggaagacgctgctggcatccagcgggatggacacctgcgtgagctgctctcccgccatgccctcgccgcgagcctccaggcccgtggcgccgccccgtagcacggcgaaggaggcgacgtagtcgaaggtcctgcggccgaagcgcagcgccacgtcgatgaggcggtcgcggtccttggtggcttccttcagcgccgcgcgggcctgggccagcgtccagtccggcacgtcctggctcgcgggcggagccggggggcggctctccagcgaggcgggcttgggacggggcggctgcgcgttctgcgcggcgccggggttcgggaagacgaggaac

SEQ ID NO: 562 - DNA, 4800 bp, Myxococcus xanthus
cactatctgctgtgcgctctacaggcgtcttcacgggcggggatgaccgccgcacgcaccgcttcggcctcgcggcggatggctcgcccgcgggcgaccacgatacgtcccagcacggcatcgacctgctgacggaatcactcaaggccggccgtccccgccgcgaagccgaggtgcgcgaggccgccgcgctggaggagacggaggcgctggacttcctcttccaggtgctgtcctcggaaaaggacgcggaggtccggcggctcgccgtgcgcgagctggcggacaagggccgcaccgccgcgcgccccaagctgcgcgagcggctggacgactcgcacccgatggtgcgcaaggccgcgctggacgcgctcgtcgcgctggagccggagtccccgctgtccgcgccgcgcgcggcgctgggctcgcagcacccggaagtgcgcgtgttgggcctggagttgctggcgaagctgggaggcacgtccccgctggtgccgggcctcatcgccggccagctcgcggacaaccagggcgcggtcggcctggccgcgctggacgcgctcacccaggtggtgccgggcgacggcgccgagccgctgcgcaccgccttcgagcgcggcccctcccagctcaaggtggaggtgctcatccgcgccgtggcgggcgggctgcttggccacgcgcagttgcaggccctggtggcccgcgcgctggatgacgcggaccccggcgttcgccgcacggccttcaccgtgcgcgtcatggagcgccgggcgctgtcccacgcgctggagtcacgcgacgaggactttggccggggcaccaaggaagtctcccgctggctggtccagcgcgcgcgccgtgcgcagggcgtcgcgggaaatccgcccatcaccgatgcggagctccagtccgcacgcgatgcgatgcccgcgcagggcaccacgggcgcggccatcaccgagagcgacctggagccgctgctggccgccatggcctgccgcacgccggacacggccgtgcgcggcgctcgcggcctggcacaactgggtgacgcacgggcgctgggcgcgctgctccagctctcccgcgagccggacgccgccatccgccgggtggctgcctcctccctccaggcactccaggacgcgcgcgctcgcgagcgactggtgtgatgctggacgacgagaacgcggacgtgcgcgccgccgcgctggacgcggtggtggcgctggacgcggacgcgtcgctggcgtcggcggaagccgcgttgcgctcgggccacgaggacgtgcgcgtgcggggcctggaccggctggtgaagctgggcgcggcgacgccgggcgcggagccgctgctgggcgacgcgctggaggacgagtccggcaaggtgcgcggcgaggccttccgcacgctgtgggcctggaacgagaaggcgccggagaaggcgctggaccgcgcgctggcgggccgcttccccgacctgcgccaccgggcggtggaggtgctggcacagcgcgccgccgaaggctgggcgctggagcggctgaagaaggccgtggaggaccgcgacaccagcgtggccaccgccgcgtatgacgcgtgggtgaagcacgtgggcaaggagcacgcggaggcccacttggcggcgctcgccaccacgcacgcgccgctgcgggagcacgccgcgaagggcgccatccacgcccccatcgagcccctgcgctcgccgctgctcaagcgcgtccaggacgaggaagtccccgtcgccgtggccgcgctggaggcgctggacaagctgggtgcccaacgagaacggacccctgctggccgggctctccgcggcgccgctgccggtgcgcgtgcgcgcggtggagctgctggctccgcgtggcgccgaagacatcatcgagccgatgcgcgcgttcatcaccgacaaggacctggagcggctctaccctccagccttcctggtgccgctgcgcatccgcgccgcgcgggccctggcgtcactgggctcgcggcgcctgctgaccttcttcgccaccgtgctgctgccgcacgagctgggcgacctccaggagcagggcggccgcgggctcgccaccgccgctcgccggggcgacgaaggcttcctgctggacgcgctgggccacgccaacgtggcggtgcgctcctgggccgcggacggcctgtcccgcctgggtgacgtgcgcgccctgccggtgctcaccggcaacctgcgccacgaccacctccccatccggctgggcgccatcctctccttcgcggccctgggcccggagggtgacggcggcctgctgcacggcctggaggaccgcgcccgcgaggtgcaggagatggtgttcgccatcgtcctcgcccgtgatttgcgcgccagccgccggggcgagccgcccgacctgctcaccagcgccctctccagtggaaggccggaggtccgctacgccgccgcccgcgcgctggagctgcgcacggagccggactcggcgcgcgcccagttggtggaagccctgctgccgcctcggccggagaaggtggccgacatgaaggactggccggccgaagaggagcgcgtgaagtacgtcgtcgggctcgccgaggccctgtccagcctccagcccgagcagcgctacgcggcggcccaggtgctgctgctgcgcgacaagccgctggagtacttccgccacgccaagaaggtggcgcggccgagcacgctggatgcgccctggaagccggagacggcacccaccagttcgcctgtgcaggccgcacccgcgaagaactggctgcggcgcatcttctccgccgtgaagacggacgcccccgccgcctcacccgaggcctccgcccaggccgagcggcagcacctgcgccggctggccttcggtgcctacgtcggcctgctgcggcaggtgtccacgggcgacgatgagagccaccgcgtgcgtcgcgacgcggtggaccgcgtggtgaagctcacgctggagggcttcgccggcacgcccgccgccgtggccgccctgctgcgcgccctggaggaccctcaccaactggtgcgcaaggccgcgctggccgggctgaaggagctcttccccgccgggagcgatgagccgctggcgctggccctggcctcgctggcgccggacgtggcgcgcgcggcgctggatgaactggccacgcggggtgacgccgcgaagccgcgcatcaccgccgcactgaactcgccgctgacggacgtgcgccgctacgccttcgagctgctggagaagctcagcccgcccggcagcctggagccgctgctggccgcgctgagcagcgagcacgccgacctgcgcgtgggcgtcatcgagcggctggcgggcgccaacgactcgcgcgtcaccgaggcgctgggacgcgccatggccagcgagcacgaggacctgcgcctgcgcgcctcggagctgctggcgtggcgtggcgatgaccgcgcggtggaggtgctcgccacgttcctgcgcgcggagaacgcgagcgccgcgaagcgcgccacggaggccctggcccggctggccacgcccgcctcggtggccgcgctggccgcccggctgcccgcggcccaggattaccatgagcgcaagcggctggtgacggccctgggcaacacgcgccggcccgaggcgctggaggtgctggcccgccagtgccagacggacgcagagggcgtcatccgcagcgagtgtgtcaccgcggccatgacggtggccggcagcgacgtgaagaagcgcgacgtgaagctggccgtgtcgttcctgcggcaggccgtgaagagcttcgacgtcgccgtgcggctggaggccctgcggcacctggagcacggcgcggaggccggccagtcggagctgctggtcagcctcttcacggaccgcttccccaccgtgagcggcgcggccgtggaggcctacgcgaagcgcgtcatcgagcacggcgccccggcggagccgctggaggcggtgctgcgcggcggctcgcgcgacctgatgctgccggccgcggaaggcgtggccttcaagggcggcgccagcgcgctgcggcccctgatgctgtacgcccgcgcgggcgaggacggccagcgcgagcgggccctgctggccctgggcacgctgggtgacgcgcgcgccctggccgagctggagacggtggccgcgggcggcacggcggaagcgcccgtggagccgagcatggtgtcggccgccatcgagggcctgggccggctcgccgcgaagctgccggacggcgaggagcgccgccgcgtcgaggagaaggtggaggccgccgcggtggagggcgccacactggtgttgcagcaggccggcgtgaagggcctgcgcgccatcggcggggagcgcgcccgggtgaaaatcgaggcgctgctcggcgatacgagcacggcgctgctggtgcagctcaccgcggcccaggagctggggaagctcaaggacaccgcggcggagacggccctggccgccgcgctggacgcgccccagcaggagctgcgcaaggaggcgcgcaaggcgctcgacgtgctgttccccaccgagcgcacgcgggtggagttccacgcggtggccagccgctacccggacatatgcgagcccgccgtggtctacctggccaacgaaggcgacccggcgctgctggtgccctggctggccacgctagacaacgtgacgctgcggttgcgcctgcggcgcgggctcgcacgccggggctgcctgcccctgccggaagtgg

SEQ ID NO: 563 - DNA, 4282 bp, Myxococcus xanthus
ccgggttagctgcccgagcgaccagaagtccgcgatcagatgatgcgccaccaccagcagcacctgctcggtctcgcttcgtcggtacagccggagccgaagcaggggaccctgctggagctcgaacgggagcgcggcctcttcgcggagccgggcgcgcagcgtgtcgtcactccaggcggaggcgtcctcgtagcggaagccggcttctccttccgggtggacccgctggaagggcgtcccttcatgcgcatggaacgtggtgcgcaggctggggtggcgctcgacgagccggtgcaccgcgcgccggagcagtccctcgtcgagcggctccaagacgcggagcgccgcggcgatgtggtaggcggcgctgtcgggcgcgagctggtgcatgaaccacagcgcgcgctggccgtgtgacagagggaagtcacctacctccgcgctggccgggcgctcgggctgccagcgcgcaccggctgcgcgcgccgcttcgaccccagcggcgatctccgccaggttgcggctgcccagcaggcgcggcaacggcacgatgacgccccatcggagctggagccggtgctggagctccacgctcgacagcgagtccaggaccagttcctccaggcccgccgtggcggcaactggcaacgacagaacctgggagacctcctccgcgacttcgcgccacagcggcgagtcctcgatgccgggcggcgcgttctctgccgcggtgaggggccctgtccttgccgtgtccagtgtggcgtgtgccaggacctgcaactcgcccgcgaggaacgccgcgcggcacgcatgtcgttgaatcttcccgctcgacgtcttgggtaccgagccgggttcgatcaggaccaccgaggacgccatcagctcgtgctgctcggccaccgttctgcgaatcgcgctgatgacttcgtcgaggccgctttccgcgcgctgcgcgttggcctcgtaaacgaccacgagctgctcggtgccatccgcttccacggagaatgccgcgccagagccggggcgcaccgccgggtggcatttctcgaccgtgaactcgatgtcttgggggaagtggttgagcccgcggatgatgatgaggtcctttgcgcgcccggtgacgaagagctcaccgtcgcggaggaacccaaggtcacccgtgcggagaaacgggccctcgcccgtgccgcgcagccgggcctggaaggtccgcgtggtggcctcgggttggccccaatagccaccggccacgctcgaacccgagacccagatttcgccaatctccccatcgcgccggagctcgaaggtctccggatccacgacagccaacctgccgtcgatcacattccgcccggagcccaccaacgggtgtgccgcggcgtgcccggcctccaccgggatggcctggccccgctggagcgcctgtccgtcgaaggacgcgacgtggggggcttgccccacctcggagcccgagacgatcagtgtcgcctcagcgagcccgtagcagggatagaacatctcgcggcggaacccgaccgggccgaacgcatgggtgaagcgatcgagggtctcgggacggatgggctcggcaccgttgaaggccacgcgccaactgctcaaatccagaccctcgcgctgctccggacggatctttcgtgcgcacagcgtatacgcgaagtcgggtcctccgctggtggtgccgcggtaccgggagatggcttgcagccagcgcaggggctgctggaggaagtccatcggtgacatgagcacggccgggtagcccgtgtagagcggctggaggattccgccgatgagccccatgtcatggtagggcggcagccagatgatggcccggcttgtctggtcctgccggaagcaccgccggatcgcctccaggttgtgcaagagattgcggtgggtgagcgttactcccttgggcaggctggtcgagccggaggtgtactggaggaaggcgagtgagtcgccggagagcggcggcggagtccacgcatccgaggcgcgatcgtcgacttcatccgtgacgatccagcgcagttgagccagctcgggggcgattggatagaactggcggagcagctccaggtgttcgctccggatgaggccggcggtggcctgggcgtcggtggcgatcgcctggagccgtaggagcgagcggtcgtgccgtggcgggtacacggggaccgccaccatcccagcgtagagacagccgaagaacgcggcgatgtactccacccctggcacatagaggagcaggatgcgggtgcccggcggcagctccgccaaccgggccgcgatggcccgggcgcgacgatccagcgcggcgtatgtctgccggtcttcctgcgtctcgccatcaaccaggaaggtgtagaggccgaagtccggcgcttgttgagctcgctcgcgcagaagctccaccagcgtgagcgcgtgggcaggatgatcgctgtgatggctcatttggcgtgggcattctatgcccagtttggagcccgccgcatcctggagcggagcgggcggtgggtttgccacagagcgtctggagaggagtttcgcgctgcggtaaagtctttgctctcccgtctccgcgtgggtgccttttgaggatctgtctcatcgcgcttccctggtctctgtaccgccatccatcggctgccctgggcgcgctgtgcgcctacctgaagcaggaggagcccactctcgaggtggtgtgccggtctgactttctcgacgcggcggccgcgctcggcttcggctgttacgaccggatctcgcaggcctcttacgacgtcggcgaaatgttgtacgcagcgctgtgttttccggagaggaaggagcaggtgcgcaccttcttcatctcgcggatggaggagtcaggtgcgccgctcacgggagcgggcagcttcctcgacccggagatccacggcgagcgccctacctggtcgagcgcgttcgacgtcatccaggcccgcttggaggcgcacctggaccgcgtggcggaagaggtggccggacgctaccaactcgtcggtttgacgacttgcttcggacagctcttcgcgaacctggcgctcagcatgcggatcaagcggcgctccaccggaacgaggattgtgctcggaggttcgacggtctccgagcgcgtcggtccctcactcttgaaggagctcgactgcttcgactacgtcatccaaggcgagggcgagcagccgctgctggcattggcgcgcggactggccgcggcagaggacgtcagcggcctgaaggggctcatcacgcgagagaccgccagcgtcctgcctcgcggcgcgcccttctgggaggtatccgacgtcaacaacctgcccatccctgattacagcgagtacgcgacccgggcggaggcgctcaacttcctctggctgatgacggtggaaggctcccggggctgttggtgggatcgggcgaagcggaccggcaaccccaaggcgacgtgtcacttctgcaacctgaacgtgcaatggagtggctaccgcgagaagggggccgagcggctcgtctcggaggtggtggccctcaacgagcgctaccacaacaacgttcttttcttcctagacaacatcatccggctcaagggcgtggatgagttcgcgcaacggctcatcgataccggcaaggactgggtcatcttctatgagatgcgtgccaacatccgtccccacgagctgttgatgttgtggcaggccggtgtccggttcgtccagttcggcatcgagagtctctccgagtcgtatttgaagcggatcggcaaggggacgtcggtcatcaccaacctgcaggtgatgaagatttgccatgagctgggaatctcgaacggcgcgaatctcctcaccgacttccctggcgggcggccagaggaagtggcggagacctgcgagaccatccagcggtacgcgcttggctacgagccactctcggccaaccgtttctggctcggacgcggagccaccgtccaggtgttgagccaggagtatggggttcgcaacctgcgcaatgccgacttctaccgggccgggttgcccgaggcgctctacgagcggctggacctgctcgatctgtcgtacgaccaggacggacccgtggctgactggagccacgtccgcgcgctctgcaagcagtggggggccgcttactccgccgcccgcgccagcgagtaccggcacctgctgacgtacctcgatagcgggcagtccatgcgcatcttcgatgc

SEQ ID NO: 564 - DNA, 3434 bp, Myxococcus xanthus
gctggaggacctggagaccgcgtactcgcagctggagcgaggcgctccggtgtcactgcctccgaagacgacgtccttcaaggcgtgggcggagcggctgttgtcgcatgctcggacggatgaggtggcgcgcgagctgccgctctggaaggcctcgcgtgacgtcacttcgctccctgtggacctgccaggcggcgaggacaccgcgggctcggaagcgctggtgacggtgacgctgggtgtggacgaaacgaagccgctggtgggcgaagtgcccctggcataccgggcgcgcgtggatgaggtgctgctcacggcggtggcacgcgcggtgtcccgctggacgggaagccgcaacgtgcggctggagctggagggacacgggcgcgaggccctcttcggtgacgtggacctgtctcgcaccgtgggctggttcaccagcaccttcccgctggaggtggagttgccggaggcgggaagtccaggagacgcgctccggacgctgcgggatgcgcggcgactgttgccggtgaatggcatgggctacggcttgctgcgctacctgcgcgaagacacggcccagacgctgcgcgccgcgccgcgcgcggaggtggggttcaactacctggggcagctcgacgcggcggctcggggggcggagcgcttcctcctcacggaggaaccaagcggcgcgtggcatggcgcgggaggccgccggccgcaccgtctcgaggtgaatgccgtggtgtccgaaggccggctgaaggtggcctgggcctacagcacgcgcgtccaccagcgggcgacaatcgaagccgtggctgacgacttcctgtcatcgctgcgcgagctgatggagggccggagtacgccggacgcggcgcgccgttcgcctggggactttccgctcgcgcgcctctcgtcctcctccctggatcgcttgctacggcagttcccggccgtggaggacctgtacccgctcacgtcgcttcagcagggcatgctgttccatgtcgcgcttgcgccccaaggctcgggtgtcttccatgagcaactggcgtggacgtcacgcgggaacgtggatgtcgccgcgctgcgacgggcgtgggcggtggtcatcgctcgcaacgccgtcctgcgaacgtccttcatccacgagggactgccggagccgctccaggtggtccatgccaaggcggacctgccctggacggagcacgacctgcgcggtgttcccgccgaggagcagcgcgctcggcttgaggcgctggtccgtgaggaccgtgcccgtggcttcaacctggcgcccgcgcctctggcccggatggaggtggtccgcctggccgagcaggagtaccgcttcctctggagccaccaccatctggtgatggacgggtggggcgtgggcgtgatgttgcaggaggtcttcgcctgctacgcggcgctgacgcaggggcgcgacgctgccttgcctcgccccgcggcctggcgcgactacatgtcctggttgcagcggcaggacttgtctcgtgccgaggcgttctggcgggaggaactcgcgggcttcaccacacccacgccgctccccggcgcccggaccgccgcgcccgggatggaggccgccgtcacgggtgaggagattctgtggctgtcgcaagaagccacggccgcgcttcaggccttcgcacggcgcaacgcggtgacgctcaacacgctgacgcagggcgcgtgggcgctgctcctcgggcgccatgcgggccaggaggacgtcgtcttcggcgccacagtctccgggcgtcccgtggacctgccagacgccgagtccatggtgggcctgttcatcaactcgctgcccatccgcgtggggctgtcctccaacgcgctggtggtgccctggctgcagaagctccaggcacggcagctggagatgcggaagtacgagcacagtccgctggtccaggtgaagggctggagcgacatgcctcggggcctgccgcttttcgagagcctgctcatcttcgagaactatccgctcgacacctcgctgggacagggcgtgccggggctggaggtggtggacgtggagagccgtgagcagggcaaccacccgctcattgcctatgtggttcccggtgacaggctgcgcttgagcctggcctacgctcccgagctgcatggctcggacgtggtggccgagttgctggagcactggcgcatcctgctggaggcactggcctctggcgtggagcggctcgccgacgtggcgttgccgggagacgccgagcggcttcaggccatggccaaggcgcaggtgggatccatggggcacgccgcggagtacgtcgccccctcgacaccggaggagctggcgctggcggggatctggacggagctgctcggccggccgcgcgttggcgctcgggacgacttcttcgccttgggcggacacgccgggatggccgcgcggattgtggcgcgcgtgcgtgaagcgttgggcgtggagctgccgctgccggcggtgttcgagtcgcccacgctcgctggcatggcggaagtggtgtcccggatggcgggctcgatgaagcagctcgcggatgacgccatcgcaccggcgtcgaggtcgctggacccggccgcgttggaccaactgtcggacgaggaactggacgcgctgctggacgcgaccgaggtggagagctgagccatggggaatgagacggacaagaagcccacgctcacgcgcgaggagaagctcgcgctgctcgcgaagcggttggagaagaagccccggcctgcgttgccgctgacgttctcccagcaacgggtctggttcctggtgcagcgcgcacccgggctgcctgcctaccacctgccgctggtcctggagctgtccggccgcctggacgaggccgtgctggagcggagtttccaggaagtggcgcggcgccacgagtcgctgcgcacgcacttcggcgaggtctccggcacaccggtgcagttcgtcgatccccaagcacgcctgccgttcacggtggaaggactggaagatgtccccgaagcggcgcgcgaagccgccgtgcggcagcgcatccagcttgagctggaaacaccgatcgacctgtcccgcggcccactggctcgcggggtgttgatgcgcgtggctcctgagcgccatgtgcttctggtggtggagcaccacctcatctccgaccatgagtccatgggcgtgctcacccaccagatggcggcgctctatgacgacttccaccagggccagccgtccgcgctgtctgccatgccgttccaaaatggggactacacgtcctgccagaagcgcaagcttcgaggcgacgagctccattcccacctggagacctcgcgcaagcgactggagggcgcaccgtataaaccgcacctgataactgatcccccgc

SEQ ID NO: 565 - DNA, 3863 bp, Myxococcus xanthus
cgaagcgcgactgcaacagcatcatcaccggcgccatcagcgtggccagcacgctctccagcaccactctcagcatcagccgcacccggccgcccatgagcgccgagtcctgggaactggccagcgccagcagcagcccgaagcacttgggcgcgaacagcatggccatggacacggagaacagccgcacggcgcccgtggtgtcgaacgccagcgcctccgggcccaggtcctccagcaggtgcgggttggagaaggacagccacccgtcgtagaggccggcaatcagtccggacatcaggaacagcagccacagcggggacgccgcgtaggacatcacgcccatcaggaagtggccccggctgatggggtgcaggccgcccgcggccaccaggctcaggtgctggaggttgccctggcaccagcggcggtctctctgtgcgtagtccagcaggctggggggcggctgctcgaagctgccgcccagctccgtcaccagccacacggtgtagccggcgcggcgcatcagcgcggcctccacgaagtcgtggctgaggatgtggccaccgaagggctgctgaccggggagcaccggcagaccgcagtgctggatgaaggcctccgtgcggatgatggcgttgtgaccccagtagttggactcgcccaactgccacgccgccgcgcccgcggccaccaccgggccgtagacgcgcccggcgaactgctgcagccgggcgaagagggtgctgcggcccacgttcagcggcggcgcctggaggatgcccgcgcgcgggttgagctccatcagccgcgccattgtcaccagcgtgcggccgtccatcaggctgtcggcgtccagcacgatggtgaagtcgtagtgccggccccagcgctcgcagaagtcctggaggttgccggccttcttgccggtgttgtccgtgcggcgccggtagaagatgcgtccctggccacccacgcggcggcacaggtcggcccaggcgagttcctcggcgatccacgcctccgggcgggtagagtcgctgaggatgtagaagtcgaaggcgtccaactgcccggtggcctccacggactcgtaggtggcctgcacgttggcgaagacggaggccgggtcctcgttgtggaccggcatcaccaccgacgtgcgcgaggtgagccgcgtggcggactcctcctccgtgggccagcgcaggccgggcagccgcttgctcacggcgagttggaggaaccccgccaccgccgtccagaaggacagcgcaatccacccgaagcacagggcgaagagcaccagcagcacgccttcggggacggtggtgccgcgcgcgctcagcaggcggtgcatctcccaggtgcccacgagggtggacacggcggcccagccccaggacgaagaggcgccggatgccggcgctctccggtgagaacgaatgagcgtgcatggcggaacctcgcgaggagtctcccggagcaggaggctgcgtcagcgggagacggacatgtccggctgtccggcgcgcagccagcggcgcaggcgctcacccagcggccacagcacgagctgctgctccggcatctgcgtggcaacctgcgctggcgtcggcaccggcaccgcggcgcgcagggcgcggtagagctcgcgcggcaccgcgtcccgggtgagcacggaggcgccgaagcgcgcgccgtcgctgaggacgaaggcggcgcggccacgggtcagcaaccggccctcgcccacgacgtccatgtccagcacgcgcgtcagccacgtctccatgcgggcacgggccagggccacggcggcctgcggcttcacgttggacgcggtgacaccctccagcgcccaggcggccagcacggccaggtcctcggcggattcgaagccgaagccctggaagaaggcgtcgagcgccacgcacgtctccggacggacccagtcggtcggcacggaggggctggtgttcggcgtcgtcacggaatccatagatagctccaggtctcggtgagggtctccgaaccgcgccgcaggaacgcgcgcagctcgatgggttcactggtgccctcgggctccagctcgaaggtggtgcgccaacccccgcaaggttcgtggcgctggatggtggagcgcagcacctggcccttggccgcggtgatgacggcttccaccggcccgtcctcggcgcgggcggtgcgagagaagtcgaggatgaatcggcgcgtggccggcgtgacgccttcgcccacgggcatgcccggggtgatggcggaggtgatgcgcgtcgaggtgacgacgccgccggtgctctcccagggcgacctggcgccccagtgcaggcggtaggccacgcgcagcggcgtgcccggggtgagcggcgcgtccggtacccagaaggcgacgatgttgtcgtgcgtctcgtccggcgtcggaatctccaccagccgcaccgcgcccgcgccccattcgcccacgggctccacccacgcgctggggcggcgctcgtagtgggcctccaggtcctcgtagttgtggaaggccgtatcgcgctgcaacagaccgaaggcgcgcggagtctccgcgcggaagctggaggtgcgcacctgccgcgggttctgcagcgggcgccacagttgctcgccgtccttggtccagacgaggaggccgtccgagtcgtggacctccggccggaagtcgtcgaacttcgcgcggtcgttctcaccgaacaggtacatgctggtgagcggcgccacgcccaggttgtcgatggtgcggcgcgagaagagggtggcctgcacctccatcaccgtgttcgagcccggggtgatggtgaagcggtacgccccggtgatgctcgggccgtccatcagcgcgtgaaccaccacctggcccgcgccggaggccgggcgctccagccagaactctcgaaactccgggaactcctcggggctcggctgcgcggtgtcgatggcgatgccacgcgcggagaggccgtagaggttgccctggcccagcgagcggaagtagctggcgccctggaacaccgcgagctcgtcgaagatgtccgggcggttgagcgggtggtggaagcgcaggcccgcgaagccgtccacgccgctgcgaggcagggacgccttgttgacgaccttgccgtagctgaagaggtcctgggagaagcgcagcggctgcgagcggcccgcctccacgacgttcatcaccactggggactggaacaggaagcccgggtggaagaactgcacctggaagggcaggcccgcgtctcgccagtgcgcgcgctccggacggaagcggatgtcgcggtactggtcgtagttgagctgcgtgtacgccttcggcagtgacttcggcggcgcctggtagggccgggccgccagcgcccgcgcgcgctccaccaccgtctccgtggagaaggccgtcgtgcccttcgtggccgcggtctgggccttggccggcggagccgccacggcggcgccgctcgacgccaccgccatggcacacagccacggcgcacccagcttcaacgctttctgccgcaacgacgtcacgtccgagcgcctccgaaggagaggtttcgccgaacggctccggtgtcccggacctcgcccgaccgcacgctccgcgtggactcgcggtgcggcgcgtcagtgcttcagcaacccgcgtaccagccccgcaggcccgaattcgctgtcagaaaaatgctgtgattccagtgggttggggcgatgcgtcactgggaagtcacgaaaagcacactctgcgcatgcctcccgtggacggtttcctgcccagcggtcgggggcggtggggaggataggggcagggggag

SEQ ID NO: 566 - DNA, 3279 bp, Myxococcus xanthus
catgtcgcggaagaggcgggcgatgtccgccaggtagcccaggcggttgcggtccaccagcaggcggagggtgttggccagcgtggcctccacgccgccggggatggcctgcatcaccgactccaccacccgcaggcgttgctcacgggtgtaggcggggttgacgagcacatccgtcagctcggcgttcttcgcgatgacgtcggcgaaggcggtgagctgctcggcgacggcgtcagtgcggcccgcctccgaagcgacatcgaggagggcgcgggcgtagcggcgggcgatcgacacgttcaccatggcggtcgcgcccttagcacggggatttcccccgagcaacgtccctggcatcgcgaagccctgtcaccgggggcactcttgctggcccgggccgtggcatggggaagcgctgcttattggcaggcaggtgagggaagagggcttggcgagctggcgcgaacacccgtagggtggtgtcctctcggccccccatgcatgacctcgtcatcggcatcgacctgggtactaccaacagcgccgtggcgaccgtggaagacggacgcccgcgcatgattcccccgcgcgcgggtggccggttgacgccgtccacgctgggcgtgaacaaagctggcgagcgcgtggtgggcgtcgcggcacaatccctgggcgaggagcacccggactccgtggtgtgggccaccaagcgtttcctggggcgccgctacacgccggagctggttcaggaggcgaaggcgctggtgccgtatccgctggtggccgggccctctggcgacgtgcgcgtgcggctcgccgggcgggtgatgcccgtcacgcaggtgtccgcgatgattctgggcgagctggccctggacgcgcaggcgcacttcggccgccccgttaccaagtgtgtcatcacggttccggccaacttcgacgacaaccagcggcaggccacgcgcgaggcggccagcatcgccgggctggacgtggtgcggctggtgaacgagcccaccgccgcggcgctggcgtatggcctgtcacgcggcttcgaaggcaacgcgctggtgttcgacctgggcggtggcaccttcgatgtgtccatcctcgaggtgaagtccggtgtcttcgaggtgcgcgccaccggcggcgatccgcggctgggtggcgaggacttcgaccagcgcatcgtccagtggctcctggcgcaggtggacgatgagctgcggcacgtggtgtcgcaggacgcgcagagcctgcgccggctgaaggtggccgccgagtccgccaagcgcgagctcaccgagaaggaagaggcgtccatctacgtcgccgggttgggcgaccactcggcgcccggcaagcggatggcggagctggagacggtgctgacgcgctccttcttcgaaacgctgtccgagccgctgtcgcgccgctgcctcgatgtctgcgagtcggtgatgcgcgaggcgaagatggacccccacgcggtggacgtggtgctgctggtgggcggcatgacgcgcgtgccgctggtgcggcggttggtggcggactttttcggccgcgcgccctccacggacgtgcacccggaggaggccgtcgcgctgggcgctgcggtgcaggccgacgagctcgtccgccagtccggtcaggcgctgctgctggacgtcgccgcccagagcctgggcgtgggcgtcatgggtgggcgcgtgaagcggctcatcccgaagaacaccggcgtgccggtggtggcgcgggacatcttctatccgggcagctccggccagcaggaagcgcgcatccccgtgtatcagggcgagagcgagttccaggacgagaactacaagctgggcgaggtggtgctgaagcgcctccacgtcgccgcgcgcggagaggtgccgctggaggtcgtcttcgagctgtccagcgaggccatcctgtccgtcaaggccacggacctgacctcgggcaacatggaggccgtgcggctggaggcccgtgcggggctgccgcagggcgaggcggagaagctgggcgcggagcaggcccactacgcgcgctcgcagggcgtggtggacgcgaagcgcgcggaggagctgttccgcaagctgctggagcgcggggagaagctggcgcggttgctccagcgcagcgcgcaggagaaccccagcccggaggcgcaggccaccctgggcacggtgcagcgtctgttggatggtggccgctctgccctcgacagcggcaacgcggcgcagtgcgccaccattgccaagcagctcacgcggttgttgtccggtcgccaggagcctcgcgcctgagcgtccatccccgaacgatggccccgggcgccggtggccttggcacccctttccacctatccgtgaacgtatgagccctcctcccaacgcgcgtgacaccgtgttcgtggtggatgactcccgtaccgcccgggaggtggtgcgcctgcacctgacacggctgggctgcgaggcggtggcgctggagggcggcgaggcgtgcatggccgagctggcccggcgcaccccggcgctcatcctgttggacctgcgcatggagcgcatgcagggggacgaggtgtgccggctggtgaaggcacacgccgcggggcgcaacgtgcccgtcatcatgttcacctccggcggcgagccccacgaggtgatgcactgctggcgcgcgggcgccgacgacttcctgcccaagccggtggcgctgggcgccctggaggcgaagctggccgcggtgcgccaggcccgggagcgtgtccgcgagggcccgccgcgtgggcgccgggtgctgctggtggagggcggccgtttcctgcacaccttcctgggcggctcgttggagcaggagggcctccacgtcctctacgcccgggacatgggggacgcggcgaacctggcggcggagcacggcgcgcagttggatggcttcgtggtggacgtgtcgcgcacgccgcgcgaggcgctggccctggccacgaagctccacgacgcgcacccgcgcaagccgctggtgctgctgtcgcgcgcggaggagtcgcaggaggtgctcgcccgggcgcaggcgctgggtggcgcgccgctcctggagaagcgtcacatgggtgcggacgagctgctcggctgcgttctggggcgactggttccgggccacgccccgctgcgcgccgcggagcgcgtgcccttcttcacggtggtggagttcaccacgcccaacggggcaacgctgtcgggcttcagccatgac

SEQ ID NO: 567 - DNA, 4048 bp, Myxococcus xanthus
ctaagcgggaaaccgacctcaagaccaggtatcccgggcgcaagcccctgaagacccgtcgaagactacgacgttgataggccgggtgtgtaagcgtggtaacacgttcagctaaccggtactaattggtcgtgaggcttactttccccattctcttgcatgccccctcaaggggagtaagggactcggggccaaggccgaggctcgagtgcttctttgcactcgcctggaagactcacactgcgcacagcgagacttcgctcagcaatgaattgaaacttaccctttgtatgcactgtcgcttgttttccggtggctatgtcggaggggtcccacccgttcccatcccgaacacggaagttaagccctccagagccgatggtacttcgcgggaaaccgcgcgggagagtaggtcgctgccggattctttttgagaaacccccggtgtcccttgtggacaccgggggttttccgttttggggcatgtggagtttccgcgcgtcaccgcgggcgttgggccaggcgccgcgtgcgcagccggcgcacgccccccaccgccagtagggcggccgtggtggccagcaccagcaggtgctcggctcgcgccgccctccttggccccttgcgcccttccttcctcgcaactggcccccgtccctctcatgcgtttcacagcgactcatccgtcgagtcggagacgcggagcgttcccccctggcggaggcagagctgaaggaaaaagaggcgaacccagcgcgtccggagcgctgaggcatggcgcctacccgtcccacagcaggaagtcgcgcagccgcatcccttgcaccgcggccatgatgaacaccgccccgcgcagcaccgagagaaagcgccccgcgaagacgcagcgcccgccgtggcgcgcgtagacctgggccagtcgctcgcggcgttccggcgacaggagctcttcatccgtagatgcgcgtacagcgcgggccccaaccttcgggcggtgagggagtcatgcgcttcttcaatcgtggctgttcgtgcaacgcgagccccaatcttcgggcggtgagcaagcgtcgtgtgcctccgcggagcacgccggccatcgcgcctaccagcgccaagccctggggaagggcatgctggtgcgcgcggatgcttggcgacattcgcggcagtttcgctagcgggcagatcctctggtttgcactcccgctggttggcattgggggcgccagttgatgtcgccgtgccccattcggtccagggcgtgtgctgcccggggacgcctggtgaatctcagccactctctcttctcaatgacgagggctgctcatgaaggtgcggcgcttctcaggagggtgattggggcgctgagtgtcgacggtcctccattcgtcgcccctgcgttgggtggcttggagtgcgaagcccgtgtgcactccttgggcttggctctggttccagaggcctcggtggcaaatgcgtcggacgcgtcgccggctgccgggctacccgtgcgcgggaaatggaggcgcctcgtgggcccggtgaaaactcagccgggagaccttcgagttcggcgacgccaggtggcaggttcgcccggtcccactggcgccgaagcatggatcattccgctcgggtgccccaggcagggggcgctctgacctgctaatacaggtgacatgcgcctacctgcgaccgcgctccaacagacctctgagcccccctctgcacgcctgccgccgcgcgtcgtggcacatgacatttccgtggcgaggtccggatggtgctcggagggctcaaactaccggattcgttggggtttcaggctgctgtgcatgtttgactcgccgtccgcgctgcgactagagtccaggtttccgcccggtctgcgcaccgcctgtcgcggtgcgcgcctcccggtgccgggccgctccacgagatgaagaagccgaccctctttgggaagtacctgctcctcgagcgcatcaacgtcggcggcatggcggaggtgttcatcgcgaaggccttcggcgtcgagggcttcgagcgcatcctggccatcaagaagatcctccccacgatggcggaggacgaagagttcatcacgatgttcatcgacgaggcgcggatcagcgttcagctgaaccacgccaacgtcgtgcacatcaacgaactcgggaagtacgacgacacctacttcatcgccatggagtacgtcgccgggcgcgacgtccggaccatgttggagcgctaccggcgtcgtaaggagatcatgcccaccgcccaagcggtgttcatcgcctccaagatctgcgacggcctggactacgcgcaccggaagaaggacgcccgcgggcaggacctccacatcatccaccgtgacgtgtcgccccagaacatcctcatttcctatgagggtgaggtcaaggtcatcgacttcgggtatcgcgaaggcggcgaaccgttcgcagaagacgcaggcgggcatcctcaagggcaagttcgggtacatgagcccggagcaggtccggggtatgcccatcgaccggcgcagcgacatcttcgccgtgggcgtgctgctgtacgagatgctcacgggcgagaagctcttcgtcggcgagtcggacttctccaccctggagaaggtgcgcaacgcggaggttccgctccccagcgagttcaacccgagcatcccgcagggcctggagaaggtggtcctcaaggcactcactcgcgaacccgaggaccgctaccagtgggcgtccgacatggccgaggacctgatgcggttcctcctggccggtgacgccatctactcgtccaagcacctctccagttacatgaaggaggcgttcgccgaggacatgctccgcgaggcggagaagatggagcgctatgccggtatcgagcgccccgaccagattgaggcctcgggcatcacggtggctcccgggttcaatcggcaggcggcgcggcgtgcgccccctcctgccgtggtggtgacgggaacacccgcgggccgtgcgtccacctcaccggcgcagcctgtccaggactacatcccgcctcccaccgccgaggaactcgaggagatgggcgttggcgcgggcgacaagacgcagattgtcgactcctcgcatacgttcatgtctcccgaaacccgcgttgccgacagcagcgtcgtggtggacgacagcatcacgggccggacggagaaccccatccaggaccatgggacgtccggttcctacaactccttgcgcgcccccgcgcccgatacgtcctcgcgcaggggcaagagtggccccaaggcgcaggtcgtcatcagcaacgaggaaggcgaggcctactccggcgccacgatgattggccccgcgccgtccgcgccgccgacgcgctcgcgcggctcgtctccctcgctggacgaagagacgggcagcaggccagcgcccgtgtcgggccgcggccggagcggaaagcgcgctcccgagcccgaagaggatccgtctgactacgagcagccgcccgaggacgacagcagcgccggctacgacgcccaggacgactacggtgacgaaggtcatccgcacgacgacctgaacgagcccgaggaagaggtgacgggctcggttcccctccccccggaggaggcgcctccacctgcgaaggtcgctgcgcccgcgaaggcgaaggcgaagacgaaggtccccgccaaggggaagcccgcgctcaacctcaagacgctgccgaagccggtgctgttcgccgccgccgcggccatcgtgctgttgctcgtcgtcggcgtggtgatggccaccaggccgtccacgggcgaggtcaccttcatggtgtccccgtccaacccttccgcgcgcatccagctgaatggccaggaggtccagctcaacacgctgctggcactcccggcagggcagtaccgggtcacccgcgaacgctccgggtcagcaaagcgcgggccaagacggtgggatgtcgtcgccgggaagcagggatcgtcgtttcggcttccgctgggaaagctgat

SEQ ID NO: 568 - DNA, 3897 bp, Myxococcus xanthus
tcaccatctttggccaggcgattccggaggacggtgccacgccgctgcacctggcgctgcgggcggcggcccatgcggagccggtgctggaggcgccggccccgcgcgtcgccgcgcccgaggggttggacgttcgcgtgagtctcgcggagggctggacgcgggtggtggccaacgacgtgtcggtggatggcttcttcgccgcgtgggagggcgcgctgccgccgctggccgcgcgcctgggcgtggagctgtccttcgcggggcgcaccgtgacgtgcgagggcgacgtcgtccgccatgtcacgggagacgaggcccggacctggggcgtggccgcgggcgcgttcatccacttcgctgagcccgcaccggcgctgtgccagtgggtggcgtggatgctggaggaggggcgccggccggagccgcgtcccgatggggagctggcgcggctgctcgcccgggccgcggaggccgcgaaggacccttatgtcctgctgggcgcgcggcccgacgccgacttcgaggagattcgccgccgggccagcgccgccctgcgccggctggagggcttccgcgtccgtccgctgccgtccgggcagcgccgcgcgctggaggcgctgcgggggcgggtggagtccgcccgccgcaccctgcgcgagccgctcacccgcgccggcttcgacgccgttcggggcaccctgccggggctggcccgctgcgtggaagcagggctgccggacgaggaggtggagcccctgcgccacgccttcctgtcggcccggccgggctcggaggcccaggcccgggcgctcttcacccagggacacgcgctggaggtgcagcgggccctgcgcgccgccctctctcgctatgcgagcgcgctggcgttggatccactcaacgtgtcgtggctgcggcactaccaggagctgcgccagcgggcacaggggctgacgccttccatgcccctcgtgcttcacgaggggaccatggcccctgcggccctgcttccgtagcgcgggggctttttccggccccttggccctccaacgggccagggacgcactcgggtcgggtgcccccctggcccgcgctcgtgtagagtccgccgccctctgccatgccctccgtcgtcacgggggcggggacaccttcatgaacgcgcacatcttccgcgaatacgatatccgaggcttggtcgataaggacctcaccaccgaggtggtggagctgctgggcaagggcctgggcaccatcatccgtcgccagggcgggcgctccatcgcggtgggccgcgactgccgcgagtcctccacccgcttccgggacgcgctctgcgcgggcctcacctccacgggcctcaatgtgttcgacgtgggcgtggtccccacgccgctgacgtacttcgccgccaacaccctgccggtggacggcctggcgatgattaccggcagccacaacccgcccgagtacaacggcttcaagattggcgcggggaagacgaccttccacagccacgagattcaagccctgcgcaagctcatcgaagcgcgggacttcgaggtgtctcccaagccgggcaccgtgacgccgtacgacatcatcacgccctacaaccacttcgtccgccagacggtgaaggtgggccgcaaggggatgcgcatcgtcatcgacgccggcaacggcacgggcggcgccatcgcggtgccgctgttcgagagcatgggcttcgacgtggtgcccctgttctgtgagatggacgcgacgttccccaaccaccacccggacccgacggtggtggagaacctggaggacctcatcgcggcggtgaagcgcgagaaggccgaggtgggcatcgcctacgacggcgacagcgaccgcatcggcgtcatcgacgaccagggcaacatcctctggggcgaccagttgatggtgctcttcagccgctacgtgctgaaggagagcccgggcgcggccatcgtcggcgaggtgaagtgcagctacacgctgtacgacgacatcgcgaagcgcggcggcaagcccatcatgtggaaggccgggcactcgctcatcaagtcgaagatgaaggagacgcaggcggagctggcaggagagatgagcggccacatcttcttcaagaaccgctacttcggcttcgacgatgccatctactccaccgcgcgcctgctggagattctcacgcacgagaaggcgaccatgtcggagctcctgtccgacgtgccgaagacgtacgccagcccggagctgcgcttcgacacgaaggaagagaagaagttcgagatggtgaagcgcgccacggagacgctgcgcgacgcgggccacgacatcatcgacgtggacggcgtgcgcgtgacgttccccgacggctggggcctcatccgtgcctccaacacgcagcccatcctggtgctgcgcttcgaggccaacacgcccgagcgcctcaaggaaatccaggccctcatcgagggcaccgtggagaaggtcaaggtcgaggtcgggggctgatatgacgacgccgcgcatcctcgccatcagtggcagcctccggacggggagcttcaaccgtcagctcctggccattgccgttgcccacgcccgctcgctgggcgcggaggtggacgtggtggacctcaagacgctggagctccccctctacgacggcgacgtggaggccaaggccctgcccgctcccgtggaggagctgcgcgagcggctgggcaaggcccagggcctgctcatcgccagcccggagtacaactcttccattccgggcggcctgaagaacgccatcgactgggtgtcccgcccgcccggcaggctcttccaggagaagtgggtggcgatgatgggcgccacgcccggcgtcttcggcaccgcgcgcatgcagccgcacctgcggcaggtgatggcctccgtgggggcgcacgtgctgcccacgcaggtgcacatggcccgcgtgtcggatgccttcactccggacgggaaactcaaggacgaggcgcgccagaaggaagtggaagggctggcggccgcgttggtttccaagctgaagccctgagaggacgcgctcatgccaacgctcggaatcgacctgggggggaccttcgcccgcgccgccgtggtggacgaggttggcaaactgatcgcctcctcgaaggtggctttggtggagcgcagtccctcgggggtcgtggagaccattgcccaggcggcctcggacgcggtgatggccgccggtgtgccgctgggcgcgtgcggtgtggcggccgccgggcagattcacaaggactcgggcgtgctgtcggtggctcccaatctgggctggcgcaacgtgccgctgggcgcgctgctcacggaccggctgggccagccggtgcgcgtggtgaatgacctggccgcggcggcctggggcgaactccacgccggcgcgggtcggggctcccaggacatgctggtggtgttcgtgggctcgggtgtggggagcgccatcatcgcgggcggacggctcgtagatggcggtggcggtgtggcgggcgagttgggccacatcaaggtggttcccggcgggcgccgctgcggctgtggtgagctggggtgtctggaggcctacgccggtggccacaacctcatcgcgcagacgcgggagttgctcgccagcggtggtgcgccggaggtggcgcggctgacgggcggagacccggcgcgcatcaccccggtgacgttggagcaggcggcggaggcgggcgacgtggcggccggtgaagtctacgcgcgggcggcgcagttcctggccctggccgtggccaaccaggtgacgatgctcaacccggcgcggctggtgctgggtggcggcgtgctgagacactgccgtag

SEQ ID NO: 569 - DNA, 4407 bp, Myxococcus xanthus
ctcccccaaccggtcagggaaggacaccgcggtgcggcccgtgggcgcatccgagacccgcctcaacacccgctgttcgatcaatgtttcgagcaggtcccggatcttgtcccaggaatggggcgcgccgtccgaccacgccatggcatcggaggcttgaaattgctcgacctggagcagcttctcgcccaggggcgcgatgtccggctcgtcgaagatgagctccacctcgccatagaagaggtgcaggacctgctggccatttcccgcgtcgagccggtcgtgcgtgagccgccttcgattgggaatgtagagcatctcatccgcttgcagctgtgccatggcttctcactcccgcttcagtgtgacgtcgcgcgaccaggtgccgccgagcgagcgatagacctcgacgcgatggttgagcagcagccgttgcgcttgcagacttgcgcgctcaagcccgaccagattcgtcagggcggtgagcaccgtcagatagtccgaatgcccctgctcgaagagccgcctcgcctcgtccaggagctgctgcccgagctggacctgcgcacgcaggctgcgcaggctcgtcgcctcgttctcctcccgaaccacggcatcctgcacccgtccgatcgcggtgtgcagcgcgagctggtattggatttcgcgacgctggagctggatcggcagtcgcatgtactcggtgacgcgccttccatcgaacagggcccaggtcaggttcaccccgacgacggactcggccagggccggctccgagaggccgaccttcaaagcgcccacgttgcccaccagttggatcgtcggaagccagctcgccaggttcgcgttgatgcggtgctcgacctcggcgacgcgaagctccgcgagccgcatctcgggcgtgttcacgttcaggtcgcccggcgttccgagtttcggtgggggcgggagatcgggaagctgtcgatcgagtggaatgacgtcgtcggcgggggttggtacccggcccagcagcgccttcagctccgaattcaagagcgcgttccgggtggcgatcagcggcacctgcgattcgaggttcaccagcaactgctcctgctgcagcaccacgagccggggcgtgaggtgctgctcgaaccgcgctcgaatcagccggagcagtttcttgttgtagtcgatctgccgcagcgtgaggtcccggagcgcgcgggcctcgaggatgtcgaaccagacctgggtgatccgcaccgcgaggtcctggacgcggccctcggtgagctgccgctgctgctcggcgaagttcaatcccgcgcgccgctgcgcaccgagggctccaaacaggtcgacctggtaggtcacgccgaaaccgacggtggcgacgttgtactcggcccgggttggcggcgcgggcggaaggttggcgttggcaacgacatgactcagccccgcagggttcaggatgccgacctggagcgggtaccaccaaccttgcggcacgttggggtcgagctggttctcgtagatcagctcccgcacctcgcgcaggaccaggttgtcgccgaagcactcttggatggccgtgtcgagagccggatcggcgaacgccgtccaccagaccgcgtcctgggtgacgcgctcggctggctgcgcgggcacgccctccttcgacggccgagggcttggaaccccgccctcgggtgcgctggatggttgggccggctcggtgcgcagttcgctggcggtcgagtagctgctcggcgtcggaggcggtttgacgacgacgggacggatcagctcgcaaccggagcaggtcatcgcgaggagggcgagcgtcaatcgaagtctcatgggtggctgacgaccacgagggctttcgcgtggttgaggacgcagcgctgcgcgacccgcatggtctcgggatcgagggaggcgaagctctcgtcgaggatgaccagctcgaccccctgcagcagcgtgcgcgcgatgtagagccggctcttctcgccgtgcgagagttgccagccggtctcgccgatcatctcctcgaggccggcgggcatcttggcgatcagctcgtccagcccgagctccttgcacagcgcggcggccttggtccgcagctcgggcgaggtcggccactcgcgcccgagcaggagattgtacgcgaagctgccggacaggacgtggttctcgtggaactgcggcgcggcggtgatgcgcttgcgccagcccgaggagccgaacgtcgcgcggtccaacgcgtgcagcagcatcacaccgccctgcggcgtcctcaggcccgtcaacagcgacaccagcgtcgacttgccaccgcccgatgggccctccagcaagatgcggtcgccctgcgcgatctggaacgagcagttctcgagcaccggccgggtgcgcgcgtcgtgccggaaggtcacgccccgcgcctcgatgagggttccgccggcggcgtcggtgggcttgcctccctccatttcgagagggactttcgattcgagctcggggcggcccaccgcgagcaacaagtcgcggatctgctcgaacgacaccgccgcctgggagacctgctggaagtagacggcgacctcgtcgaaggctcgcagcgcgagcaagatgccgcccacggacaccgccagcgcgctggcattggccgtaccgctgctgaacgccggcagcaaggtcagcagggcgagcaccaaccagccgtcgcgcaggagcgcggtcagctgcatggtccggcgatccatgaccttcgagatctcggagtaggagctcaagcggacgtcttcgccatcatgccagcgctcgagtggaagctgcgccagccgcgtccgatggccgagcatgcgctcgagcaggtcgtgggtgatctcgacgcgcgcgctcgaccacgcccgctggacgccgtagtggcggcgcgcgaggacgaacgcgaccacgacccacaggacgagcaccatcgtttggggccaccctcccgcaccgagcacgaggatgacgcccgccaggatcaagtcgacgagcgacaacaccgcgagcagggcgccgccgaccgcaagctgctcgacgacctcggcctcggcgacgcggccgaaatggcggccgatgccgtcgagccgcacctcgtcgggggtcagcttgagggttcccgcaaggagctgctgcttcagcagcgttccgagccggatcgagaacacgccctgccaccacacctcgagcatgcggagcggaatcgcgcacgcgatcaccgcgatccaccccaggaaccagccggtctcgaggtgggcctggagcgcggcgcgaccgagcaaccagaacgagccagccagcaccagcgagaggagcgtgtggctcacgaggatgccggcgacgagagaagggatgtcgccgagcagcgtccgccggctcgcggtgcgcctggggcgcatgatccagccggtgcgcagctgcgcctggccgagccgctgcagcagcatctgtgagcgggcgtgctcgcgcgcacggggcgacatctccacgccgccaagcagctggtccacctcggcgacggtggcttcctgctcttcgcgcaggagcgcgatcgcgctcttcgtcgggaccgaaaccgccgtggcgtcgcgcgcgagcaggcgcagcttcccacgccgcgtacccagcagcaccagataggacgggacgccgtctcgccggacctggaggatgcagggcgcggcgcgtgcaaggacgtcgggcagctcgtggtagagtggcgtgatcggctcgagctccacgccgagtcgatctccgagcgcgaacatccagacccggctcggctcgacggccgccgcgggcggagcgatctcgcccgcggccctgccatagccttgcctctgcgccagctgctccagcgcgtcgggcaatcgctcgaccggccacaacaggtcggagtgcgagcgcgtcatcccgccagctccaaaccgcctgcggcgggctccgcgaccggcgtctccaccggcttcggcgccggcctctccaccagttggccgtccgaaagccaccaatggcgccaacgcccaccgccccagagcagcgtgcgattctcctggtcggcgcgaaggagcacggcgtaccgcgactctttgttcgcgagcagctccttcggcggcccgttctcgaggatccgaccgttctcgatcacgagcacgcgatcgaactcctgggtgtgctcgacgtcgtgggtgacacagaggagtgtgatgtctgcccagagccgccgggactcggcgaggagccgcgcgcgccggtcgcgatcgagaccgcgaaagggctcgtcgaggatggccaggcgcacgccggagcgaagcatcgcgcgcgccaggcgcacgcgctgaccttggccgcccgagacgagcc

SEQ ID NO: 570 - DNA, 3355 bp, Myxococcus xanthus
taggcgcgcatgcgtgtcgcccgtctcatgcgggcagcgcaccttgagggcgtcagccgccgcaggtggtgcgtcaccacgacgcgcgacgagcgcgcacgccctgcgcccgacctggtcgaccgcaacttcgcggcccctggacccgaccacctctgggtggctgacatcacgtacattccgacgcacgccggtttcctctacctcgccgtcgtgcttgacgcatggagccgtaaagtcgtcggttgggccatggctggccacctcaagacggagctcgtcgtgcaggcactcgacatggctgtggggcagcgtcagccccaaagcgtcgtgcaccacagcgaccaagggacgcagtacacctcgattggcttcgggcttcggtgcaaggaagccggcgtgcgcccatccatgggcagcgtcggcgacgcgtacgacaacgcgatgtgtgaaagcttcttcgccacgctcgagtgcgaactgctcgcacgccgccgcttcacgtctcacgccgaggcgcggatggccgtcttccgcttcatcgagggctggtacaatccgctccggcgccactccgcgctcgactacgagtcacccgctggttacgagaagaagcaccgcgctgccgcttgagggcgaaagcgcggaacgctctgcggaaccggagcaacttcaggacctggacaatggcctaggaaggctgggcaaggccaacacggccatcaaaggcggcgtcggcgcctacaccctcatcgatggaaaggtgagtgatgcctacaaggccctcgccaccggggggctgtcgagcagcaatccccaggagcgcagcgaagccctggatgcgctcgccagtgcgggcaagacctcaaccgagaccctgaaggcggggctcgagacagcacgagacctcgagaagtacgggagcgcgacccgggctgccaacttgtccctcaaggccgccgccccggacctgggcctcaaggggcggctcaagattgctcacaacctctccatgaaggcgttcaaccatgcggacgccggggatgtgggcaccgctgagaagttcgaagcgctcaagaaggccagtcggtcctccacgacggacatcgccgccaaggcgcacggcgacagcaacaacaaggcacagaagcggctcaaccaggggatcaagacaggcgccgagaagaccgcggacagcgcgttcgacgcggccatcgagaaaggtgccaaggccgcaggcggaaagctggccaagttcgcgggacgattcgtgcccggcgcgaacgtcgccgtcgccggcttcgacatcgccacagccatcgcgacgtccaactccaaggacgccagcccaggcaagaagataacagcgtggacaaccgccgcagggtccgtgctcgcggccacgaacatcccggtggtgagtcaggtcggcgcggccttctccacagtctccgacctcgtcgggagcttcttctaggagccctccatgcactcgcctcctgacaagtccaacccaggccagccgctctcgattggggagttgcagggcatggggctgttgaaccaagcgcccggagcgatggccttccgcaatgcgacgagccctcgacttccgctcctccgcgaggccccttcgctggaggagctccgggtgaagatgccggagctcgggggaatttcgcccgaggccatccttgatcgcttcgccacgctatgccgcgtggtggcgccgcgcagggagcgcgagccgggcgaagccgttgactccggagacgacgtgctcctggacgtcgtcggcttcgccaacggaaggctcatcccgttctccgcccgcgcggaatggaggacggaagccactcccgacccgctgctccccggcttcttcgaagccgtggtgcgggcccgggttggcgagtccgtagcggtggacctcgtcctgcctgatgactacgcagtggagtcccttcgtggcgtccctgctcgcttcgacgtgaagatgaaggcggcctaccaggtgacgctactgggggagtcatctccagaactcttcgccgcgctgggacgcggaggcacgctcgacgaggtcatggagtacatcgccggggaactcatcgcccagcgggacgcgcagtacctgtgggacttccaggaccacgtgatgagggaggtggctcggcgcacgcatgtcgaggtgccacggagcctcatcgacgaagaaatccgccagcggtgggccgaggccgagtatccaatcctggtgagcctgggcctaccgcacgagcgggtccgggaaggactggatggctggctgctcgacgactccacccggagcgaactggagtaccggctgcggctggcgcttgggcttcgggccatcgccgaaagagaccacatccagtccgagcgggagtccgcggaggagctgttcaacagcctcgcggagagagcccaactgagccgcgttgagctggggcgcctgctccagtccgacaagaatctcggccggaggttcgacacgctgacgatgcacacggcggtcgtcagccacatcctgtccaaggccgacgtttcgcgggagtaatggcaaggccatgggcccgcggtcgtagggagaaggcgcgcggctcgaagaatgggggcagagcagtgcccatggctccccacttcgagccgcgctgtcaggtccgggcccgccaggtcagccactcccccggacgtgccagctccacgttcaccttccgcgtgcgcgcggcggccagaagcagcgcttccgcgtccgggacctcctggtagtcctccgaggcagcgaggccgtagtggatgggcacgaggagctttgctcccaacaccaaggccgcggccaccgcctgctccggcgtcaggacggcatgcacgtcgctcacgggcttgcgccagccgaagcgcgccccgttgataggcaggaatgccgcatcgaaggggccgaactgtcgcccgatgtgccaccaggagccatgccacagcgtgtcgccgcagtggatgatgcggcggcctccaccggagacgacccacgaaacctggggatccccatagccgtccgccgcgggaacggcggtggcggtgaagtcattgagcaagatgggctcgtagagcggggcggaccgcacgcggaatcccgacgccgaagccgccgcggccatgtctggggcgcacaccagcgtcccgctgtcccccagcgcctgacggacggccacccggtcgaagtggtcggaatggcgatgcgtcaccaggacgaagcggcccccgtcgctcacgtccactgggacaagcgggtccttcagcgcggccccccacacggtggggtcgctcaacgggt

SEQ ID NO: 571 - DNA, 4026 bp, Myxococcus xanthus
gctgtttcatggactccgcgcggcgtccgacgagctgggcggcctcccagccccggatgcgctcggcggcccacaacttctccaccgccggccggtccgacaccgcgggcaggtccacgcggacggtaagcgagaagggctcctgtcccgaccgcccccgcagcgtcaccgtgcccgtcccgggcgaggcatagcggcccagcagcgtccagggcacgccatccaccaggggcggtagctcggcgggcgccagctccgcgcactccacgccatcaaagtggacttccagctcggtgacacgcggtgccagcgcacgggagaactgcgccacgaccttgtcgtcgatgcgctcgcccgggtggatgaactccacgtcaccgcccgtctgcttcgccatgtcccgtagcagcacgtcgctgacgttggtgccgatgccgaacgagtacacccgcgcagtcttccgcgcctcgagcacggcgcgcagaatctccgcctcgttccccacctgtccgtccgtgagcaggacgatgacgccgtcgggcgccgcctgcactgcggcgcgcatgggcgcgagcagctccgtgccgccatccgcgttcagcgcggccacccagcggtccgcctcttcgagcgtgcgctgcgtgaagggcacaggctcgggctggaacgactggaagcgattctcgaacgcgatgacgttgaaccggtcgccctcgcgcaggtggcgcaggcacagccggagcgcggcctgggcctggggcaggctctcaccggccatggagccggagacgtccacgacgaacaccacctcctgcttgggcggcgcggaggccagggccagcaggtccggcaccacggtgagcgcgaaggtgcccgggcctccctcgcccttgcggtgcgtgacgagcggcgtgaacaccgcgctgctgtccgggctgcgcaggctcagcaccaggtcgcggtccagggacacctcgccgcgcgagaagccgacgcgcacgcgggtgccttcctcccgggtggtggtgatggcgtgggacgggctctccaccaccacctcgcggcccaggtccacgagcaggtccatgcgcaggccgtagtgcacgttacccacgggcggggtgatgcggtccgcgtccggcacctgggccgtgggctcttcactgccgtggccggtgcggtcgcccgtggtcgcgccggggatgtagcgaggcgccaccagcgtggggagcatccagcgcacgctgccttcctcggcggtgacggcctggaggaactccacctccaccacggtctcctcatagggcagcaggttgcccacctgggcggtgaagacgttgcggcgctcctcgtcgagcagcgcggcgccatggccggccgtgacggcgtcgtcgtaggtgcggaaggcctcttcacgctctcgcaccacgccttcgatgcgccgcccggcgcacgtcatggagaaggcggacagcgtggcatccgagggaagggggaaggtgtagatggcctccaccggctggtactcctcgttgcggtagcgctggcgaacgcggacgcgcgcgtggccgccgaggagctcgcccgtgacttcgacaccttgcagggggacctgcgtgccgttgcgcgtgtacagccctgccttttcgatggtcatggcttctccctttcctggaactccgcgatgagggcgcgaacgcgttccgcgagcgcccgggtcttcgtgtccgctgcttccgagacgtgcagctccagccctgggagcagctcccagcgctcgtaacgattcaggcccgtggccggtcttcgaggcgcgtgcggtggcgccaccggggccggtcccggtagcggctgcgcgtgcaccgggggcgtgggtgtcgcgtccgagtcggcgagctggcgcagctcatcgaggctcaagcgctgcaactccgcctggatggcatccaggggaaggaaccgcgcctgcaggacgcggatggccttgagccgcaccaggtgctcttccccgtacacggtgtcgggtccccggaaggggggcgcgggaagcaggccgcgttggacgtagtagcgcaccgtccgcggcgagacgcccaccgcctcggccagctccgtcagcttccattcgctctgtgtcttcggcgtgctcacggttcagacagtaggactcgacatggttggtgtcaagttgccactggtgaattggcagtagcaggggccagagcgcgagggacctccgctcagcggcatctcgacagtgctgctgccgagtcctgacacccggcgcgcggtgctgcgccaggaggtcgccatcctcgcccggggcgattgcctttacctacacggcgctgctggccttcgtgatgacgtcgctgctgtacctgacgaagcggcagacgcagttgcccgaggccctgccggaggagtccttctcggtgggcgcgacggcgctgctcgtcctggcgtcgctgcggctgagccggcgggccatcaagctggagcggcaggagctcttcgactagcggctgtcaggacaggccgcccgcgggagggccctcttcctcatcctcggtgtatcgccggtcttcatgtccatcgtcggcccgctccatgtgggctttcacgccgctgagcgtgcgcagcaggtctagcgggatgggcaggatggtgtgattgccaccggtggtgatttccaccagcgtctggaggtagcggagctggagggtggccgggtagcggccgaggaccttggcggccatggagagcttctcggcggcctggtgttcgccctcggcggcgatgattttcgcgcggcgctcgcgctcagcctcggcctgccgcgcgatggcccgctgcatctccgcgggcaggtcgatgtgcttcacctccacgttggacaccttgacgccccacgggtcggtgcgtgcatcgagcacctgctgaatctcgtggttgatgcgctcccgctcggagaggagctggtccagctccacctggcccaggatggagcgcagcgtcgtctgggcgagctggctggtggcatagaggtagtcctccacctggagcacggccttgtcggcgtggatgacgcggaagtagacgacggcgttgaccttcacgctgacgttgtcccgggtgatgacgtcctgtggaggcacgtcccgggccacgatgcgcaggtcgatgatgaccatgcgctcgacgaaggggatgagccagcggaagcccgcgcgtttgaggcccacgaagcgcccgagccggaacaccacgccgttctggtactcgttgacgattcgcacccccgacaggaagagcaggaacaggatggcgacggggatgaacactccgaacagtccagtcagttgcatcaggtcggtacctcgtcgacgaagagggtgagtccttccatgccccgcaccacgacgtgtgcgccggagcggatgggagcggtggacgtggcgcgccagcgctctccatgaacgaacacctcgccgctctccggtgtcaccggggccagggcggtgcctcgctctcccacgagccccaggtcgccacctcgctgggggagccgccgcgtctgcgcgctccggtagacgacgtaagccgccgcacctcccagtgccacggtggtgggcaccagccacgtccacgacacttgaaaggagcggtccacgaaccactccgggttgaagcggtccacgaggaacagtccgcccaggcccagcagcaccacgcccacggcgccgagcagcccactggtgacgaacagctccgcgacgatgagggccacgcccgccatcatcagcagcactgcgcccgcgcgaaccggcagcgcggaggacgccaccaacgccaggaccagcgccaccacgccgatgagccccggggcgatggcgcctggatgtgacagctccaccaccagccccagcccggccaccaggaacagcaggtagacgatggcgggattggcgagcgcgtgcacggtgcgctgggacagcgtgggctccatcgtgacgatgtgcgcat

SEQ ID NO: 572 - DNA, 3867 bp, Myxococcus xanthus
gtgctctaaagcggtccccgtccacgaagcgggcgagcagcggcaccgccttctcgtggttacgggtgttgttgtaggccgtacccaggtagaaggacgcgtccagcgcctggtcctgcggcgggttcatggccaggaaccgctccatgttggagatgacgctgtccatctcgttcttgcggaaggcaatcttgccctgctcgaacgcggcgtcgcccgtctcccggcgcagcacggcggcgcggtcattgagggcctggcgctccaggttgctcagccgcgacgtgtccagcttcaccagcgcgtcgatgcccttgaggcgctcgtcaccgggcaggctggtcatcatcttgtagaccttgttcgcctcctgctggaccgactggtgcgccgcggtgtccgcgcgctgcttctccagttggccggtgaggtcggcgaccgtcttctccaggcgctccttctcgttggtggcgctggtgctgcgcgcgctggtgatcatcagcgcggcgcccacgcagatgaccgcgaacagcacgtaggccaccgcggacgacagccactggcgcttctggaaatcttcgtgacgtttgccaaccgccttcacctccgcatggaggttcttgagcaggttgtcgctcttgatgacgaggttgcgtgcctcgacaatctcacggcgcagatccgtgagctccttttccacatccgttttcggctggtctggcatggacatcttcctaggcccggaaatgaattcggccgattcacgcatcgtaaggagttctcccggtcatgcgtcgataatttccgcagcggaacagcgctgcttagccaatgcatttcccgaagaagggcaacagcgcccggctcgcctgcttcccctccgaacctacaggctcccagggagcagccgtgatggctctgctggaaagctgtacgtcacgcccagcgagagccagctccctcccaggctgaaagaaccgacgcgcgccgtggacggccccaccggacctcggaggaacgcgagccggtagtcggcagtgatgccccaacgcggcgtcaggcgcaacgtggcgcccacgttgcccatccacgtctgggtggtggtttcctggagctcctcacccttgcgctccgacgaggcgagcgtgggccccgtcagcaagcccgcgaagggcacgagcccatgggggcccaactgcggaatcaccgtctggaagcgcaggccgatgagcgccccgtagcccagcacgtccacctgccgggcctgcggcggcccgccgtcgacacccggctcgttgaggtacaggcgactctgcgtgccgaacaggtcgatgcccacctccagcaggtcggagatggcgtaggcgaagtacgccaccaccgtgggcccgcccgccacttcccgggcacgcggcagcccctggttggcggagcgcgagtaccagccgtcgtagagcgtcttgttgggggtgatgcgccagccgccctggatggtgatgcggcccaccccatccagcgaggtggacacgtcctcatcaccgtatccgtaatcctgagcggcggcgggagcggaaagcagcagtgcgagcggaagaaggcgacggagcatcaatggcggctttggcgtcaggggcgcttggggctcagcgcgatttccaggaaggtggtccgccggcggcgaagtgatgcgacgaagcagcgcaccacgcatccggcgccgaactcgcgcagcaccacgccgagattcgccaccacgtcccgcagggtgatcacaccgtgcatgtgcccgctcctgtgcgctgcggaggttggcctgggtgctacaagcgtgtggcgcacggtaacagggggtccccccccgtcaattttcggggcactcagcgggcgcgccgctccagctccagcaagggcatctccaacaccaccaccgtgccgtggctgcacgtggggtggaagtcggcccggtccaactccccgagcagcgcgcggaactgcgcgtcggagagcggcacggcgccggcctgcttcgctgcgtggcacgccatcacccgcaccgcctccgccagcgacaccgtgtccaacgtcgcgctcttcggcggaagcgcccgcgccagggcctccagcagcgaacgcgcgtccgccccttccagtcccggcggcaccgtcttcaacgccaccgtggtgccgccgaacggctccacgtcgaagcccaggcgggacagggcttccctgccctccaccagagccttggccgccgcgacgggcaactccagcgtggtgccgaagagcgtgggcgccggaggcggcttgccggactccaacgcgcgcaggtagcccgtcaggcgcgcgcgctccagcgccgcgtgcggatccatcaccaccagcgtgccccccggtccctcgcagacatggaagcggccccccagcatgcccaggggccgcagcgcgccgaagtagcccggcggaggtgcctcgttgagttgcggctgcgcctgaccgaaggcgggggcctgccccaccgcggcggcgaagggcagcgctcccggccgagccccctgccccagcggccccagggacggcgcccctggaccggggcccggcgcgtccatggcggtgggcagcgggccgccccacgcggcttcctgggcgcgggtgaggaagcgctccacggcgtgcgcgtagtgcgcggcgtccatgggctggccggcctggggcgcggcgccctccacgcccgagcccagccacggcgcggcgcgcagcatgcggctgagcgcggccgtcaacgcctcctggacaccccgggcgtcggcgaagcggacctcctgcttctgcgggtgcacgttgacgtccaccgcgcgcgggtccacgtcgatgtgcagcaccaccacgggctggcgcccggcggcgaggaagtcctggtacgcgcgctgaatagtgccaatgaggccgcgatcccggatgtagcggcggttgacgaaggtgtagaggccgcgcgcgttgttgaatgtgaactcgggcgacgcggcgaaccccgtgacggccacgcccagccggcgctcctccacggggaacaggtgcggatgcgacgtggagcccagcgccgcggcgattcgctcgcgcgggtcatccgggcaggccgcgctggagaagagcgtgccgccctcgtgcgaggcgaagaagcccacctccgggtacgccagggccaggcgcaccacggcctcctccgcgtgcttcagctccgtgtcgccccggcgcaggaacttgcggcgcgcgggcacgttgaagaacaggtcctccacagtcatgaccgtgcccgtccgcggcggcgcgtcctccaccagcggtggcccaccgccctccaccgacacccgcgtgcccacctcggagttcgcggccgcggagtgaagtgtgaaccgggaaacggatgcgatggcgggaatggcctcgccccggaaccccatggagtcgatgtggaacaggtcgtccagctcgcgcagcttgctggtggcgtggcgctccaggcacgccacggcgtccgagcgtcccataccgtgcccatcatccgacacgatgatgcggtccacgcctccaccgtccagctcgacgcggaccgtaccggcaccggcgtcgatggcgttttccaccagctccttcacgacggaggcagggcgttccaccacttcgccggcggcaatcttgttgatgaggacgtcgctgagacgggcaatccgggacatggcgggcggacaccctccgccacccaggcgacgttgtccagcaacacaacatgggtggcggctgacaatcccaggcgggtgggctaacacacgacgccgcgtatggacgtgtcacgaccaggcaagggac

SEQ ID NO: 573 - DNA, 3899 bp, Myxococcus xanthus
  unsure (1)..(3899): unsure at all n locations
gtcagggtgcaggccagcacgaggccagccaggaggaagcgaggtgacgtcttcatggggtctcctccacggtggcgtccgcgggcgcgcccgcggcgggctcggccaggccgtgcagactctgcaggcgttccttccactcacgcacntgcgccatgcgcgggccgctgccgccggccaggtagcggcgccatgcctccacggcctcacccgcgtccttgcggcgctcctgcgcgtcgatgcccaggttgagcgcggccaccggcacgctcgactccagccggcgccacgtctccacggcgtctgtcgtgcggcccttgcgccagtcgacgcaggccaggttgtgctgcacctgcgtgtcgtccggattgccggcgagcgcggccttgaaggccttctccgccgccctcatgttgccggcattgtacgcctgggatgcctcgcggcggtggagcgcgcccgtcatcgccgtcagccacttgggctgtccgggcatcggcttcttcgccgccgcggtcaactgcttgcgcgcggcgggcacctgccccttcttgtagagcacgaaggcggtggccagcgcgcgcgtgttgggccaggcccagggctgcgtggacgcaagggccttggtgatggccgcgctcgcctccgcgtggcgccccgactccgcgcgcgccaggccgcggacgaactgggccagccgcaccagctccttgcggttgcccgtgcccagcttgtccaccaagtccaaatcccgctcggcggcgtcggcatctccggcctccaggcgcaccagcgcccggcgcaccagcacgcgcggaaggttggcgcccgccacctgcgccgcggcgcgcgacgggcccaccgcggtgaggcgctgcaccgccgcgtccacctgccccagctccacctcggccagcgcggcgccgacggaggcctccgcctgttcgtcgggctcctccgtctgggcggccgcgcggttgaaggcctccagcgccgcctgggcatcgttcgtggccagccgcgcgtaccccagcagcaagctgtcacgccacgcggcgcccggcagcatcacgccctgctccatcaccttgcgcgcgtccgcgtaggcgcgcgtctccagcagcgaggcgcccagccggcgcgccatgggtgcgccccggtccaggtcgtacgcgcggcgcaaatcccggacggcgtcctccagccgtcccgtgcccgccctgtcccgcgcccggtgcgccagggcccgggccagccactgcttcgccccggcgtgttccggctccacctgcagcgcgttggcgtagtcctcgatggcctggtcccactggccggtggcgaagtggtccgcgcccagcagcacgtagcccagggcctgacgcggcgccatctccaccacgcgccggtgcacctccaccgcgcgctggaagcggcccgcgcggcgattcaccgagcccaggttggcccacagctccaggctgttggcgcccgcgcgcaccgcgccctccaggaactggatggcctcctcgtgccggccctgtgcctggagcgccttgcccaccgccatctgccccagcaccaggcccggctggagctggagcaccttgcgatactccgcctccgcggcggccgcgttcttctgggcgaagcgcacgtcacccagcagcaggtgcgccgcgggtgagctgcccagcttcatcaccgcctgggcctgcgtgtccgccttcgcgacgtcccccgcgcccaggtacagacgggccagcttctcgcgcgcatcacccgcctgcgggaagcgcgtggtgacgccctccagcaacgtgcgcgcctccacggccctgccctccagctccagcacctgcgccaggcccagttgcaccgacggcgactctggccggcccgcctgcgcctgctggaaggacgcgcgcgccgccgcggcatccccgcgcagcacatgggcgcgacccagcagctcgtgaatctggaagtcgttgggtgccagggcctgcggacgcagcgccaggtagcgcttcagccgcgtggccgccgcgtctccctgctggacgtagaggtagtagctggccaggtagtaatgaacgatgaggtgttcggccttgtcggccgtggccacccgctccatcagcggcacggcctccgggaagcggcgcagcttgaagtacgccacgctcaccggataggccagggccagctccgaggggttcgccgtcagcaccggctgcacccggtccacggtgcgctgccagtcattgagcgcgttggcgctggcacccaggccggcggcggcggccacggagccaggctcggcggtcagtgcctgttcgaagagggccagggccttgcggtacttctcctcggcctccttcttgtcacccgaggcgctggcggcgctggcggccacctgcgccgcctcgccgtcccgcaccagccgctgggattcggacatgggcggcgggcggtactgggccagcgcgggcgggccgcacagggtggtcagcagcgcgagcgccggcgtgagacggcgcgaccggggatgtcgtggggagcgtcgcatgcgtgtggagtcccagaaggaagtcaggcggcggggctgaactcggccacgacgacggtgatgtcgtcccgctgcggctggccggcgctgaaggcgcgagcgtccgccagcaccgcgtcacgcagcgcctccgcggacaggtgggcgtgcgcctggaccgcggcggccagacgctgggtgccgtagagcttgcccgcgttgtcgcgcgcctcggtgaggccgtccgtgtaccagaccaccacgtcccctggccgcagctgggcctggcgcgaggtgaactgggattcgacggaggcgcccagcagcgggccgcgcgcgggcagcgatgcaatctgaccgctgcgcttgttgaacaccagcggactggggtgcgcgcccgccgcgtagtcgatgtagccgttggacacgtcgatgacggccagcgcgctggacatctggtgctcaccgcggcccacgttggccagcgtcacgttgagggcggtgatgagcatctgcgcgttgacctgcgacggctcgcgcagcgtcatcgccgaggcgaagccactggtggcgctggtggccaccagcgacgtggacaggccgtggcccgtcacgtcgccaatgccaatgacgatgcgccggtcatccagcgcggcccggaaccaccagtcgccgccgcacgcatccgcggtgacgaccaggccggcgatgcgcagcggccccacctgcacgccctcgcgccccggcagcagcgtctcctgcacggtgcgcgcgagcgacacctctcgctccaactgcgccttggcccgcacgtcctccagcagcaccttgatgcgctcggccatgtggttgaacaccacgcccagcgtcaccacctcgcggcccgcgccctgcgccgttcccgcccgcgcgctcaggttgccggcggccagttgcatcaccttgccggtcagcatgcccagcggccgggtgatgcgccggctctggtaggccaccagcacgcccgccagcaccacgaagcccagccccagccccagcatgcgcagcgtggtggcgcgcaccgtggcgcgcttgtcctgctccagcgacgccagctgctgctgcagcccgcccagcgagtagctgatgacgaccagcccccttgccgctgctggagccgtagtcgatgggctcctggatttcggagatgggctgcccccggtagaaagcgctcaccagccggcgctcggcgcggcggaccggcgcgacgtcctccttgtcctcgctggcgccttcgctgtccgccatccggactccgtccgggtcgaaaatctgcacccggaggatgttcgggttcgtcttgacgatggag

SEQ ID NO: 574 - DNA, 5043 bp, Myxococcus xanthus
cagaggacggacacaaatctggggctactcagaagcctctttgtgtttcaggggcgtaccttcggtatctacacccaggccctgtccggtgctgatgcaccatcaaggcctgccgctgcccttccatagaactggcgaacctgctggggataccctgggcgctcaagttcctctgggccccgcccatggaccggcacggttcggcgaggtggggccggcggcgcggctacatcctgccgctgcagtgcctgtcgtcggggctcctgctggcgctcgcgctccccgaaggcggcctggacatggcggctgctgatggccgcggtgctgggcatcaacctcctggccgccacgcaggacgtggccaccgacgggctggcggtggacctgctcgcgccggccgagcgcggctggggcaacggcatccaggtggcggcctatcgcgtcgggatgattctgggcggaggcgtgatgctcgctgtcttcgacgcggtgggctggcgccccacgttcctcgcgttgggcacactgctgctcctggccaccgtgcccattgccctcttccgcgagccccccaccgcgcccccacccgctcagagcctgggcctgcgatggtggttgaagcgtccgggggccgccgcgtggctcacgctgctcgtcgtctacaaggcgggcgaagccctggccaccgggatgctgcgtaccttcctggtcgacgagggcctgtcgctgacggccatcggttggctgttgggcggcgtgggcttcaccgcgggactcgtgggggcgctgctgggaggcggtttggtggtgcggctcggacggcgacgggcgttgctcgtcttcggaggcatccaggccggcgcggtgctgctctacgcactggcggctcgaggccccacgtccctgcccctgctcaccctcgtctgcggcgtcgagtacgtcgccagcggcatggccaccgcggccgtcttcaccgcgatgatggacgcctgccggccggaccacgccgccacggactacaccgtgcaggcgtccctggtggtgctggccacgggcgccgccgccgcgctgagtggcttcagcgcccaggcccttggctatgccggccacttcacgctggccgcgctcctgtgcgcggcgggcacgctgtacgccgccctcaccttccacccgccccggagcctggcctccgaggccgctcccgaggtgtcgtgatgaccatcgccgtctacgccggcagcttcgaccccgtcaccgccggccacatgtccgtcgtccggcaggcggcccgcctcttcggccacgtcgtcgtggtggtggccgtcaacccggacaaggagagcctgctgtccgccgacgagcgcgtggccctcctgcgtgaagccgtggcgcaccaccccaacgtcaccgtggcccgcacgcaggggctcatcgtcgacttcgcgcgggacatcggcgccagcgtcctgctgcgcggcgtgcgcggtgccatggatgcccagttcgaaacgacgctggcgcagaacaaccgcgcgctggcgcccgagctgtccaccctcttcctcccagccgaagcccacctggccgaggtgagcagcagcggactcaaggcgcgcgtggcgcgcggcgaggacgtttccgccttctgtccgccggccgtcgcgacgaagcttcgggagcgactcgatctttccctccggagcctgccttgagcctgtccttcatcacccttggcatcggcgacgcattctccgccctgcgatattcgtcctgtttcgccgtggaggcggaggaccaggtcctactcgtggactgcccgcatcccatccggaagatgatgcgcgaggcgtccgagtcctccggcgtgcccctggacgcggaccgcgtcagcgccgtggccctcacccacctgcacgcggaccatgcgtcgggcctggagagcctcggctacttctccttcttcgtgctgcagcggaagctggaggtgctggcccaccccgccgtcgcggaccggctgtgggaaggcaacctggccgcgggcatggagtgcctcatcgagcggtgcggggagccccccaacgacaagcacttcgaggactacttacgccacacgccgttcttcacggagaccgccgtgcggaacggaccctttctcatcgagagccggatgacgtaccaccacgtgcccaccaccgcgctgcgcatccacgcggggggccgctgcctggggtacagcgcggacaccgccttcgacgagggcctcatcgactggctctccaaggcggacctcatcatccacgagacgaactacggcgtgcacacgccctacgagaagctggcggcgctgcccgccgagctgcgcgcccggatgcggctcatccactacccggatgacttcgacaccagcgcgagcgtcatcgaaccgctcgcgcagggccggcgctacaacgtctgaggcgcgaacgagcgcccgggagattccaccccgggcgcccggtgccgtcaggcgctactgcgagaagatgaccagcgagtagggaccgatggcgaacgacgcgttgtgcgacaggccgtccttcgcgccactgtaggccacggtgtcaatcgacgccgtgttgccgaagtcgcccgagtacccgttccagtcgctgttgaagcgcgcgtaccacatgcccccgcgcgggaagccgatgttgtagctggggaagtacgtgccgctgaagttggcgacgatgacgacgtcatccccaggcccgccgctctcccaacggtggtacgcaatcaccttgccgctgttgttgacgtggtggacgttgacgttgccgccgcgcaggccgcgcgtgttgttgaaccagttgcggcgcagacggatgaggtcgcggtacagcgtccggatgccgctgtaagtgctgttcttcccccagtccacggggtccgtgtcctggaagtagccgtcctcgaggaactcctggccctggaagatcatcgggatgccaggcgaggtgaagacgacgcccgccgccagcgtggagcgcttcttggcggcccagctccccgcgttgcccggccagatctcctccgggacgcgcgccttgccgttggccacctcgtcgtggctctccgagtagatgacgcgcgcggtgtgccgcccgctgtagcgctgggtgatggcgttgcgcaccgagttcatgtcacggccgctgtcgttcgacgcgatgaccgccgcgcggatggcgtgcacgaagtcgccgccccactgcgagtcgaagcccgcgccgcccgaggtgtcggacgtggcgtcgttggtgataaagtcaccaccgccgaagtcctcggcgatgctgatcttccacggctgcgtggcgttgatttcgcggttgatggagcggaacacgcgccacgcgtcggggatggcggtggtgtcgctgccattctgcgtgcgcatgtacttggtggcgtcccagcgcagaccgtcaccccggaaggaatgggtgaggttcatcatcgagtcgcgaatgtacgcgcggacctcggggcggccgtagtccggacgggtgtcgccccacggcgtgctcttgcgccagtcgttgtagaagtactcgccgcccgagcccaggcagtcgccgctgaagcaccacatgggcaggtcgctggggccgtagtggttgtgcaccacgtcgaagatgacgccgatgccacgcatgtgcgcctcgtccacgaagcgcttcatgtcattggggtgcccgtaggcgctctccggcgcgaacgggaaggcagcgttgtagccccaggagaagtcaccggcgaactcgtacgcgggcatgaccttgatcatgttcgcgcccaggtcccggacgtggtcgagcctggcaatcgcgctgttccagttgccggggccgaagccgggcgagtcgtggaacgtgccgacgtgcatctcgtagatgatcatctcgttgaagccagggctgctgtactgctgcgcgttccaccagtactcgccgtggtcgtagatgatgctggagccggtggagttctcctgccacgccgagcgggggtccgcccgccacgcgtcgctgccccactggttgcgggtgatgaacttgtacttctggcccttcaccgcgcccgccacatcgccagagaagttgccgttgaactcgttgcccagctcaatccaggtgccccagccgttgaaatcgcccgagacgaacacccggctcgccatcggcgcccagacgcggaacgtggtgccacccgcatagacggtggcgcccatgccgggccgcgtggacgagttgagctgctggctgatgaccgccgtctcttccgcggaatctcgcggcgcttcgagcgcggactccccacagccggcggcaatcacacccgccagcaggagcgcactccacctgttgctgtgcctcatggatgacaacctcccttggtcagggagcgtcctagcaaccggcgtaaatcccgcgcaaacggctctgcacgaaatctgtaattttccatcacaacacggcgcgtcaaacgtatccaccggcacacctgaacccctgtgtgacacgcgcgagaagttcccagcgctcgccatcgacgcatgagtgcgatacgccccacacgttgcgccccacccagggagcgcgctggggagagcgacgcacgatgacgaagaagacagcgctggcccgacgtgaggccctgctcgcgttggccgcggtccttgccagcggatgcgccacgagccccccctcccccacgcccgcaccgccttccggcacggtgcgcctgacgctccttcacctagcggacgtctaccaggtccaggccgtcgaggaaggaagggggggcatggcccgcgccgccacgctgcgcaagcaggtgcttcgcgagagcccccacgtcctgacgctgatggggggcgacacgctgtctccgtccgtggagtcgctggtggaggtggacggcaaggcgctcaagggccggcacatggtggacgcgtggaatgcgttcggcctggactatgcggtgctgggcaaccca

SEQ ID NO: 575 - DNA, 2931 bp, Myxococcus xanthus
gtgctctaaggacgttcccctggagaagattgtcgaggcgctcggggtcgagcggaacctgagccacgccccgctgttccaggtgatgttgatgctgcagaacaccccggagggccacctgagccttccggggctggcgctggagcccatcgacctggagatcgagagcgcgaagttcgacctcaccttgagcttcgagcccacgcgtgaagggctggccggcgtcatcgagtacagcacggacctcttcgacgcggaccgcatcgagcggatggtcgcccacctccaggtgctcttcgccgacgcggtggcgcatccagagaagcggctgtcagagctcgcgctcctccccgagcaggagcgcggcgtcgtcgccgcgttcacccaggggcgcctggtggcgcccacccgccacgtcccagcccaccggttcgtggaggaacacgcggagcgaacgccggatgccatcgcgctcgaactggggcaagagcggctcacgtatggcgagctgaaccgccgggccaaccgcgccgcgcaccagctcatcgcgatgggcgccggcccggagatgctggtggccctggccgtgcctcggtcgttcgagatgctcatcggcctgctcgccatctggaaggcgggggcggcctacgtcccgctcgacctctcgtacccgaaggatcggctcgacggaatcctggaggactcgggcgccgcgctcatggtgagcacccatgcggcggagcagaagtggcgcgcgccgcaggtgcggacgctctggctggacgagcccgcggatgccgcgcccaccggcaatcccgacagtggcgttcgcatggagaacgccgcctacgtcatctacacctcgggctccacgggcagacccaagggcgtgattctggaacaccgggggctcgcgaacgtcatcgagatgcagcggcacgaactgggcgccgacgcaggctgcgtcatgctccagttctcctccatctccttcgacgtctcggtctgggaaatcgtcatggccctgaccaacgggggccggctcgtggtggcccccgcggacacgctgctcgcgggcgacgaactggccaaggtgctgctggctcacggcgtcacgcacatggtgctgcctccgacgtcgtatgcagcgctccccaccgaccgcgagtaccccgcgcttcgcatgctgacgtccgcgggagaggcccttccgccagaggtcgtccacacgtgggcgcggcccggcgtcctgttcgtcaacgcctatggccccaccgaggtgtccatcatcagcacgctcggccactgccggcaggacgacccgggagctccgcccatcgggcgccccgccctcaacctggaggggtacgccctggaccgccacggcgcactgctgcccattggcgtcccgggcgagctgcacatcggaggcgtcggtgtcgcccgcggttacctgaaccgcgaggagctcacgcgcgaaaagttcatcccgcatccgttcaagcccgacgcacggctgtaccggagcggagacctggtccgctggcgcaaggatggcaacctcgagtacctcgggcgcatcgaccatcaggtcaagctccgtggctatcgcatcgaactgggtgaaatcgaagcggtgctcgcctcctaccccggtgtggcgaaggccgtggccaacgttcattccgcgggcgcccaggggggcgtgaaggccctgattgcctacgtcgtctcgacccagcccgtggatgtgcacgcgctccgcgagtacgcccggaagaagctcccggagttcatggtgcccgcgcagttcatccacctggaggagctgccgttgtcatccagcggcaaggtggacaagcgacgtctaccgccgccgcgcttcgaggcgtccgcgagcgagacgcgcttcgtgcccccgcgtacacccaccgagcagacgctggcctcgctgtgggagtcgctcctggagcgccgcccgattggcgcggaggacaacttcttcgacttgggcgggcactcgcttctggccgcgcaggtcatgagccgcgtgcggaggacattcggcgtcgacgtgcccctctccgccatcttcgagcagccgacgctgacggcactggcggcggtgattgccgccaaggaggccgcaccgcagcttcctccgctggtccgactgacgagccccggggaccggcccctttcgttcgcgcaggagcggctgcgattcctcgccgagctcgaaggccagagcgcggcctacaacatccccttcgcgttcacgttgcgcggctcgctggacgaggccgcgttgcgacggagcctccagcgcgtgctggagcgccatgaggtcctccggacgaacttcccgctcgtcgacggtctgccggtggcccgggtggccgacgcggtgctcacgctgaccacagaggacctccgccacgctggcgcggtaagcctcgaccagcggctggccgaggagtccgcccggcccttcgcgctggacgtgggccccgtggtgcgcgtgcacctgttcaagcgcgcggacgacgaacacgtgctcctcgtggccatgcaccacatcgtgtccgacggctggtccttcggcgtgatgatgcgtgagttctccgcgttctacgccgcggaggtccggggtgagcccctggcgcttccggaccttcccatccagtacacggactacgcggcgtggcagcggagctggctcgacggccaggcccgggaacatcaactagggcattggcgcaaggcgctcgcgggtgcgcccgccgagctggacctgcctactgacaggccccaagacggggaccagattcacccgcgtgccaccgagccgctggcgttggcgcccgacgtgacccagggcctcacctcggtctgacgtgagcaaggaacgacgggctacatgggattgct

SEQ ID NO: 576 - DNA, 4302 bp, Myxococcus xanthus
tgctccagaagaggcccacgacgaggaagcccaccagcgccgacagcaggccgtctctccccaggaagcgcgcctccagcacctgttggacgtagaggcccagtgggacgagcaggcccgcggcggcggcgctggtggccaccgcggcgggttgtcccggctgctcccgtccatggcccagccaggccaccatcgccgcggcgagcgcgcccgcgaggctcacgggcaacggctccggggcccggaagaagtagggcagggcgggcagcaccgtcagcgccaggcgcagcgccagggggtggaccccggtgggcttcacgcacgcctgcgccgcggccacgatggcgaggtactccggtgtcaggtgcaggtccggaacggcccccgcgaccaggcccatgcaggcggcacctcccagcgcgcgaagcgtgcgggtctcgaactcctcgcggtggaagtactgcacggagagggccatgggttcaccgtcctgctgctagtacgtattgttctggccgaagttcttgatggacttcttgaggaggttgcgcgactcggcctgcgcctcctccgcgctggacgcgcccgccaaggctgcctgggagcggcggacgtccgcaagctccccggacagcgcgtccgcggaggtgccgaaaatggtccgggcgttgtccagcaggctactggccttcgccttgttgccccgcttcatctcctccgcggcggccaccatgtgctgggtacccatcgcccggaccgcatggacgcgcacctccttgtccaggtactcgcgcacgcggtccaggtcgctcgtcacctccgcggtgagctgcagcgccgtctccgtcggcaagtcccgcgccacgtcgacgtagtgcacccgggcgttcagcagcgcgagcgcgccggccgtccgcgaggtgttcagcgtcagcttcgccatgacgcgcaccgtctgggcgctggccatgtcgtacagcggcaccttcagcacgttgccctcgcggaaggacgccatgcccatgacctccacgtcctgcacctcgggcgggacgtccagccgcagctccaccattcgcgccacggtgctggtcgcctggtccagctcgcgggagaagacctccgccagccgcgccgagtcgtcgatgaagccggagaagccgcccccctgctcggccatgccgcgcatcagcgtctcctggtagtcccggcccacgcccagcgcgctgacggtgatgccgtcgcggcgcaactggcggacctggtccagcaggcccggctcggacacgatgcccgtggtgggctgtccgtcgctcagcaggatggcgcggctgacgcggtactcgcgcatgtggggccgcagggcgttggccgcggcgtcgagcgcgccgctgatgttggtgctgccgtcatcctgcagtccggagatgagggtcagcagctcctcgcgcgcctcctccgtcatccgccggctgggctgcacccgcacgtcggtgccgtagtcgatgaaggccagccggtcctcgggcttcaggcgctgcaccagctccgtggcggcgcgccgggcgtcggccagcttctggccgttcatggagccggagcggtccagcaccagcgccaggctgacgggcacccgctggccggtctccgccggacgcgccttcagctccatccacgcgaaggcctcgctgggccccgtctgcacgtacgcgccggacagcttgcccgccatgttcagggcgccgtcctccggcttggacgtcaccagcgtcagggtccgcgtggcgggcgggtcctccgggcgccgcaccgtgtggctggtgtccgtgacggcgggagggggtggtccgggcggcgtgggcggcgtgcccagcaggagcgcgcccacggcgagcactcccgtcgcggcgaccagcagcagtgagcggttcattcagggcctcgaggttggagggatgcggcacactcgcctggagtcacccgaggccgcatcggtcaccaggaggagggtccacccgttgcccgatacgacctccgctcgcgggctcaggcgtcgtgcgccggcagtcgctgccggacgagctcttccaccacgccgcggacacgggcttcgtcgaagggcttctccagcagcaggttggggatgctggccaggaagtcccgcgcgcccgaggtgaacgcgccgccggagacgaacacgaagcggcgctccagccccgcgtactcgcgccgcacggcctcgtacacgtcgcgccccgtcaggtccggcatcatcacgtcgcacagcaccgcgtccggtaccagcccgcgctccagcagctccagcgcctggcgcccgctgcacgccacgtccacctggtgctcgcggaggatgcgctgcaacacccggcccaccgcgggctcgtcatccaccaccagcacccggccgcgcggcgcgcgcggtgcttgtcgcgaatcaggctccgagggcttcgcgcgctccaccgtctccggcgtgggcagcaccacccggaagagggtgcctcgctccggctcgctgtccacggtgatgtcgccgcccagcccgctgatgatgctgtggcagatggacaggcccagccccgtgcccacgcccaccggcttggtggtgaagaaggggtcgaagatgcggtcgatgacctcacgcgcgatgcccacgcccgtgtccgccacctccaccaccacgcgcccggcgccgtccacccgcgtggccagccggatttcgtgccggtgcgccgcgccctccggaatggcctgcgccgcgttcaccacgaggttgaggaacacctggctgagcttgccctcgttggccatgacgggcgggatgtcgccgtagtcgcgccgcagttgcgcgcggtggcggatttcgttggccgccatcatcgccaccgactccagcaccgcgtgcacgtccagcggcgacacgcgctcctcgtccggccgggagaacgtcttgagctggcggacaatctgccgcacgcgctcggcgccttcacatgcctcttgcagcacctcctgccattcacccaggtccggctcgcccttgagccgcgcctggagcgccgccgcgccgtccccgggcggcaggctgcggctgaactcgtcggacaggaagcccaggttggacagcacgaaggccagcgggttgttgatttcgtgcgcgatgcccgccgccagcgtgcccaccgacgccagccggtccgccagcgtcagccgcgcctggagctggcgctgctccgtcacgtcgcgggcaatggaaaccaccgcgggctggccgtcgaagcgcagcggcaacgacaccacctccgccacgcgggtgcgcccgtccctgcgcaccagccgccgctcgccggtgagcgcgccggcccgcaccgcgtccgggctgcgcatgtcccgcacgaactccgtgagggggcggcccaccagctggtccgcgcgctcgaagcccagcgtggccaccagcgccgcgttggcgtagacaatctggttgtcccgttcgatggccgccgcgtccggcacgccctccagcagcgcgcggaagctcgcctccgacaaccgcagggcttcttccgcctgccggcgctcggtgatgtcgcgcgccagtccctccaccgccaccatgcgtccggaggcgtccgtcaccggcgccaccacgtgctccagccacagcgtccgcccgtcggggtggaggaagcgcaccaccaccggcgcgccctggaagggctctggcgcttccagcaactgctccatcagcgcgcggtcctcctcgtgcacgcgccggtaccacagctccgcgtccgcgtagtgcgccaccggcccgtagcccagcttggtgtgggccacgcggctgacgtaggcgaagccacgcggggcctcgcgccggtacacgtagaggacgtccgacgcgttctccgccagttgacggaagcgccgctcgcgctcgcgcagcgcccgctctgattcgcgccgctccagcgccatggagatggcgcccgccgccgccgacagcaggtccacctccagccggtcccaccgccgcgcctccgaggtgttgtcgaagcccacgaaccccgtcagcacgccgcgcacgcgcaggggcagcaccagcagggacaagatgccctgtgggtccagcagctcccgctccgacgcggggaagctcgccaccaggccctcgatgacgtcgccccgcgacagcgtctccgtccagcgccgcagcgcgggctccatgggcacgttctggaggtccgggttgtctatttcgggcttcacgccgggcgcgca

SEQ ID NO: 577 - DNA, 4320 bp, Myxococcus xanthus
cgctttacaggctcacgcttgcgctcactcgggcggctgcgcgacctggcgcgcgaacacgagaccacgctctacacggtgctggtcgccgcgttccaggcgctgctgcaccgctacaccggccaggacgacctcatcatcggatcgcccgcctcgggacgcacccgcgcccggctttcgggcctggtcgggtatttcaccaaccccctgcccctccgagcccgattcaccccgggcctgcgcttcgacaccttcctccagcaggtgcgcgccacggtgctcggtgcgctcgaacatcaggacatccctttccccgccctggtggagcaactccagcccaaacgcgatccagcccgctcccccatcttccaagcgatgctggtgcttcagaaatcccacgtgggcgcggacctcgggctggaagcgctcgcgctggatgaagccggagtcgtggtctcgctgggcgagcttgacctggaggcctggcccctgaaccggggcagcgctcagttcgacctcagcctcgcgcttgcggagacgcgcgaggggctctgcgcgtccatggagtacgacaccgccctcttcaaggccggcaccatcgacagaatgctcgggcatctgcgcgtcttgctggaagccgtcaccaccgcgcccaccctgcccatcgaccaggtgccgctgctcacggaggaggaacgcgcccagctcctggactggaacgcgacggcgcacgtctacgaggcgccactcacgctgcacggcctcttcgaagcccaggcggcccgaacacccgaggcggtcgcgctgtgcttcgagtcggagacgctcacctacggcgagctggaccgccgcgccaaccagctcgcgcaccacctgcgcgggctcggcgtcggccccgaacaccgcgtgggcgtgtgcctggagcgctcactcgaactcgtggtgtccttgctgggcgtgctcaaggcgggcggagcctacgtccccttggaccccagctatccccaggagcgtctggacttcatgctgcgtgacgcggcggtccgggtgctcctcacgcagcagcggctggcgaaggtgttcacggaggccgctgtcacgcgcgtgttcgtggacgcggacgagcgcgcgcccttccagcacgcggaatccccgcgccgctccgcatcctggagcgagtcactcgcctacgtcatctacacctcggggtccacggggcggcccaagggggccatgaacacccatgcgggcgtccgcaatcgcctgctctggatgcagtcggagtacggcttgagcgcggacgaccgcgtcctgcagaagacgccgctcagcttcgatgtttccgtctgggagttcttctggccgctgatgaccggagcgcggctggtgctggcgcggcctggaggacaccaggaccccgcctatttgaagcagctcatccaggacgaggccatcaccacggcgcacttcgttccctccatgatgcaggccttcctcgcggagtccgcggtggagcagtgcgcgagcctgcgccgcgtgttcagcagcggtgaggcgctctcgccggagctgcgcgaccacttcgtggcgcggctgccggagacacggctctacaacctgtacggccccaccgaggccgcggtggacgtgtccgcatgggactgccaccgctcgcttccctcccgcaccgtgcccattggccagcccgtggccaataccgcgttgtacgtcctcgacacgcggctcgcgcccctgcccgtgggcgttccaggagagctctacatcggcggcgtgcaggtgggccgtgggtacctgggccgcccggatttgaccgcggagcgcttcgtgccggatggcttcgcgcgcgaggaaggcatgcgcatgtaccggacgggtgaccgcgctcgcgtgctcccggacggcagcctcgagtacctgggccggctggaccaccaggtgaaggtgcgtggccatcgaatcgagctgggcgaaatcgaagccacgctggagcagcacccggcggtccagcaggcggtggtgctggcgcgcacggcagtgggggacgacgtccaattggtggcgttcatctcgcaccggggccacgcccccacgccagcaacgctccgggacttcctggccgaaaggctccctgggttcatggtgccgtcccacatcggcatcctcgctgaactgccgctcggccccagtggcaagcgggatcgcctcgcgctcgcgtccgtccaggtggaggcctcggacaacgggctggaatggatggccccccgcacgcccaccgagctgacggtggcccgcatctggagtgacgtcctcaagcgcgagcgcattggcgcgaacgatgacttcttccaactgggaggccactcactgctggccacccgggtcgtcgcccggcttcgcgccatcctgggcgtggaagtgccgcttcacaccttcttcgcggcccccaccgtggccgctttggcggagcggctccagtcctgccggagtggaggccccaagccgccccccctgcaccgtcgctccgagccgggccccgcgcccctgtccttcgcccaggagcggctatggctgttcgcccagatgacgggccccaccgccatctacaacatgcccagcgcggtgcggctgaagggcacgctcgatgtgccggcgctggagcgcgccctgggcgacgtcgtgcggcggcacgaagccctgcgcaccgtgccacgtgtcgaagccggcgccgagcccgtgcaggtggtgctgccggcggagcccctgacgatgccccgcgtggacctgcgggccatgccagaagaacagcgggaacccagggccgaagcactggcccgtgaagaggccgcgcttcccttcgacctcgaccagggcccgctcctccgcgcgcggctgctccagttggaggacacgcaccacatcctcctgctgaccctgcaccacagcgcctcggacggctggtccatgggcgtgttcgcgcgcgaggtaagccagctctacggcgcctttacccgtggcgagccatccggcctgccggagctcccggtgcagtacagcgactacgcgctctggcaacgccgctggctggagagcggcgagctcgagcgccagctgcgatactgggagcagcggttggatgcgctcccccgactccagctccgcacggaccggccccggcctacggtacagcgtcaccaggggcgcagccgccgcttcctgcttccccaaccgctggtggagcagctcgaggcgctcggccgagcggagggcgtcaccctcttcatggtcctgctcggcgtctacaacctcgtcctccatcgctattcgggacaggacgacatcgtggtgggaacggacgtggcccaccgcaacccgccggaggtcgaagggctgattggcttcttcaccaaccagttggtcttgcgcgcggacctgtccgcgaaccccaccgtccgtgagctgctcgcgcgcctgcgccaggtgacgctcgatgcgtacgagcatcaggacgtgcccttcgaacggctggtccgtgccctcaagtccgaacgggacgcggggtacgcgcccctgttccaggtgaagctggtcctccagaacgcgccgccgccgctgctcacgctgcagagcctccacacccacgtgatggacgtggagggtggcgagacggcccgctgggacctgctgctcgacttcagcccgggccccgaaggcctgtgggcccgggccgagtacaacaccgacctcttcgacgacgcgaccatcgttcggctgtgggagcatttcctgctcgccgcgcggagcgtgccgtcctcattggcccgccccatcgccacgctcccgctcctgctgccggcggagcaggaactcctcgcccgctggaacgacacggccaccggatacccccgcgacgccacgattcaggcgttgttcgaagcccacgccgcggcgactccggacgcggtggcgttgacgtgcgagcaccaccagctcacctatggcgcgctgaaccagcgggccaaccaggtcgcgcaccacctgcgggcgctcggcgtgagcgcaggagcccgggtagggctgtgcctcgaacgctcgttggacatggtggtggccctgctcggcatcctcaaggccggcggcgcctacctgccgctggacccgacgttcccccccgagcgactgggtttcctcgtccaggatgcgcgcatggcggcgctcgtcacccgttcgggtctggcggacgatctgcccgtccagtggattcccgtggtgagcctggacgaggacgcagcggcgctttag

SEQ ID NO: 578 - DNA, 4148 bp, Myxococcus xanthus
gtgctctaaagggaccggacggacttcgccaactcggagctggccgccggggtggaggaccgctggggcgcgcccgtcatccagcccgcgccgtccctgcgctacgtgcacagcggcaccatcttcaccgagctgaagccgctgcccttcgaccgccagcacgtcgaggtgcaggcgaagatgaactaccgtaagcgcgggctgcgctacttctccggcttcgatttcaccctcaacgccgactacgcggtggtcaaccgcgagagcaccgacatcgacgtggcgttcatcttccccatggagatggacaagtcgcaggtgctgctgtcggagctccagttcctggtcgacggcacggagtccagcctggacctgggcgagtccggcaaccggctggtgtggacgggccgcatcgccaagggcgccacgtcccgcttcaccatccgctaccgcgcccgggggctgaactcattcgtgtaccgcttggatccagcgctgcccgcgcgggacgtgcgcgtccacgtcgccgtcgaaggaggggagaactacgactacccgtcgggtgtgctggccgcgtcgtcggtgaacaccacggccgacgcggtgacgctggattgggccttccagtcgctggagtcgggagtgaacctgggcgtcatcctcccgtcggagaaaacgttcgacgcgctggtgggcacgatggcgacccgggcctgggtgcccttcctggggctgctcgcgctgctcgcggccctggggttgcgccaccgccgttcgctcgcgctccacgagacgtacctgctggcgtccgtgtacggcttcttcttcgtgctgctggcgtacctggcggccttcatgaacttctacgccgcctacgccgtctgcgcggtgggcctgggcgcggcggtggtggtgtacgtccgctggctcttcccgaaggagcggacgtccgtgctcgcggcgctgtggggcgccacgctggtggtccccaccggcgccgtcatcctccagggctacaccggcctcatctacacgctggagatcctcgccgcgctgctggggctgatggtgctctccacccgcgctggtgtgcgggccttcctctccgacttgtccctgccaggtgagcctccgcgcgccgccgtggctcccgctgcctccacccctgtcaccccggaagcgagctgattcctccatgtggaccgtaccgcttttcgttggactcctgctgaccgcggccgatggctcggccgccaagactccctccggcaccgccaccgtgccgcttcaggagctgattcccctctacgcgcagcgccagacggctcccgctgaagcacctccgatggaggcactggtgaagagccagctcaagggccggctcacggcggatgccctcttcgtggacggacacttcgacgtggaggtgctcgcggacggacgctggacgcaggtgcgcctgctccaactcgacgcggacacgtacccggccacgttgccctcgttggaggaaggcaccgtgggcgtcgtcgacgggtacctctgcctgctcacgcggaaggccgggcgctacgtcttcgacgtgggcgtctccatccgctcgcccggagcggggccggagcgccgggcccaactgcgcttcgggccccacgcgtccccggtgccgctggcgctggaggcggacacgtctgtcttcacgctcaccgagccgctggcttcgatgggaggcgagtctcacgccgtctatcccgtgcaaggcatgctgcgcgtcggctggcgcgcggcggtggctcgggtggcacaaagccagaagcagcaggtgcgcccgccgctcgagccgcgcatcaccgaggccaccgcgtcctgggtgtccacgctggaaggcagagccacgctgcgcgtcagctatgcgctgagcctggaccgcgagcagccgctggaactggtgctgccggaaggacaccggctggagcgcgtcaccctgaatgccattcccgtccccgtggagtcggagaacggccccctggcattgaaggtcgctccggcgcggctgggagagacgggcgggacgctggaggtggtgctgtcgcgagagctgggcgtgttccacctctccggccggttgaagctggcgttgccgcgagtctcctggccggtggcggagctccgcgcacgcgcgcacttccccgcggtgttcaactatcggcgcgagggcggcagcctggagcagtacgagtcgacggaatccgtggccgcgggggcgtcgggcctgcccgggaaggcgctgcacttccgccagttcctggtggccgcgtcctcgcccacgctggagctgggctactccgtggacatctccgacagctacttccgttgaagccggggcacgggcgccaccaccgcgaaggtggtgcccgtgtcggaaggaagcagctccaacctcgcgtggaaggcgcgcagcatggactgggcaatcgtcagccccaggcccgtgccgccgcgctcgcgggcagtggtgaagaaggcgtcgaagatgcgcgcacggttggactcggagatgcccttgccgcggtccttcaccaccacgcgcaccaggtccgcctccggggcctgctccaccgacaggtccacgcggacggtgtcgccaccgtgctggcgggcattggtgacgagctgccacagcacatcgtcgagcacttcctgcgggaggctcaccttcaggcccgcgggtggtgccgtcacatggatggccgtggcaccgtcggcgcgggcgcggagggcgagcccctccaacagcgggcccagctccacctgcgcgggcgtggccgtcatggagtccgcccgggccagctccagcaggcgctgcaccagtcgggtgagcctgcgggcatccgcgtccacgttggcgaggaatcgcgcgcgttgctcgggggacatcgcgtcggcgctgtcgcgcagcagctccaccgcgccttggatggaggccagcggcgtcttgaactcgtgcgacacgttggccgcgaaggaacggatgtactggttcctgtctcgcaacgcggtggccatgccggccagggattcggagagctcggccagctcggccaccacggggcgcgccatgggctcgaagcccgaagggtcgctcatggcgatggcgcgcgtctgcttcaccagcgcgcgcaccggccggcccaccagcgccgcggcggccagggacatcagcgccaccgcgccgagcaacacgaagccagtggcggtgaggttccaccggtccgcgtacgtcgccttggcgaacgtcatgggcgtgcgcgtcagcaccaccgcgccccagacgcgatcgccttccagcacgggcaacgccaccgtgacgcggatgccggtgtcgcggctgagcgacgccagcggggtgtcctcgggatcggcgacgcggcggcgcagcacgctgacgggctcgccgcgcagggcccgctggacctctgtgcggtccgccagcgtcgtccacagcagggcggagctgctgctggccacgaccacgccctcggtgtctaccacgcggatgccggccagcgtcgccgcacgcacctgttcgagcagcggcgtcagttgcagtccagccgcgtgtgacagcggctccgcgggaacacgtgaaggccgaggcgtgtcgcccggcggcagggatgcatccgaggccctgaccaacgggaggatggggcgcaggcgcgtgtcgtcgggaatggggaagggccagggagcggtgcgctcgcggccgtaggcgccctctggcacggtggcgcgcagccgctcgcggaagacctccgcgaccaccgcgccctgggcaatcagctccgactccgtctggcggatgagctggttgtcgtagacgcgcacgaaggcgagccccgccagcgtgagggcgaaccccgccacgcccacggcggcgaacaccagccacaagcgcgggcgcgcgcggcgctcaggggagggcgagccgatagccaaggccatgcaccgtctcgatgacgtctccgcccgcgctcgcgaacttctgccggacccggcgcacgtggctgtcgatggtccggtcgctgaccacgacatcgtcgtagacgcggttcatcagctcatcccgggtgaagaccttgccctgagag

SEQ ID NO: 579 - DNA, 3875 bp, Myxococcus xanthus
cgggaggacgggggcaggcctgacaaccgaccggcccctgaacggcaggcgggcggggcgcctggcggcttgccggggggcaatgccgacccgtgcatgagcggacatttccaacgccgggtttgtgctaccctggccgcccccttcgctcaccgccatgtcctcaatcgaccccaccgcgatcagccgtccgcgctcgccggacatcatcagcggctaccacctcgacaagcttgtcggcagcggaggcatgggggaggtccacaaggccacccagctctcgctaggccgcacggtggcggtgaagctcctcaatcccgagctggcgaaggacccgtccttcatcgcgcgcttccagaaggaagccgccgcgctcgccgccctgagccatccccacatcgtctccatcgtcgacaaggggaagacggacaccacgtactacctggtgatggagttcgtggacggcccgtcgctgcgggagctgattcgcgagccgcagttggacgtcatgggcgccctgcggcgcatgctgcagatctgccgcgccatcgagtacgcgcacggccgcggcgtcatccaccgggacctgaagccggagaacatcctgctggaccagcaggccggcggcatcgccaaggtgtcggacttcggcctggcgtcattcctggaggatgccagtccctcctcgcgctacgcgctcacgtccacgcacgtgtccatgggcacgctgtcgtacatggcgcccgagcagcgcgtggacgcgaagagcgcggacgcgcgcgcggacatcttctcgctgggcgtcatcctctacgagtggctcacgggcgaggtgccgctgggcacgttcgacccgccgtcgcggcgcaagccggggctggactcgcggctggacgccatcgtcacgcggtgcctcaagccggacccggaggaccgctacccctccgtcaccacgctcatcgcggacctggagctgctcgtcccgggcagcctgccgtcactggcgccggtgaagctgacgcacctccagcgcgtccgccagggtgtgcgcaaggtggtgcgcatggccctgcaggccgcggccgtgctgctggtggtggcggcgctgctccgtgctgggccgggagtggctgcgcagcggggagaagcccgtgccgccgcagcccggcgccgcgctgaacgcggacctgggcccgccatcgccccggtccatgcccggccggctggagacaggctccgagaagcgcacggtgtcggtgggtcacggcccggacgcgccgtcgctcctggtcgccggacggccggtggaggcggaggagaaggccatcatcttcccgcccgtggaggagcgctcgcagtcgcgcgtgggccgtgcccgcgtggacgtggtggggctggacggcgacatcgccgtgctcagcgcccgcgtgcgtgcggacgcgccgccggacacctggaagcgccgcgcctacgtcatgctctacgggccgtcgctgcaggcccccgcggccgcgctgctgctacagggcagcacgggccgctatgtggcgctcatccatgacggcgcgggcgcgccgctgcggctcgagtgggccctgggcgagcgccgcggcaccatgctgggcctggcgtcgccggagggcgaggccgcgctggagctgcgggtggacgcggacggcgtcatgcagggctacgtcggcaagggcaaggaccagcgggccattggcgagccgctcaacctggggccgggctggatggagcacttcggggacgcgcccgtgcccgccttcggctgcatcgaaggtacctgccgcgcggagggcttcctctacaccgtgcggcgcgcgccgcctccggggacgacggcgcccgtgcccgacgtgccggtggcgaaggccgtggtcgccgcggtgcccgccaagcggcctgctccgccgcctcccccgaagaagcagcccgctaaggcccccgtgaagagccctcccaagcggaggtagagcgtccggcagcacgcgccccggacattgcagcgcaggggaatatggccacggccgagggattgcactatccctggctcctcctatgcgcaccattcgactcggcttcgccgcgctcgcactcgtcacggccctcacgggctgccaccgttccacttccacggcgacaccgcgcgtcctcgaaaccgccgcggagcaggcgcagaagggcacccaacaggcccgcacgctcgcgttcgcgggcttccatgccttgctcgtcgcgggtgacgccttgctggcgcaacagcgcttcgatgacgccattgcccgcgacgcgggagatgtctacgcgctggccggtcagtcgctgatggcacgccgcgcgggccgtcccgaccgcgccctgacggcatccctggagctggtggcgcgcgcgcccacgcacccgctggcggccgtcgcggcgcgccacgtgctggactcggtgggcacgtcgcgggcgctggacgacgacatcctcctcggcgtggagcgagcgctggcggcgggcgcgacgggcgaggccgcctatctgatgcgcggcgcgcggatgtcggtggccgtggtgcgcggcgacgcggaggcccgcgacgcggcgatgcagcaactgggcggggtgagcgaagtctcgctggtggggcccttctcgcccttccacgtgctggcctgggacgaacgcacgcccgtgagtcagaatggctcgctggcgggccccctcaccggcgccttcggtccgctgccggtgcgcacggtgcgcgcccccgacgggcggatggacctgacgggcgagcccggccagggcgacctctacgtccaggccttcgacgcggacgtgacggagccgggcctctatgtggctcgcaccgtgagcggcacctcgcatcaggtgctgatggacggggctccgttgatggagcgccgggcctgggagcgcgccaccaccaccgtcaccgcgcgcgccgtgcagttgcccgcgggcaagcaccgcttcgtcgtgcgtcaaatcaagggcggcacctccggcctgctcaccttcgccctgctgcgcgtggacgggcgcccgtccggcgtgcgcttcagcgcggccaccggcgcggcgccgcaggcctggggcagcaaggtcgagttctccgacgagacgcccggcgtgttccccaccacggagggcttgaagacggccctgcacgaggaggccggtgagctgctggccgtcgtgctggcggtgcgggacggcctgcagcgggacgcggacggcgcgcggcggctgatggcctcggtggacgccaacaccccggccctgctgtggctgcgcgcggaagtcgcctccgcggaccgcaccgtgccgtccaaggtggcgcgcggccgggccacgcgtgacctggagtccgtgctggccaaggaccctggcaacgtggcggcgctgttgctgcgcgcggagctcttcctcgacgagggccagcccacctccgccatggacatgctgaagacggcgtccgaggtggcccagcccgccggtcacccggtgttcatgctgcgcgcccgcgccgcgctggcgctggaagtggaagccctggcggaggagtcactcaccgcggcgctggaggcccagcccggcctgtgcgaggcgctgacgctccagtacagcctggcccgccgccgtgacgcggcggagcggagcgacaccctggcggcgtccctgaatggctgcccggggacggtggtgcgccaggccgaacacgcgcgcacgcgcggcgacgtggagacggcgacgaagctgtacagcgagctccaatcccgcgaccccagcagcatcagcctggccaacacgctggccaacctttactgtccaagcgccgc

SEQ ID NO: 580 - DNA, 3784 bp, Myxococcus xanthus
cgtgctctaaagaatgaatgggacaacgcgggctgccccgcgaacggctgtgagaacaccacctgccgcaccaacccagcctgctgcagcgaggtgggtcaggacatcgtcattcccgtctccatgaacgcgttcgcgattcacgggctctgctacatgcccggctccggccgccccgtgcgccccggcgacctgacctgcatgcgggactttctcgatgacctgcccgcgctggacgccgcggccccgggcaacctccgcttcgacttcacgtcgggccggccgcgcagcctcatccaggtggagccacggacgggcctcgccaatgtgatggactgcaaccctcacgcatcgacccagaaccaggccatcgagtgcgtgaactgagcactgccggcacctgaagaggaccctcccccggacacatccgccggggagggttccacccaggcggcccgctacgccgccagcgcctcgcggcacttgaggcagacgtcgccgccctgccccaccgcttccgagtacgtccagcagcgcgggcacttctcgccgtgcgctgggagcacctcggccgtgacgcggacgccttcgccgaaggcctgcgccacttccaacgtctgcgccgcgtcacccttcacgtccgccagctccacctggctggtgatgaagaggcccggcagctcggccaggtgcgcctggaggaagtcgcgcgccgggccctctgccggcagcaccacccgcgcctccattgatgagcctatgcgtttgtcccgccgcgccgcctccagcacgccctgcaccgcgccgcgcaccgcgaagagcttcgcgtagcgctcggccaacgccgggtccaacttcgcggacaccaccggaaagccgcccaggaagacgctctccgccggcttgcccggcagcgtctgccacgcctcctccgccgtgaagctcatcaccggcgccaggaggcgcagcagcaccgaggccacctcgtacagcaccgtctgcgcgccgcgccggggctgcccgtccgcgcgccacgtgtagagccggtccttgaggatgtcgaagtacaccgccgacaagtcgccggcgacgaagtccaccaccgtcgcgtagacgaggtggaactcgtagtcctcgtacgccttgcgcacccgcgccaccacctccgccagccgccccaacgcccagcggtccaacggcagcagctccacctccggcaccgcgtgcttcgccgggtcgaagtcgtagaggttgctcagcgcgtagcggacggtgttgcgaatcttccggtagccttccgacaggcccttcagaatctggtccgacaggcgcacgtcattgcggtagtcgctggccgccacccacaggcgcagcacctccgcgccgtactgctggatgaccttgtccggcgccaccacgttgccgcggctcttggacatcttctcgccctggccatccaccacgaagccgtgcgtgaggcaggccttgtacggcgacatgtcgcgcgtgcccaccgccaccagcatggacgaatggaaccagccgcgatgctggtcactgccctccaggaagaggtccgccggaatccgctgccgcttctccagcaccgcggagaacatgcacgccgagtcgaaccacacgtcgaggatgtccgtctcgcggcggaactcccccttgccgcagcgcgggcattggaaatccgcgcccaggaactccttcaccggcgtgcggtaccacacgcccacgccctctttctccaccgccgccgccacccgctccatcaactccggcgacaccacggcttcctcgcagccctcgcagtaggcgatgcagatgggcacgccccacgtccgctggcggctgatggtccagtccggccgcgtctccagcatgccgcggattcggctgtgcccccacgagggcacccactgcaccttgtccacctgctccagcaccacctgccggaacgtctgcgtcccatggaagggcgcgtccatggggatgaaccactggtacgtcgcgctcaggatgaccggattgcggcagcgccagcagtgcggatacgtgtgcgccaccgtgtccgtggcgccgttgagcagcgcgcccttctccaccagcaactggatgacgacggggttcgcctcgaacacacgccggccttccagcgccggccccaccgtgtcgtcgtagcggccgtccggacgcacgggattgtagatgtccaacccgtacttcaggccgacctcgtagtcctcctggccgtgccccggcgcggtgtgcaccaggcccgtaccggcatccagcgtcacgtgctcgcccaggatgacgcggccccggcgctcgtagaacgggtgctggtacgtcaggtgctccagctcctcgccgcgcgcgtacgcgaggatgcgcgacgggtccaccaacgccgccgcggagacttcaccgccgggcagctccacgtgcttcaccgccagctcgtccgccttcacctccgccagcaccttgggcaagagctcccgtgcgacgcagatgacgcgcgtgccgagctggtagaagacgtactcgaactccggattgacggagacggccaggttggacggcagcgtccacggcgtggtcgtccagatgacgaaggccacgtccttgcccttcagcgaaggcacgcgctcggccagctccgccccggcctggaaggccacgtacacggagggcgaggtgtggttctcgtactccacctccgcttccgccagcgctgtctggtcgtacagacaccagtacacgggcttcttgcggcggtagagcatgccccgcttcgcgaacgtggccagctcgcgaatctcctgggcctcgtaggtgaagtcgagcgtcttgtacggctgctcccacgagccgaacacgcccaggcgctggaactccgccttctggatgtcgacgaactccagcgcataggcgcggcacgcctccaagaaggcgtcgcgagccagcgtgcgcttatcgattttcttgtccttcagccgcttctcgacggcctgctcaatcggaagcccatgcgtgtcccagccggggatgaagtcacaccggcggccggacatgttccggtacttcaccacgatgtccttgaggaccttgttgagcgcgtggcccgcgtgcaggtggccgttggcgtagggcggaccgtcgggcaggacgaagggctccgcgtccgcgttctgctccagaatcttcccccaaatcccccgctccgcccaccagccgagcatgcgcggctcgagctgcgccaggtttcccttcatggggaaatccgtgcgcggcaggttgaccgagtccttgaagtccttgtccttcgggggtgtgtcgctcatgtcgacagcggccgtaacacgcggcccccagggcttcaatgcgctcaatccccacgctatgctggacagctaggcaaggaggaacctgtcagcccctccgcccaacaccactgcgaggactgacgatgaagaactttggactgatgctcttcccactgacggtcctgctcctggcaggctccgtcgagggcgcgtcgcccatcccgggagcagaggcgccggtcagcattggccagaccagcgacacctcgtccgtcaaggacgaggatgggaatgacatcgagctgcccaagcacgatgccaagcaaactctatgcatcgggaagtgtcaggagcctgtctcgaagcgcatcagcggatgtgaagggggagaccgtaaatgccagctgcgctgtgcgcacaccatggagcgctgcgcccgaaag

SEQ ID NO: 581 - DNA, 2917 bp, Myxococcus xanthus
ctctacagaaagcgcccagaacgagccccgcgaggacatctgccgcgcgatgagccgctcctgcgactcctgctcctccgtcatctcgaccttcctgcactgcgggcgtttgggaggcaggtccttgagggcctccgccttctctcgccgcagcaaggtgcagcccggagagggatagtccaggcgttggcgcagggtttcgatggcctcctctccctggtgttcctctcggaacgccgcacgcgtgccgaagacacggggttgccggcactgaagcgcgtcgtagatggcccagacgtcgagcaactcgttctccaccggcgtgcccgtcaggccgaccgcgaatgagcgcttcaacgcgcgggcggcgcgcgagcgcagggtgtctgggttcttgaggttgtgcgcctcgtcgaacacgacgacgtcaaagtccaccttcagcaacgagcgttgataggcccccagcgtctcgtagttggtcagcaccaggtcctgccgcgacaggaaggcgccgttcagttctccgtcacgtttgacggcctccaaaccggcaccatggagaatgaagggctcccaggtggactcgacgaagaaacgctccagttcctggcgccagttctccagcaggatggtcgggcacacgacgagctgaggcttcagccgcgttccaggaggaagctgttcatggagcgtcatgcgccgcagcgtgaggaagcaggcaacctggagtgtcttgcccaggcccatgtcgtccgccagcaggacaccaggcgtcgcttcccgcgcgcggcgccacagccattcaattccctgtcgctggtgaagcttgagctcgacgcccgtcaccatcacggaacgcagcaactcccaaggcacggggtcatcgatgccggattgcgctgagccagtggccgatgcggccagctcacgcaccctgacggcttcaatggacttcttgggcttggatgaagacgcagagtctccaccggagggagcagccgtcccaggctcaggctccgacagacgaagcgccgtcgtcaactgacgccgcaggtcctcccccggtgcgatgcgagcccccgccacggtgagcggctccgtgctacctcgtgccagcgcagcctcgttcgcggcgtagagctccgcggcggtctcccgcgaatccagccgcaagggcacggcgtcacgaccgtccggcgaagcaactcgcaacgtgaacgagaatccgcgctccctgtcacctgggtcaatccattcgagccccgagccttcgacgcccacagcgggctcgcgtcctcgctggacctcgaagccgaggacgcgttcggagtagagcgagaggtcgaggatggcgtccgcattcaccccctcgggaatgatgaccgtggggtcctccatctcccgttggacgtccgccgcgaggcggtgctggaggggccggacgttctccaggattctctcagcgccttcggggagaaccaggggccgccgggcgtcatcccccgcgattccacccgcctgaaggctcccgagcggcaatgccgtctgcctcccatcgggatgaatcgcgtaggggtgcagcgagacgacttccgtcgcctccgggtcctgctcccagcgcaatcccacgcgggcaacaggttgcggctgatagcggctcaggtatccccgtgcggtgtactggacacggacggccaatcgccgagagacatcctccaggacgccgcgaatccgaatgacacgcgcgagctgttccttccggggtgcatgggttgccagtctggcctccacgcaagcccaggcggcagccggccccagcaggatgggctcaccgcgctcggacgaatcaacgaaccaggggatgggattgggcgcatcggggagcagctcgcccgcgatccggacccgataccgggcacccgccccgccagggacgcccacgacctcacagccgatgtcctgctgttcgagcccgaccaggtccatcaggaggtgctggaggaccgcccattcttcatgaagcgactcacgctcctcttcatccagccctccatccacgggccggcccaatgcagcccattcgctctgggaaaagcggagctggtgcccatcgagccacccgcgctccctccactcggcctcacgcagaccgacgcggaaggcgagttctgtaggcaggtcctgcagggagatacgtaactggcccgcgtcgatggaccagcgctgaagcgtcccacgcggattggacgtcagtgactcgggagacggcattgggatggcccccgcaagcgtcattgcttgcacgcgcgaataagaatcaggccttccgcacagacgcactaccaccgcagggtgatggccaaaacgcggaaactgttcatccccagccgcccactgtattcacgggcagcgcggcatggcgtcgtgcctcactcagccgtgccgggcatccgccgacgcggaatctacctccggcatccggaacgacagacagtaataaaacggcgccacctgctcctcggtgacgtcgaacgctcccggaggcagcagctcccgggggctgtgtggatcccacgagtagaacgtcatcgcgcggaacgcggcgcgctggaacagcgagggccggaaggccgggtccatctgctcgtccacgaccaccagcggcgtgcccggcttcgccacgcgcgccatctccgccagggcccgctcgggtgcccggtagccgccaatgcctcccacgtgaaacacccggtcgaacgacgcatccgggaacggcagcgcgtgcgcatccgccatcatcagtcgcacgcccgcacagtctccggaccgcaaccgccgcttgcagtgcttgagcatgccctcgctcaggtccacgccccacacctccacgtcgagccccggcggcaggccttta

SEQ ID NO: 582 - DNA, 3964 bp, Myxococcus xanthus
ttgcccacttgcgcacacaccatgaccgctgatgtggctgaaacgagttgtgaccttaacatgtcgatggggcgcgcccccgggccaatggaggagccgcaccggttctgtccctggcaggccgggtttgcctgccgcgtgtagatgacggacttcgccagttcatacatgaacgcggtggcggtgccgctgcccacggtgcgctggctgacggcggtgaacgtcgtcgcggaggtggcatccgagtagagcgtggcgacggtgcgcgtgccggtgacgacggtgcgcttgtccgcgagcccgtggtactgcatcgtctccgcggtgatgcccgtgcccggggcctgggtgtcgttgaccaggatgtagccattggcctgcgtgccctgagaggcattgagcccgagcagcgactggaggttcgccgcgggccgcagggcgatgaggcttccgccagcggtgacccagtgggtgatgagcgtcacttgggccgcgctcagcgtctgctcgccgagcaccagcactttgtagtcatcaagggagacggagacgcccaggttgccggcgtcggtggtggcgaaggcggcgatgccctcggcctccaggatttcgcgaaggtagtcggtgaaggggttgccgggagcagtggccaccagcacggggcccgcgccgtggacgcccggacggggcggcggtccgtaggtctcgaagacgacgtccacccagtagttggagttctggtggctgccgttggggaacgtggaggtggaggcataggcgaagacgccgttgccgcctgatgtggtggcgccaggcagggcgtgcagcggaggggcatccactccggtggccaggccgttgctgtcgaacgagtagccgccgagcggcgcgaagtacgacgccacgtaggtggtgccggcggtgatggcgacgggagaggagaacgtcacctcctgccagccgacggccgtttcgttggtgaaggtggcggaggcgagcggctggcccgtggcgctccacagattgcccacgtgggtgccgttgttgccgctgcccttgtagaagcgcacgcccgtcacctgtccgtccacatccgagcggaacttcacgcccacttcgatggcggcggtgtcagaagcggtggcggtgccgggcgtagcggtgggggcgaagatgcggaaggtgttgtccgggggctgtgtcgggggcggtgcgccggtggcctggaagacgacgtccacccagtaattggagttgccgaagctgttgatggggaaggagcccgcggcgccgtaggtgaagacgccgttgccgccgctggtgctgccgggcagcgcgaagaggggcggggtgtcctggccgctggcgaggccaccgttgtcgaaggcgtacgagccgacgggggcgtggtacgaggcgacgtaggtggtgttggcggcgatggcgacaggggtggagaacgtcacctcctgccagccggtggccgtctcggaggtgaaggtggcgaaggccaggcgctgcccgttggcgctccagagacttcccacgtgggtgccggtgttggcggcgcccttgtagaagcgcacgcccagaacgttgccgctcacgttcgtcttgaacttcacgcccagctccacggggtcggagtcattggtgacggaggcgactgcgggcatggcggtgacaggccacagggtgacgggctccgccgggcggaagacgacgtccacccagtagttggagtcgccgaagctggtgctggggaaggagcccgcggcgccgtaggtgaagacgccgttgccgccgctggtggcgcccgcgagcgcatggaggggaggggcgtccacggccgaggccagtcccgcgctggtgaagccgtaggcgccgccaggcgcgtggtacgaggcgacgtacgtggtgttggcactgatgcgcacgggcgtggagaacatcacctcctgccagccggtggccgtctcggacgtgaaggtggcgaaggcgaggcgcgcgccagcggcactccagagacttcccacgtgggtgccggtgttggcggggcccttgtagaagcggatgccgaggatgtctccctcgatgtcggactggaacttcacgcccaactccaccggggcgaagtcattggtgacagaggggacggccggggtggaggtgggggcgaacagcgtgtacgtcggctgggcgcgcgcggcggtgggcagcgcgagcaagacggccgcgagcagcgccagcgcgtgggcgcgtggcggcctcgcgacccagttgggccgtggcttcgaaggtgtcattcggacttttccttggggggatggcacgacgagacagagcagcggcggcatcttgctgtctgtccctgacgtggacaatgacgcgagacgtaggtccgcgagtcattgccgcatgccgcgatttttggcttcctggcggtcagactgttccggtgtctgttgtcctcggtcgtgatgggggccttgatgcactgcatggcgttgcattgacgcatccatattgcagcgaccaggttggggaagcgcagatgcgctgcggctggtatgaagggggatgttccattttttagcaacgagggttgtccagctcgacgaaatcaaggtccgcttcgaggccgcgaacgaagcggagaccttcggctggttcgtcgagcacttcgagcggattcaggatcgcgcccagcagcagaatcagcccgctgtcgagatccatctggcgactgggctcgtgcgtgccgacacgctcgcccctgcgtctccgtggattctcgttgtcgatggagatctcgaggtagcgagtgacatcgacctgtcgacccagccttacgacatcagtttgttcgtggtgctcggcagcgtgcattcgaagaacctgcgcttcagcggaagcgcgtgctgctacgtgacgaagtcggtcgagcttgcgggcggctgcttcggagatcacggcgacgaggcggccgaactccacaccatccgtctgaaggcgcgcgtattgatgctcgacggcaacaccggagtgaacgctcagcatctcgatgcggtggtgttcgcaagcaagggctggggcctgcctcgacacttcaccgacgatgacgtgaccgcagatttcttcgtcgccgaggcgctggacgaggacggtggaattgacgagggtgcggtgtgggagttgatgacgagcgggaaggacccgtttcagcccggagcactggcggcgctcagcgcgaggcgcgtcgatgccgagacgcgactcaagcctcaatgagtcgtgccgaagctccgcaacgcgttgtcggcgagctgatcgcggcccaagctcggcctctccgtctcgggaggcgacaacacggcccggccggtcagccgaggcggcaaccttcctgacacagggggcatcagagcgccgcgaagatgtcgccgagggtggcgagcatcgacttcgagtcccgcacctggaacgtcgccgcctggacgctcgcggattcgatgcggtcgacgcggagcatgcgcaccgctccgcgcaggtggtcccagacgagcaggtaccacgcgggccagctcagcagcaggtagtgcggctccacgatgcgcaccgtgcgcacgtcgttcgagcggtacgtcagctccagggcgtgctgctcgaagaaggactcctggaggggacgtagcaccgccgctcggggaggcttccaggtcgcggtgacgttccgtgaagtggggccgacgaggatgcgacggcgcagcttgccgacgcgtgcgcgctcctccggtgggaacgaggcggcgagcttttgacgcaggctcttgagtgtcgagagcaggagcggagactcgagtcgctcggcgagcgccagggcgagcaggaggtcaagcagctcctgggcgctgagctgcacgcgcccgagccccgttcggggcggtacccgaatgccgccgcc

SEQ ID NO: 583 - DNA, 4019 bp, Myxococcus xanthus
ctctacgggagatgtccgcgtcctcgatggggagcagcgcgggcatgtactccacgatggaggtcttgctgcccacgtggttgaacacggaggcgaactcacagcccaccgcgccggcgcccagcacgatgatgctcttggggacgcggtcgatctgcaggatggagtcgctgttcagcacccgcttgtggtccacggggacgttgggcagggacttgggcaccgagcccgtggcgaggatgatgttcttcgcctccaggacctgcttggagccgtccgcggcggtgacctccaccttgcccttgccggcgatgcggccgtggcccttcaccaccgtcaccttgttcttcttcatcaagaagtcgatgccgttggcacccttggtgacaatcttgtccttgtgcttcatcgcgttgggccagttgatggccgggctgctcacgtcaacgccgaagtcagccgcttcgcggacatggtggaacagctccgcggtccacagcagggacttggtcgggatgcagccgcggtggaggcaggtgccgcccagccgcttgtccttctcgatgatggccgtcttcaggcccagctgacccgcgcgaatggcgcccacgtagccgccggggcccgaaccgatgatcaccacgtcgaacgtctcagccacgcacgcctccgtaattattgcggatggaacccgggtgggctgataacccccggtcccggttggaatcaaggagtttgctcgtgcgccgtttcccgctccgaaccctcctcttgatgttcgtagcactcatcgccttcgggcgcctgtggtgtgtgacgcaccaggaggaagcgcccagtccacggcccgggcgcatggcccaggcgggtaacgccccggccggggcccccgacccctcctccgcccccgagtgccggacgctggaacgggccctcgaaagcgccctccgcacgccccaggacacccgggtcctggacgaagcgcgccagcagctcgacgcatgccgtcagccgcccgttcgcgcctgcgcgctgggcgtggccctggacgcccggtcgcccttatccgagggagaagccacaccgctgcgtggcctgctggccagcctgtgtgagcactgcccgccggccgccaattcgtgcgcccgggccgtggggcaggccctgctgaatgccgcggtggggccgaatgccgatgtcgcgagcgcgaaatggaacctggagcatgcggggccaggcctgggaggggcttgtgcctcgctcgtccagttggggctcgcacccgcagcccagtcagacctcaccgtacgacccccggtgctcgcactcgccggggagctggcgcctcactgctcgcaggcaggcttcctagatgacgcgctgctgcgcgccgccgctgtgaacctcgtggcgcccacgcccgcgctcgtcgccctggccgcggtgcccattcctcccgagacgagcgccatgaagccggaccggattgaaggcaccgagcccagcttccaggcgttcgaccgggacgaggacaccggggttccggtcggcaaggcgctcaagaccaagcgatgggaggcggacggcgcgctgcgcgcgagctacgcgcccacgctgaagcagctcgtatcggtgaggatccgcgccacgggcccgggaacggtgcgcgccatcgtccggacgcagcagggcgtgggcttgaaggacccggagaaggacttcgccttcgtcaaccccaccgtgtgccgtttcaccggcacgggtcagtgggagcagtgcccgctccaggtgccgctgcgcgacgtggacgccgtgagcgtcttccccgagcgcgcggacaccgaactgaaggagctggaggtccacggcgcccgctgaaggcgccgccgaccgacgtcaggcgacgaggccgcgctccttggccagtgtgaagagtggcgcggcgtccttcttcagcaccgcgctcacgtccttgacgatggagtcacccgacttcgcgaccgacaggaagttgtcgaaggtgcgcgtgaggatgagcacgccggagatgatgacgcgctgaaggttgtgctgcaggtccgtgccttcatagatgagccacgcctgctccacgcaggtgcggcgggcatccatgaggaactggttgaggacggtgcgctcgttcgcgtcgggcaccttcgacttcgagctcaccgaccccacgtagatgaggttcgtgttgagccgcgccgcagcttcctgcatctgcgccagcaccagcgtcacgtcctccttggtcggaggattctcccagcgggagaagatgactcggtcgatgatctccgctttgtaggtagggccgttcacgatgcctccggtgaggcgagcgcctgaccggcacccgcccggcttgccacgctgccgtgcggtcggatctgtagcaggaacactccattcgttgaagtgcacgacacctgaaccggcattcatttggcccggcaacacagtcctgtcctgcagcggaaacggacaaatccacttggaccgacacggacactcagggaaaacacgtatacgcccgcgtcatctccaggattcaccggttcctgtcgtacagcggacatgcgcggcggatcagcgcgaagcgcgcctggcgaggactgccttcacgtcgtcgagcgagaggcccaggggccggaccgcgacgagcacgtggtagagcacgtccgccgcttcctccgcggcgcgtgacgggtccacgtccgcgcacgccgtcaccaactccgcggcctcctcgcccagcttcttcaagcgcaggttgcggtcctccagcaggcggcgtgtgtagctgggaggcgcatcatcgggccgctccgctggtgcggcgcgccgagcgagcgtgtcatccagcgcgctcagtgcatcccaacggcccgggccgaagcaggtcttcgtccccaggtgacacgcagggcccgccttcgccacgcgcgcgagcaccgcgtcaccgtcacagtcggcgcggagcgccaccacgcgctggacgtttccactggtggcgcccttgtgccacgggccgcgcgtgcgcgaccggtagtgcatctcccccgtggccagcgtgcgctccagggcttcccggtcggcatgcgccaccatcaacacgtcaccggtgctcgcgtcctgcgtgacgaccgtcaccagtccgttgcccttcgcgaagtcgagcgcgtccaggtcgagcatcagcgtgtctccacggcgccgagccgctcccgcaccacgcgcgccatggccgcgttggtggcgattccatttccgccgaacgcggtccgccgccccgtccagtcggtgaacacaccgccggcctcctcgatgatgggctgcaaggccgctccatcccagggggacagcagctcatccaccatgacctccgcgcgcccggtggcgaccaacaggtagccgtagcaatccccccaggtgcggtccacggccgcatcccgcgcgagcgagcgccaggcggccccgcgctccgggtacaccgggaagcgctcatccgtggacagcaccacggcctgggacagctccgcctgcgtggacaccgccgcgcgctggtcgttccagaagcagccccgccccggcgcggccaccagcaactcactcaccgcggggaagtacgcggcccccacgaggatgcgctcgccctccgccagcgccaccaacgtgccccacagtgggacaccgcggatgaacgtcttcgtcccgtcaatgggatccagaatccaccggcgcttcgcgcccggacgtgtctcgccgaactcctcgcccaggatgccgtcctgggggaagcgcgcttccagccactcgcgcgcacgggactccgccgtgcggtccgccaccgtcaccggagagccgtccgacttcgtgtccaccgcgatgccaccgcggaagaaccccaacgccgcgtcacccgctatccgcgccacctcggcggcgggctgcatcagattacccgagtccgtcatgtcaggctccgaatgtga

SEQ ID NO: 584 - DNA, 6424 bp, Myxococcus xanthus
gcaccagctcgttgaacgcgaggcccgccttggcgcgctcgccataccccagccagcagatgcgcgagggcaggccctggaacgccacgcgctcctcggccatgttcagccagcgctggagcgaggccttctgggggaacagctcgcgcaccacgcggtcggtgacgcggatgtcctccgggtcacccgagagcgccacccagcggaagggccccatgccctcgcagaagaggggacggatgtaggcggggacgaagccggggaactcgaaggcgttctccatgccgcccagctccgcctggccgcgcaggttgttgccgtagtcgaagacgtggctgccggccttctggaagtcgttcatcgcctgcacgtgcatcatcatcgactcgcgcgcgcggcggacgtacgtctccggatcccgctggcgcagctcggcggcggcctccagcgacaggtccgtggggatgtagccgttgagcgggtcatgggcgctcgtctggtccgtgacgaggtccggcttgatgccacggcggtacagctcgcggaacaccgacgccgcgttgccgatgacggcgatggagcggcccacgcgcttctcctgggcgtccttcaccagggccagcgcctcatccaggtccttggcgacgacgtccaggtagcgcgtctccacgcggcggcgagcgcgcgtggggtcgatctccacgccgaggaacaccgcgttgttcatggtggcggccagcggctgcgcgccacccatgccacccagaccgccggagaggatgaggcggcccgccaggtcgtcggtgccgaagtggaagcggccggcggcggctaaggtctcgtaggtgccctggaggatgccctgcgtgccgatgtatatccacgagcccgcggtcatctggccgtacatcatcaggcccttcttctccagctcgtgaaaatgctcccagttggcccagcggcccacgaggttggagttggcgatgagcacgcgcggcgcgtccgggtgcgtgcggaagatgcccacgggcttgccggactggacgagcagggtctcatcgtcgcccaggttctggaggctcgacacgatgcggtcgaaggagggccagtcgcgggcggccttgccggtgccgccgtagacgacgaggtcctcggggcgctcggcgacgtccgggtcgaggttgttcatcaacatccggagcgcggcctcctggacccagcccttgcaggacagggtggaaccgtggggggcgcggatgacgcgggacatgaacggactcctagcgtgtggcggacggaaaggcccggcacactacctgaaccggggtgcttccgggccaccgcgatatccgcgtcgcgccgcgtcgcgtccgccgcctcacgaatgcagcgtgtcgtcgtcggaggcgtccatgcccggagtctggacggggctgcgtgacgcgggccggtccacgacgccgtcctcgcggtcgatgcgaatgtcgttgatgacctccttcactcccagcacgtcccgggcgagcgcttccgtcgcgtgccgttcatcctggctgcgcaccacgccggccagcagcaccacgccgtcccgcacgcggatgtccacgtcctcggcgtccacccagctctgcatcagcccgtcgcagaggtccgccaggattcgctcactggagcgccggtagcctcgcggcgcgcgtccccggggtggcgtccgcacagggccttcggaccggtagcgcccacccgagaagccgccttgccccaggtcgtggtcgtccgaccgtgacggactggtggagtacccatcccacggtggcgccatgttctccacaccggggccatggcccgcaggctgtgtgcccccgtagcggacatccgtttcggccatgtggccggcggcgcgccagggccggccccggtccgtgccgcccgcttcccgtcggcggcgctcgtggacgtcttcggcgcctcggtggccatggcgcctcccgccgtgttcccggcgctctggcatctcacggccgccccggcgtcctccctccgtccccacgtcctccaggacgccgaggtagggaggctccaggcgccagtcctccgcgacttcgcggaacgtgccgctggggctgtagccgggccgtctggcgatgtgctccgggtcgaagtgccgggcgcggcggtccagctcccggtccaggttgaagtcgcggccatactcccggccctggtccagggcgcgcgcggcgcgtccgaagtccacgtcttgttggtaatcgcgtgtgtcccggtccctcgcggcgtcccggaagtgccgctcgctgtcgaaggagcgtggaaacgcatcatcctcggaggcccaaccgcctcggcggtggtggccccggtgcggaccgccccgacgttgctcggcgccggcgtcgtcccgctcgaagtcgcccctgcgttcggacccgcgctcgtcaccgtgctcatccctgtccggggcgcgggcccaggtgcccctcggttgggtgtgttcgtcctcccagcccctcgagggccgctgctcccgttccctgtctccccatcgccggtcgtcatcgcgcctgccgttcatctggatggcctcctctcgttgagcgttcgcccagggcctgtctcctgacgttctggaccgcgagcgctgctggcaacgcaggcaggccccgtcagaggctcggccgggcatgggggccccggaggtggccgctgtatgccgggggaggcgccagtcgttccatgagcattcccgcgcggccagagcgcggtagagtccacagtcgcgaccggccagccagccagccgcgcgatgcctggagggagtgccatggacgacgggagccggaacgcacaggggcctggcgcgcgagcgtcgtccgcgctcacgaaggcaacgccctgcgcccagcctcccgaggaggcccgtggcccctccgtggggcccatcgcgacggtggcgggcggcctccccgccgtcatctccgccatgcggcacgtctacggtgaaatggacgtggtgcgcgggacgaagctgctgctcaaggtgaaccagaaggagggcttcgactgccccggctgcgcgtggcccgacccgggacaccgctccatggcggagttctgtgagaacggcgccaaggcggtggcggaagaggccatgtccgcgcgggcgacgccggagttcttccgtcgatggagcgtggcggacctcgccctccagacggaccattggctgggcaagcagggccggctgacgcacccgatggtgcttcgcgaaggcgccacgcactacgagcccctgtcctgggacgaagccttcgcgctggtggccgaggaactgaacgcgctcgacacgccagacgccgcgagtttctacacctccgggcgtacgagcaacgaggcggcgttcctctaccagctcttcgtgcggcagttcggcaccaacaacctgccggactgctcgaacatgtgtcacgagtcgagcggctccgcgctcaatgagacggtgggcatcggcaagggcactgtcacgctggaggacttcgaccaggcggatgccatcttcgtcatcgggcagaacccggggacgaaccatccgcgcatgttgtcgtcgctcgaggccgccgcgcgacggggctgccagattgtcagcatcaacccgctgccggagacggggctcaaccgcttcaagcacccgcaggacgtgctgcacctcatcgggcccggaacggcgctcaactccctgttcgttcaggtccgcatcaacggcgacgccgcgctgctgcagggcatcgccaaggcgctgttcgagatggaggacgcgaaccctggctcggtggtggccaagggcttcatcgacgacaagacgctcggcttcgaggcctacgcggcccacatgcgcgcggtgaagtgggaggacgtggaggaggggagtggggtgccgcgcgcgcaggtgctcgcggcggcggaaatcctcgcgcgctccgagcgcaccatcttctgctgggccatggggctgacgcagcaccgcaacggcgtggcgtgcattcaggaaatcgtcaacctgacgctgctgcgcggcgctatcggcaagccgggcgcgggcctgtgcccggtgcgcggtcacagcaacgtgcagggcgaccgcacgatgggcatctgggagaagccgcccgaggccctgttgacggcgctgtcccgggagttcgggttcgagccgccgcggcaccacggcatggacgtggtggacacgctgcacgccatgcacgacggccgggtgaaggtgttcttcgcgctcggtggcaacttcctctccgccacgccggacacggagttcaccgccgaggccctgcgccgcacgcgcctcaccgtccacgtgtccaccaagctcaaccgctcgcacctggtccacggacggcgggcgctcatcctgccgtgtctgggccgcaccgagcgcgacgtgcaggccggcggggcccagttcgtcaccgtggagaactccatgggcgtggtgtcgtcttcgcggggctcggtggcgcccgcgtcggagcacctgctcagcgaacccgtcatcgtcgcccggctggcgacggcggtgctgggggcgcgctctcgcgtgccctggctgtcgctggtggaggactacgaccgcatccgtgagcagatttcgcgcgtcatccccggcttcgatgacttcaatcgccgcgtgcgggagccgggcggcttcgcgctgccgaatggtccgcgtgagggacgcttcaccacgaagagtggcaaggctcacttcacggtgcatgcgctacagcccattgccctggagccgggacagctcctgatgatgacgattcgcacgcatgaccagttcaacacgacggtgtacgggctggatgaccgctaccgcggcatccgcaatggccgccgggtggtgttgctgcatcccgcctacatgaaggcgcaggggctggcggctgaccagcttgtcgacctgcggagccacttcgaaggcgagacgcggctggcgcgtggcttccgcgtggtgccgtacaacatcccgcgcaggtgcgcggccacctacttccccgaggccaacgtcctcgtccccgtgaacagcttcgcggagaagagccgcacgcccacgtcgaagtcggtggtcatcagcatcaccccggccggagaagcgcgggccctgcccgctggcgcggtggcatgaggcgcgtgagagagcatgcagcccgtcaatgaaaccgggtggccggagtcgctccggcccctctatgagacggtgacggggacgcccgcggcggaggccatggccgcgtccacccagtggcgcgagtccttcgcggcctgggtgcgaggcgcttcgctggatgagcgcaccctggcgcaagcggcggcctggagccggctggacgagggcgagcggaccctcggcgagctgttgttcctgctctcctcatgcagtgagttgctgtggccttatgccgtgccgccccggggcctgctgccgcgcttgatggcgcggcaggagacgatgctggctgcgttgcaggaggtgggggacgtggacacggccgcgcgggtgcggcgtgagacggaagccaccgtcaccacggtactgacgcgcatcctgaagcggcacccggacgcgctccagtccctcgtcggcgacgcgccgtgtaccttcgacggccgggccctgcgcttccacggcgcggtggaggtggacctgcgtcaggtgttgggcaccggcgcgaagtccgtcgcgctgctggagcaactgcgcgcgctgatgccggcgacggctgcggacgggcgcgaccggttggcggagttcatccggacgcgggccgcgcggctgccgtggcgggaagcttcggaggtcctggccgagcggctcttctcgctggcgacgtcgccggagggccgcagcggcatgagtggcttcctggcgtgctaccccggtggacgcaaggagccggactggtgcgctcgggcggggctcttgctgtcgcgcacgctggaggtcggcggtcctcccgaagtggtggagaacctgtgcgagctgctggcgcgcttcgatgcgccgccggtggacggcctgcgcggggcgctgggcgctttggtgaacggcgacttcgaggcctcggcggacctgggccccgtgcgcttcgtgctcgaccactgccaggccacgctgcgcaagggcgagccgggtctggtgctcacgctgttgtggctggaggagcggttgttccgtgccgccgtgcgcaagggcgcgccagatgcctttgaccgccgcaagcgcgcgctgtcgaagctcaagccgggggcgccgggattcgaccagctccactggttggcggaagaatgtgccgagctgtggcctcgcttcatgctgtagagcacatag

SEQ ID NO: 585 - DNA, 4705 bp, Myxococcus xanthus
tgcgagagctgggggcgctgggccctcggccgacgtacctccgcgcggatgccgcggacgaaggcgcgctgcgagaggcctaccggaagattcgggagcagcactccgccatccatggcgtcgtgcactcggccatcgtattgagggaccagagcctggcggcgatggacgaggaccgcttccgcgcgagcctggccgccaaggtggagaccagcatccacatggcccgggtgttccagcaggagccgctggacttcatcgtgttcttctcatccatcaacagcttcacgaaggcgccggggcagagcaactatgcggccgggtgcaccttcgttgacgcgctggcctcgcacctggcgcagacatcgcggtgcgcggtcaagacgctcaactggggctattggggcaacgtgggcatcgtggccacggaggagtatcgccgccggatggagcagttcggcatcggctccctggctcccgccgaggcgatgaaggcgctggaaacccatctgtgctcgccgctggagcaggtggggatgctgaagaccacccggcccgcagcgctggctggcgtcagcacagatgaccggctcagtgttcagcgtggccctgcgcgcgcgtcactcgtcgcatcggcgacccggggcgccgccgcccgcgccgcgggaatcgcggagacgaaggccgcggtggggctcgaggcagaacggctggcggcggtcgagtcgcttctggtggacctgctggccgcccagttgcatgacatggggcccggtgtggcctccagccatcgccactggttcaccgaaagcatggccatcctggcgcgtcgtggctacgtggccgctgacggcacccgcttcctcgaaggaaaggtgccggaccgggaacaggcgtgggcacggtggacgcagtcgagcgccgagtggcggcaggtacccacgttgcgagccgtcgtcgggctgctcgaaccggcactgcgggcgctccctgacatcatcaccggcaagcgccgcaccacggacgtgatgttcccgggcggccggatgacgctggtcgaggacctctacaagcacaaccccgtctccgacttcttcaaccaggcgacgtcggcggccgtcgcggactgcgtcgccgagcgcgtgcggagcgcgccttccgccgggcttcgagtgctcgaaatcggcgcgggcacgggcagcacgacggcctcggtgctggcggcgctggcgccataccggacgcacgtcgcggagtattgcttcacggacgtgtcgaaggccttcctgctgcacgcgcgagaagcctatggcgcggcccatccgttcatgcggttccagttgttcgacgtgtcacgtccgctggcggagcaggacctggagcagggcgcctacgacatcgtgattgccagcaacgtgattcacgccacgaccgatgtccgggagagcctgcggaacgcaaaggcggcgctggcccagggtggcgtgctggcactcaacgaactcacggccaacacgttgatggcgcacctcacgttcgggttgctcgacgggtggtgggcgttcgcggacaaggcctcgcggctgctaggcggtccggcgctctctccttcgctgtggaagcgcgcactggagcgcgagggctaccgctcggtcgcgttccccgtggaggacgcgcatcacctggggcagcagattgtcctcgcggagagtgacggcatcgtccggcagcctcgggccgctcggacgaaggcactcgcagggcggggggaagacgcgcgtcacaccgtcgccgcgccggccgtcgcgtcgccgaagtccacgggcctgtcggggggcgagctgcggaccgtcgtccgggactgcctggccgcgtgcgtggagatggcgccagcggcggttgcgaacgaccgcaggttcaccgaatacggcgtggactccatcatcgccgtcaagctgatcaacgcgattggccagcggctgggcctggtgctggagaccacgctgctgttcgaccacggcaccgtcgacgagctcgcggacgcgctggtggcccggtatggcgctcagctccaggtgtcgcgtcccctggcgaagaaggcggcgcccgcgccgcagcctgaggttcccgcggcgctggggctcacgccctccgccgaggcgcccctggtgtgcagggtgctgttggagcggccggggcaggcggatgacatcaaacgcatcatgaacaccgcgcagccgctggaagaccgcgaggtccgtgtggcggtgagggcgttctcgctcaacttcggcgacctgctgtgcatcaagggcctctatcccacgatgcctccctatcccttcaccccgggcttcgaggcgagcggcgtggtggtggagataggggcggcggtgcgctcgctcaagccgggagacgcggtggtcgccggcatgggagagatgctgggcgcgcatgccacgtccatcgtgtgctccgagtcgcgggtgttcctcaagcccgcgaacctgagcttcgaggaagcgtgcgcgttgcccgccgtgtcgctcaccatgattgacgccttcaagaaggcggacctccagccgggcgagcgcatcctgattcagacggccacgggcggcacgggcttgattgccgtccagctcgcgcagcttcagggcgcggagatcttcgccaccgcgggctcggccgagaagctcgagtacttgaagcgtctgggcgtccatcactgcatcaactacctcgaggaggatttcgaggcggcggtgaagcaactcacccatggcgagggggtggacgtggtcatcaacaccctgtcggggaccgccatccagaagggcgtgaggtgtctgcggccgggaggcaggtacatcgagctggcgatgaccgcgctcaagtccgagaagtcgttcgacttgtccgtgctcaatgacaatcagactttcttcagtctcgacctgagaaagctggcgagctcgcggccggatgtcattgcccggcatcaacatgagttcgtcagactggtggaggagggcaagctccgggcgaccattcaccgcacgttccccttcagcgacgtgcagagcgcgtacaaggccctggaggaccggaagaacatcgggaagattgtcgtcaccatcgactcgccgcatctggatacacaggacgtgagcgcgcctgccgcggtgggccgttcgacggagcccctggaccttggcgcgttcacccgcttccaggaactggtccgtctcaacggcagcaccgagggccggcccatcttctggttccacgcgagcatggctggcgtcgaggtctaccgcgccctgtcccaggagatccgccgtcccttcctggggattcaagcgcgcggctggatgagccaagaggcgcccatcgccggcatcgaggccatggcgtcctactacgtggacatcctcctggcggcccagcccgaggggccctatgagctggggggctactccctgggcggaatgctggcctacgaggtgactcgccagttgcaggaacgcggggcgcgggtggcttccatcgtcatgctggatgcacccgacagcacccatctggatgtgttccagttctcacggcgcacggcgacgttccaggcggtcaacacggccctgttctcctccattgcccatcacccggaacggctggagcagacgctcatccaccgcgatgaggtggaggcggacctggatgacacggctctgctgcgccagctgatggggctcgcgcagtcgcgaggcctgagcaaggacgagaaccaggtgcgtttcatggtcgagcagaacgctcgggtccatgcggcgtacgacgtgggccggttccggctcaagcccctgcttcgtccggaggaggtggcggtgttctatctgcgcaatggcagttgcagcttcttcggcaacctggagccgtatctcaccctgacgcccggcgagttgacgttcgacggaaccaactactgggcggagtgggaacggttcctgccccggatgcagattctggaagtcgcttcgtcaaaccatctcatgttgctcgcggagcccgctgttcaacgggtgattgccggattctgtgcccggttctacgggaaatagatgttacgaaagggcgttcgaagtgaagaagacactggttcaggttcaggcggcggtgacgcggtcggtgggcatcgtcatccacaaagtggtgccatcattccgtctggcggtcgcccggttccaatacaacatggcgtcgaagatgtactcacaccagggctacaagttcatcaactgtggctacgcggacatggagggcgaccacaaggcggtggatttcaaccggccggagaatgtgtatgtgttgtgggaaagcctgtaccagcgcgtggtggggcaggcggagctttccggtcgcgaagtgctggaggtcggctgcggccgcggcggtggcagtgaatacctgatgacgcggctgaagcctcgctcactgacggcggtggacctctccgacgtggccatcgcgcgctgcaaggagaactaccggctggacgggctgtccttccaggtgggcaatgcctgcgcgctcccgttcgaggacaggcgcttcgacgtggtggtgaatatcgagtcgtcgcactgctacccctcgcagttgacgttcttcgaggaggtcaagcgggtgctcaagcccgggggcg

SEQ ID NO: 586 - DNA, 3751 bp, Myxococcus xanthus
gcgctctaacgccgcaccgagccgtcctcgtcccgaagctgtacgggctctccgggctgcggcgtgccttccatggagacgatgtcttcccggcgcagccatggcgcgccatggcggagtcggcgggcggcgtcgcgggacagataggtgctgagcacgatgggttctcctctcaccgcgacccgagggcaccggcgcccggggcgtgctgccaggggagaacatggggtgctggcctgcggatggctgcccgtcccggagcgccacgtcggggggcagccgggcgggcgggcccgtgcgccgtcgccccgtcgcttcagcctccgctgggcgtgcgcttgaaggccttggtggtgacctggaagagcagggagctggccaccagtgccaggacgatgccgataccgcgcagccgcaattcgtcgcggaacaccagggacagggccagcgcgctcagcagcaccacggccgcgacgcgaagcacctggccccgctgcaatgcccccgagcgcgcgggtttcgcccgggcaagaacggggatgctcgccgccttgcgccaggtggtcgcggtctcctcccggacttcgtcctccgcgtccaccagcccctggacgtaggcccgctccacatccagcaggctggggtagaccagctcgccctccggcgtccgcacgacgtatcccatgagccctcctcccggccgtccgtcaggacagttcggtggcaatctgctcagcgacgcgcagtccatcaacggcggacgaaacgatgccgcccgcgtagccgcagccctcgcccgccgggtagaggcccttcatggacaccgactgcaggtcctcgccgcgggtgacgcgcaccggtgaggacgtgcggctctcgatgccgatgagcttgccctcctcgctgatgaagccgcgcatcttccgctcgaaggtgcgcagggcttgcttcagtgactcggtgagccgcgccgggaagagttggttgaggtccgtgtgcgccaggccgggacggtagctggtgccgcccgggtccttcttcacgcgcccggccaggtagtcaggaatcgtctgggccggcgcgtagaagcggcctccgcccagctcatacgccttgctctcccagtgacgctggaactccaggcccgccagcggcccgcggaagccctcgcgctcgaagtccgccacggacacggacacgacgatgcccgagttggcgtagcgcgcgttgcgccgcgagttgctcatgccgttggtgcactggagtccgtcctgcgtgggcgtgggcaccacgatgccgccggggcacatgcagaacgagaagacgccgcgcacctcgccgtccacctccaggttctccgccagcttgtagtccgccgggggcaggcgcggattcttggccgcgttgccgtactggatgctgttgatgagcgtctgcgggtgctcggcgcggaagcccagggcgaagggcttggcctccacaatcacccggccgtcggcggcgaagcgctcgtaaagctcgcgcgcggagttgccgggagccaggatgacacggttgctctccagcgtgcgtccgtcggacagcttcacgcccgcgatgtggccgtccttgtagagcaggtcgtccacgcgcgtgctgaagtggacctcgcagccgccagcgatgagctcctcacgcagcttcgccaccgcaccgggcagcaggtccgagccgatgtgcggcttgccctcgatgaggatgtggtccggcgcgccgtaacgggcgaaggcctcgatgaccttgcgcaccatggggtggttgatgcgcgtggacagcttgccgtccgtgtacgcgcccgcgccgccctcgccgaagttcatgttgctttcggggtccagcgtcccgtcgcgcatgagcttcgccacgtccttgcggcgcgacaccacctcgcggcctcgctccagcaggatgctgcgaacgccgcgctccagcaggcccagcgcggcgaagagccccgcggggcccgtgccgatgatgatgggccactgctccggcgccttcaccgggcccagcgcttcgggaggagggggcgtctcacccacgtccggtggcagcttcgccggcttcttgccccgggccagctccacctccagcgtgtagatgtagcgcgggctgcccttcttccgcgcgtccagcacggagcgcaccacccgcacggacgcgaggtcggagcgggtgacgcccaacttctccgcggcgcgctgaccgagcagctcctctggctcgtccagccacagcccgatgttgttcacccgatacgccatcgcatccgctcctggtggggcgcgtatctcgccgccctgttgaaagattgcaagcccttgaaatccgggtgcgaacccgctgatgcacccccccacgccaatcccccgtaccgccgaggactgcgcaagcgcgttcgcactgccctccagggccgttcggggccctggtctacttcaacccttgggaaatgttgaggaatccgtgaggaagagaacggctggcacgagggttgaaacagggctgtctcgtgattaggcggcgtcgctccttcccggccgcgttctttatggaggcactgaccttgagcaccgatcaaaagggcacccggatcctggcgcgcacgttcttcaaccagttgcgcgcgagcggctacaccccgcaccaggtgattggcatcgccacggagctgctcgagctggtgacggcggacatcaaggaaggcgacaaggcgacggccgtccaggcggcgcaggagcaggccccggagcgtcgcccgcacgcctgaggttctcagcgggttctccccgcgggcgcgtgggctccggacgggtttccggggcgcccgcccgcgtgtggaggcagcgaggtggtgaaaggaccggccttggccggtcttttcgtttcggctgatgaatgagtcaggcgcggggcgccctctgctcccgcctccgctggtacgcagccgcgccggcgacaaagagcagacccgcggtgagggcgctgaagacgctactggccgtctgcgtggcctggagcgccatcagcacgccgcccgcggtgaaggcagccacatccacccacgcgggacggcgctgcggcaacaccagcaccaggatgcaggccgtcagcggcagacccagcgccacctggcggatgatggcgtcggtgctcgtgcgcaccgtgtcccagttgtgcaccaggatggcggcgaagatgaccaccgtgcccagcgcgagcaccagcacgcccgcggcggccgcgtccttggccagccgggccttctcgtcgaactgctggacggccaggtccaccaggtgttccagcgcgctgttgaggatttcggcgaagaagatgagcaggacgcagaagatgagcgtcaccttctccgcgagccccagagggataccgctgcccaccagccccaccagcacggcggcgatgaggtggacgcgcatgttgcgctggtagatgacggtgtggatgagccccgcccacgcgtgaccgaacgaggcgagcagccccgaaccgtgacggggggggaaggatgagggtggccggggaggtgcgttcatcgatggcgaaagcgcgggggaggctaacacccgcgggacggattgccccttcgtcgtgaaggggtatggtccgaccctgtgaatgccccttcctaccctcttcgtgtccgtctgggtggcgcactgctcgcgctgttgttgacttgagagcacac

SEQ ID NO: 587 - DNA, 3793 bp, Myxococcus xanthus
ctctcaagactccggctccgtcgcggcggcaactccgtcctccgcggccacggcctgggcctcgaccgccggttgcgactgcttcgccgcgtgggcgggccgcgaatcccagccgtccttcaccgaatagcccttggccttgttctgctcgggctgccgcgcgtcctcgcgccggttcgtctcattccggaggccgcgggcggcgtcccctcccgacacgcgcgattcccgctgggagcttcttgaagacgaagagcgatcgattccagtcatggcaagtcctcactgagtccggggaaattcgactaacagtgcggagcctgccacccacatcacccttcatcaagccgcagtgcgtgatttagccagaattcaacctacacccgccattcgtaacaaagctgtaacacccgccgcccccaccaccacgacgacgaagggcagcctccgccacgccagcacggcgccagcgagcacccccgccggacgtgcccagcccgagaagcccccgttcgacgtcagcgtggccgtggccaccagcgcggtgagcagcgcaatcgcggagagggacagcaggccctggacccgcgcggacacctgcatgcgctggctcagcagcgggcccgcgagccggaaggcataggtgcccgccgccagaaccaggatggggagcagcgtcatcgcagcaccagcccgagcgccagcagcgagagcagcacgggaacccctgtgggaagaatcggcgtggtggcgagcgcgatgagcgccgcgccccccgccacccagcgcgcccgggcagccgccgcgcgggcttcgtgggcgcgtgctgtctcgacctccccctccgcggtaccgggctcggcgttcggaggcttggcgggggcggtcagcgacggcagcagcagcgccagcaacccggcgggaaacgcggcatcgagccccatcgcctccgggctgcccagcgccgttcccgccagggcgccgacgaggacgcccacattccaggccacgaacagcgccccaccgcacagccagtacgccgccttccgacgctccggcgtggactgcgcgagcgcgaacgccacggactcgtccaccatcaagtgcgtgccaatcagccgcacgagccagtgccttccaagcacgtccgaaatcaccagaccgaacggcaggtgcctcgcgttgagcagcagccccgcgatgaccgcggccacgggactgccaccgcccgccaccacccccacggccatgaactgcgaaccgcccgcgaagacgaacacggacatggccgacgcgacccacaccgacaatcccgacgccaccgagatggcaccgaacgaagccccgatgacgctagaggcggcggcaatcgccgcgacatcccgaaccagacttcgatccacatgccccatggccatggcgcgcatccatgaaacgaaggcacgggccggtcaacgacgaacaccggcgcggacctcgaggcccctgccttcgagccggcaagcccccgcgtacgcgctgcgcccacccaacggtacatttctactgcccgtcgcctcccaccgccgcctcggagtgaagcgaagagcaaccgggcttcaagtgacccacccacgctgtactcgacgatattttcaggggctgaacgtgcccacgggacgtgggagagtcagcggtgatgagtacgggctccatccttggcatcgacttcgggaccaccaacaccgccgcggccttcttcgacaaggccggcaagcttcgtgtcgttccggtgacggacaagagcgtcacgctgccctccgtcgtctggttccacgcggcggacaaggccatcgttggccacgccgcgcgccggcaaatcattgacgaccctcgccacaccgtcttcggcgccaagcgcttcctgggccgccgcttccagtccgagtacgtcacccagcacaaggacaagtacgccttcgggctcgtcgaggccgaggacggctacacggccgtgacgatgtacgggaagcagacgtcgctgacggacgtggcgcacctcatcatcaagcagattcacacgttggcgaaccacgccgccggcacgcccttccgcgagtgcgtgctcaccgtgcccgcgcacgccagcagtcgccagcgcgcggcggtgcgccatgccgcggagcaggccggcctccaggtgcgcgccatcatcaacgagcccaccgccgccgcgctctactacgccaacctgcgcaaccccgagcagacggtgatggtgttcgacctgggcggcggcaccttcgacgccaccctgctcgcggtgcagaacaaggtggtgaaggtgctggccaccggcggtgatgccttcctgggcggcgccaacttcgacgagcgcatcgtggagatgctggtgaacgacttccagcagaagcacggcatcgacctgcgcgggaacaaggtggtgatgcagcggctcgtcttcgccgctgagtccgcgaagatggcgctgagccagcgcgacgccacggtgctccgcgtgccgtgcatcgcccagaaggacggcggcttcatcgacttcgactacacgctcacccgcaagcgcctggaggagatggccttccagctcatcgagcgcaccgcatccgcctgcgacgacgtgctagagcgcgcgaagctgaaggcagaccagattgacgagctggtcctcgtcggcggccagacgcgcatgcccgccatccgccagcgcttctcccacttcaagcgcatgtcctccgacaaggaggtcaacccggagctcggcgtcgcggtgggcgcggccatcctcggccggaacctggcgcgcggcatcaccggcctggcggacgtggtgcccatgcccatcagcatcatggtccccggcggcgcgcagcacgaggtcatccccgccaacacccccgtgcccgcgacgaagtccgtgacgatggagctgccgatgattcccgggccgctctccatcgccctcttcgaggcgctggacaccaccaccgtggaccgcgagctgctgggcaccgtccgcgtcgagttggactggcgcaccacctacaagggccccaccacgctggagctccgcatgggtcaggacttcgtcctcagcgccgcgctcgtctcccctcagggcgcccggcatccgctggccatcagcgacatgcgcgcacccaagcgctccgcgtaacgcagcgtgacgcacgtcgccgtgcgaagatgctcgggcaacctgggaggtacacagcatggtgggtaagtccgcggtgggtttgacgttgatccgcgtggtgttcggtctctcgttggcgctggggcacggcctgcccaagctcaccggcgacatgagcaagttcgcggcgggcgtggcgcagctcggattcccgtttccgacgttcttcgcctggtgcgccacgttggctgagttcctgggcgggctgctggtggccgtgggcctcttcacgcgtccggcggcggcaatggcgggcttcaccatggcagtggccctctaccggcaccgcgcggaccccttcggccgcatggaaatggcgctgctctacctcgccgtcatggccggaatcgcgctcatcggcgcggggccgtggagcctcgacgcgaaagtccgccgtcgcgcctgagtcacgcgaatcaggcgggcacgcgttccacacactccggggtgtcgttggcaggggagttcaccacgcgcgacacctggtagacgttcagcgccttctcggcgcaaggcaccagcagcgggagcaggacccaagactcctgcgggtccgga

SEQ ID NO: 588 - DNA, 3197 bp, Myxococcus xanthus
ccacggtggcacctaccaggggatgattctcttcgcgctgccgggctcgcccaaggccgtacggctcgcgctggaggcgctcatcctccctgagctgggccacgccgtgcgtgagctgtcgcgatagcgtccgctccgcgcttgtctcaatccatgagaatggctgaggccggcgtgtttcgttgcgaggagtgtcccctgttttcgccggaagtgtaagttaacggtgaaggcggggatttctctccctgccatctcaaccgcacgtccccgcctggcagtggagaaacgtatgtatatgaagcgcctcgcttcagtcctcctggtgctctgtagtgtctcggcgttcgcgaaggcgcccccggcgaaggctcccgaccgcgaggtgtggatcaccctcggctccgatgccctcgaacacgtgaacgccgctttcgccaacgccggacatgcggcgccatcgatgagagggcagacggcggacgtcaccgcgctacgcgtgcgtgagtcccagctcaacctcatctcgcgaatgatgcacgagaagctcaaccgctgcggtggcttcatctaccacgacactgaagcggccgcgctcaccgccctggacccgtcggtcgcggcgaaggccgccaaggccaccgccgtcacgtacagcctggacaacgcgtcgacggtcaacgcgttgcaagcgggggttcaggagctggccatccgatgggtcatcgaccacctgtccagctacgcgacgcgttactacacgtcgacgacgggcgtggcgtcagccaactggctgaagggccattgggagtcgctggttccgccggcgcgctccgacgttaccgttgaactcttcaaccacgcctcgtgggcgcagccttccgtcatcttgacgattaccggcaccaccctgtcggaagaggtcgtcgtgctcggtggccacctggactccaccagcaacggcagcacggctcccggcgcggacgacgatgcatcgggaatcgccacgctcaccgaggtgattcgcgtggccatgctccagaactaccgcccggagcgcaccgtgaagttcatggcctacgcggccgaggaagtgggcctgcgcggctcttcggcaatcgccaccaagtacgcggcggatgcagtcgacgtggtgggcgtgctccagctcgacatgacgaactacaacctgcggtcgaacatcgacgtggccttggtgagcgaccggacgaacgcggcgcaaaacacgttcgtcaccaacctcatcgacacgtatcagcccgaactcgaatggaccacgacgacgtgcggctacgcgtgctcggaccatgcgtcatggacgagcgcgggcttcgcggcctcgatgcccttcgaggcgccgctgagcgcgtccaacccgtacatccacaccgtcaatgacacgctccacaacagcgggggcgatgcccgtcacgcgctcaagttcgcgaagctggccgccgcgtacgtggcggagctggcgaagggtggggtgacgattgacgagacgccgccggaggtcgccatcaccgcccctgccgccggaagcacggtggctggagttacgaccgttacggtctcggccacggatgcttccggtgtgaaccgcgtggagttcttcgtggacggcgaactgaaggcgacggacaccacggcgccgtacgcgttcgactgggacacggccgcggtgcccaatggcagccacatcgtgacggcgcgggcggttgacctcgtgggcgtcgcggcgaccagcgccggggtgtccgtgacggtgagcaacgcgaccagtacggctggattcgattctgtcctgagggcgccgcggtgtgcctcggcctccaacgcgtgtgattccggtacgctgctcaatggccgcggcggcttcgtcgggcccgaggtgaacgcgccgaacaccatcaagaactcctgcagggacggcttgtcgggtgcgcacctggttgaccagtcgaacgagcgcatcgtggtgtccacgctggacgggacgaacttcgcgccgggcaagttggtgcgcgtcgatgcaacggtcttcgcctacaacaagctcaacgacaagttggacctgttctacgcggccgacgccaacaaccctgtctggcagctcatcaccacgatgcccgttccgtccaagggcctccacacgctgtccgccacctacacgctgccggagggcgacgccgcccaggccgtgcgagcggtcttccgcaaccgcggaagcacggcgccttgcgtggaaggcaactacaacgaccacgacgacctcatcttcgccgcgcagccgtccgcgctgctgcgctgacgctcctggtgcgtcgggtccccaggcttcgttgttgtctgggcctggggacctctgacggagcgcgcaccttgagtcgccccaagcgcgtcgatagggtgcgcgcatgcgaaccgtggatgagtggaaggcggcactgcgcgctgcattgaaggaggccatgcgcacgcggagcccgcaggcttcagcggtgcttcgcgagctgctcgcggccatcgacaacgcggaagcgccggacatgcgcgtggcgcccaccgccgtgggtgacgtgttcgccggaagcgctggtgggctggggcatggcgaagtgccccggctggccttgactccggaggccgtgcaggccgtcatcgaccgcgagcttcaagagcggcgtgacgcggtggccctctacgagaagctcggcaagcaggacgaggcgagtgccgtgaaggcccagttggatgtgctcctggcgctatgaggcgcgaaggcgcacgaatgcccgcggcgagcatcgggaagacgggcgggccgcttgccgttcctggaccatgtgggaccgcctgacgtgacacctcgctcgaagagacgcaccgccccggtcgttggactctcgcctcgagccgccgagcacctccggccacggctggaggccgtgctgacgtccaccgacgcgcgcgcccgcatcgccttcgatccggtggagttcccgcaccgctaccaggacccacgagacatcgaggtcagcgcgctgctggcggccgggttggcgtacggccgcgcggacctgttccgtcccaaggtggacgcactgctgcgccgcatggggccgtctcccgccgctttcgtcacggcccttggcgtagcgggcgcgcgggcg

SEQ ID NO: 589 - DNA, 3432 bp, Myxococcus xanthus
ggggcgctccgcctacaagcgcgccggtggccgcgtggaagaggcgcaccacgctgtccttgcccgcggtggccacgcgcgtgccatccggggagaaggccacgccctccacgtcgaactcgtaggggttgatggccgggtccgccagcatcgtcggctcggcggagcccagctcccacacggagaggaagtaggacttgctgcccaggcgcgagtacgccacccgggcgccttggggcgcgaaggccaggccccagatgaagtccttgttgttgaggacggccttgcgcccaaggcccgaggcgctaccggacacccaggtgcccggctccgactccagccgggcgctcagctccggggacacccgaggaggcgcgtgtgcacagccaccaccccctaccgccaccaccccgcccgccagcagtgcgaacgcccccctcgcgaacttcatgtccctgagcctcctgacgccgaggcggccttctgccgctccttctcgacgttgatttccgtgacgcccttgttgtcgatggacaacaggaacagctgcttcaccgcctcgcgcttcgcgttgaaggacgtgcgcccggtggccccgtcgaagtccttcaggttggccatcgcgtcacgcatctgcgcgcgggtgcgcggtgcatccttctgctccatgagctgccgcaacatccgaccggagtcgtagccaatggcctccagcagacccgggtcccgccccgtctccgcccggtaggcctcgcggtactgctccacgaagcggcgcgtggccggacgctgcgagtccacgaagaagccgtccacgaacaccgagcaggtgacgaacttgccgccgcgctccaccagctccggcagccccgagcggcccttggggctgctccactggttggcgccgaagagcgtcaccgtcttcagctccttcttgcccgtcgtcttgcggatgcgctccaaatcacgcgggtcacacgcgttggtgacgatgtcctccaccgccagcgcgggcgccaccaggctgacgcggcgccagtcgtccggcatgaagatggcgtcgaagtcgatgatgggctccacgccgctcttcaccttctccatcgccttgcggcggcggaaggcgtccaggttctccccctgcacgtcgcgcacgccctcgatgtagtcgccgcggtcatccaggtagtagcggcccaccagcttcttggcctcggtggtgaaggtcgtctggtcgtgcgaatagcgctccgccccgcgcacgccgccgccccgcgccaccacctggtcccagaaggcatccgccagctccacgccgtaggggatgttcgggtacagcagcgcgaagcgcttgtagcccttcacgttcatcgcgtagtcggcgatggcctccgcctgcgccgcgttggtgagcatgttgcggaagacgtagctgcccagctcggtgatgccgtcctgccggctcatggtcagcagcggcacctggagctcctcggccaccagcgccgcgcgcttcgagtcatccgccagcaggggccccaacacggcgatggcgccgtcgtcgaaggccagttgctccatggcctggcccgtcttgttgacgtcgccctgcgtgtccttcaccaccagctccacgccgctgccttccagccccagctggatgccgcgcagcaccgcctcgccaatgggctggtagcggccccgtcatgggcagcagcacgcccaccgtgcgggggcgggcctccacccggcgcgtggcgcgggccagcagctcgcgggcctgcggcgcgaaggcgtggccgggcgcctgggcgaggaaacggttcagcgtctcctccagccgcgtccagtcccgcaggtggtagtagacgcgcgccaacttgaaggtgatgacgggccacgccgggttggacggcgacaggccctccgccacgcgggcgatgtccacgaagcccgcgcggccctccaccagcgcctccaccttggccaccgcggcggcctgcgcctgagcgccctgggcctggcccgcctcgtccaccgcaatctgcagcgcctgcccgtagaggccggcgccctccgcggcgcgagcggcctcgttgagcagttgggtgcgctcggcgccactggcgcgctcggcgaggctggagagcgtctggtacgcgtcgcggtaggcgcccacctccatcgcggagacggccagcttgtgcttggcgtcatccgcccgcgaatggagcgggttctcgaagagcagctcgttgaagctcttgcgcgcgttgacgaagtccttggactcgaagaagaggacgccggcctgatagagcgcgtcctggcccgcggtggtggcgggatacgccttgcgcaccgacaggtaggcctccgcggccttcttcttgtccggggtggcgcgggccgtctgggatgcctgcgccagcgccgcgtcggcggtggggtccttcttcgcctccaccgaaggacgcgtggggaacgggtctcccgaaggcaggtccccgccggtgtcacctccggagggcgtgcgggtggaccgggggcaggccgtcagcagcagggccagggcgatgacgagcgagcggcgcagggtgggcaggacatccatggcaggggcgtgcatagcagtggggtgcgcccccgtcgacacccgagcggggggaagattccactgccaggaaccgctgttttgcagtgcccgtgcccgcggcggcctgccgcgccgcggcgcccgcctgcccaccaggcgcggcacggaggccgcgctttcgcggccccgcgcccgcaaccgtcgtcagccgaacagctccttcaccttggcgatgaagctcttcgactgcgggtgcgactcctcgccggaggcctccgcgaacttctccagcagctcgcgctgcttcgacgacagctcggtgggcgtctccaccacgacgcgcacgtgctggtctccccgctgctggctgtgcaggtgggggatgcccttgcccttgagccggaacaccttgccggactgggtgccgttggggacggtcatcttcaccttgccgtccagcgtggggacgtcgattttcgcgcccagcgccgcctgcgtgaaggagatgggcacctcgcagaagacctcgtactcctcgcgctggaagagcgggtgctccttcacgatgacggtgacgtagaggtcacccggcggaccgccccggtctccaggctcgcccatgccggacagccgcacgcgcgtgccgttgtccacgccgcccgggatggccacctcgatgacctcctcggagggcaccttgcccgagcccttgcaacgcgtgcacgggtccggcaccaccgcgcccgtgccgccgcagtcaccacagggccgggacaccgcgaagaagccctgggtgtagcgcagctcgccgctgcccgccgacgccgagcagggcc

SEQ ID NO: 590 - DNA, 4169 bp, Myxococcus xanthus
  unsure (1)..(4169): unsure at all n locations
aggggcaggtgactttatgggattccgagctcgcgagagggggaccgagcgccttcgcggtgcgcgcaggctaccataggcgtttccagcccggaaagaacgcgcacgagtaggttgaagcgcaccctcccgggcaagcgggcgagggcccccgccttccaccggtcagcactccacgttcgattcgccgttcccggagtggaaggtggtagacccgcccctcaatggaacccattgtcatcctgggcgcgggcctcgcgggcctctccaccgcccacttcctgaacaagccctggcgcctcatcgagaagtccgaccgtgtcggcggcctcatcaagaccgaggtcatccaggggtgttattttgaccccaccggtcactggctccacctgcgcgacccggaaatccaggccctggtgaacacgctgtggctgccggagcagatggtccgcatccagcgcaaggccggcatcttcacgcgcggggtgttcacccgcttcccgtaccaggtgaacacccacggtctgccgccggaggtggtggcggagaacctcaccggctacgtggaggccgtctacggtgagaagggccgcgagctgcgcgagcgcgagccgcgcaacttcgaggagttcatcctccgctacatgggcgagggcttcgcgaagaacttcatggtgccctacaaccagaagctgtggacggtgcacccgcgtgagatgtccgccgcctgggtgggccgcttcgtgccccgtcccaacctcaaggaagtggtggacggcgcgctgggcgctggcagcgacgcggtcggctacaacgcgtcgttcctgtacccgcgagagggcggcatcgagagcctcgcccgcgccatgctgagccacctgaagggcggccagctcagcacccataccgagcccaccgccattgattggaaggcccggaaggtgacgctgtccgacgggagcgtgcagccctatgcggggctggtgtccagcatctccctgcccgggttggtgaagctgctcgccaagggcgaggccggcgtgcccgacgcggtgcaggacgcggcgaagcagctgcgcgccaccaccgtcacctatgtggccgtgggcgccaagggggccaaccgccagccctggcattggatctacctgccggagccggagttccacacgtaccgcatcggctcgccctccgcggtgtacgcgccgctggcgccgccggacacgtccaccttctacgtggagtacagccaccacggcgagctgtccctggccgcggcggagaagtacgcggtggaggacctggtgcgctcgcagatgattcacgccgcggacgacgtgctcttcgcccaggcgcgcgagattccccacgcctacgtgctctacgacgacgcctacggtccggcgaagtcggagattctgcgcttcctggagcataccggaatccagattgccggccgctatgggcagtgggagtactcctccatggaagacgccatcctcgccgggcgtgcgtgcgcgaggatactcaacggttgacatccccatcgcccacccgtcgcattgtgtcgacgggtggcttggggcgtgttagccatctctgttcgagttcatggccccgcacctcaccgtcgtcatccctgtctacaacgaggagtccatcatcgcctcggcggcggaggagttgcgccaggggctggacgcgcgcgggctcgactacgaaatcatcttcgcggagaacggctcgcgcgacgccacgccggtcatcctcgaagagctgtgcgcgagcaacccgcgcctgcgctggttccactcggagacgcccaactacggcgtggcgctcaaggccggcatcctcaaggcccggggcacctacgtcatctgtgatgaaatcgacctgtgcgacctgaccttctacgacgcggcgctgccgcggctggagcggggcgaggcggacatggtggtgggctccaaggcggccaagggcgccagtgaccagcgcccgctgattcgccgcgcggccacgcgggtgcacaacaagctgctgaaggtggcgctgggcttccagggcacggacacgcacggcctgaaggcgttccgccgagaggcgctgctgcccgtcatccagaagtgcgtggtggacatggatgtgttcgccagcgagttcgtcatccgcgcgtggcgcgagggcttgcgggtgatggagattcccatccagctccacgagaagcgccagccctccatccacctgttcaagcgcgtgcccaacgtgctcaagaacgtgggcaagctattctacgtcatccgcgtccgcgggacctgagccggggagggcgcaccgtgcggctggcgtccatctccgtcgacctcgactcgctgccccattactgccgcatccacggcctgccggagtcgttgctggacgcacgcgcccgctcgctggtgcacgcggtggcggtgccacgcttccgggagctgctggacgggctgggcatcacggggaccttcttcgtcatcggtgaggacctggagtccgacccggtcgccgtggcgggcatgcgcgcgtcccacgaggcgggcatcgaggtggccagccacagccacgcccatgactacgcgctgacgcgccggggccccgaggccatccacgcggacctgtcccgcgcggacgccgccattctcgcggccacgggtgtgcggccggaggggttccgcgcgccgggctacacgctgaacgcggacctgtacgaggccaccgcggcgctgggctaccggtatggctcctcggccttccccgccgtgccgtattactccgcgaaggcggcggtgatgggggccctgtcggtgctggggcgtccgtcccgctccgtgctggacacgccccgcgtgctgctggcgcctcgggtgccgtaccggcccgacccggcgcagccctaccggcggggctcgggcaccgtgctggagttgcccatgacggtgacgcccgcgctgcgcttccccctcatcggcaccttcgccaccacgctgccccgcgcgtccctgcacgcgctgtggcgcacgtgccggcgggacaccttcttcaacttcgaactgcacggcgtggacgtgctggacgcgtcggacgggattcccccggagctggtgcggcagcagcgggatttgcgcgtcagcgccacccagaagatggcgcgcctgcgcgaggtgttcggctggctgaagtcggagcgcgaggtcctcacgctgcgcgacgtcgccgggcggctgtcggcctcggtgtaaggcgttcccacgaggggacctgtccgccagcgtacgtccccgccgtgcctgggtgtccgtggggcacgcttgccatgccagggcgagggcttccgccgacggaccctcccggcggcggggccggtggtgtaaagagccccccatgctggagaacgtcaccgaccgagtgaagaagggcctgcgcgagtggacggaccggctggccaacaccgaacagaagcagcggctccacggcctgtcgcgcccgggtaacgagtacggggtggacccgttcggcttcgatctggactacagcctgtccgcggtggccccgctcctgtggctctaccggaactacttccgcgtggagacgtttggcatcgagaacgtgcccgccggccgggtgctgctggtgtccaaccactccggccaactgcccatggacggcgccatgattggcgtggcgatgatgctggatgccagcccgtcccgcgtcatccgcagcatggtggagaagtgggtgtcgtcgctcccatacgtgtccaccttcatggcccgcgtggggcagattgttggcacgccggagaactgccggcggctgctggagtcggaggaggccatcctcgtcttccccgagggcacgcgcggcatcaacaagctgtggccccagcgttaccagctccaggagttcggcctgggcttcatgcgcctggcgctggagacgaacacgcccatcgttcccgtggccgtcattggcgcggaggagcaggctccggcgctgatggacctcaagccggtggcgaagcttctgggcttcccgtccttccccatcacccccacgggcctgcccattcccctgcccacgaagtaccgcatctacttcggngagccgctgcacttctccgggcgccc

SEQ ID NO: 591 - DNA, 5069 bp, Myxococcus xanthus
cgcggaacctccagcgccgtcagctccacgcggtcgaactgccgcgcgagttcgaagagcgcctggtccccttccgctcgcacgcgggcgatgatctcccgcacgcgcagcgcgacgcgggcatcggatccagtcgcgcggtccagcagacgccggacgtcctcccgagcaagagcggacagaggaccgcggtacctcagggtcgacgaagcaaggaaggccgtcatgccatcaacctttcaatgcgggtgacgaggatgccctcgcagcccagtgccttcagcgcgttgatggtgcggtagatggtcttcgccggcaccaccgcgtgcacggccacgaagtcaccaccgtccagcacgtccaccacggtgggaccattgaggcccgggaggacttcgcgcacccggatgagcgaatccttcggcacgttggccatcaggtagcgcttgtcgcgcgccgccaacaccgagcccagcgcctgcttcagctcgtccagcttctgctgggtgtccaccggattgcccttgcacgccaccagccgcgcgctggactccagcaccgtgccgacctcgcgcaggccattcatcttcagcgtggagccggtggacgtcaggtccacgacgatgtccgcgatgcccagatggggcgcaatctccgccgcgcccgatactggtaccaccgccacccgctgcccgcgcctggcgaagaactcctgcgtcagccgggggaagcaggacgcgacccgcatgccctccttcacgtcttccggcgaggcgaagccgccctcctcccgcgccgccaccaccaggcgacacctgccgaactccaggtccatcagcaggtccagctcacgtccggactcacacaccaggtcccaaccggtgacacccgcatgcgcggcgccgtccgccacgaactccgggatgtcctgggcgcggacgaagatggcctcgaactctccgcccaatgacgcggtgagcgcgcgctcaccccgggcccgcacctccaggcccgcgtcattgaacaactcccgtacttcgtccgagaggcggcctttgttgggcagagcaatcttcagcagcatgggggaccttcgagactgcgaggagacaacggcccgaaaacgaaaaaaggcccgtcctggggggacgggccttcggtcgctgcggcaggtgccgaggtgggtgcgtctagcgtctcacccaggcatgcgcatggcgaacggtcccgtcggggccgagccgatgatgcgcatggtgatggtgaagggacgcggagagcatcgcagcatgagtaacgacaaagcgccccacagtcaaccgggcccggggagcgcccgcgcaacgcttgcaaacacccgctcgtgcgagcaggaagcgcccatgcaagtcgcggacgtcatcatcgtgggtggggggcatcatgggctgcggcatcgcgctgcggctgcggcaggccggagtgcgcgtcgtcgtgctggagcgctccattccaggtgcggaggcctccagcgcggcggcgggaatgctcgcgccccagatggagtccgacggtccgggcgccttcctggaattgtgcctgcgcagccgcggcctctatcccgccttcgccgccgagctgcgcgagctttccggcgtggacgtggcctaccggccctgcggcatcctcaaggtcgccttcaacgaggccagcctgcaccacctggacgccacggtggcgtggcagcgtggcatgggcctccgggccgaattgctcgacggcgccgcggcccgcgccctggagcctcgcctttccgcgaaggccgtgggcgccgcgcacttcccggatgaccatcagttggacaaccggctcctggtgcgagccctgacgatggccgccgcccggctgggcgcggagttccgcagcggctacgtgcgcggcgtggtgcaggagggtggccgcgcggtgggcgtggacctggacggcgagctgctgcgcgccgacgcggtggtgctggccgcgggctcctggtccgccctggtccacggcgccggcgtggaggcacgggcggtgcggcccgcgcgcgggcagatggttcaattccagacacgcctgcccctgctggaccgcatcgtcacgtccgagaagggctacctggtcccgcgcgcggacggccgcgtcatcgctggcagcaccatggagctggtgggcttcgacaagcaggtgaccgcggcggggctggcgcgcatcctcgacatggccctggagctgtgcccggagttgggctcggcgcccgtcacggagacgtgggcgggcttccggccgtggaccgaggacaagcggccctacctgggtgaaggccccgtgcccgggctcttcctggccacgggccacttccgaaacggcatcctcctggcccccatcaccgcgaagctcgtcgcgcaggccgtactgggtgagcgtcccgccgtggacctggcccccttccggtacgatcgctcgcccgcccaaccccgcacctgacgcaacccgacgtcaagggtgggagccgttcccctgcctcctcggacgcggggggcacgagcgagcgggcggtcccgccgcctgattcagaggggcggacaggacgcggagcatgcctgtcccacccaccgccaggggtcgtcccctcgccaggcccctcaatcgatcagccgtgaaccctgatccgatggtaaattcccgtacgcgttggccaatgaatcccggaaacctctagaatcgctcgctgtggaagccatcccccctgccccaccccgaatcctcatcgtcgatgatgacgactccgtacgagacgtcatctctgtcctgctacgtgaggaaggctacaactgtgtcgtcgccaacggggccgagatggccctggacctggcgggcgaggaggagacgccgctcgtcatcagtgacatgaagatgccgggcaaggacggcctctggctcctggagaacctccgcgagcggctccccgacacctccgtcatcatgctcacgggctacggtgacaccgaatcggcagtggactgcctgcgccgcggcgcggtggactacctgctcaagccacccaagctcacggacctcatccgggccatcgagcgggcgctggccgagcgccgcatcgagatggcccgcaagcgctaccagaagaagctggagcgcaaggtccgggacaggacggccgagctgttctttttcctgcgagacatcgccaacacgaaccataacacgctgctggtcccacgggtggtgctggacgggcgcgagcacgagacgagcgaccactcccagcgcgtggtcagctacacgtccgccatcgcgcaggaccagggcggcctggttcaggtgctgcaggagatagcactgggcctgcagctgcaccatattaggaagattggcgagccggacgctgcgctgcttaagccgagcaagctcaccccggacgagtgggtggagatgcgcaagcacccggacatcggcttccagatgatccaggccattccgttcctggacacgcctgcctccatcgtcctttcgcaccaggagcgctgggacggcgccggctatccgcgcaacctccagcggcacgaaatccacatcggcgcgcgcatcttcgccgtggcggacacgctggacgcgatgacgagcgaccggccctaccgcaagggcacgacgttcaccaacgccatccaggagatcaaacgctgcgccaacacgcagttcgatccggaggtcgtgcgggcgttcctcgacattggcgaggaggggctgatccgcatcaagcaggagatggcgacgaagaagctccagctcccgcaggccgagcaggacgcccatgacgccgaggcggagctggcccggctcacggatctggacgacgacgtggacgccgccgtgcctgggcactccgccagtgacgaggacgagcccaagtccgccgtcgttcgttcggtggctggcaacaaggggtgagcctggctggaagagatgaccgcacggggggcggctgttatgaggacaggtccgccgtgacgacacctgccctccagcccccgccttccgcgttggctccgcccctgctggacgcgcaggggcggcggatgacgtacctgaggctgagcatcaccgaccggtgcaacttccggtgcagctactgctcgcccgcttcgtggggtggcaagcgggacctgctgggccccgaggagttggagcgaatcacctccgtcttcgcccgcatgggaatccgccgcgtgcggctcaccggcggcgagccgttgatccgcccggacatcctcgacatcgcccggcgcatcgccgcggtgcccggcatccagcacctggccatcaccagcaatgccagccacctggagcggctcgcccgccccctgcgcgaggcgggcgtcacccagctcaacctgagcctggacaccctcctggcggagacgttccgccgcatctccaaacagggggatttcgacgcggtgctgcgaggcgtggacgcggcggcgggcgccggctacgcgtctctcaagctcaacgtcgtcgtcatgcggggcgtgaacgacgaggaagcctccgccctgatcgcctatgcgcacgcgcgcggcttcacgccccgcttcatcgagctgatgcccttcggtcagggcacgccggtgcccaccccggagctggtagatcgtctcgaggcgtcaggactgccgctggatctatagcctgatgacgcgggagacccggccgggccggcgcgctagtggcgtgcgcccggaggccgagtgggcttcatctccccgctcactcagaacttatgcggcacttgcaaccgcgtgcgtgtggcgtccaatggcgacttgcgcagcttcttctgcgaccgggggcaggcgccgctgcaccagctcatccacggcggtgccagcgacgtggagctggcagtggccatccaccgggcgctgggggacaagccataagggcaccggttctccaaaccggcaacggcgccacgttgctgtccatgatgggcatcggcggttgaaaacacgacgggcgggcccgcgctt

SEQ ID NO: 592 - DNA, 4829 bp, Myxococcus xanthus
ggcgccagcgccgcgcgcgcgcaggccgccgcgcccgcggtgtcacccttcttcgcgcgcgcctgcgcggcggcgcccatgtcctccaccggcatgttcggggtgaagccgcagcccgccgcctccgcggtgggcaccgtggccttgcccagcttcttgcgctgcgccaggaacagctcccgcgtgggctgggcgcgcgccagggcctgctgaaggtaggtgctggcctccgcgttgcggccattcacgtagtacaggcggcccagcgacgcggcgatttcgaaggtcttctcacggtccgccagcccctccgtggagtcgagctggcgcagcagctcctccgcggacggcggcgcccggcccgtgcccgacatgggcgggtggcctgggggcagttgctccgggctgatgctgggagccgcgccctccgtcggcgggtggccctccggcatgccagaggtggcgggagaggccgtggtccccggagggatgaccgggtggccgggaggcagcgtcgagggctgggcggtcagcagcgccgcggtggccagggcaagggacaggttcatgtgtcgttgctcgagtagctcgcttccggccaccacgtggcctcgctcctgcggacatcctgcggggcgagtttcccgaggagctccttcaccgacatccccagtaccggatgacgcaggtggggcgccagttcaacgagcggctccagggcgaagcggcgcttgtgcagctccaggtggggcacctggagtgtggggtcggccaccacctgtccctcccagaagaggatgtccaggtcgatggtgcgcgggccccagcgcacctcccgggtgcggcccaggtccttctcaatctgctgaaggatgcagagcagccgctgcggcggcaggccacactccagggccaccaccgcgttgaggaagcgcggctgcggcggccccacgggggcgctgtcgaaaagcgaggagcagtggagcaccgccaccgcgtcgatgcgggacagcgcggacagggcggcgacgaggtgattctcgcgctcgccctcgttggaacccaacccgacgtagacggtgtcgctcacggctccatctcaacagggttcaccagggttccgattccctccagctccacctccaccgtgtccccggccgacagcttccccacacccgacggcgtcccggtgctgacgatgtccccaggcagcagcgtcatgatgtgggagatgaacgacaccaggcgcgcgggactgaaaatcatgtcggatgtgcggctgtcctggcgcacctgcccgttcacccggcacacaatgcggaggtcggcgggagacaggcccgtcaccgcccacggccccgcgcacgcgaaggtgtcgtagcccttggcgcgggtgtgctgaatctcgcggcgctggacgtcgcgcgccgtcacgtcgttgaagcaggtgaggccccagatggcgcgcgccgcggtggactcgtcggcgttcttcagcttctcgccgatgacgagcgccagctccgcctcgtagtggacttcctggctcgccttggggatgcggatgggcgagcccgtgccattgagcgccgtggagggcttggtgaagatgagcggctcgggcggcaccggcttgcccatctcctccgcgtgcttgcggtagttctggccgatacacacgaccttggacgcgtccgacggcaccagcagcgtcagcgaggacagcgagcggtggatgcccgtctccttcgcgccagcccagggcgcggcggtgaggaccaccacctcggagccttccacccggccgtggtgcgcacggccctcatgcaggaagcggcagtagcgcgcggtcgtcatgaagtcctctggaagccgagcacgtcggccatgtcatggagaccaggcgcgcgccccgccacccagcgcgcggccctcagcgcgccagcagcgaactggtctcggttggtggcgcggtgcgtgagctcgatgcgctcgccctcacccaggaagtacacggtgtgctcgcccaccacgtcgccgccccgcagcgtctgcacaccaatctcgcgcgcgggccgcgcgccaatctgcccatgcctcgcgaaggtgaggtcctcctgggtgcgccccagggcctccgtcagcacttccgccagccgcagcgcggtgccgctgggcgcgtccttcttcatgcggtggtgcgcctccagcacctccacgtcgaagcccggccccagcacccgcgccagctccgccgccatgcggatgaccaggttgacgcccaccgacatgttcggcgcggcgacgatgggcaccgccttcgcgctctccgccagcgccgcggacgcctccggcgtgaagccggtggagcccaccaccagggccacgccgcgcgcggcacacaccttcgcgtgcgccacgctcagctccgcgctggtgaagtcgatgacgacgtccgcctgcgcggcgtccagcgcgcgctccaggctgtccaccaccgtcacgtccaccgggcccagccgcgtcgccaccccggcgtcctggcccaccgaggcactgcccggccgcgccgtgcctcccaccacccgcaggtctcccgagtcgagcgccaggcgaagcaacgtgctgcccatgcggccggtgatgccggtgatgacggtgcgaatcatgtctgccgcgctccaggtaacggcgggatgagggaacgctcagcccgtgagcaggcccagctggcgcagggtgtcgcgaagcttcgcggcgttgggctcggtcatctgcaccaggggcaaccgcacttcgggcccgaacaatcccatcacgtgcaatccccacttcacgggcgtggggttggattcgatgaagagcaggcggtgcaactcgttcatccgcacctggaggtcgcgcgccaccgcgatattccccgcgcgcgccgccgccaccaggtccgccatcatccgcggcgccacgttggacgacacggagatgacgcccttgccgccgcaagcgatgaagggcagcacggtgaagtcgtcaccggacaagagcgtcatccggtcgccgcacttctccaggatgtcgatggcccgaggcatgctgccagtggcctccttgagcgccaccacctcggggatgtcacacagccgcagcacggtgtcgggcagcaggtccacgcccgtccggcccggcacgttgtaggcgatgatggggaagcccgggtgcgccttggccaccgcgcggtagtgctccagcaagccctcctgcgtgggcttgttgtagtagggcgtgacgatgagcgtgccgtccgcgcccgcgtagcgcacgctgggcacgccgtcgatggtctccgccgagctagtggagccggagccacccaccaccgtcacgcggcccttcgccttgtacaccaccaccttgaccgcacgggcccagctcagtagccgtcatcgtcacggcctcgccggtggtgcccatggggaccagcacgctggtgcccccttcaatctgctggcggaccagcgcccggtatgcgggctcatcgagcgctccgttgcgaaacggagtggccagcgccgtcatggagccttcgaaggtcttcatgccggcgcttatacgttcaggcccgctcaccgcgccagagatcctcgacgcgctcccgctcccggaccacgcgccacgccgcaccgtccaccagcacctcggccgggcgtggccgggagttataagtggacgacatactcatgccgtacgcgcccgcgctcatgaaagcgaacaactcgcctgcttgcggaagcaccaggggccgtgccttcgccagcacgtcggtggattcacacaccggccccaccacgtctacctccaccgccttgccccgccgcttcaccaggggctgaaggccgtggtgcgcctcgtagagcgcggggcgcagcaagtcattcatgcccgcgtccaccaccacgaagtgccgcgctggcgtcttcttccggtacagcacgcgcgtgagcaacacgcccgcgttgcccaccagcgcccggcccggctccaggatgagcgtggccccggtggcacccgccgcggccagcacggtgcgggcgtactcctccggagacggcggcgtctcgtccagataggtgatgcccagcccgccgcccacgtccaggtacgccagcggatggcccttttccttgagcgcggaatacaggcccgccaccttggacaaggccgcgcgaatgggcgccgtctgggtgagctgcgagccgatgtggcaatccaacccggcggccagcaggcccttcatcttcttcgcgcgcgcgtagagggccaccgcctcctcgaacggcactccgaacttcgacgtcttcaggccggtggagatgtaacggtgcgtgcgcgcatccacgtccggattcacgcgcagggcgaatggcgcgcggcgccccaggcggcggcccacggcgtccagcgcctccagctcctcggcgctctccacgttgaagaggaggatgcccgcggccagcgccgcctccatctcctcgtgcgtctttcccacgccagcgaacaccgtcttcccggcgtccccgcccacatgccgcacccgggccagctcgccgccggagacgatgtcgaacccgccgccccgctcggcgatgagccggaggatggccaggttcgagttggccttcaccgagtaacagatgaggtgcggccggtctccgaaggcctccgtcaccacccggatgtgccgggtgagcgtggcggtggagtacacgtaaatgggcgtgcccacggactcggcgatggccgccagcggcacatccgccgcgtggggcacg

SEQ ID NO: 593 - DNA, 3070 bp, Myxococcus xanthus
gtgctctaaagacggcaagctgaggctggtgactggtcacgaaagcgaccggtgcttcttcgcggagacggacaccggcacgggtatcgaggagaagcacctgcctctcatcttcgagccgtcgttcaccaccaaggccccgggtgaaggcaccggcctggggctctccattgcctaccgcatcgtccaggaccacgggggcagcttccacgtggacaccgaggtcggagaaggctcctgcttcaccgtttttctgcccatccccctgcagctcgagaggttgccgtgaaccaagtcaagcgcgccaaagtcctcgtcgtggatgacgactccgtcgtcctcaaggccgtgacgcagattctccagcgcgagggccacccggtggtggccattgacgacgcggtggagggcctggcggccgcgaaggatccgaccatcgacgtggtcgtcctcgacatcaagatgcccaacctgtccggcatggacctgctgcgcggcatcaaggccgaccgcccggacgtggaggtcatcatgatgacggccttcgccaccgtggagacggcggtggaggcggtgaaggcgggggcgtacgactacctcaccaagcccttcgagaacatcgacgaggtcagcctcacggtggccaaggcggccgagcgcaaggcgctcaaggaccgcacccgcgcgctggaggaggccctcacggtccgcagccagttcgaggacctcatcggccagtccacgcagatgcgctccgtcttcaagctggtggagacggtgagccactccaccgccacggtgctcatccagggggagagcggcaccggcaaggagctggtggcccgcgccatccactaccgcagcgcgcgcaaggacaagcccttcgtggcggtcaactgttcggcgctgacggagacgctgctggagagcgagctcttcggccacgtgaagggcagcttcaccggcgccaccggcaacaagaagggcctcttcgaggcggctgacggcggcaccatcttcctggacgaaattggcgacgtgcccccggccacccaggtccgcctgctgcgcgtgctccaggaaggggaagtcaaacgcgtgggcgccaacgagccggtgaaggtggacgtgcgcgtcatcgccgccacccacgtggacctgtcccgcgccaaggagcagggcaagttccgcgaggacctcttctaccgcctcaacgtcatcaccatcgacctgccgcccctgcgtgaccggcccgaggacgtgcccctgctggcgcaccacttcctcaagctctacgcctccaaggcggacaagaaggtgacgggcatctccccgcgcgccatggaagccctcacctgcaaccggtggacgggcaacgtgcgtgagctggagaacgtcatcgagcgcgcggtggtgctgacgggcaacgaggtcatcgacgtggaggacctgccgccgggcttccagtccgcgccgcagccggactccacggtggaggtgttcagcctggcacacctgccgtacgcccaggccaagcgcctggcgatgcgtgccttcgagcgccgctacctgtccgccctgctggagaagaacaaccagaacgtctccagcgccgcgcgcgcggcgggcgtggaccgctccaacttccgtcgtctgctcaagcagtacgaggtggccggccggtccatgaagccccgcgtggtctcccaggaccacggcgaggcgctggaagccgcgtcctgacgtgtgtcggccggcgggcacccgggcatttcccatgcgcgcccggggccctcctggactacaaggcggggttgcgtgcagaccctggcaatcgtcgcgaagagggacaagcccgaggcggtagcgctcgcggctcaaatccgtgagcggtacccccacctgtcggtgctggcggaccgcacgctggcccatgagctgggctggccgcgggtggatgaccgggagctggtgacccgggcggacctgatggtggtgctgggcggtgacggcacgctcatctacgcggcgcgcctgctcggcggccgcggggttccgattctgggcgtcaacctgggcagcctgggcttcatgacggaagtcccggtggaagagctgtaccccatgctggagcaggtgctcgcggggcgcttccaggtggactcccggatgaagctctcctgccgcctgctgcgcgggggcagggtgctcatcgaggacgaggtcctcaacgacgtggtcatcaacaagggcgcgctggcgcgcatcgccgaccacgagacgtccatcgacggggtgcccatcaccacctacaagtcggacggcgtcatcctggctacgcccaccggctccacggcgtactcgctgtcggcgggtgggcccatcgtccacccgtcggtggactgcacggtgctgtcgcccatctgttcgcacgccctcacgcagcgctccatcgtcgtgccggcggaccggaccatccgggtgacgctgcgcagtgagacggcggacacgtacctgaccatcgacgggcagacgggccacgggctccagggcggggactgcatcgaggtggtgcgctcgcacaaccgggtgaacctggtgcgcaacccgaaggtggcctacttctccatcctccggcagaagctccactggggcgagcgctgaagggcgccgcgcgccgtgttcctcttcctgtcgaaggtgctcgacctgttgctggcgccgctctcctgggcgctgctgctgtggctggtggcctgggggctgcggcggcgacgtgagcggctgtcgcgggtgctgagtgtgctgggcggggtggtgctgtacgccttctccatcgagccggtggccatgggcctgatgcgggcggcggaggcgggggcggtgcggtccttccagccgggggccacgtatgacgccgtcatcgtcctggggggcgcgttggatccggccgccacggagcgcaccggcgtgccggagtacaacgcggcggcggagcgggtaaaacggggcttcgagctgctgcacgagggccgggctcggcgggtgctcctctcgggcggtttgctgg

SEQ ID NO: 594 - DNA, 4359 bp, Myxococcus xanthus
aggaggtgcgtcagcgcgtgtcccgcagcgagcgcgtcctggtgacgacgctcaccaagcgcatggcggaagacctcacggagtacttctccgacgtaggcgtgcgcgtgcgctacctgcactcggacatcgacgcgattgagcgcatggccatcatccgtgacttgcgcaagggcgagttcgacgtcctggtgggcatcaacctgctgcgcgagggcctggacatccccgaggtgtccctggtggccatcctggacgcggacaaggaaggcttcctgcgcagccacgtctccctcatccagacgattggccgcgcggcccgtaacgtgagcggccgcgtcatcatgtacgcggacaacgtcaccgactccatgaagaaggccctggaggagacgacgcgccgccgcgacatccagcgcgcgtacaaccaggagcacggcatcaccccgcgttcggtgaagagcaacatcaccgacttgtccgagcacgcggcctacgatgcgggtgacgtgggcgccctgccgatggcggccgaaggcgaggacgacgtcctccagccgaaggaaatcaagcggctcatcgaggaattcaccaaggacatgctcgccgccgcggacgagatgcagttcgagaaggcggccgagtaccgggaccgcgtgcagctcttgaaggacatggacctggggctcaagccggcgtcgcgctcgctgctgcgggccccggcgaaggcggcggaagcggaagccccgaagaagggcaaggggcgcgggggcggaggacgctccgcgcgggcccggagccgcaagtaggcgggggctggcatggacgcgaagctcctggagaagctggacgcactgccccccgagcccggcgtgtacctgatgaaggaccgccggggtcaggtcatctacgtgggcaaggccatcaacctgcgcagcagggtgcgctcgtacttcaaccgcaccggcgacacgcgcgtcttcgtgtccttgttggaccagttgctgggtgacctggagacggtgctcgtcagcaacgagaaggaagcgctgctgctcgaaaacgagctcatcaagaagcaccggccgcgcttcaacgtcctgctcaaggacgacaagcagttcatctccctgcgcctggaccgcacccagccctatccgcgcctggaagtggtgcgcaaatacgagcgcgacggcgcgcgctacttcgggccgtactccagcgcgggggccatccgcgagacgctgcgggtggtcaaccgcttcttccgcctgcgcacgtgcaccgaccacgtgctggccaaccgcaagcggccctgcttgttgcaccagattggccgttgcccggccccgtgcgtgtacccggtgccccaggaggactaccaccgcagcgtggacgaggtggtgatgttcctggagggcaaggcgggggagctggtggagggcctgcgcctgcgcatgaagcgcgccgcgcaggagctgaagttcgaggaggccgcgcggatacgggaccagctcaacgccatcgagcggagcctggagcggcagaaggtcgccaccaccgacttcaaggaccaggatgtcttcgccttccaccgggaaggggaccgcatcctgttctacgtcctgtgggtgcggcagggccggctcaacggcgggcaggccttccccttcggcagccaggagtttcccgacgaggagctgatcgcctcgttcgtcaacctctactacgaccagggcagcttcgtgccggaggaggtgctgctgccgctggagctggaggacggcaccggggggctcgaggcactcctcacggagcgcaagggcgagcgcgtgcgcgtcctggtgcccaagcgcggggagaagctggacctggtgaagatggcggcgaagaacgccgaacaggccttcgtggagcgccgacgcacgaaggacgaaacggacaccgtgctgtcccggctccaacagcggctggggctgcgcaacttcccgtgccggatggagtgcttcgacatctcgcacttccaggggtcggccatcgtcgcgtcgcaggtggcggtgacggacggggacgcggacaagtcgcgctaccggaagtacaaaatcaagacgctggagaagcaggacgacttcgccagcatgtacgaggtcatctcccgccgcctgaagaagggcctggaggacaatgacctgccggacctgctcgtcatcgacggaggcaaggggcaactggccagcgcgcacgcggcgatgaaggacgtgggcgtggagtcggtggacgtggtgggtctggccaagagccgcgacctggaggtgttcgaccgcgacgcggagagcgcccggagccccgagcgcatcttcgtggtggggcgcaaggaccccatcgtcctgtcccagaactcggcggagatgttcatgctcacgcgaatgcgggacgaggcccaccgcttcgccatcaccttccagaagcaggtgctgcgcaagagccgggtgcgttcggcgctggaggacatcccgggcgtgggggagacgcggcgcaagcaactgcttcggcacttcggctcgctcaagcgggtgggggacgcctccatcgaggagctcgcggaggtcgtcggaccggccatggcggaacgcgtccatgcgggccttcacggacatccagaagaggatgcggaagatcccgtacgggaggcttcccttgacgacgcgcacgaacccgttgacgaaaaaacgcagggagggtcgccacccggggcagcgtgattaatttccgctgcagacctgatgggaagtgcgctggaagcgcgacgttcctggggtttttcattgcgactgggctcggcgctgaactatagcggttgacgattccgagcacgtttcacagagggcgagggaccgacatgaggctgtatccgaaggtgatcccgatcatctcgcgcgaggccgttcagcagctcatgcaggacggggacatcgaggtggagccgatgcgcgtggccgacgccgagatggacctgtcagccatcatgcgtgagtaccttgcgaacgaggagcgtgtgaaccaggcgacgcgtgaagcgctggagcgtcgcggctacgactattccaagttcaaccaggtgaagcgcgagatggcggacgtccgcggcttcaagatgggcgacgagggcatcgagtacgtcatcaaccagatgattgaattcctgctcatcagccggaacgtcgaagaggtgtactcggcggataacgggctgcgtcagaagatcttcgccgtcatgaagcgtcacctcgacgtggacgacgaaatcgacaaggaggctcgctcccgcctgaagcacctgcaggagggcaccagcgccttcgacatcgagtacaacaagacggtcgagcagatccgcagggcgcgcggcctcatctagttcgcaggggtggggcatgccgttccccgctccgctgcctaccttgtaaaccaaggaggcagcgtcgatggcgggacccttcaccacgttcgttctgtccggtttgctggctgcggcgccaggtgggttcacgttcgagggccgcgaggccagcgcgaggaccgagcagccagacggcttcttcatccaaggctcacttcccttcacggacctcgctgaaagcggcacggggagcgcgtcgctgacggtggaggaccgcgtgtcccttccgggcgctacctttggggataaggggacgctggaagcgtccttccgcctgggggccacggagtaccgggtcgagctgatgcggcctggtttcccgccggagcaggggaaggggggctcgggcccgcctcctcgcccgcctcaacatgccattggcggcggcgtgttgctggacgtcccgctctatggggacagtggcctgggctggacggcgatgacgcgtacccacgccgcggtggctgtctggggcgtgggtagcgtctggcgcaacggacagcttctgacggacacggccttcgtgcacgcggcggcgctggccgcaggcgcgtacgcggatgacgacacccaccggctgctgcgtcaggctcgctacgacgacacggagctcgtggtgctggtgtggaacctcccgccgcagctcgagccgcgcggcttcatccagttcgtgtttgaggacgtagccatcgacgtgggcggcacggcggtgcgttcacggcccttcgtggagaacacgggcaatccgccgctgagctggcgctcactgacgccggtaccgccctccgccgtggtaggggcgcctgttaccgcgtcgcctccgcccgcgccttcggccatcggaggcggtgggacggctggggcgcttcaggatacgggggccgtgacgcgggtgacgg

SEQ ID NO: 595 - DNA, 4063 bp, Myxococcus xanthus
ggggatcaggcggtggtagtcaaactccgccccgtcagtggcatcgggcaaccggtcaaaggagacgttcttgaaggtgcctcggtaggacatctcattgacgttgctcccatcgggcgagaggagcctgacgacgtcgccatcgttgttgaggcccaggccgcccgaggatgcggccacggtatcgggcgtaccggccgggaagcctcgagcgccaccaaagacgacgaagacccggccgggagcgagcgtggtgccgggggcgaagacatgccgcacggatgcggagtccgacaggctccagcgggacaggtccgcggtggaggtccccgcgttgtacacctcgatgaattcgtagtgggtgtccgacacggtctgcccgggtgggatgggctcgttgggcaggacctcgttgatgatgaggttggacaagggctccgggtccgtgacgccgccggagtctcccaggtcgtagctgctgatgacgggatagtggtcgctgacgatgtcgccgtagttgggaatccacgcgtccgggcgcaggatttcgacggagccgggcaggtagttcgcggccagctcgttggagacgagcgtgtggtcgatggcgtcgggatagtcgacggtggtgcgcaagccgcgcagggacagtggctcggtgatgaaggtgtagcgctgcgtgtcggccacgaacggcgcgaaggggctgggcagcggggcgccgtcgctgccttgggtgatggactggtcgacatcgtcattccagtcgccaatgacgagcacgcgctcggagggcagggatgtgtcgagatacgacttgagcgccgcgctggagcgttgccgctgttcgtaggcggtctggttgtcgaacgccttcaggtgaacgacgatgacgaccagtggagtgctcactccgtcgacggtggtggtgaagtccacgcgcagcggcggccggccaccgaagtccgcggcgttcgcggtgaggatgagctgcgcctcctgaagcgtgagggtgctgtcgtagaggatgccgggcttctgctcgccattgctgtagtaggccgttccgttggggacgaaggacgtgtcattggcgaggaagccattgaagccgggaagctgctccttgagggtggcaaagtccgcggcgtccaccatctccacgaggccccacacgttgacccccgagtcgcgaatgatgtcgcgcgcgtgggccatctgaaggtcgtccggcgggccctgggtgggggcaccgaaccactcgaggttccaatggcccactgtgaggggtgcgctggcggtgcgcacgtggaggaccatcgcgtgccagccctgtttgcccgtggcgtccgtcaccgtgactgtgaatgctgagtacccgagctccgagagggtgccgctgagggtgcctgctgttgagagcgtgagccccgaaggcggcatccccgacacgatgtgccaggaaagcggcgcctttccgccggatgcttgcagttgggtggcgtagggcaggtccttgcgcgcatcgggcagcgatgtggtgacgacggtggggagttcgtagaccgtgagggtgaaggcgcgtgtgcccgtccgtccgttcgcgtcggtgacgacggcctgtccgctggtggtgccgggagcgggaggcgtgcctgagagccgtccggaggcggagagctgcagccaggagggaagggggctggctggagcgaacgaatacggcgcctttccgccggtgacggagtacgtggcgttgaaggactgcgagacatacccgtcgagctgaatcgcaggtccatccacggacggaggccggtgcacgacaaggtcgagcgcccgggtgccgacgcgtgcgtcggcgtcggtgacttggacggagaaggagaaggtacccgtcgtggacgcggtgccttcgagcaggccggcgctggtgagccggatgccggcgggaagcgaacccgcgctgagcacccatgcataaggcgcccgtccacccatcaccaacaggccttgtcgatacgcggcatcggtataggcatccggtagcgcgctgggggtgagggtgatgccgccctggacggtgaggttgaacgtggcggacgacgcacggccattggcgtcctggatttcgaccgtgaaggaggcggctcctggttcgctgggtgtccctcggacacggctggcatccagttggaggcccgtgggcaaggcacctgaggtgatgcggaacgtgagcggtggtcgccctccaacggcgtgaagctccgtggagtaggccgctccgagcgaggcggaggggagcgtgtcgctcgcgagatagggcgcggtgaaagtggagagcgagaggacacgttggctcgaaagcccggtggcgtcctgcacgtggacggtgacggagaaggtgccggagctggcgggaacgccggagatgtgcccctgtgtatcgaggcgcacgcccgacgggagggtgccctccgcgagcgtccaggtgtacggcgtcgtgccgcccgaagcatcgagttgcgcggcgtagttgtcgccgacgtatgcatcggggagcgtggatgacgcgacctggaggccggcgttgagcacctcgagctcgaacgtggcgcgaacagtccgtccgcgggaatcacggacctccgcgtcgaaggatgaggtgcctgccgattggggcgtcccggtgatttcgcccagggtggagaggctgagtccggtgggcagtgcgccctgcgcgacgcgccacgaataggcaggcgtgcctcccgaagcggtgagggagctgcgataggcctgcgcgacggatgcggcggcgagcgcctccgtggtgatggccagtcccggtccagtctcgtcagtgcggggaggcgcggagtcagaacatgcggtcagcagcagcgcgaggatgggaagcagggcgtgatgggcgcgcatgaagactccggcccgcgaaggagtcgggcccacggatgaggtgtcggcactgtagaggcagccgtgacgacggcgcacagggtcccactgtacccagagcaaagaaaagggccgcggctcacaaggagccgcggccgggaggcttcagagtgaaaccattagactacaggttgggcacgccccacgaaggagcacccaccgcccagtcttccttcatgttggtgtccgtcgcgctgatgcggcggacgctgttgctcgtggcatcagcgttgttcggaatgcccgcccaggatgcggacacgtcaccagcggagggcgtggacgtgttggtgcagggggcaccgttgcaatccaccggggaccactgaccagcggcctgcatggcctgcaggttgcccgggaatgcaccaggcggagttcccgcggcacggaagggcaccgcatcctggatagcgcctgcggcgtccttcacgaggatgacgcggctggagtaggtgatcgcggagtccgtgcccttgctttcgccgacgaagtcccaagccgtgtcgtagttgccagccgcggtgctcgtggggaactggtccttggacgtggtctccgccttcacggtggcgggcgcattgatatgcaccacgatgatgtctcccgcagcgacgtccacgtcagggagcctcgccaacagccgagcagtagtcacatccatctcaacggtgatattgttggttgttcccgcagtaatgacctgcagctcgaccagatcctggtgcgacgcggcgttcggctgcacctcggtcagacggagaacggccggcgtgcggaagccgcggaacgcctgcgtgctgccctcggcggccacaacgccacccgccaagtccgtcacggtgttcgcaacggtgacagagtagttggtgcccggggtctgctcgctcgtggtcaggaagacctgcttcccttcgacgcggaacgcggaaacagtcaggctctcggtgagcgtgaactgctccggcgcgttggtgatgctcgccgccgagatgttgcggctgaagctgagcacaagctccgtcagcgatgtcgcggaagccgactcgaacgtcggcgcggcgcagcccgacagggtgagctc

SEQ ID NO: 596 - DNA, 3465 bp, Myxococcus xanthus
accgcaacagcgccgggtacaacgccatcctcgcctacgacaagctggtttagatcgtttgaggccagctcgccaagagcgacctgcgcgacggtcagaaggtcgacgagaagaaggacaagggcgacgtcgccaagcagaagatcgtcaagcgcgacgcgaaggaccgccaggaagaggcgctcacgaagttcgaggaccggctggtcgccgcgtgtgacgtctatgtgaagctgtatccgaacacgcaggacgaaatcgacctgcgctaccaggccgccgtcatcctctatgaccgcagccacttcgtggacgcggcccggcgcttcggcgaaatcatcgagaagttccccgaggagcgccgctcgcgcgacgcggccgacctcaccatgtacgtgctggagagccgcgaggagtggctcgagctgaacacgctgtcgaagaagttcctggagaacaagaagctggccaagcccggaacggacttcgccgtgcgcgtcagccgcgtcgtcgaaggcagccagtacaagtgggtggacgaggtcgtctacaagaaggagaagaacccgaagaaggccgccgaggagttcctccgcttcgtgtccgacttccccaagtcagagaacgcggaccgtgcgctcacttacgcgatggtcatcgcgcaggaggcgggcgaaatcgacaagggcctggccgcgggtgagcgctttctcaaggagtacccgcgcagccccttcgagctgaaggcgcgttactcgctggcgggcctctacgagaaggtcgctgagtaccggaaggccgccgtcatggcggagtccctcgtcgccagctacgacgccgcgatgaaggcggacgatgccaacggcaagcgcaaggcgaccaaggcggccgccaaggtgagcgtcgcgccgggcgccgaggacgcggagtccaagcgcgagcgggtggccgccgagcgcaaggcgctgctggaagaggccggcggctggatggcggatgcgcagttcaatgcgggcgtctggtgggaaggcgcgggtgagccgcagaaggcggtggctgcctacaacacgtacgtctcccgcttcaaggaccgcaaggacgtgccgcaggtggccttcgcggcggcgctcgcgtgggagaaggagaagaagtggagcgaggcggcccgggcgttcggcgccttcgcggagacgtacggccgtgactcgcgctccagctcggcgcaggtgtaccaggcgcgctaccacgagctgctggcgtacgagcacctgaggaacgcacgcgagcaggagcgcgtgcagggcgagctggtgcgggcgtggaaccggctgccggagagtgctcgcaaggacgcggcggtgctcaatgcttacggccatgcgcgcttcctgtcgctggagccggcgtggaagcgttacgtgggcatccgcttctcgcgggtgagcaccatccgccgggacctggcggcgaagcagaaggagattcagcggctggagaaggagtacctcgccgtcctgtccaccggctccggtgattggggcatcgcggcgctcacgcgcatcggcctggcctatgccgacttcgcgcgcaacatcatggactcgccggacccgtccgggctcgatgaggagcagctcgccatgtaccgcagcgagctggagaacctggcgttgccgctggaggacaaagccgccgaggccctggagaaggccctggagaaggcctacgagctgggcgtctacagcccgtggaccctggccgcgcaggaccaggtgaaccgcctgcgtccgggggcctacgcacaggtgcggcaggtggactaccgcggcagcgacacactcgtccgctcggacctggtgcgcgtgctggaaggcgccaccgcgacgacgccggccccggcggactcctcgaagccctcggatgacgaggcgcaggcacccacggcggcgcgcggggaggtgctgcgatgaagctgtttcgcatcgattcctttcaggttggggcggggaagacgcagatgacctggttccgttcgctcctcgtcggctcgctggcctttacggcggcgtgcgcctcggggcctcagaagaagcagaccgctgcgccggaggtgacgccgcccgcggcgcaacagcccgcgcccgagcagaagccggtgccgcctcccgcgcagaagtccggcagcgcgcagtccgccttcgcggcggcgctccagtcctatgaagcgggggacctggacggtgcgcgcaagggcttcgaggcggtggtggatgaactgccgcagagcctcaacgcgcagttcaacctgggcgtcatcgcggagcgccagggccgtccggatgacgcgcgcgtggcctacgagaaggtcctcctgttggacccggcgcacgtgcccgcggtggtcaacctgggcgtcatgtatcgggcgcaggggcggctggacgaagccatcgcgttgttccagcgggcgctgaagacgcctggtcgcgagtacgacgcgtcgctgctcaacagcctgtccatcacctatcgcgttgccggaaagctggacgagtccgaggccgccgcgcgccgcgtgctggtgcgcaacaaggacgacccgggggcctacaagaacctggcgcacgtggcctacgcacgggagaagtaccggctggcggagctgctggccggcaccgcgcgcaagcactcggagaacgacccggcgctctacaacctgctgggcatggtctacctgaagctggacgaccgggcgcgcgcgctggtgcagttccagaaggccatctccctggatgcgaaattcaccccgggctacctcaacctgggcgccctggcgctgagctaccgcgactacgtgggcgccgagcgctccttcggaaaggccgtggagctggagccgggctcaccggacgcgacgctgtacctggcctgggcgctggacgggcagaaggggcgtgacccgaagaagggcctggccgcgggcgaggcgttcgagaaggtgctggccacgcgcgcggacctgccggaggccgtgtgcggcgcgggctgggcgtatgcgtcggaccgcgcgggctggcagaaggccatcgcgttcctcgaccgctgcaagggcctggagacgacgaccgacaatgacaagcagatgatcaccgcgaaggtccagggcctgcagaacatgctcaaggccccaccacccgaggccgcgcccgccaccgcggaaggggaaggcgatggcgctccggcggatgaggccattggcggcggtggtgcgcagcccgcggggggcgccgagggcgtggcgcctggacagggctcggatgtggcgccggaaggcgatgccacgggcggcgcgggcgcacatcctgggcagggcactgatgcgatgcccgcggacgacgcgaccggtggcgtgggcagtggggcgccgcttgctcccggtgggaaaggcacgcccgcgggcaagta

SEQ ID NO: 597 - DNA, 5132 bp, Myxococcus xanthus
gttgccccggagtgccaaaggtcatcagcttgacgcgcccggtcccctccatcgtgccattgctcttccagagctggagaccatcacggccgttcgtggccagcaggaacagcgtcccgtccacatccgtgagtgaacgtggctcggaactgacgccgcgggtctggatgttgcgcaccagcgccgtgccttcggccgtcccatcgcttttccacagctcgctgccatggacgccatcgttggcggagaagtagagcgtcccggcatcaaagacgatggatgagatcatggcgtcacgcggcgcaggcacgaacgtggtgatgcgcaccgacccggcctccgtcccatctgtcttccacagctcgctgccctggaggccgttgaagacgaaatggagcgtgccctccacgtccgtcagattcgcgatgacgggccaggcggaacttccattgaatcccagcacgggcaccgtgccttcactcgtcccgtcgctcttgaacaagcggtaattggcaaggggactcccgcccgacgtggcgaagtagagcgtcgaccctacggccgtgaagaaaggggacatgatgacgccggagatgtcggcgaccttgacggtcccctccgtcgtcccgtcactcttccacagcgccttggtgttgagattgatggtgaatacgaagaagagcgtgccgttgacgtcggtgaggaactccggcttcgagctcgagtgaggagccgtgaagaggtccttcaggcaatacgtccccgccgccgtgccgtcgctgcgccacaactcctctccgttggcaccatcattggccgtgaagtagagcgtgccgttcaccccgatgagattgcgaggagcggagctaccgctgcccggatggatgtccctcacccggaccgtaccggccgccgtcccatcgctcgtccacaactccaggcccgtcgcgtcgtcgtagacgttgaaatagaggcgctggcccacggccgtcagccaggggcttgaggtccaggagccaagggatgtcaccgcgacagtccccgccaccgtgccatcgctccgccacagggcctcccgaccgttgttgccgctcgccacgaagtaggccgccccattcatcgggaccaggaggttttcgccggcgcccccctgaggcgtgccggcgaacagttgaaccgtgccctccggggttccgtcggtcttccagaccccatgggccacgaagacaaccgtgtcattcaccaggaggaagctcctggggttggaggtggaggtgccaggagcgaggtccttgacgaggaccgtgccggtctcggtcccatcgctcttccacagctccacgccagtgctgtcctgtctggcggcgaagtacacagtcccattgagaaccgcgagcgaggtgggatctgcccccatgtcacctggacgcaggtccagctgttcgacctgttccaccaggccagctcgctggacacggacgccgcgtgccccctcgacggtaccgtccacctccgcggaatccgcacagctcatcaccaccgcgagcaacatcaccccgtaggccggggccctccacccactgaacatgctccccctccatcgtgtagccagcgaccccaggatgggagccaccgcgagcgaacgatcttcggcggaaacacctgtcgtcaatccccccttctctgtggcgcaggtcgaccttgtcgcgcgtcatcggcaaggtgcccgtagacgtgtgcagccacagggagaatgccccccagccggccggttccctcaagcaggtgcggaggaggtgcgcgcggggcttgaggcagcggccaggaaggagcggatgaaggagaggacaccgcgagtagactgggccgagttgctcaggaggacgttcgacttcgacgtgttcggctgcgtgaggtgtggaggcaggcggcgggtcttggcgtatgtgaagggggcccccggggtgcgggcgattctggagcaccggggcttgcccacggcctgtgcgaggttggccccggcacgagggccaccccaggccgcggggtgttgaagctcaagccgccagagccagccaagagagccaggcccctgccgcgccccgcctgggaaagcggctgggctgggcaggcgtgtgtctgctggagatgaatggcttctgcgccggcccggagtgcggctcatgggctccccgtcagcgtccctcacctcccgctctgctcccgcccgctacgcccaatagggctcctgtccttcctatgctcgcaagcgccggggctacttcttcatgacgggcgacgagcggccctacggctatgtctcgcgcaaacaggtgaagcagctcatcggcgacacgctggagcaggacctgccggtgaaacacgtggtggacgagctgcagctcacctacgagccgttcgtcctcatcccggacctcgcgcggcggcgcaactgcgagcgtgactggcgggagctgctcggcgaccgcgtcatctgcctggaggcccccaccgacaccgtggaggtggcggcggggctggtggggctgtacgagggcgcgttctccgacctcgatgcgctcgcctggcacttgaagaagcaggacctgtcgcggcagcggctgggcgccgtcatccgcgcgctcacgcccttcgcggcgacgctgggacgggacggcatcccccggcccgagttggaggacgagcacctgcccacgaacgacgacaactcggggtaccggcgtctgcgctgattcgaagcctcttccgcgtcgcgagcggaaggacctcacgggcattggcaccccatgagcctgttttcacccgggcacaaccagactcgggcgcccgtttcgaatagagcgtcaggacgtccgacctccccgcgacaggtgccgcatgcctctccccagactgaccctgctttccgccgttctgctcacgggctgtgcgaccagccccgccgcgaaccgcactgaatccaagcccgctcccgcggcgtcagcgcccgccgagccacgcaccgtccgtgaagcgctcgcccgggaaatcaccgcgccgttgccgcacaagcccgtggaggccgagggagtcctcttccggggcaaggtgctggccgcgggtacgccggagctgatgaagcgccccaatggggtgaccatcctcaccctcccgattgggacctccgagccggtcacctgtctcttctacacgagctccatcgatgccggcgccgcagtgaggagcctgctcgagtcactcctcgatgacgtcaccgtggagcgggtgcgcgccacggacgtcaagtccttcacgggcagccccgccatgtacctagaaggtgactactcgcgaggcgccgctccggccgtgcaggtgggtcgcatcaaggtgatggtccacgcggaccccgtgctccccaagacctgcttccacaacgagctgggatacacgaagaccttcctcgacgtcaccgagtccatcgccacgggcctcacctccacggcgcgggagcagccggtggcgccctactacagcgacgtgcaggtgatgcggctgggcgacgtacccctcgggttccagtacacggcgctcttcggcgccaaggcgggcgggagcatccttgaggtcagcaccacgatggtgcgtcccggggccccggcccagctccagttccaggacaccaacatcacggagcaggcggacatctcgggagtgctcgtcgccaagagctattccaagcgggtcaacgacacggtcgccgcgaatgtgcgcctgcgccgggagcagaacgggagctacggcgtctcgggtcaggtggccgccaaggaggtgcaggctcagttcgggggcgaactcatcggcgaggtggggctcgccgcgcggctccgcgagggcctgctgaagggccagggcgacgcgctcgaggccctgctgtgggtacctcccgccgacgcgtccgcaccgacgaagatggtcatccgcccccgcgaggaggcgggagcccgcgccgccacgatggagctgggcccgatgtccgtgaaggtggagctcgacgcccacggcttcccccagcggacggaaatcccctcgggaagcgccactgtcgtccaggagcggctgtcccagactggcgagccgtagcggcaggcgggcgtcgaacactaaaggggccgcgtccaggttcgacgcggccctggacgcgggcggttgtgaatgcaccgtgcgatgctgtgggccgtccccacctcacgcacacccatgagtccctcccgcacagcccacctcgtcgttgagctcggcttcggagacaccagcaagggcacgctcaccgactggctggtgcgccgccacggcgcggggctcgtggtgcgcttcaacggcggagcccaggccggccacaacgtcatcaccgatgacgggccgcaccacaccttctcgcagttcggcgcgggcaccttcgtcccgggcgtgcgcacgcacctggcgctgaccaccctcctccatcccctggccatgcgggtggaggtcagctcccccctgtgtcagggaagttgtcgcctcggctgaccggccgagctgagcaccccatgggggcgagtgcaggcaggtagctgtgtcgtacacggatgcattcaaggcggagatggtgaagcggatggtggggccaggcgcggtgagcgaggctgcattggctcgccaggtgggagtctcgcagccgacgctgtcgcagtggttgcgcgaggcgcgtagggtagcggcgatgacgccgccgcccgaggagaagaagcccgctggcccgaagaagtggacgcccgaggagaagctgcgcgtgctggtggcggcccaggggcttgagggtgaggagttgggggcgctgctgcgccgcgagggactgcacgaggtgcagttgaaggagtggcggcaggcggctgccggggccctgtcgggcgagtccaccgggccactgacggccagccagcgccgccggctggcctcttcggagaagcgggtgaaggaactcgagcgagagctgcgccgcaaggagaaggcgctggccgagacggcggcgctgctggtgctcgaaaaaaaacttcaggcgatgggctgggacctttagagcacagggaagc

SEQ ID NO: 598 - DNA, 5420 bp, Myxococcus xanthus
gctggcacggaggccagcagcacgcacagaagtgccgtccgggcggccaccaccctactcacagggaaccttgaggtcttgctcgtcattctccgtggcctccgggcgggcatccgggtcggtcgggtcatccgccatggcccgcttgcaccccatgtagaactcgccacgcgcgttgaagaccttgatgtagttgctgttcgcgtacgtcatctcgtcgcggaacggcgcggtgtcgaagcagttgggccgttcgtggtcggtcagctcgaagctgcgcttgtgcatgacgtggaggccgctgctggccttcgcatcatactgggcaaggccggtgcagtcgcccttctgcgaggcgcccacgccgtagttccgggacaccacgaaggtccccaggaagttggggagcaccgaggcgaccacatccaggatggcgccgatgcccaggctgtccaacgtggaggcgaagcccaggaacaccatccggtccacctggcggtagaggccgtggggctggctgagggaaccaccggtgtgctgaccggcgcggcggccacggacgatggcgtcaccgccgtccggcatgtgccagccgttggcgtacatggagtacttcgacttgagccgcaggctgcccaggtcgcgcccgcccatcatgttctctttgaagaagccgccgttgccaccgctcttgtcgaggtaccgcgtcggcaggatgacgttctcgtagttcatctcgacttcggattcgacccagcccttgttgttgaagccccactggttcaaaacccatcccatgccgttgttcaacgggctgaggatggcgcccgccaggccgcctccttcgctggtactcgggcggctgagcatcccgctctcgaggagcgcgatctccttgttggagatggtcgccgtcacgtccgtgtagcgggcaatgaaattgccgccagtgccgttgggctccaccgagtccatgtccttgtagcgctcgacgaactccttgtgcgcctcccggcgggcgtcctcgaaggcgtcatcgtgcttcccgttcgcgaagtcggagagcgcgtagctcgtcatctcccagacggcgtagcgcgccgcctcctggagcttgagcttcgccctcaccaactccgtgaggtacatgctgaacatcagaatcatcacgaggagcggcacggagagcgcgaactcgaccgtggcggcacctcttgagcgcgagcgcatttggagacgggcacgcatggcagtcctcagtgcgtcatgatcttcggggcaatgccctgaagcggtccgggcagcgcgtccatcatctcaccaatcttcggcagcgagttccggccctggaacacggacgccagacgcgggcgccagtaggggttgaagaagttgggctgctccgcccagttgccgggacggtggtagtaggtctgcccacgggagatgacgttgaggccttcgaccaggcccaggaacttcttccggttgttcagcatctccaggccgtccgtatccggagtgaaggcgaacttcaccttgccctcctggttcaacagggcgggcgcgttggtgccggtgccgtccttgttgtcccggttcacgacctgctccggctccttgttcagcgccacccaggcggtgggctggttgaagtccgcctggcgcttggccgcgtcgtccatggacgcgttggcggtggggttgcacaccgagccgagctggccaggctcgaagtgcatgaacggcgtcaggccaccccagcggtggtggccgtcctgcaccggccgcacgttggccgcgaagacgtccgtacgggcccagcacacgaacgccagctccagcacgcagattttcgagcggtgcagccccacgtcgcgctcggggccacccggccgcatgtggccggaccagcgctccgggttgctcgggtagttgacgcgccagtgcatgccgccccggtgacgaccgctgtcggtgtcgttgagcgcccagatgctcgtcttcgtcatgtgcttgtacggcagcttggtggtgttgttgttccccttgcccttgcggttgtcgccgaagcacttccagtagtcgtcgttcttggtgcacgacaccgggttgtccgccttgcccacgcccacgtcgatctccggcgggccgaacttgagccagtacgggtcatccgaaccgatgttgtcaccctgggccgtcatgccccagggattgatgttgtcgttccaatcacggatgtagttgcggccctcctggccgggaccgcggccggcgcggatcgcgttggcgttggggaagcccgtggagagcatgcgcgtctggccgatcttgccgaactcgaagatgcccgggatgtccacgccgccgttgaagaagtcgcgcatgaagctgagcatgtccggcagcggcagcaggtcacccatgcggcggctggtgatgaagccctgggggcacgcgccaccgttggcgtcacacgcgtagcgcgtggcgttcgtgattccacccatggagcgcttggcacgggcgatggggtctttggccgccttcttcgtcacgtccagcgcgccgaacgggttcttccacgtgttcggcgccagcggcttgccacccgcgtgcgggctgtgcgcctggctgaagagacactggctgtagagacccgtcgccaactggctggccagcgaggagatgttgctgtcgttgtcgtcgatgaccgtctgcgtggtctgcgtcacgtgcgtggacgcggacatcatcaccgcctgcgacgcgaagtacatcacgccgttcatcacccggtgcgcggggatgatccactcaccgacgatccggtccggattcagccgcgtgatgacctgttggatgggtctgaggaagtagttccggtacgcggtcatgatccggccaatggccttgatgaccgcgctcacatacggaatgacgttttccaggatgggacaagcgatcttccagaagaggttgttcgtcttgcccgcgcatggattcaacgtgcgcatgaagccgtagatgtccgtgaggaacgcctcggcggaatagatgagtgacagcagcgactgccacatcatcgccgacacgtagtgcgacacctgcgtgcggttcgcgtacgcgtagaagttgaacgcgcgcgcctccatggcggccatggagtacgacgcggagtccgccgtgttctgcaggcggatgcgttcatgcaccgtgtggccgatgttgaccgtggtcaacacggcgatggacatgatcaacaccatcagggcggccagcaccaaggcctggccttcctggcggcggaaactctgtcggagggtccgggtgaacatgggtcgggagtcctcttcctcttacagaccccagtcggggttcaggtgcatgatccacttgcggtggaagttggactgcatgcgcatgctgtacgtggccgtcagcggcatgaagtaccgcttgccagccaggttggaaacgatcgggatgctgccgttggccagcatccaaagcacggtcatctcgagcggatagacggagtcgtaccccatctcgtgctcgataccgcgggcgccagcgagcaacgggttgaggttgccacgccggttcatcatgttcgcgcgcgggtccacggtgccgcggtcaatggcgccttgcagcgccatgcccgcgttccaggtgaaccaccagtagaagatgatggagttcgcgaacggtacgcgcagttggtaccagtagcgcaggcggatggtcagtcgcgtggacttgcggaacaccagctccgcgtcgtcaggctccggcaggttgaagaactttcggatgtggttctccagcgagggcacctccgggaaggagtccgcgccgtcgaagtccagctcctgccagttgtagccgctgcgcagcttccacatcgaatcgatgggcgtgaagtacgcgggactgacggtgtccacgcggatgacgccgaacaggttggagccgttcaccgtccggggcacgcggccgccaccgaagttcagcatgcgcatgccggagtcgtagagctggtggaggacgaacgtcttccccagctcgacgatgtcgtcggtacgccccatggtgggaagcaacgccacgatggccgcgtcatgcatgcgctcgttgttgccgttccacacgatgccggcacgcgcggcctggtaggcggggtactccgtcatcagcttcgcgtgctgcatcatcgtgagctggatgatccccagcgtcatgaagacggcgagcggcatgatcatcgccgcttccaccgcgggctgacccgactgccggcgagacgccccctgcgcccgcggttcctgtgcttcctgtcccatgaaaccattatccggggactggtgtcagaagcgcatcggtcaaatggacagacctgcgcctacgtttccctcccatttgatgagaaaactcgtcccgctaattcgtgggtttagcgggcatctcgttcgccgatgactcgcgagccacccgccggcgcgccgatctggcggcctccgaggccggcgcctcttgtatcacgaggttacaagcctcgagtccttcggcacgcctacccagcgcgaactcaaactcacacaactggttcaaaagcgtccagcgctcctgtccagtcgcccccgaggccagggccgaacggatcagcccagccgcccgggccccctcccccgcggcgaatgccgcccgcgcctggcgcgacagctccgcgacgttggcgcgctccacggggggcggtggcggcgcggcggtgggtgcggattttttcgaggccggtgccggtgccggtgcggggcgctgaggctcggccttggcaggggcggcgacgcctcccagggtgcccttggattccgacgcgtccagctcgtcgtcgtaggcagcgccccgtgccgctggcgacttggctcccaggcgcagcgagtcgcgcggggggacggaccgaggtgcctgcgagtccgcgacgcgccgctccgaccggccagcgaaggcgtcgtccgagtccgccggcggcgtctgcaggtccatggattcgctctcgactttggactcctcgtccagagacgacggcgccacttcctgcgccatgggcgcgggctccagcacggcccgcatgtcggccttgggtgcgcgagcagcggcgggcggcccacgcttcgccatgctctcgctttcacgcagaatccgcatgtcgagcccgccgccactaccagcgttggcccagtcctccacgaccggccgctgctcccgtgagcgctcggcccccttggacttcgtcggcgcgcccatttcccggccggcgtaacccaccgcttccgcctcggcgggcatcgtcagaaccgccgcggagcccggagcggcctcgaccggcgcggccggcgcgaaacgatcggcgg

SEQ ID NO: 599 - DNA, 3521 bp, Myxococcus xanthus
  unsure (1)..(3521): unsure at all n locations
gtgctctaaagaacagcgactcatccagggacgctgcgaacgccttcgcttgaacatcgtttctccaggaggggaaatgttcgcgcctcagcaaacgccgttccaaagggcaaccgccgcgttttcgcacctgggaggccacgaggacgtggcttgacgtgtcaacggcacgtccatgacgcggcgtcaaaagcgcacatgaaacgcacgcgcctgtccgagcgatgcctgctgcgcgtggccgcgaatcgccgagggcctgcgcggcacgggcaaggtgggcatggatgacggcatgagcgccagcgtgcccatgcgtcgatttccttgccctccgacccggtcccggtcccgggtgggcgcgacgcagccgcaacgcggctcggcgctcctggcaaatgccggagccacagggtccacactccgcgagatccgcccggaagcgagcggcccgctcaccgacgttcccctttcgaggccctcccgcgctccgtcatgaaccagcgcgacagcctccgcggtccacggacgacttctccctgacaaggccccccgtgcgacgcgcctgccggggcgtggagaccgcgcccccggggagtaggcatgcctccgcatggaaacgactggcactggcgttgcaatgtctcgcggcgagccgtccacgtccgagtaccagtacaactacacgtacgtcgctccgctcgcgctggcccaggaagtttccttgagccatcggcccacactggagtggtggggacagaccatggagcacctcccgcacatcgtgaacaaccgcccacactgggtccaagagtaggagcagcgcaagaacgggggctcggcgccgccactccatgcccctggcccgaaaggcattcaactgaaaccgacacctcgcggcaaatcctatcacgccgccagcacttgacttcccacaagaagattcatttcatttacaaatgccaaatcaaactccggaataccaatcctgcatccagagctcagagaaagtctcctggcgtcttgatgacctattgcccaaggacaccgtcctggatttcagccaccggttcctttcggatgcgctgacgggcgcggaagccattcccttcctgaacgcggaggagcggctgatgctgaatcacatccgctccaacagctatgcgcacctgttcctgttcctggaggagtacgccgtggccctggccgcccagcgcgccagcctcgagctgcacgggaacgcgacgcacatgcgcgcgctcctgcgcttcacggaagaggagctgaagcaccagcagctcttcgcgcgcttcaccggcgcgttcgcccgggggttcaaggtcgtccctgccctgctcgacaaccacgtcgaggtggcgcgggccatcatggcgaagtcgaatctgggggtgctcatcttcaacctgcacctggagctgatgacgcagcagcactatctggaaacggtccgcggaaacaatgccgagacgctggatccgctgttctgcaacctgctcaagcaccactggctcgaagaggcgcagcacacccggctggacttcctggaggcgcagaaaatcctcgcccgggaacccgacacgctggacgaagccctcacggagtacgcggagctgctccaggcactgagggggacgttgaacgcccaactcgcgctggatctccagacgctggagaaggcggtggggcgcacgttcaccccggaggaacacaagcacctcgccgagtcccaggagcgttcgtatgtctggggcttcatcggaatgggaatgaaggcgcccctcttcctctcacgcctgcgcgcgctctcccccatcgccgagcagcgcatcctggagctggcgccgacgtactactgtgattgaggcgggcttcgggaccgccgcctcgccgtgacagtccggacgggccgccccccttccgaggctgggggcgaccaaagtgtgcgggctccccgcgatgctgacggcccatgctcctttcgtcgcgcgcgtcgatgccgggccgaatcaccacatcggctcgctgcgcgctacgatttcggccacgagcgcgtcctcggtcatcgcctctgattgaagcgccaccgccggcgtaaaccacaggcagcctcgcccattcatgagttcggtcaccgcacgcggcacggcccgaacttcgtgttctcgacgagcgggactgggaggtccttgaacaactggctgcatctgctcaagagttcgtgcacccgtcgaacgacgggggaacggcggtgtttctcacgggaatgctcagagacctgaggaaagtggccctccggattgatcaatcccgacacccgtggcgtccaagcgggcgcaccatgacgccgccctcgcacaggcatgacgcctccgcgagaggcgtcccacctcaggcccacgccccatgtggaaactccatctcgtcccgcttctgtgtctgctcaccaccactaccagttgcaccgagccgcccgctcccctcgcccatgcggtcccgcgccagcgtcccattgcgaaccgatacatcgtcgtgctccgcccggaggcccgcgccgcatcccaggggccccagaagacgcgggagcacgtgtcgaacctcgccaagacgcatggcgcgaaggtgctccacacctatgcgcatgcgctccagggcttctcggcggagctggacgacgcgcgcttggaggcgctgcgcgccgacgagcgcgtggccttcatcgagcaggatgcatgggtgcgcccgctcgtcacggcggagacggtggcgtggggcctggaccgcgtggaccaggaggacctgcccctggatggtctctatcgcccggcgctgagcggcgcgggtgtccacgcgtacgtgctcgacacgggcatccgctccacgcatgccgagttccagggacgcctgggcgagggcttcgacgcggtggaccccgacggtggcgcggaggactgcgacgggcacggcacccacgtcgcgggcatcctcggtggcacgacctggggcgtggcccgggccgtgacgctgcatcccgtgcgcatcctgaactgtgacggagaaggccccctgtcgggcatcatcgccggcatcgactgggtcgccgcccatcaccagtcccccgcggtcgccaacctgagcatcgggctggaggtctccgaggcgctggaccaggcggtccgcaacgtcgtggccgccggcgtcaccgccgtggtggccgcgggcaacttcggcgtcagcgcgtgcgacgagtctcctgctcgcgcggcggaagccctcaccgtgggcgccaccaacgtggaggactcccgcgcgtcattctcgaatcacggcccctgcgtcgacctgtacgcgccgggcgaggacattcgctccgccggcatcagcaacgacacggcaagcgaggtcttctccggtacctgcatggccacccctcacgtcgccggcgccggcgngctctacctggagatgcaccccaccgtcaccccggcccaggtgatggacgc

SEQ ID NO: 600 - DNA, 4587 bp, Myxococcus xanthus
ctctacagccccagcccgtagagcaccgcgcccttgagggccaccagccccagcaccagtccgaagacgagcagcggcttctggaggatgaggctcagattcaccgacatgcccacgctgatgaagaacaggcccatcagcagtcccttgaagggcgccaggtccgcttccagctcgtggcggtactcggagtccgccaacagcacgcccgcgaggaaggcccccagcgccatggacaagcccactgcgttgaccaccgacgcggtgcccaccaccagcagcagcgcggtggcggtgaacagctcctggctgtgggtggcggccacggcgcggaacaccgggcgcaccaggtagcggccgctcagcaccaccgccagcagcacgcccacgtccttcaggagcaggagccacaccggccccggggagggcgcgccgccgtctcccagcagcggcagcagggccagcagcggcaccacggccaggtcctggaagaggaggatgccgaaggccagttggccatacggcgtggtgagccggttgcgctcggccagcagttgcagcgcgaaggcggtggaggacagcgacaggccaaagcccgtgacgatggccgcgccccacgtcaggctgcacagcaggcccacgctggccagcagcgcgccggtgaacagcacctgcgcgccgcccaggccgaagacggagcggcgcagcgcccacagccggctgggctgcagctccagtccgatgacgaacagcagcagcaccacgcccagctccgccacgtggaagatgtgctccacgtcgctgatgagcttcagtccccaggggccgatgaccgcgcccgccgccaggtagcccagcacggagcccagtccgagccgccgcgagagaggaaccgccagcaccgccgccgcgaggaacacgagcgcctgctgcaggaaggacatgcggcttccttgcacggacgtccgggggcggcaattcggcgcgggcgcggggggccccgcggtctcaggcgtccgtggccctgcgtgcgagcggcgggtgtacagcgtgggacgccgaggcacccgcggagggcagggtgaaggtgaacacactgccttcgcccagggtgctctccgcctggatgccaccgccgtgggcttcgacgagccccttggcgatggccaggcccagtccggtgccgcggctggccgcgtcgcgggcctgccagtagcggtcgaagatgtggggcagcgcgtccggagtgatgccggagccggtgtcgcgcacgtggacggacacctcaccgccgcgcgcccgggcgcccagcatcaggtcgccccccgcggtggtgaacttcaccgcgttgcccagcaggttgcccagcacctggagcacccgcaccttgtcgcagcgcacgcgcacgcccgcggcggggaactccacggacaggcgcaggcgcttggcctccgccagcgggcggatggagtccagcgcctcggtgagcagccccaccacgccgtgttcgccccactccagaaggaggtcgcccggctccaggcggccccagtcgagcaggtcggagatgaggcgggacatgcgctctgtggcgtcctggatgcgggtggcctgcttggccacgctttcgccgcccggcttcgcccccgcgccgcgcagcagcagcgccgcgcccaagtgcaccacgcccagcgggttcttcaagtcgtgcgacaccacggccagcaaatcctcgcgggcccgcgccgcgcgccgggactcacccaccagccgcgcgttgtcgatggcgaggctggcgcgcaggcacaggtcctccgccagcgccaggtcgtccgggccgtagcgccgcccggagcccgaggacacgaaggtgacggcgcccagcgtgtgacctcgcgcgcgcaggggcacaatcatgtacgagcgcgcctggagcagccgcagcagcgcggggtgcgcgggctccgccgcggcggcgcgcagcagggagtccgtcaccgccggcaccagctccggctctccggtgcgcagcacgcgcaagaggcccacggcggcgtcgtcccgcagctcggtgcgggtgggcagcgcgcccgagcgctcctgctgcgtcgggtccaggcacgccgccgccacgcgcgtcacccaggggccctgctccagcgcgtccaccaggcaccagtccgccacgtcgggcaccgccaggtgcgccagcagcgtgtacatgccctgcgggtccggcgggtgggtgaagagcgtcgtcatcgcctggtagaggaaggagcggcggcgctcggcctgctccacctccgcccgcgcggccagttccagctccatggcgcgggagaacacggcctccgcgtcggtgagggggcgcgccgtcaccagtacgcagcacggccccccatcctccgagggcagcggactgagcatcagcgcgtgacgccggaggcccgtctgcgtggcccagggcgcttccagttcgcaggtgtcttggatgagcatcacccgcgcgcgcgctgtctccagccgcgccaactcctcgggcgggaagcccagctccccccagtgcctgcccaccaactcctcggggagccgacccactgtccttgcggccgcctggctgcacaccaggacccgccccggatcattcaggacgtaggacgggtcggggagcccggcgaaaacagtggcgagggatgcggggagtcgacctgccatgaatggggactggctggaaggggcccccatcatgacaccgcccgggcgccggaccatcccggcaccgggagaatcctgtggatgttttaaaatccaatgttctgccgcgtgtaactcagactcccccgctaccgcggaaaaccgaggtgagccggctcgccaggtcgggcagggcgacgacttcgtgggccaggttggcgcccaccaccacgccgggcatgccgtagacgacggaggactgctcgtcctgggccaggatgcggcctccggcgccgtggagttcgcgcacgccttccagtccgtcctggcccatgccggtgaggatgacggcgagcgacgcgggcccgtaggcgcgagccaccgagcggaacatccacgtcgcggacggccggaagccattcaccggcgcggcccgggagacctccgcccggccttcgcctcgcacgcccaggtggcgatcatccggcgccagatacacatgcccggggagcaggggctcgccatcctccgccaccttcacgggcaagggccccgcggtgcgcagccactgcgccaggccctcgctgaagccaatggcgatgtgctgcaccaccagcagggggacggggaagctggcgggcagctcggacaggaggcggaagagcgccgcgggaccgcccgtggaggcggccagggccaccacgccggggcgcgtgggcgacacgggcggcgcgggcggggtgggcacgggcgcggggggcgcggtgcggtccggccagcggcgcaccaccttcacctcggccatggccttgagggtgtcgcgcaggcggcggctgtccgcgtcgaagtccggggactccgggcccaggggcttctggagcaccgcgagcgcgccggcgcgcagcgcggccatggacgtctggatgtcgcgctccaccagggtggacaccaccaccaccggcgtgggcacctccgtcatgatgcggcgggtggcctccaggccgtccatccggggcatctggatgtccatggtcaccaggctgggccgcaggcgctgggccagctccaccgcttccacaccgtccctggcctcgcccaccaccgtcagggcggggtcggcgcggacgatttccaccagcaggcgtcgggcggtgggcgagtcctcggccaccaggatgcgcaacgggtcgttcttcatagcagtcgtctcagcgtctccagcaggctcgtcgggtcgaacgcgctcttcaccagataggcactcgcgccagcttgcaggccgcgcgccttgtcctctggcttgccacgggcggtgacgagcaccaccggcaaccgggagaagcgcggcgaggcccgcaccgcctcggtgagggcgaagccgtccatgcgcggcatctccacgtccagcaccagcgcgtccgcgccgcccgactggagccgctcccaggcgtccgcgccgtccacgcaggccaccacttcatagcccgcgctctccaggatgctctgctccagcgcgcgcgtggtgggcgagtcgtccgccagcaccactcgccgccgcgtccgctgggtggcgggggcggggaagagcgaggccgcggggcggccacccgccgcgcggaccagggacacggggttgagcagaagcgacagccgtccgtccggcagcaccgccgccgcggacacgtgccgggcccggcgcacgcggtggcccagggagcgcaccagcgcctcctgttcggcgagcacttcatccaccaccaccacggcgcgcgcgctgcccgcggccagcaccaccgcgccccggcgcgcgcgaggcgggccgggcggcagccccagcacctccgccagcgaggccaacggcaccagcgcgtcaccggaggcccacgcggg

SEQ ID NO: 601 - DNA, 3891 bp, Myxococcus xanthus
caaagcgcggcatccgggcgcgcgggtgctgctcatgagcccccgagggcccaccttcacccaggccactgcgcgtgagctggtccgtcacgaggcgggcctcatcctggtctgcggccgctacgagggcgtggacgagcgggtgatggcgcacctcgacggggagctgtctctgggggacttcgttctcactggcggcgagctggcggccatgacggtggtggatgcggtggcgcggctggtgcccggggtgctgggcaacgtggactcgtccgtcacggagagcttcgaggaaggcctgctggagcatccccagtacacccgcccgcctgtcttccggggcgtcgaggtgccggccgccctgcagtccggcgaccatgcccggattgcccgctggcggcgctggaagtcgttggtgctcacccatgagcgccgcccggacctgtatgcccgcgtggtgctgtcaaaggctgaccagaaacttctggcccgtcgggaggaagagctgtaaccctgaacgttgctagcgggttggatcatcagggcttgtccgacaccgctctctctgttagtacggcccgctcttcacgcgaccatcgcgtcagttcaagttttccggagtttgtcatgcgcaacgccgccattcagcacatcgaggccaagttcctgcgccaggatgtcaccgtgttcaataccggtgattccgtgcgcgtccactggaaggtcaaggagggcgagaaggagcgcgtgcaggcgttcgagggcatcgtcattcggaagaccaagggcaaccaccgcgctaccttcacggtgcggaagctctccttcggcgtcggcgtggagcgcgtgttcccgctgcacagcccccgctacgagaagatcgaggtcctgtcgcgcggtgacgtgaaccgcaagcgcctgttctacctccgcgccctcaagggcaaggcggcgcgcgtcgacgtcatcgaagagccgaagccgtccaagaaggccgcctcggcctcctgagcgcttccagcgcctgggcagtgaaaaggagcgtccgatcccggacgctccttttttcattcgcgctaacatgcgcgagccatgcaattcgccgaagtcgccgtccagaacgtccgcggtttctcccccgcggggcgctttgccctgaaggcgggatatctcgtcctcaaaccgccctcggcggagtcgagccccctggcgggcctctccctcgcgctgctcttcgcggatgggcgtggcactgacgccagcttcatcgccaccggtgcgaagtcgggcaaggcggccctgacgttcgccggagtggatggggtgacataccgcgtgctgcgcgacctcggcggctccgggacattgcaccggatgaatcccacgacgcagcagccggagctcgtctcttcggatgcgtcggagatcagccagttccttcgcggacaggcgggacttccaccgaagaccacgttcgagcaggtgtactgcctccaactcgggcagcttccctcgcggcgcccgaggaaggccgctgccgccgcggcgaaggtggaccccaggacgtccggccggtacccgtccctggcgtccgcgtccaccgtgttgcccgcggaggacatccccgctgccgaggcgaagctgcgcgcgctggagcaggaactggctgcctccacggaggtggacagccttcagttcaaggcggacggcgtggcgtcccagatcttcgacgccgagcagcggctgaagggcaccgaggggctcaaagtggccatctccgaggccgaggccgcctggcgcgcggcgcctacgcccgagtccctggggctgcctcaggacatcgtgaaccgcctgaagcgccaccccaaggtgattgccaggcgtgacgaggccctggcgcgcctcaacgcggaccgggagaacgaagcggaggcacgacccgcctcggtaccgtccctgacgcagaacatggggttctgggccggcctgggcgcgggagtgctgttcctggcgctggccgtgggcctgggctttggagtggaccggaccttccgctacctggcgctgctggacatcccggccttcggcgtcgccgccttcctggcgctgcgctacgtggatgacctgcagaaggccacgcgtcatggcagcaaggagaaccgcttcgacatccgggagaagaagatcctcgaggagtacgaagcggaagccgcgccgctgcgcatggcgcagaaggcgctcgacgtggaagagctggacggcatcgcgccggccctggagcgcagggagctgctggccgcgcgcgtcgcggagctgcaggaccagttgcacaccatggagtcggatccggactacctcgcggcggccgctcaggttcagtcgctgaaggcggaggcggaagcgctcaacgacgagctgacgcagaagggcacctacgtgcgcgacgtgcgcgaggtggagcgtgagatgggccggctgaaggagtccattgccctggccaaggcgcctccgccgccggccgcgccgggcccggatggctccgtgcccgtggagacgctggaggatccgtcgcccatgctcctgtcccaggcggcggacgtgttcaccacggacatcctgtccgtgcaggcgatgctgaaggagcggtgcgtccagtacctcaccgcgctcacggaccggcggtaccagagcatcgagtgggaccgcgagggcaaggccttcgccctggcctcgggccggcgggtgccggtgggcgagctccctgcgaaagatttggacctgtactacctggccctgcggatgacggtggtggagaaggcgagcgcccgagtgaagcgtcccttcctgctggaggacgtcttcactgggatggaggaggtgaagctccccctcatcgctcggatgctgaagcacctgggtacgctgacgcaggtgctgcacgtcacctcgcacccgggcttcgcacagatgtcggacgggcccgttaacgtctgaggcgacgtggcgggttacctccagggggagggccgtcaggggaggggtggatgcgacgggcggcgccggctgagcggcgggagtatgggaatgcgggggaggaggcggcggtgcgcttcctggaggcacaggggtggcgggtgcgggatcgcaactggacctgccgcttcggggaactggacgtggtcgccgaacgtgacgacctggtgtgcttcgtggaagtgcggatgcgctccactgccacctggggcgacccctcccacagcgtgtctttcgccaagcagcgcagggtggtgaaggcggcgcttcggtacctgttcgcgcatgacttgcgtggacggatgttccgtttcgacgtgatttcggtggtggggcgcggcgagcgcgccaccgtggaccacatccctggcgccttcgacgcggggatgtgagaggacgacgccatggctggaacgctctatctggtggcgacgcccatcgggaacctgggggacgtcacatcgcgcgcgttggagaccctgcgcgcggtgcgcttcatcgcgtgtgaggacacgcggcactcgcgggtgctgctcgaccacttcggcattggcgggaaggacctggtgagcctgcccgccttcgcggaagggcagcgagccggacgcatcctggaccggattggggaaggggaggactgtgcgctcgtgactgacgcgggcagccccgccatcagtgacccgggcgagaagctggtggccgaggcgctggagcgcggattgacggtggtgccggtgccaggccccacggccctggtcgcggcgctgagcgcctctggattgcccacggggcgcttccacttcctgggcttcctcccgcgcaagggcgccgagcgccgggcgatgctggaggaggtgg

SEQ ID NO: 602 - DNA, 4604 bp, Myxococcus xanthus
atcatcacgttctccgtgccggtgacggtgatgacgtcgaagttgacggtgccacccttgagctgcttcgccgtggcctccacgtagccttccgtgaggtggatgtccgcgcccagcgccttgagccccttgaggtgctggtcgatgggccgcgcgccaatggcgcacccgcccggcatggacacccgcgcccggccgaagcgggcgaccagcggccccagcaccagcacgctggcgcgcatcgtcttcaccaggtcgtacggcgcctccggggtgatgtggccgttgacgccgacccggcagacgtccgtcgtctccgagtcgcgctccgcgtcgcagcccatggtgcgcagcaccttgagcatggtggcgacatccgccagggccggcacgttgcggtaggtggatgtgccgtcggccagcagcgccgaggcgaggatgggcagcgccgcgttcttcgcgcccgaggcctgcacttcgccgtgcagcgcctggccgcccttgatgacgatcttgtccatggttccctgcgtcttcagccctgtggctcgctggccacgggctgtgtcccaaatgccatccgttcccgccgctccaggtccttctccacccgcgcgtccgcgtaacccgcggcacgcaggagctccaggacggcggggccctggtcctcgccaatctccaatgcaaggaggccgccaggctccaaccactggcgcgcacccgtcaccactcggcgcaccgccaccagcccgtccggcccgccgtcgagcgccagcgtcggctcgcgtcgcacctcggcggacaggccgggaatctccccggaggcgatgtacggcgggttggagaccaccacctggaagcgctcgcccgcgggcaccggggtgaagaggtcgccctgcagcaccgtcacccggtccgccacgcccagcgcctgggcgttctcccgcgccagcgcgcaggcgtccggagacaggtcggtggcgatgacggtggcctgtggccgctcggccgcgaggctgatggcgatgcagccggagccggtgcacacgtccagcgcgcggccgggcgcgtccttgggaagcatgcgcagcgccgcctccaccaacagctccgtctccgggcgcggaatcagcacccgggcgtccaccttgaaggggcggttgtagaactcacgcacccccgtcaggtactgcgtgggctcgcccgccatgcgccgctcgatgagggcacggtaggcgcccagctcgtccttggagagcgggcggtccaggtccacgtacagccggacgcggctgagcttgagcacgtgcgacaggaggatttccgcggtgagccgcggcgcatccacctgtcgcttctcgaagtgctgcgtcgtccaggtgaggaccctgcggatggtccagggctcgctgctcatgcggagggcttcgggccgccggccgtctgcgccttgagcgcttcggcctggtagaaggtccggcaggcggtgatgacgtcttccacgtcaccggccatgacgcccggcaggttgtgcaccgtgaggccgatgcggtggtccgtcagccggtcctgcgggaagttgtaggtgcgaatcttctcgctgcggtcgccggtgcccacctgggcgcggcgcgcggagtcgcgctcgttgcggatgcgctcctgctcgatgtcgtagagcttcgcccgcagcatgcgcatggccatggtgcggttcttcaactggctcttctcctgctggcacttcactacgatgcccgtcgggtggtggatgaggcgcaccgcggagtccgtggtgttgacgctctggccgcccgagcccgtggagcgcatcacctgcatctcgatgtccgccgggttcacctgcacgtccacgtcctccgcctccggcatcaccgacaccgtgatggtggacgtgtggatgcggccctgcgtctccgtggccggcacgcgctgcacgcggtgcacgccggactcgtacttcatgctgctgaacacggcgtcaccggacagcgtcaccgtggcgtccttcacgccgccggcgttgcccgggctcatgtccaggatgtccgccttccagccccggcggtccgcgtagcggaggtacatctgcatgacctcctcggcgaagagggcggcctcgtcaccgcccgcgcccgcgcggatttccaggatgacgttcttctcgtcattcgggtctttgggcaggaggagaatcttgaggctggcctccagctcgtcgcgctgttccttcagtccgggcagggactcgcgtgcgaaggccttctcgtcggcgtcgctgctgccgagccatgcttcgacctcgctgaggtcggcgagcaccttgcggtaggtcctgaaggcctcgaccagcttctccaggcccgcgcgctccttggacaccttctggagcctcgccgagtcggcgagcacgtcggggttcgacaggtcggcggtcaggcgttcgaaccggcgttcgacgtcttcgagtttgtcaatcatcgtcgttccggggggtattgcccctttgcacggcctctggcaagggcgggcggagtcaagaaattccttggacgcttgggcgggagcatgaaaaaagggccgccctcaccgcgctcagcggtcggtttcacatcacctacacggagtccttccacatgcccgcccagaagggaaatcgttccaagaagaaggtcgccaaccgcgccaagggccggaaggcccagctgaagcgccgccgcagccgcgccaagaagggccagtccaacaacaaggtctagtgcgttggctactccctccctcggacttcgggggagggaggcggacgtgcccacggttccaattcgggcagcatccgctccacgccttctgaagactccgccaggagccgcagcaccgcctccgccgcctcgcccgtgacgggcaccggctggaagggcagctccgggaagcggtcggtcctcaagggcagaatctcgctggacaggtagccgccgtcgggcccgaagtggcccttccacagggcgccgcgcttgtcgcgagggttccagttccccccgaagacgaagttccccagcgagtagacgaccggtctgccctggtacagctccatggcctggaggacgtgcgggtgggcgcccagcacacccgcggcgcccgcgtcgatggcgacgtgggccaggcggacctggtagggctccggggtgtaggtgccttcgcgtccccagtggaagtagggcaggacgatgtccgcctgggcccgggccgcggcgatgtcctcccggagcatctgctccatgacggcctcgtcggagaagtggccagcgaccccaggggtcgtctccgtggcgtagaccccgggcggttcgatgttgcgcgtgcccaggaagaagtagcccagcagcgcgacccgctggccgcccacggtgacgatggccgggcgccgggcctccgccaggttccggcccgcgccgaagtaggggatgtgcgccgcgtccagggtgtccagcgtgtcgagcaggccctgggcgccgtagtccatcaggtggttgttggccaggctcaccacgtccacgccgccggcggtgaggatgcccaccagctccggcttcgcgcggaagttgaagttcttgggcagcttctcaccgcgctcggtgaaggggcactccaggttgacgacgaacaggtcggcggcgtccgtcaggggcttcacctcctggaacccgtaggccagcagggcgtcctgggggcggcccttggcggtctccgcgtcgtagtgtgtctggtagttgtggcccagcgtcacgtcgccgcccacgatgatggacacggaacgggcggggggctcggccgctggcgccccgatgggaggggcgggcgcctggcccgcatccccgggggcgggggactgtccggcgggctcctccggcggcagcggctccggcggggggatggtgcgggggtgacaggcggacaacatgagcagcagcagggcgacgtggcgcatgggcgaggggaaactctaccttgcacctcttggagcgcggcgcgtagattgcccgcgcgctcatggcccgcgaaaaggacaacatcgctctctccgacgagcacaacactcgtggaatcgagctggcggaccggggttggctcgacgaggccatcaaggagttcaagaaggccatcgacctcgacccgagctccgcgcacgcccacgacaacctggcgaccgtctacgcggagaagaagctcttccgcgaggccctgtcggagtacctcaccgccctgaagctggagccggagagcgccacggcgcactacaacctggcctgcttcctctccacccacgcgggggagatggcggtggaggagtacaaggaagccatcgagttggatccggagtatccggacgcccacctcaacctgggcctcacctacgcggaccagggccgcgtggaggaggcgatgcgcgagctccagacggccatcgagctggactcccaggatgccttcccccgtcacgagctggccgcgctgatgatggacgagggcgactaccgctccgccatcacccagttgaaggaagtggtgcgcctggagccggacaa

SEQ ID NO: 603 - DNA, 3286 bp, Myxococcus xanthus
aggggggcctcacttcggctgcacgcccagcttgcgatagagcccgaccatcagcatgtcgccttcgggctgagtgcggatggtcagttgctccgtgcctcgttgaaacacaccgggctgttcccggtcctcgacaaagcccgcccgggtcaactcgacctgatagaactcccggacctccgcagacgtggccttcacggcgtacatggccatctgtgagccttccagattggaccgcgtcacctgctccgcgccagccatcaccggtgcccagtccagctgaatgctgccgcccggggtgtacttggacacatcggaggtccccaggatcaacgtgacggtgttgtcctggttcttctggaagatgaccgtgtaggccgtgagcgtctcggtatccagcgccgtgagcatgggctcggcaatcggcgagttgagcgcctccggtgaagaggagatgaagagccccgcggcccggaagcggtccaccatgtgctggatgagcgggtccatctgccaggacgtgcgcgcgagctgaaggtgcatgggcacaccatccgtcacctggagcccgggagactccacccaggctgtcacggcggggatgtcccagcggaaggacgggcgagccggtggcgtgcctgcatcctgcccgggcgccggtgccggcgcgggcttggcgccagcggccggtgccttcttgggaggggcctttcccgccttcgcttccgccgagggacgccccttcggggcagcgggcttcgacgtttcagccagccccacggagggcgctgtcgcgagcgccacgcacatcagccacacgcgcatcagggacactcattccccaggaagcacgagtcccggcggccatatgagacggggtacggaatggcctgccagttgagccccggtggcaacaagcccggggacgtgggccagcccttgaaccccatggtcgccaggccgcccatggagtcagcgggcagtggctgaccgaagaaggcctcctcgcccacggcgctcatccagaacatgttctccgcgccaaagaagaagggcagcggcagccctccgacaaccgtctgcgccagacggctcgccgagaagtccggtccaaaggcattcaccatcaggctgacgccatagacgctggaagccattccccagtacggcaggttcaaggggcagggggcgggaatatcggggatgatggggcacgagccggactcacccgagcccgtcagtccccagtcatccagcatgctggtcagacggcccgtgcagttgccgccctgggcgcgccccatggcgcacacgcgaatggggagcatccggtagtgctccgcctggaagaagccccccgactcccgctgggcgacacgctgcggaatccggaaggccgtgaggtccgcctgcgcggtacaggagatgccgccgccgtcgcggtaggcaaccgacgtgaagacgggatgcgggtcgaaggtcggaccgccctgggtacacgacacctgcatcccgtccgtccgggtcaacgcgagcgtgatgacgcccgcgctgttggtggtcgtgcggctgtcgaagtcccggtagcgcatggcggcgtcctgccccgcgcgctccgccgccgcggaagaaggcgatgagtcattgggccactcatgcagcttgtgtcccggcgcctccaacaaggcggagtgcgccgcttcggtcaccttcaccgaaaggaaggatacctcggcgaagtggatgacgaagaggaggatggtgatgaagacgagcgagccgatggccatctccaccatcgcctggcctcgctgggtgcgacgcgaaggagacagctccatgtcacggccctcccctgtagccctgtgcacgcagggcctcgtatgcctccgccgcccagcccacgccggcgccgttcagctcgtccacgaaatcctccgcgccgctggagtccacggtggcggggaccaacgtggcgcgccagtacggattgagcagattgggaggctcgcgccagtgctcgcgacgatggtagtaggccagcccggtggacaccgccgtctggcggctgatgttcaacccgccgcccgccggccccaggacgagtccgctgttgtcgaacccgctgtccgtccccccgaaccggaagcggaacagcaggttccaggggtccgcctgggtgccacgcacggcatagtcccgctggatgaccgcgaagttcttcggctggccccagttgtcatccttgtccatgaccttgacgccgttgtagtcgacgaacatgggccagacggacgggcaccccatccgattgcggccataacaggtccccatgttgtgacgcgtctgcgccggctccaggtcacccgttcccaggcgcggagaccagcggtgccggtccctggggtcgctcgaatccgaggcgatgagcagcgactccgcgacaccgattccaaaagtctgcgtggggcacggggaccggccacgggcgaaggtgacgaaggccagaccatggtcatccgcgatggagtacgtgtccgtcgtgcccagatacgtgccatgaagcggcgtgcgagcccagtaggtgctgccatccccctgaatcatcaccgtgtccggggtagtcaaccgccgctggatacccgccgtgacgagccagtcatcagtggggaagatgccacggttggcgacgaagctgtgcccccggctgcccatggccgcgtagacgtgatgcccgttgatgaggttgggccacgccacggcccccaggtagggcgccacctcgcggcgcgtggtggagaccccatccactcggagctcccccgcccagcggctgcccgcgccggcgctgtcgatgatgtcgttcgcggcggactggttgttcaattcgagcatcatgcgcccgtactggacgacctgccccacgacgaacatctgctgcgcggcctggctgagccgcaacgctcgctgcgcggcgggccgctcgagctgatcccactgaggagcaatctccgtccggtcgtagcgagagagcgcgttctggctgcgggtgatgtcccggacgccctggatggcgcacctgcagaagctgctgcaccccgaatagggaatgcagcacggcaacaacgcgatgtagggaagcatcgcgatggtgaggcatccgcgtggcgcaatctggcgcgtagtagtgctcagcatgagtgtaccgcgcttgaacagtgcattggccgtatagcattgtaaccccgctgcctgtgagaggatccggtgactctttctctgacac

SEQ ID NO: 604 - DNA, 4050 bp, Myxococcus xanthus
  unsure (1)..(4050): unsure at all n locations
cagttctatttccggcagacgtcgcggaccccgcgggccgtcgccgcgagggcctcgattcccaacgcgagccagtccgcgccgtcgcgcgagaaccgctcggccagctcggcgtccaccaccggggcccgctttgagccagggcgaagctgctggaggaagttctcccgggcggtgacggagttccgcgcggagcgctccgcgagcttgatgccgctggcgaacacctccgacaggttggggtcgcgcaggttggacggagagccctcggttgattcgcggcagcgccgcgcgaagtccgccgcggtgtgcttggagggcgaggccagcagcacgcgctccagcacggaggcctccggcccgggcacgtcgaagttcgccgcgtctccctccgcctcgcagacacccatggcgtccagggccacttctggcgccagcgcccgagggcagcccccgagctgttgcagctcccgccggcaggcctccacgtccacgggcggaagcggcagggcggagatgagggagaacagcgagtgcagcacgggcagcttcacggtctccgagcctggcagcgccttcaggacgcgctgcacggagtcccagggcttggggtctccgggcgtgtacagcttgaggtagtcctgctggaggaagctcagccaggcctccgcgaaggactgggcgcgcttgcgactctccggcgaggcgatgcgagaggcttcgtcatacaccgcgaggaagtactcgaggcagatggccttgcgcagccggatgatgcgctcccccgcggtggtggccagcgtcgcgggcggcgtcatggacagtcccagcagctcgagctcctccgcgctcaaccacaagcgcccccggtcgagatccgcctggaggtccaccccgtcgtcgaacatctgcagtcccacggcggagagcttcgcgatgcgccgcaccgtggcttcgtccacgtccgcgagctggagccgctgcgccatgtaggcgcccggaacggccttcaggtaccagagggagaacagctcgtgcgcagtgagcggacggccctggtccagcgcgtcccgttccgcggcgaaggcgcgaagctgctccacgagcctccggcggccgtcgatgagcgggggcgcggcggccatgaactcccgcagcgccacgatggcgtccaggtcatcggtgaggagggtggcgtcgtcgagggccgcgtacccgttcgcgcggacgaacgcatcgatgcgccggacgccgaacccgtagtacgtccagaggcggccttcagactccgtggcggcaatctgtggcaggtagcccagcacatcggcttcgaggagccatcgccgcatcgcggcgagggagatgtcgctcagtgggttgccctgcaggtcgacagcgcttttcatgtcacggctccacgggagatccaggagggtgacaggatagtgaggggggctgcatgctccagaatgccttacatcggttgggccaggcgcttgtcgcaggtgggctactggtcctcttggccgatctccancggcccgaggccatcagtagggggagcagtagatgcgcctgcaggtcaggttcatggccgtcgtggcagcgggaaccgtggccttctccatgacgttcatcagctttacgagcttctgcttggtctgcttggacgattggggggccttcgctttcgtcttcgtcatgacactcctccatcgatggatgtggactgctggccaagcctgggcgctgacggcggatgcgtcaagcgctgagagtgattgcgcgaactgcgtgaagttttttcaggacgccacgcattccttcacgcgttgcggcgatgacttctgaatcatgtctcgcagcgcgccgtgtcccaaacgggctcagcaactcctcgacgcttacagccgcgccggagttcagctttcggaagaatatttcaatggcgcgtccaccacccgcgccgcgcagggcatggccgttggcggaacaaatccaccgtgtggcgctgtctcgttcgaagaggacggggaagctcgggtccacccgcacgtggtgtgagtcacgcaaaggcttttcacgggtgggcggtggcacgggctcgaagcctcccgaggtcaaccgcttgagccaggtggattggatgtgccgtcgcgcctctttcgggtggctgacatcgcgaaacgcgcgcacggcttcggtgagcgcccggggcagctccgtggccaggacaccgttcttcgagagggcaccgcgggccaggggcgaggccgatacccgcgcgagccgcgtctgcttccactcctggtcggcgagcgacgtctcgtcgagcatcccgcgcagcaggtcgtccacggaatagatgacgtggtgctcggtgatggggatgccgacattcaggctgctggccacgcctgcgccggcgctctcgcccacgtggtagtacgtggagggccagtagaggatgtcgccgggctcgacctccgcgacgaaggacgacgccaggtagggctggtagtccaggatggtggagacgtcctcgctccacggccgcttgtgccagaagcgcatccgcttgcgtccgcgcagcgcgaacatgaacgtggtgaagcggtccaggtggactcccacggggctgtgctcgtaggtcccatggaacagcgaggtgatgccgcccgtcacgggcatgcccacgcgctgccacaggccggagaagaaggcgcgttgccgtgaccagagctggaagccggaggcgtgcatcgtggcgatgatgagggcgtagcggcgctcgcccagttgcgaggcgatgcgggcgtcatacccgtccagggagccatcggactttctgggcagccactcccgggagcggagctgccgcagccggtccaccgtgaaggtgacgtcgggccgtgacgccggctcgtagctgcgggacaggtagcgctgggtggcgccggccgatgcctcgaagacgtcgtcgacggtgaagggggaggcctgtgttcccttgaagagcacggggcgctggttccagtagcgcctgacgaaggtgtcccagtcgaagcgggtcgcgatttccaaggtgggcatccgtcaggcctccgctccggtgatgacgtgaatcccgcgcagccggaggagcgccgccagcgtggcgcgactggcctctcgctgcggaccggggcgagccagtttgcacagctcaccgacgcaaggcggcgcttccgaggacagtgcgttgatgagccgctgtcccagggcctcgttggggccggggaaggcatgtccgttgacggcccagatccacagccccgaagggtccttcatccggatgatgtccacggtcggcgtcttcctcacccggtcggggtctgacaggggtggggcctggtccggcggcggcacgggctcgagcgcgcaagcgctgaccctccgggcccagatgaggcgcaggacctgctgaacgtcttcttcccgagtcagcgcgtggagcgtatccgcggcctgctcgacggatggaatggttgcctgcgcgcccctgcgcggccggcgccaggggtaggggtggtagggcacacgctcatcgtgcgcgtgccgcgcttcgaggagccccacgagcacgtccttggccgcgtccgtgggccggctccccttgacgggaatccatacccggacggccatgcagtccccctgggcttcttcgagctgccagtagcgagaggggctgtagagcagctcaccgggaccggcctccagggtggtggccttgtccaggtggcggtcgaagtcctcggtttcgttggggggcgagccccagagcttcttccagagccggacgcgcagccggccctggagcaccagcgtcaccagcgaatggtggggccgcttcgcgatgccgtaagggcctcgtgagaagcggcccagcaacaggtcggtggccatgggcagcaccgggacgcccacgcgctccaggagccccctgaggaagtctcgcaaggcgctccagagggcgaagtcgaacatgaacggttgttcgacgtggagctg

SEQ ID NO: 605 - DNA, 4870 bp, Myxococcus xanthus
atgggcgccccaggccccaggtagtcggctgcgagcggttcggaacgggtggcgttggggtacggcgggaagtggaccagtgcccgctggaggatggcctcctccgcgggcgtgcgcacccacccgcgggaggatgtctccacctcggtgcccagctccggcgggctccattcctgatggctgtcgctgccccggtagacagcgtgctcccatgagaagccgatgagaccgcccaccaccgccacggagaagagcagcgcgggaatccggacgacggggcgcgaggcggcaacgggcatcagcacgactccgacctcgcgcaacccaggtaccagttgccacgcgcctcgtaggtgcgctggttgttgttgcgcccccagtcctgccactcgttgctgaagtagccctggcggcctccctgctgctcgatttcctccacggcgccgtcaccactctggtcgggcttgatggcgaggctgggattgcgaggatcatccccaggcgtcctgtagctctgggattccagcctcaggctgtcatggaggagacccgagttgatggcctggttcaccaaccgctcggacgcgctcgacatgtcggtgaagccgctgttgtcctcgttctgatagagctgggtgacgcgctcgtgcatccctcgcccacccgcggtgcccggccgcacgtccgcgtgctccgtgagcgcccaggtgtcggtgaggatggcaatctgctcccaggggagcagatagacgttgtcgcctcgggcatggccctccgggagattttcgcccgttgcgtttctgtggatgccgttggcccgctcctgcttctccttggccagcttcacctcggagaattccggcaggaacgactccggcaagagatagttctggacgcccagacgcgcggaacaacggatgaggccaccccgcccgaaggtatccatgaaggactggtggagtgagactccgtacgcgcccacggcctgtgcatccagggtgcagtacacctgccgtgcgccagggttgagccagcacgcatgggcgacaacgtccgtgtggtggtcttctgaatcgggattggcgctgcactccggaccctttcctgggccgtagctgtcgatacccgactcgtggtcgcagtacatgtaccgcgaataggcctgtgccatctcgaagccggagaaggcctccgtcgtcgtccccccgtcctccgtcgcgacgctctcgggctccttctcatagtccaggacggtgtagtcccaggccgtggacagggaggtctcctgcgagtccaacatgtggcgcagcaggtcgaagaggaacagcgagtagaggaacacggggacgatgacgagcatgcacaccgccatttccaccgccggggcacctcgcctggatgcgcgctttcacagggacaccccggggacccgcgccagccgggatgcgtccgtgttgcctgccgcttccaggacctccgcggcctcgtcggatgagatggggtgcagcttcgcgcgccagtagggactgaagaggttgggcgcctcacgccagccattcgcaccgaagcggtggtagtagacgagcgccttggagagcgccacgccatcctgcgccgcgagcgtcagcgtcgctgtcccctgcgcgccatggtccagttgaatctgggccgacgcgttcaactcccagggcgcccggctcgggtcgccgacccggagtcgccgcgtcaggtagctgtacacgcgcggctgcccccaatccctgccagaggaggggttggctcggaacttcatgaagcagttgcccgaccgggcgcagcccgacaatgcgttggcgttgatgccctcgaagttgtgcgagcccgagtgcgcgccacccggggtatggtcaccgccgttggcatcgctccagacttccgcctcgtagtcggtcgtcgacgtgagctggtgctcccaggtattccgaatcgccccttcctctcgcgcggcgaccgtcgtcccctgattaccgcctttcttcccgccgtcgttgacctggcccttgtcctgaaccgacttcgccgttccctcgtgagaggtcaccgtgtacggcttcttctgtgcgatgtcccgaaggtcccggatgacgtcgtcatgcaggtacggaggctttgcaaccccgcgcgctgcggtctttcgtgccgccggccagccagaacgggtggcgttggagatttccgtcatgaccctggcgagcgcttcgggcgaagcgttctccacgctcccccggcagttcatcccatccaccgcgcagttgaattcattcgcgttgagcccccccacggcctgcggtagcgcaccaacgtccggcgcggtgtagtccgccaggagcgacaggccatggctgcggccatcctggatggcctgaagcgtctgggaatgcgcctcacgctgggaggcatgcaggttgtctaccatgacgtcgagcccccggatcgcggcgttgaagctggactccagggcacggaccttctggtcgtactcacggcccgcgttggcgaactcggtcgcgatcttcgtcgcttcaatggcgtgcaagcagtgctcgtagcaccccttgcaaccgcacatgattttctcgcgccttgcgaactccttgaagttcgcctccgaggcccgcatcatcgaacccgtcacgctcgccgccaccatgtatgcgtggatgctgttcatcgcgacgtaggaagccgcgatggcccggttgctgactgcatagtaattgagcgaccgcgcctccaggaccgccatggagtacgccaacgcgtcgctgtgctgctgcaaacccatcttctggcgcagcgcatgtgcgaggttgaagctcagcgtcaccatcagcgcgagcaccaggaaggacagcgctcccaggacaatggattgccctcgctgtgcgcgtctcctggccgaggcgctcacggcgccttgcctttgtaggagaatgggaagacgcattcgttgctccctgggagggctgcccggttgaggaagaagttggactgcatccgcatggtgtaggtggcgcgaatgggggtgatgtagattttctgcgcagccgcctgctccaggagggactccgtgcggtccggtttgtcgccctgattctttggatcggtaggcttgcgatacattcgcagttccttctgcagctcgcggccacgggtggattcgtagatgacccagtccgcgaaggggatgatcatccggtagttgaacgtcacctggacgcgcagcttggtgcggtggctctccttccagcccgtgggcgcggtgttccgggggtcatcgaagtccagctccggcccacctccgccggcatcgctccgcgtggggccgcagacggtgacctgcgcgtgtttcagtgacgtaccgggaatctggttgcccgacacgtcacgccacttggcctggaactccgccgcgcttcccaccggggggatgtaagcccccttctgcccgggaacgctcagcatcggcatcagcaccgcgagcgcggccttctccatctcctcgaccttggcgctgttcagcgacccagcccgcacagccttgtaggcggcgtacttggtcagcagccgcgcctggtgcatcagccccagctggaggatgcccaggatgaggaagacgaacaggggaaggacaatggcagcttcgacggccgcctggcccgactgattcctctcacgaatgctgcccatggcgccaaagactacctagcgccccccgcaaaaaggaaaacccagacccctcccggcccgcaaataatggcatccactgtcagacgccaaacagacgccacccacaggggctggaaatggccccaaacccaacaccagacaaaccctatcaggcaggcagccaggcaggggcttgcctagcgccgccggacaatctcctggatgagttcgacgtagcggcggttcttcgggttcagcttgaacgccctgcgaaacgcgtcttcggcctgcccccactggccttcgccctgggccacttctcccaggaaggcccagccctcctccagcgtgggctcctggcgcaacacctcctgcaactcctgctgcgccagccgtccgtgcgcctccggcttcatcagatagcgcgcgtaggcccggtaggcctggtacagcggcttcgggtcgatgtcgcaggcgtactcgaagtactcgaaggcccccgcgtggttccgcgcggccagccggaatttcgcctcttcgaactgcgtcgtcgcatccagcaagtccgtgcggatgcggaactgttcggccgtggtgggccgcgtgccccggtccttctcccgatgcgccgcgcgccgcttgcgccacagcaggttctgctccgcgtccgacagcgcgccaaacgccttcgcatgggccgccagcagcacctccgccttctcgcggagctccggcgtgtggaagcgcaggggcgcgtagcggtccgccagggccaggaaggccttgcgcagcggcaccggctgcacgtcctcgggcacgtccaacagcgcgaaggggtccttgctccggtgcgacatgaaggcgctcaccagggcattgcgcgccgcctcgtcctcgtcggagaacggcgtcccctgcggagctggcgccgccaccggaggcgccaccggttcgggcgcgggcgcggcgggcgccgtccccttccccgcgctcagccgggccgccttcgcgtccacgtcctccacgaagcccgcgacctccagcaggcacagcgcgtacaaccgccggagcaccacctccgtgtcgaacccggtgcgctccatcagctcaccgaaggtggggcgcaaccggagcgcctggaacagccgcgcgtccttcgacg

SEQ ID NO: 606 - DNA, 3380 bp, Myxococcus xanthus
aggcccggaatggcagccgcatccccatggtcgaagcaagcgagggcaccgcgcaaatcaccctggaagtccccggtggcgtgagcgccacgcttgaagcaggccaacggaggcgagctcacgctggaggcagcgggcaacactgtcacgctcgcccagcaaggcgtcaccgtccgggccgcgaccacggtgtccgtcaccgccagtcaggtggaggtgagcgccggtcaggtcacggtcaacgcggcgatgtcgtccttctcgggcgtcgtgaagtgcgacacgctgcagaccaactcggtgatgggcgtgacgtacacgccaggggcgggcaacgtatggtgagccaccccgtcaagctgcgcgggctcgttttcgacggagccaccggagccccgctggcggcccagcgcggcgcccccgcgttcatcgagcggcaggaccaggagttcgttcaagccatcttcggagagctcaggtccgaggaaggccgcaaggcgctggcgggcaccctcatctccgatgggacactcaacccccaggggctcaagctgctccagcccgttcacggggtgttcaacgtggccttgctggaggcctgctgcgacgtgttcggtgagcctcgggtcgaggcgacccgaatcgaaagcgcggggctcgtcatccgacgtgtgggcgcgggcaatacgcgcgaggcctgggttcggcgggacggcaaggtcgccggctgggtcacgctcgacggtgaggaacaggagcgcgaacccgaccctggacggcgcgaagggcccgcgggccccggccccgcggacgtccggcgcgaactgctgcgcctcatgcgggccaccagccgggaccaggagaccgtgacatcgctcttcatcgcgccgcccgacgcgtgcgccgcggcgaagcgcaccgtgctatacgggctgctccaggtagcgagcggtgaagcaccggagggagcatccagcacagcgcccgcgttcgatgacgcgcaggtgcggagcctgctgtccccctacttcgccgcgggaaagacggtggactggacagggctcgaaggcctgtcggtcacctaccaggatgtcgcccagcgcagattgccgcaggcgaagcacgacaagctcgccctgttcatcgacttcctgcgtggactggtcgcggtgttcgacgccttccaagtgcccgcgctcatgacggcgatgaaccgcgtacagctcgactatggcaatggccagaagcggcccgcgggcacggcgctctccgggctggcggacgtcctcgtccaggggaagacgggcacggtggtgttgcctcgttcgtggacgcatcccaatgcctcggaggcggcccaggtcctccaggcggcgaaggccgccaccgcgccacggatgcgggacctcatcccgcctgagcggcgcttcgagcggcgtggctcgcgctacgtggccagggccttcgtccggatccaccgcgaagatggctgcccacccgccatcgtctggagcgaggagagcgcgcccttcaccatcgccgcctggcacgagcgcggaaaacggccgcccgtcctcatcccccttccgtcgctcaaggacctgagcgccttcaagcccaacgtcaccttccaggtgccgccggggatgaacgagctgctgaacaagaactcgccgaaggactttcctcgaaggcttcagccagtacccccgcgggtcagggcatcgggtggctctgtgggttcaacattcccatcatcaccctctgcgccttcatcgtcctcaacctcttcctgtcgctgctgaacatcgtcttcttctggattgccctcatcaagatctgcatccccattcccgcctcgctgcgcgagcggttcgaggactgaccgcgccatgagcccgaagcctcccgacaggcgccctcccgtgggctttccgctgcggctcgtgccggacgaacgcggcgagctggcgtttccttcgctagaagccagcgtgcggcagtccatcgaggtcatcctccgcacgcgccccggcgagcagctcatgcgacagggcttcggcgccgggctggagcggatggtgggacaacccaacaccgtgtccacccgccggcgcatccaggagctggtgcagcgcgcgctcaccgagtgggagccgcgcctggaactcatccgcgtggacgtgctggagctggcggacctgcccgcccaggtccgcgtggaaatcgtctaccgcctgcgccgcacgggtgacgtgcagcagctcgggctcgccatggacctcggaggctagatgcccatcattcctccccgactcgacgacaggagcttcccggacctcgtcgaggagctgctctcccgcatcccgggccataccccggagtggacccatgcccgcgtgggcgacccggggcgcaccctgctggagctcttcgcctggctggcggactccatcctctaccgcgccaacctcatccccgagcgccagcgactggccttccttcggctgctgggcgcgagcctgcgccccgccgaggccgccaccggcgtggtgagcgtgcacttcgacaccgaggtgctccagccttccgtgtcgctgcgggccttcgccgcgttgcgcaagcccgtgcccttcgaaacgctggatgagctgaccgtggtgcatctcaccgccgaggcgtaccgcaagcgcccgctcacggagacggagcgccaacagcacgcgtcgatgctgccccggctcgcgcaagtctatggcctggaccccaaggcccagcacggcttctacgcgacgacgcccgtgttccccctcggcgccgctgacccgcgcgggctggacctggtgacggagacggtggacggaagcctgtggctcgcgctgctcgcccccaaggcggaacacgtggtggccctccgtgaggacctgacgaaggggaacggacaagggcctcgcgtcctgagcgtgggcgtctcccccgtcatggaggtccccgccctgtccgagctgctcggtgcgcgcggccggctgccacacgtctgggaggtaacgggcactcccgccgcggacgggttgccggtgtaccaccggctcaccgtcgtggcggactcgacgcaggagctgtcccgccggggcgtcgtgcggctgctgttgccatccgacctgggcgcgccggtcaatgacgtgagggcggacgcgcgcgccggcctgggcgaccggccgccacgcctggacgacccaagggtggcggcgcgattggtgacctggctgcgcctgcgtcccagcggaaagccggagcgcttcgcgctgggctgggtggacatcaacgcggtcgaagtggaccagcgcgagacgaccggcggacgcctgattggacagagc

SEQ ID NO: 607 - DNA, 3841 bp, Myxococcus xanthus
ggtggagaggtgtgcgggatgctccaggtgctgcgcgcgccggggaagccgttcgacgaacgggacctgcgcctgctgggcacgctgtcggagttgctggtgacgctgctggagcagcgccggctgcgggccgagtcctcgcgccaactggccgagacgcgcctcctgctggacctggcgcgcaccacgtccggtgtgctggagacgtcgagcatcctggacgtggccgccgacttcctcgtccgcctgctggacgtgtccaactgctacatcctgctgtacgacgagggcgcccggctgctgcgcggcgccgcggcctccatcgcgcaccgcgactacttccgcacggtggtgttgcccctccatggagacggcctgacggcgcgcgtggcgcgtgagcgcaggcccatcgcggtggaggacgtgtcctccgcggacggaggcttcaacccggagctcgcgcaccgcttcgacgagaaggcgctgctggcgctgccgctcacctcgcgcgaggagctcatcggcgtggtggtggtggacgacacgcggggcccgcgcgccttcggtccggagctcatcgagctggcggaggccacgtgtggccagctggcgttgtccatcgccaacgcgcgcttgtacgagtcactgtgggccagctacgcggagctggccgccacgcgcgcggagatggtgaagcgcgagcggctggccgcgctgggcgagctgtccgcgattgtcgcccacgaggtgcgcaatccgctgggcgtcatcttcaacgcggtggcctcgctgcgccggctgttggtgccgggcggggacgcggccatgttgctcgacatcctgggggaggagagcgaccggctcaaccgcatcgtcggtgacttgctggactacacgcgtcccagggacccggtgctccagcaggaggacctgggccgcgtgctccaggattcgctggaggccgcgcggatgcagggcggcggcgcggaccgctccatccgcatccaatccgacgtggagcccggcctgccgccggtacccatggaccgtcgcctcatccgacaggcgctggtcaacgtggcggtcaacgccatccagtccatgccgcagggtggactcgtgcaggttcgcgcgcgccgtgaagcccacgcggggcgcgagcaactgcgcatcgatgtggtggaccagggcccgggcatccccgccgagctgctccaccgcgtcttcgagccgttcttcaccaccaaggcccagggcaccggcctggggctggccgtcgtcaggcgcatcctcgaggagcaccggggcgaaatcgccgtggacagtattccggggcgcggtaccaccttcaccttccggctgccgttctcgcagcctccgtccttcccatgaccgacgcgaacactccgccgacccgaggacggctcctcgtcgtggacgaccagcgcaacatgcgcgccaccaccgccctgttgttgcgggcggagaactacaccgtcttcgaggccgccaccggcgaggaagccctggcccagctcgccagcggcagcatcgacctgctgctgacggacctgaaaatggagcccatggacgggctcacgctcctgcggcgcgcgctggaggtggctccccggctccaggtcatcatgatgacggccttcggctccatcgagagcgccgtggaggccatgcgcctgggggcctacgactatgtcaccaagcccttcaaggagagcgagctgcgctaccgcgtggagcgcgccctggagcgcgcgcgcctgcagcgcgacgtggacaacctcaccaccgacttcaaccagcgccacggcctgtccgccctggtggggcgcagcgccgccatgcgcgagctcaccacgcggctgatgcgcgtggcgcagagtgacgccaccgtcctcatccagggcgagagcggcacgggcaaggagctggtggcgcgcgcgctccatgcgcacagccgccgcaaggcccgctccttcgtgcctgtcaactgcgcggccatcagcgagtccctgctggagagcgagctgttcggccacgccaagggcgccttcaccggtgcggtgaagtcccgccggggcctcttcgaggaggcggacggcggcacgctcttcatcgacgaggtgacggagaccagccccaccttccagtccaagctgctgcgcgccctccaggagggcgaggtccgccgcgtcggtgagtccaccgcgctgcgtgtggatgtgcgcatcgtcgccgccaccaaccgggacatcgagctggaggtgcgcgacaagcgcttccggcaggacctctactaccgcctcaacgtggtggccctccgcgtcccgcccctgcgcgagcgcctggaggacgtgccagcgctggcggagcacttcctggagcgggccaatgcccgcagccccaaccccaagcgcctttccgccgccgcggtgtctcacctgatgagctacggcttccccggcaacgtgcgcgagctggagaacctggtggagcaggccgccgcgctcgcggagggcgatgagctgctgcccgaggacttccccgtgcggcagggccgcatgacgccggcccatggcacccccagcgtcgccttcctggacgggcagggcggggcgctcgggcgcaacgccagcgcggggcccacgctggcccaggtggtggaagaggcggagcgccacgccatcacccaggccctggagcggcacggggtggacctggcgcgcgtcgcggatgagctcggcgtctcctccaccacgctctggcggaagatgaagcggctcaacctccgcccccccagtgagctggcccgggaatagccctgaagtagggggaaggctcacccatgtaactttcccgcggccatggattcagatccgaaatggacgggttcataggtgaaaaagacaaatagttgaatttgctcgtctttttcacttctgaaaccccattgcagtcatgaaatggagcggcggggcagaagcagcgtcagttagtccttcaagtgcttgagaaaactagagtttctccccgcgaggctgctggcacggcgactgctataggaatgcgcgggacacatcgaagcgaggctgaaggcggttcccccccaccccttcagcacttccggtgagtcaccttgagaagacccgcggcccggcacctctttggggtgtcgggccgccttcttttccgcgtctgtagctgcctcggctcgcgacgaaaggaagcgcaggtgggttcctctgaatctcagtgggtgctgcgtcccggtcggctggaagaccacgctgtctttgcccggctgtttcttgaactcggggtggatgagccctcgccgcccgagcccgtgtgggcggcggaaatcgctcagcgctccctgttcgccgaaggtccccagggtgtgggcgcctacgccgtgacgaacgtcctgggggacttcgggttcgtgaggcaactggtggtggcgccgttcgcccgggggcagggactggggcggaggatgatgacgcacctggccgggcactttcgcgcacaagggtgcacccgctgggtcctcaacgtgaagcgggacaacaggcctgcgctcgagctctacacgtcgctgggaatgcggccggcgcgcgaggccaccacgttgcgggtgacgcgggcccacctggcggcgctcccccccgcgtcaccggacggggccgtggtgccggtgtcgctggaggactgcggcgcgctgacggaggccttcgggatgattcccggcaagctggcggcctccgcggccagtgactcgcaccggctgctggggctcatcgacccccaagcccctgcg

SEQ ID NO: 608 - DNA, 4862 bp, Myxococcus xanthus
cctctcccgccagcacccggaccggcagcgccgcctccaacgagaagggtgccgtcacgtccgtccacgtgacatccagcggggcccggccgccattcaccacgcggacctcggcctcccgccgggtgcccgggtaggcatgcgggaagtccacacgccgcgccgacaaccgcaaccgcccctccgcccccgacagggacggtgtgtcccgacaagccgccgctccccaccccagcatcagcgccaagacaatgccgctgtaccgggacgcctgcgttgcgtgcgccatggcgttcccccccgtgccttctggctatacccacgccagaaggcaccgcggacgccccgccccctcgatgtcccacctcccaacacttcagggtcggcggggaggggggcagtgttttttacaggccgttccactgctacaggctgcaaccacgcgaaatggttggatgccggaagggtatggttctggcacccggggtacgccatgacctctgtcgcatcctcctcatgcgccccttcgtcatcgcaggccttcaccgtgctcatcccacgcggccttcaggcggccgtggaggggctcgcggcggagacccgccaggagctgctggccgagctgttccgcctggccgcgctggcccggcaggaggaaagtcagctactccccgagttcccgtacacgctgcggctggacgtcgccggctgccaggtcagcgtggagctggacccgtcccgctcgcgcctcaccctagtgggcctgctgcggccccagccgctggagtgagcccggcgacccgcctgggctggggtgagatgtcgcgccgtgctggatacgcagaatcctgggacctcacgtacctggtggagcagctccgggagctgattgggcacgacctgcgcctgggctcggccctcagcgatgagctggaggacgtcctgggcagcctggtgcagcgcaatcagcgcctgagggtcctgcagcgcatggtgaccgcggaacgcgccccagaggacctggcggcccttcgcggggcattggaggagatggaccgggagctgatgacccggctgcctgcgttgctcgaacagctgcgcctggcgctggcttgaggtggggcaccggccctgggtttccacaggcacttcatccccagcgccgactgcttcttctaaaggttcataagaggtattgatctattggtagtggcagtaggcagctcggacttggggacaagtcagcaagctcccgggaacactcacgaattcgggatgtgctacatgtgggtaaagtgacggttatccccgggaacccacaggtgttgatccacaccgaggtttctccacagcccctcccccactgtccacaggccatccacagcttccgagtggatgcgggaaccaccccaggtggaggcccgttctcaccacacgtccgccccgcacatgcctgttatcgtctggcgcgggatgtgccccgacagcggggtgccggcggagggtttccccatcgacttctatcggggcgagcgcatcgggaagtacgaggtcgtcacgcagctctccgtgggcggaatggcggagctgttcctgggcttcacttcgggtccgggtggcttccgcaagtacgtggtcatcaagcgggtgctgccggacgcgcgggacaatgcgcagttcgaacgcatgttcctggacgaggcgcgcatcaccgcggccttcaaccacccgaacatcgcgcaggtgttcgacctggggcgcgaggatgacgggctctacctggccatggagttcatcgccgggcagaacctgaaccagattaccggcgcgtgcctgcgccgccaggagcagctcccgctgggcttcacgctgtcggtggcgcgcgacgtctgcatggcgctgcactacgcgcacacctatacggcgccctccggcgcgcccagccccgtcatccaccgcgacgtcgcccagaagaacatcatggtgacgtacgacggcgtggtgaagctgctcgacttcggcatcgccaaggcgaaggacagcttggagcgcaccaacgtcggcacggtgaagggcaccaccgggtacatgtccccggagcaggtgcggggcgatacactggatggccgcagtgacttgttctccgtcggggtgatgatgcacgagctcatcaccggcgcgcgcctgttcgcgggcaagaatgagcgcgacgagatgatgaagatcctggaggcgcccgtcccctggccctcgcacgtcgcgccgcacgtgcccgaagaggtgtccaaggtggtgatgcgggcgctggagcgcagccgcgagaagcgcttcgccaacggccgggacatggcccgggcgattgaagcggcggcgggcaagttgctgctggacgcgcatgaccgggccgcgctgatgcaggactggttcgccgagcgcatgtccgccacgcgcgtcatgctggagtccgcggacggcaccaccaacggcgtcatgctggactccgcgaagcgggccctgcgcagtgatgacggaccctacctccccgagcgcaaggacatcccgacgccgtcgaacggcgtggccggcatgccgcgcaagccctcgcgcaaggtgcccgctgctgcggcgccccggaaggcttcggcggccgtggagggcacgccgcagccgccggagagcaaggcctccaatgtgctgtgggggctggtgctgatgggcatcctggtgggcggtggctatgccgcctggcacctgtcgaaggtgctgaacgagacggtggatgaaaaggacgcgagcgcgctgcgcaccctcccccaacacgacccgaacctgcccgtctacctgggaccaggctcgggcccgcccacggatgccggcaacacggagactccagcgaaggtgtcgggcggcgaggacgcggagggctcccgttccaaggaggcggcgagcgcccgtccggtgaagggccggggcaagctgaccttgctggtgctgccggaggcggaggtcttccgaggcaagaagcgggtgggccgcacgccgatgttcaacgtggcgatgcccgcgggggagcacgacctgaccatcgtgggcccggacggcaagaagcgcatgctgtcggtgccgatcagcgccggggagacgacccagttccggctgaagctggcggaaatccccgagcgctgaaacacagaaccgggattgaggggcacgtcccggggcacttggttatcttcgcgcccctctccctctgattccggactgtatggcccctctgaccattggcttcctgatggacccgctcgagacggtgcgggtggaccacgactccacgttcgcgttgatgctcgaagcgcagaagcgcggccatcaggtgcgctacttcgaacagggctggttgcgcttcaacggcacgtgcgcggaggcgcgcatgcgccacgtcaccgtgcgccgcgaactggggcggcacttcgatatcctcgacgaggcccctcgcccggtgtcctcgctggacgtgctcttcatgcgcaaggacccgccagtggacgcggagttcctgcacgccacccagttggtggagctgtgcggcacgggccggccccctgtcttcatcaacgagccggcgggcctccgcgacgcgaacgagaagctcttctccctgcgctacccggacctgatgccggacacgcgcgtcaccagcgagctgccggtgctgctggacttcattgcgcgcaacgcggcgggcaccatcctcaagccagtggatggcttcgcgggcaagggcatcctcttcctgtccgccacggaccggaacgcgcgctccgcggtggacatgctcacccggggcggccgcgaggccgtcatggcgcaggcgtacatcccggagagccgccagggcgacaagcgcatcctcctggtggacggcgagccggtgggcggcgtgctgcgcgtcccgtccgacgacaaccaccgcggcaacatggccgccggcggcgtgccccaaaaggccgtgctcaccccgcgggatttggagatttgcgagcgcctgaagccggagctggtgaagcgcggactgcggctggtgggcatcgacgtgctgggcacctacctcaccgaggtcaacgtgacgagccccaccggcctggtggaggcgaaccagctggacgacgtgtgcgtggaggccaaggtgctggacgtggcggagcggctcgtcgccgagcgcgccgcgcgctgagccccgccggaggacgccgggcggcccggcgcccggtgtcttccctgagctgagggctgactcatgtttcagcgcaccacacgacgcggtgcgtgatttgaatcctggttcatgtttcagcgcgatgcgacgcgacgcgccttgaatcagtgactcccggaagagtcaggtttcgccccgcggccgcccttttccctcgtggccgccagggagacaccatgctcaagcagcgtcgcagccgttcctggccgtggtcgtggtccgccggggtgcctcttgccgcgtggctgttcgcgggcctcgcgggctgtggcgctcccgtcggggacgcgccggaggtggagcccgaggtgacggagcagcagcagcccctgctgacgcaggtgacaagcttcggtagcaaccccggcaacctgcagatgttccgtcacgtaccgtccggcatgccggccaacgctccgctggtggtggtgatgcacgggtgtacgcagcgggccgcggggatggagggcgccggctggtccgcggcggcggacgtctacaagttctacgtcgtctatccgcagcagcagggtggcaacaacatgaccagttgcttcaactggttcgagcccggtgacttctcacg

SEQ ID NO: 609 - DNA, 4042 bp, Myxococcus xanthus
tgtgctctaaagccgggccggccgtcgtgtcatcttccgaggccacgtcgaacccacaggacagcgaagcgggcgctaccggcacggacgcatcggctcctggaccggaaaccttgggcacgcccggagcgtcgtctggcgcgaccgacagcgcaccagttaccgcgcccgacggccacgaggcaccgtcaatgggcacggagccaccgccgccagaggacccgctggcgcaggggattcccacgccgggagacctcaagcgcctggacttccgtgggggtgagcctcgcgtacccgtgcgcctgatggagggccggaacgaggtcaccttctctccgcgcggccggatgcgcctgcgcttcggagggcccgacgagaagatgctcgacgcggccgcgggcacgcgctggacggtccgggtgacgcaggggagcccggcggtgctgtccgcgcgcgtgcaactggcggagttccgcatggccgaccgcgcgggactccaggcggcgctggagtcatggcgtgagaaggggctcgcggtccgagcccaggtcctgggctccgtctacggcatcgccggcaaggtcatcgacaaccggcgcaccctgctgctggtggacgaggtcctcacgcccgaggccgccggccacaagcaggcagagttgctgcgcagccacggcgtccagacaacgctctttgaagaagtgcgcacgccctccaaggccatcctggaggtgcgcgacgaggcgggcgtcgtcgtgggattggcccaggaccggctggacgcggagacgcccgacggcgcgggcttcgacgtgcgccaggtcgaatacggcgtgggctacgacttccacggcttcgaggaccgcaccttccggggcgcgctccagctcgtcgtggaccgttcgggccggctggcggtggtgaacgtcgttcccctggaggacctgctcaagggcctggtccccgcggaaatcttcgcccgcgcccactcggaggcgctcaaggcccaggccgtcaccgcgcgcggcgaggtgctggcgaaggtgggcatcaagcacctggcggacccctacctcctgtgctcggagcaacactgcgccgtctaccggggccgtaccggtgaggccgccagcaccaccgccgcggtggaggccacccggggcgagggcctcttcagtgaggacggccgcctggtggactccgtctacagcgccgtctgcggcggccacaccgaggacaacgacgtggtgtggggcgggcctccggaccccagcctgcgtggccgcccggacgtcatcggccccgtgggcgcccatcccctgcccgccagcctggagcgctggctgacgaccgccaacctcccggcggcctgccggctgtccagcttcgcgcagcccagcaagttccggtgggagaagcgcttcacggccgagcaggtggacacccgcctgaagcggctgggcgtggggcgcgtccaggccctggcgctgacggaccggggcgtctccggccgcgcggccgtgctgacagtgtccggcgacaagggggccacccaggtgcgcggcgagctcaacatccgccgcctgttcggcatgctcaacagcagcatggcggtggtggaggccgaacgggacgccgggggccggctcaccggctggcttttccgtggcggcggctgggggcacggcgtaggaatgtgccagacgggcgccattggccgggcggaggccgggcagcgctaccaggacatcctccgtcactacttcaacggtgccgaggtggcccccatctattgaggctgggaggggttatccttcaaacccgtgcgcggcccgcgaatcgccccgacctttcacctgttcagccgcgaacgcgacgggactagtccgcccgttcggaggtttatcatcccgccgtgagcacgggttctcccacaaattggcgccgccggaggcggcaggggtcgtccgcggggcgtttcgccgcggcgattgcgctcgccctgctcctccatgccgtctacgtgggaaccctgctgctgacgagttcgttccagggcgacgggaaggcacgcaagccggtgacgcggcccacctccgtggccgtacgtccgctcaccgccgaccaatgggcgcagaaccgcggaaaggcctccccccagacgaagtcccaggcgtccgagcgtcccaaggcccaggacaagaagccggaagagaagaagcccgacgagacgcccaaggggcaggtggtggacgtcgcgcccggcaatgacgaggtggacccgaacgcgaagtacctcgcggagagcaacaaccgcgtgaacaaggagacgcgcgctcgggagcagacgcccttctaccggaacgccatgccccagcggacggctccgcagaatcaagaaggtcagaatacggacgcgcagacgccgccgcgcatggccggcaacaacggcatgggcaacgacgaccggcccgtgtcccagggtggccagaagcccgccttcgagattcccgacgcccgaaagaagaacgaggtggcgatgaagacggacccgacgtcgccgggtccgggcatgacggtgaacaaccagaacgagagcgacgaggtggtgggcaactccaagcgcctcaacatccagcccggcaccggcggcgaggaagccggctccacggtccgcgcgggcgctccggggctggcgtcgctgacgccgtcgcgcgccgtcatggacaaggtcctgggcgccgcgcccaacgaccacctgcaggacgcagaggaaggcgatggcaccctcctcaacacgcgtgagtggaagtacgccagcttcttcaaccgcgtgaagcagagcgtgggcatgcactggaaccccaacgagcagctgcgccggagagaccccaccggtggcatctacacggggagagaccggtacacgctgctgcaaatcacgctcgacgagcgcggccaggtgacggacatccaggtggagaagagcagcgggctcgacttcctcgacttcgaggcagtgtcgtccttcaaacgcgcgcagcccttccccaacccgccgcccggcctgctttcggacgacgccaaggtgaagttccagttcggcttcttcatggagatgggcggcggcccgaagatgcggctgttccgccagcccaactgagcacgcactgaagtaccgtgcggccccgtggaagcaacgacgctcaccgacagaaacctcgcgcagcaggagcggaaccggaaggtccgcagagtgctgctgggcatcctcgtggccaactgggtggtggccagcgccaagctgatcttcggaatgctcagccagtccgcggcggtaacggcggacgggctgcactcgttcatcgacggcggctccaacgtgctggggctggtggccatgggcgtggcgtcacgcccggcggacgaggaccacccctacggccacggcaagttcgaggcgctcgcgtcgctgggcattggcgcgatgattggcgtgggcatgctggagctggggcgcatggcgctcgactccgtgctcaacgacaagcacccgcaggtgacgggtaccatggcggccgtcatggccttcaccctggtggtgaacatggtggtgacgcgggtggagcggtactacgggcgcaagtacaagagctccctgctgctggcggacgcgagccacacgatgtccgacgtctacgtcaccctcgcggtgctgagctccctgctgctggtgtggctgggctacccgcgcgcggatgggctgattgcgctggcggtgatggtgttcgtggcctgggtggcctacggcatcgtccggcaggcggtgggcatcctctccgacacggcgcgcctggaccccgacgaggtgaagcggcacacgctggcagtgccgggcgtgcggtcctgccgcgacgtgcgcagccgcggcatggaggagagcgtctacgtggacctcaaaatcgaggtggacccgcagctcaccaccgcgcaggcccatgaggtagcggaccgcgtggagcgcacgctgcaaggcgcctat

SEQ ID NO: 610 - DNA, 4873 bp, Myxococcus xanthus
gtgctctaaagcgcagctcgtcacgcagggggaacccaggcggtgacgctcgaggccgtcgcggcgcacgcgggggtgacgaagggcggcctccagcatcatttcaagagcaagcagctgctgctcgacgcgctgttcgaggagatgaaccggcagttcgtcgagtcgttccacgcgaacatcgcggaagacccggaggcccatgggcgcgaggcgcgtgcgtatctgcgtgccatggtctccagtcccgccaactccgagcagattcggggcttgagagccctgattggaagcatgatggtggagcccgaccttcgcgaacgatggaactgtagctggcaggatgacctccagctgaagtccggtgaggtcagcccccaggacatcaattccatcatctgcaggctcgcgaccgacggcctgtggttcgcggacctgctcgaggaccagggaatcaggcctgaagtgagagccgccgtcatccgaaggctcgaggaactcacccgggagtaggcgcccctcgctgtcagtgtgtctgtctccggctgacaccccggccaagaattcgtctgtcagggtctcccgtgaggggccgtccgtggcgggtttgtgtctcgagatgcctcattcgtcatgtcatctgttcgggcgcaggtgacgtttcatcccctggctgctggcggaccagggcgtggtgctgtgtgaaaagtacgcttttacgttttctccgacgttttcctcgccagacgacaatgcctatccaacggtcgaagcgccttcttcttgcatcgacgctgctcccgcttctggcctgtgacggcaagcaggaagaagcagccttcgcaccgccggtccagaaggtgtccacgctgaaggtgcaaggggaggccgttgtccttcacgacgaattccccgcgcgtgtctccgcgttccgggtcgcggaagtccgccctcaggtgggcgggctcgtgcgcagccggcgcttctccgaaggagacacggtccagaaggggcagccgctctaccaactggaagcggcggtgttccgcgcgaatgtagaaggcgcggcggcggcccatgcggccagtgaggccgggcggctccaagcggagctgcatgcggggcgcatccagtccctcttcgagaaaggcgcgagcacccagcaggcgcacgatgacgcccgggccgcgctcgccatcgcgaatgcggaggtggcgcgcgcccgcgcggcgctggacagggcccgcgtcgacctggactacgccacgattaccgcccccatcgcggggcacatcggcatctccaggtcaatgaaggcgcgctcgtcggccccgcggatgccacgccgttgagcgtcatccagcagattgaccgcgtcttcgtcgacatcaagtcacccgtggagcgcgcggcgggcttgcagtcactccagggaggcaccggagaggcgggggcggaagtcatcgtgctctcctcgacgggggcgccctatccggagcgaggccgcgttcagttctcggacatctcggtcgaccccgggtccggcgagctcacggtgcgcgccctggtccccaacgcacagcggaagctcctgccgggcatgttcgtgaaggcgcgcgtcgtgctcggagaggtggccggtgcgctcctcgttccccagcaggccgtgcttcacgacgcgcagggccaggcgcaggtcttcatcgtccgagaggacaacaccgcggaggcgcgcaacgtccgcgccggacgcatcgtcagcggacgctacctggtggaggagggactctccgccggagagcgtgtcgtggtcgaggggcaggaccgtcttgcgccaggccagcaggtcacccccgtcgagtggcagcacgccccggcctcgcgctgaacctggagtgagccgtgccaagattcttcattgaacgcccggtcttcgcctgggtgattgccatcttcatcgtgctcgccggagccatctccattccccggctccccatcgagcgctacccgtccatcgcgccgccgagcgtgacgattaccgccacctatcccggcgccacgccggccgcgatgaacgacagcgtcgtgtcgttgattgagcgcggcctgtccggcgtgaagaacatcctgtacttcgagtcgtcgagcgacacgtcgggcatcgcgcaaatcgtggtgacgttcgcgcccggaacggacccggacctggcgcaggtcgacatccagaaccgtctgaagaccgtcgaatcgcggctgccgcagatggtccggcagctcgggctccaggtggagacgaccaccaccaacttcctgctcttctccacgctcgtgtcgagcgacggccgctacgacgaggccgagctgggggacttcctgagccgcaacgtggtcgaggacctgcgccgcgtgcccggcgtggggcgcgtccagctcttcacgccggcccgcgcgctgcgcgtctggttggacccggagcggctcatctcgcacggaatctccgtggatgaggtcgcggcggcgattcgcgcacagaacgcggaggcctctcccggacggctgggggacatgcccgcggttccaggccagcgcgtcaccacccccctgatgctccaggggcagctcctggacgtcgcggacttcgagcgcgtcatcatccgggccaatccggatggctcgaacgtgctgctcaaggaactcgccaaggtggagctggggccccagagctacgcctcgtccacccggcagaatgggaagaacgccgccacgttcggcgtgcagctggccccgggggcgaacgcgctcgatacctccgagcgcatccgcgagcggatggcggacctctcccgggcctttcccgcgggcgtcgagtacacgattccgtacgacgcggcgccgttcgtgcgcgtctccatccagaaggtcgtccagaccttcttcgaggcgatgctgctcgtcttcgcggtgatgtatctcttcctgcagagcgtgcgttacacgttgattcccgccatcgtcgcgcccatcgcgctgctgggaaccttcgcggtgatgctggcgtcggggttctccatcaacgtgctgacgatgttcggcatggtgctggcgattggcatcatcgtcgatgacgccatcgtcgtggtcgagaacgtcgagcgcctcatggcggaggaggggctttctcccctcgaggccacgaagaaggcgatgaaggaaatcacgggcgccgtcatcggcatcaccctggtgctcacgtccgtgttcatccccatggcgttcgccacgggctccgtcggcaccatctaccgccagttcagcctggcgatggccgtgtcgattctcttctccgcgttcctcgcgctcacgctcaccccggcgctctgcgcgacgctgctgcgcccggtggagcccggccacgcggggaagcgccgcggcttcttcggcggtttcaaccggctcctggagcgggtgacggggcgctatgcgaactggacccgggccattgtcgggcgtctgggccgggcgttcttcgcgtacgccgtggtggtcgccatggtggccctggcgttctggcggctgccgggcgccttcttcccggaggaggaccaggggttcctcaacgtctcggtgcagctcccgtcggacgccacggccgagcggacgaacagcgtgctcggggagctggaggccttcttgagcgagcgcgagggcatccaggacgtgctgaccatccagggcttcggcttcttcggctcgggggcgaacgctggcctcatgttcgtgatgatgcgcgactgggacgagcgccagggggagacggcggcgggtgaggtcgccgccgccaacgcgcgcttcgcctctccgagggagggcatggtcatcaacgtgctgccgcccgcggtggacgggctcggcaacagcgcgggcttcgccatgcggctggaggaccgtgccggacacggcccgcaggcgctcaacgacgccatgaaccacgtcctccggcgcgcctcggacagtccggtcatcgccttcccctatcaggaggggttgccggacggctcgacggtgcgaatccaggtggaccgtgagcgcgcggcggcgctcggtgtgtcgttcgcggaaatcaactcggttatctccaccgcgctggggtcgacgtacgtcaacgacttccccaacaagggctacatgcagcaaatcatcctgcaggcgcgcgcggagtcccgcatgcaggtggaggacgtgctcaagctccccgtgcgcaacgcgcgcgggcagatggtgcccctgtcctcggtggccgagcccgtctgggagcgggggcccatgcagttggtccgctacaacggctaccccgccgtgcgcatcgccggggcggcggcaccgggcttcagcagcggtgacgccatggcggagatggagcgcatcgcgggcgaactaccacccggcttcgcggtggagtggacggggctctcctatcaggagcggctctccggctcggaggcgcccatcctcctggcgctgtcgatgctcgtcgtcttcctggtgctggcggcgctctacgagagctggtcgattccgctgtcggtcatgctcgtcgtgccgctgggactcatcggcgcgctggcggccgtgatgtctcgcgggttgatgaacgacatcttcttcaaggtgggcctcatcaccatcatcggcctgtccgcgaagaacgcgattctcatcgtcgagttcgcgaagcagctcgaggagcagggacgctcaccgctccaggccgcggtggaggcggcgcggctgcgtttccgtcccatcctgatgacgtcactcgccttcgccctcggcgtggtgccgctggtggtggccaacggcgcgagcgccg

SEQ ID NO: 611 - DNA, 2388 bp, Myxococcus xanthus
cccccgctgctgcgctcctccacggagattcgaggccgggcgttggccatctccaacattccttccaggccccccgccatcagctcgggccggttgtagcggtccgacagggagaggcggcggccgcgctcgccttcggaggacatcgagacgtccacgtccgagcggcccatcatcgccaggtagcgaggcacccgctccagggcctgcgcaggcccaatcatgggcagggccaccgcggccacgcggcctaccagcgtctgcgcgaagccgaagacgccctggcggcccagttgccggtaggcgtcctcgtcaccgagctccgcgtatcgctcccgccgtgccagggccaccgcccgctgccagagcgcaatggggtagtccaactccggctttcggctgtcgtaccccagcgcctccagttcctgggccagccggccctccgcctggagaccccgcacgaagaacccctcgaacacgctggcgggcacgcggggcggtggcggggacatgcccccagtctacgctaaatccactatgagttcatgtatttctgggattgcgggttggtgccggagtggagggtacgggggcgagggcgattgccagcccgcgacccgggttgctatggggccgcgagcgccttagaggagtcgtccaaggagatttgaatgtcggtgaacatccagctcgagtggaccccgaaccccagcacgctgaagtacgtggtggaccggcggttgttggcgggcggggcggtgaacttcacgaaccccgaggacgcccaggcgaagtccccgttggcgcgcaagctgatggacgtgcgcggcgtcacggcggtgatgattggcaccaacttcgtgacggtgacgaagggggaagagggcgagtgggacgagctcaatgacgaggtcatgtccgcgctggacacccacctgacggccaacgagccggtggtggacgaggcggcgctggcggcggcccgcgaggcggcgggaccgtccggtggtggcacggttgaagggcgcatccaggacatcctggacaacgaaatccgcccggcggtggccatggacggtggtgacatcaccctggaccgcttcgaggacggcatcgtctacctgcacatgaagggggcgtgcgcgggatgcccgtcgtccacggcgacgctgaagatgggaatcgaggggcgcctgcgggaaatgattcccgaggtcctcgaggtggtgtccgtctgaggcgcaacgtcaaagcctcgcaggtccggcgggagctgctgccggaccagtcccccgcgctgctgcgcgagctgcatctgctcacgcgcgaggggcacctcaacgcggacgcgctgcgcaagctcaagcaggtgaaccacctgatgggcttgctgcgtcccgccgtggaggatgtccaggcgcgccacccgaacgcggtgatggtggacgcgggcagcggcaacgcctacctgggcttcgtcctctacgagctgttcctcaagggctccgccagcggcacgctgctgtccattgaaggccggccggacctgacggagcgggcccagggccgcgcccaacggctgggcttcacgcggatgcagttccagacggcgcacatcgacacggcgcagtacccagagcgcatccacctgctgatggcgctgcacgcgtgtgacacggccaccgatgatgcactcgtcgcggccatccgccatggcgcggaccacgtcgcggtggtgccgtgctgccaggcggaggtggccgcgcagctcaaggagaagcgccccgtcgtggccagcagcggcagcatgtcactgctgtacgcgcatgcctggcaccggcgcgagttcggctcgcacctgacgaacgtcatccgcgcgctgacgctggaggctttcggctaccaggtgacggtgacggagctgacgggctgggagcactcgctgaagaacgagctgattctggggcgccgcgtacaccgggagaaccggcgcgcgcgcatgcaactggagcggctgttggcggagaccggggtgaatcccaagctgacgcgtgagctgggcgtgaagccggcggtgtcggccgcggtggagactgtctccgcgccggagccggatgtctccgaagaggcctccgagcacgtcgtcgcgcgctgaacgcgggcgtctgccatgtcgacgcggcctgtcacggcgcaggtcaggtcccatgagcgccaactgtgccttctcggcgcggtgcccctcccactgcggcggtgacagggacgcttgcctcaacgaagtcgccccaccctcggggggcgtccctgggggaagctctgctctgcgtgtccgggaacggtagatgcgcgggggcggcgcgttcggagagcttgctgttcggaaat

SEQ ID NO: 612 - DNA, 4312 bp, Myxococcus xanthus
cgctctaaaggatgtccgttccgcggccggccatgttggtggagatggtgacggcgcccttgcggccggcctgcgcgacgatgtccgcctcgcgctggtgctgcttggcgttgaggacgttgtgcgggatgccgcgcttcttgaggaagctggccaccacctcgctcttggcgatggacaccgtgcccacgagcaccggctgcccgttcttgtgcagctcctcgatctccgccgccaccgcctcgaacttctcacgctccgtcttgtacaccacgtcctgcaggtccttgcggatgggcggacggttggtggggatgactcgcacgtcgaggttgtagatcttggcgaactcctccgcctccgtgtccgccgtgcccgtcatgccggtcagcttggagtacatgcggaagtagttctggaaggagaccgtcgcgagcgtctggttctcgttctcgatcttcacgccttccttggcctcgatggcctggtgaaggccgtccgaccagcggcgtcccggtatctggcggacggggaactcgtcgacgatgacgacctcgccgtccttcaccacgtagtccttgtcgcgcttgtagagcgtgtgcgcgcgcagggcctggtccacgtggtgcagcatctcgatttcgcccgggtcgtacaggttgcccacacccagccgcttctggagcttctcgatgccgtcatccgtgagcgacacggagcggtgcttctcgtccagggtgtagtcctggtcaggcaccagcccggggatgacctggtccacccggtagtacttgtcggtgctgtcctcggtgggaccggagatgatgagcggcgtgcgggcctcgtcgatgaggatggagtccacctcgtcgacgatggcgaagttcagctcgcgctggacgtagtcctgcaggcggaacttcatgttgtcgcgcaggtagtcgaagccgaactcgttgttctgcccgtaggtgatgtccgagcggtacgcctcctgccgctgcttgtcgttcagctcgtgcagcacgcagcccgtcgtcatgcccaggaagcggtagacacgccccatccactccgcgtcgcggcgggccaggtagtcgttcaccgtgacgacgtgcacgccccggccggacagcgcgttgaggtaggtgggcagcgtcgccgtcagcgtcttgccttcaccggtgcgcatctccgcgatgcagccctcgtggaggaacatgccgccaatgagctgcacgtcatagtgacgctggccaatgacgcggcgcgccgcctcgcgggtgatggcaaaggcctcgaagagcaggtcatccagcgaacggccgttctggatctcctgccgcatgcggttcgtctcggagacgaagtcctcgtccttgagggcccgcatgcgggtttccagctcattgactcgggcgaccttcgcgtgggccttcttgagctcgcgctcgttcttggtcccaatcagtttcttcagcgtccattcgatcattcggtcggctctctcgccggagaatcctcgaaggacggcggcgagtgaagggaaatccctggaggtgtaagggagaaacgtatggaaaccacgtgcgtccgccgaaacttccactcggcaggccgcccaccacgcagcggctcagagtaaagcggaacccagcccacgcaatgtcccccacacgaaatcaacgccgaggcccctcccggccttcacgacgacctccctctcgccatccgggccgccccggagcgcagcctaaccgccagggccctgcccccgggggcaagccccctgcacacaccgcgccgcccgcccccagggtccctccccgggccaaggtccccgccatgccggcccggacgctggccgcccggcctggccgctggctgtggacctgccgcgcgggtttcgaggcccacctcttcgaggaactggaatgggccggcgccgagccccgtctgctgggcgaagccctggtggagagtgacgccgtctccggccctccgcccgccttcgcccgcgcaggctatcaggtcgctgccaccctgacagccacgaatcccgaagccatcgccgacgcggcggcccgtgccgtgctggcgcttcccgggcggacgccctgggcggtgcaggccttcacgcccgacaccccgcgtggcaacgccctggcccctgttgcggaagccctggaatccgccgtgtccgccaggctgccggcagaacgccgcatcgaggacgcccagcgggcacgcgaggcgggggcgctgctggtgtccctgtgtgtggcgccggatgaagtgacggtggtgggcgcggtgcacgcgcgcgaggccgtgtccctggcggcgggcggacgcaggcgcatgcggcgggctggagacgcgccgtcgcgcgcggccatgaagctggaggaggccctggacggactggccttcgagcctgggcgcggcgatgtgtgcgtggacctgggcgcggcgccgggcggctggacgcagcggttggtgagccgcggcgcgaaggtggtggcggtggacccggcccggctgatgccggagctgaccgggaacccgcgcgtgaagcacgtccaggagagcgccttcgcctatgcgcccgacgagccggcggactggctcttctgcgacatggcgtggcgccccctggaagtggcgcagttgctggccaaatggggccgccgcggttgggcgcagcacctggtggccaacatcaagctgcccatgaaggacaagaaccccatcctgctgcgggtgcgccacacgctcggccaggagggcggctgggaggggctcaccgtccgccagctctaccatgaccgggatgaggtcaccgtcaccgcgcacaagatgaagtgagcccctgcgcattggcgatggacgcgctacacaaggagcgcaatgccctacccactcgacgacgccacggccaccgccctcatcgccctccatccctgggtgctcacccgcagcccccaggccccggtgcaggccgccgtggaggtgctcgtccaggcggagcaggcccggcgtggccagccggacgcgaaaacgggcgcactccaggtgcctgcactcacccagggcaacctcctcaaggaggagtacgacttgtccacccacggccatcatgacgggtggcgcgtgggcgccgtcatcgcggacgtgcaggggatgatcaacgtcaacgcccgcttcggcttccccaccggggacgcggtgctgcgcgccaccgtggagtccctctccgctcagtaccccggcgcgaaggtggtgcgcatccacgcggacgctttcgccgccctgctcgtgccgacgtcgcagctcacggtggaggagcacctcgccgcgccgacgcgcgaacggttggcgcagggcgtgcgccctgtgctgcccccgggaacgcccgacgcggacgtgccctcatggacggtgagcctgctggagttgacggtggacgcgccctcgcactggcaggtgctggggccgctgctgtgggcggagctggagcgcacccacgtcatggagcgcaccggccgcgcgcaggggcttcagcgcaggcgcatccggctggatggctccattcccggcccagcgacgctctgagcgcgcacggtcgcgactgagcgccaagccattctggccatcctcgctgggtggccactgcacccgctcccggagcctcaaggggactcacgggggagcgttccttgcgtccggcgaaaggggcctcaataccgaggcgtcatccacccgctcccggagcccttcgggcttccacgggagcgcgctccttccgtccgcagcgaggcgcctcgacgaaccaccgagacgccatccctccgcgccggctactcctcgaggatgaacttgcggggattctgcccgatgccgttgacgcggacctcgtagtggaggtgcggacccgtggagcggccggtgttgccgacggcggcgatgtgcatgccgcgcttcaccttgtcgccggccttcaccagcatcttcgacaggtggccgtagcgcgtcttgatgccgtagccatggtcgatgacgagcacgttgccgtagccgccctccaggcccgcgaacaccactgtgccgtccgacggcgcgaagacttccttgccgtgcggcgccgcgatgtccatgccgccgtgcatgacgcggtccgcggtgtacgggtccaggcgcgaaccgaaatcactcgtcacccagccgcgcgcgggccagatggacggagtggaggccagcagcgacttctggtcctggaagtaggcctgcaactccggagcttagagcacgg

SEQ ID NO: 613 - DNA, 4392 bp, Myxococcus xanthus
gttcccgggaagccatccttccgcgtcaagttcagccaggaggcgacgggcaaggcgtctgcctccgaagtgcttgccgcgcacctgctgcaacgggagtccgggcggatcgcggccttcgagaagaaggcctggccccacctggagaagaagtacaccgcgcgcgccgccgaggccatggcggcgctgcgcaaggcgtgtggcacgtcaccgaccttcacgttcgactggaagaccttcgacgatgcggtgatggcggagctggacgtctgggcggcgtgtgcgccgctcgcgacgcgggcccgggctcgctgtgtcgccgtgaaggatgtcacggtcctcacctgtcgcttcgggcctgcgctcgcgttcgagcggggtgccgacgcgctcatcttcaccaccactcaagggggcgcggccgaggggcccgcgttcctggacgcgaggctcaagtgatgcgtcgactgcccatggtgctggcgtacctcctggcggcgccggtgctggctcgcccggccgcgacgctcgaagacctccgggcgctggccgtgcagaagtcctgggcggagctgctggagcgcgcggaggaggttcctcccgccacgcgctccgacacatggcgtgcgctcgtgacggaagcggcgacggccgaagtcgaatcggccacggctgcggacgacaaggacccgttcgccaccgcccggaaggcgcgcgctctggggcagcggtatgccttcctcgccaaggcacccggcttctcctcggcgcgcgatgcgcgaggattgaaggacctggagcgttgcctcgaactcgagcggagtggctgcatcgacacgtaccgggagctgacggtggacgcgagcgctgagacgacgctccaggccgcgcggctcgtgaagaggggccacttcgcctacgtcgcgatgccgctcttcgcctcggcggtgcggggcgggaaggaggctggcgcctgcaaggacgaggcgctcgcggaggcagtgctggccgcactggacctgcccgcgacggatgcccgcgcgggtgatgcgaggaaggtggcgttcgagtggtgctggtcggcgctcggcgcgagactcaagagtgcgacggtgggcgcctcgtcctacttcctggccaacacctgccagcccatgcgggcgcggaaggcgctgacggagctgcagaacgacctctgcaaggacgaggggttgtaagcgacatgcgcgtgctcaaccgaggttcgtgattcgcgagcaggttgaggggcaggcccgagtcagagtccgaagccgacgaggtgcaggtggtccaggccccgctcgaagcggtaggcatattggtaatagagggacaccggaatcgcctgcccgaaggtgaggtgcagtgacgccgaggcccccacggccgcgtggttggcgcggttgtcggtgcgggccagcgagccgaaggcctcgacgccgacgtcgcgcacgaagagggacgggaagagccacagcgtggaggcccatccgtagtcgatggggacccggtactggtacgtcgcggagccgatgagcgcgtcgcgcgcgcgaatctccaggtcctcgtagccgcgcaggtactcactgaaggcgatgcccggctgcaactgcaggggcagcggggcggtctgctggctctcgcggttggtgtaccagatttgccccgctctcaggccgccgacctggagcagcccggacggcgcgccggggaggaagcgccccactgcggtgaggcggaggttgtcgcgccccgtgaagggaaggccccccgtgaaggcgtcgagtcccaggcgcacatcgcccatggtggagtcccggaggaatgcgccggggtacacacccgcgaccgctgtcatgcccaggccgcgctgggtgctgccgtaggacgtggcgtcacccgcgaagtacgacacggagacctccgggccgacgatgcgcgtcagcatgcgcgggaagcggtccgtggcgtcgtactcgcggcgcagcgccagcacgccgaaggtcaccggcgtcgtccagaacgagcgcgaggcgaaggccgtggcctggagatctgtgcgctgattctggcggatgtacgcgcccgacacctggatgtaccagggcgcgagttgcgcgttgccgtaggccagcgagaggctgggggcgtcttctcgcgtgtcgaaggagagcagcagcgagtacgcgtggaagccgagccggtcctgtcccgccagggccaacccgcccatcgtgtacgtgtcgtccgtgttgtcggggtcggctcccgcgagcaggtagggcacgcggagctcggggatgaacaagcgctccagcggcgagtagggctcgtccgagagaatctggagctccatgcccgggtcaggcggggcttcgacaggaccgtcgagagccgtgagcgccgtgggcgcgtcttcggccgcgggagatggggacggcggtgcggtgtcctcggtagcaggctgctccgactgaggggccagcggtggaggtactgcgccctcggcggtattggcgggcgactcctcggagggcggcgctccgtggtccggcgcggcccctggcggaggtgacgcctcatcgctggtggacggctgtccggatagcggtgctccatggcccggcgcggtctctgacggtgagggcggttgcgccgcatcgggctggaccggagcgccgggcatggggaacgcggcgaactcggactcggaaggtgcggccgtgggcgtctgctccgattccgatgctggagtctccgtgcgcacttcggggagccggggcgctccgggttcggtctcgggagacggagccgaagggtggggcgcctgcgccagcaccgcgtgccctgccacctccacgcgcgccgtgccagcgtcagcctccgtcggcgcaatgggcaccagtggggcgcggtcgatggtgaagttcagaccgtcccggttgaggaacaccacttcctcggtccccacgggatgaacgtccatcaccaggtgcggcgcgtccgtgatgcgaaccacttcccgcgtcgccaccgtgaggacgtgggcctggagtcgcccctcatgttcccggaggaacacgaggcgttcatcatccatccacctgggcgagtagttgaagcggccatcgcgcgtcagccaccgaaggcgtccatccgcttcccgcaggaccaggtcccaacccgcgtcccctgagagggggaagacgacccgctcgccatccggagcgaccgcgggcggccccacggaggtgctggcgccgaagtcggtgagggccttccgggtgtccgtctccaaatccagccgcaccacgttggccgaatccccatcgacgcggacgtagacgtaggccgtcccatccggcgtgatgctgccacccatccccatcacgtcgtcccagagccgaacgacgtcacccgtgcgcgcatccaccttccacagcttcgccgtgtagcccccttccgtgttcaggtcggccatcaccaggtacagccacgcgccatcgcggctgaacgacatgccgctgaccagcgtcggggagcccagcacccagcggcgcccgggcagcagctccaccagcggccgttcgaaacgcacgcggccatccggctccagcaccgtcaaccgcgtgtagcgctcccggcccacgcccaccgtcgcggtgacccggctggccgcgtgcgaggccaatcgggagaagtatcccgcgtcgggcacccacgttcgctgcgccgagggccgctcgcgcacctgcaggttctctcgcagcgactgcgtgtactccgcgaacagcgagccgatgtcccgcccgtacacgcgcttgaagcgcagggtcaccgccagcggcggcaccagggagccgccctgttcatccaccagcttccacagcttcgactccccgtagcggttcgcgaggtactccacgaagtgcatgccggtgatgtagttgccgccgaacgggtccagcgcgcgctgctcgggggacaggtagccggggttcagccgtcctccggtggcctgcaccacggagtcgtaccagccgcgccagatggggctgtggggccgtcccgcgtccttttcgaactgcccttcgtagtaggtggccagtccttccaggaaccacgactccgtataggagttgggctggaacaggcccccggtgacgaggttgaggaaaccccagaccccgtccgtctgctggagctgcacgtagtggacggcctcgtggcaggccacgtcgccgacgtccacctcgcccaggttgaacaggtggaacagctccagcgtcaggtgggaaggcatcaccatctgctgcggcgtgctggcgtagtccgggaccacgtaggcgttgttgaagttggagctcgtca

SEQ ID NO: 614 - DNA, 4075 bp, Myxococcus xanthus
gctttccgtgctctaaagcccctctcggacctcggagcggcggtgcgcgtaccggtgctggccctgcgcatccaccggcgcgtcccacatcgcgttggccgccagttcgtgcaccacgtcgcccaccagcgccgccgccgtgcgcgaaccccgcgcctgggtgacggcctgcgcggcggcctcaccggtggcgttgatgtccgccaccgactgaagccggtgccgcgatgcccccgcgggcagcaacggcgcgccgcgaagcaggtcccccaacaggcgcgtctcccacggggaggggcgtccgtcggaggcccgtgtcgccagcagcagcgcgggcggctcgccgcgcagcgcctccgcatgcgcgggcgtcagcttcccgtcgaagagcaccaggcgccggggccccgaaggcgaccctggcccctggcacagcgccatgccgccctgtgcgaggacgggagccgcctgctccaccagcaccggagaaagcgactcgtctgcaatcaacaggaggccgccggcctccaggtggggggcggtactcaagggctagtatcgaaccttgacttcgctgaagaacgactggggcggtgctgggaagccgtgggactcctcgtacttcgcgttgaagaggttggagccgaggaacgacacggagatgccgtcgtagacgttgaagcccacacgcgcgctggccgtgacgtagctgggcagctgcacgcgggtggtgggcaggcccgtcgtctcgtccacctcgaagcccgggtcataacgtgagcccaccagcagcgcgtacagctccacgaaggcgaccttgccgatgttggtccggccacgcgcgtagatgcgatgggccggcgcgtagtccagcggtgactgagggccgtcgtcgtacggcagcgccttggcgtcgaggaactggtacgcgatgtcgaaggacgagttgatggacggaatctgcgcggccgcttccagctcgaagcccgccacccgcgcgtcgcccaggttctggaactgcgacacagagccgaagacgagctgctggttgatgaagttcttcgccagattgtagaagcccgtacccgtcaggcgcaccctccgatcgaaaggccagaaatccaccgatgcctcgatggtgtccagcgtctccgcgcgaaggttggagttgcccaccagtgtggccgcgtacatctgctggttgatggccagctccgccaacgtgggcgcacggaaggcgcggccgtagttggtgcgcaacgtcagcaactccggcaccgcgtggaacacgacgctggcgcgcggcgaaacctggtccgtgcggttctgccagacccgctccggaatctggtagcggtcgtaacgggcacccgcgccgaacaccagccggttgaagaggcggtactccgcgtccacgaagccgcccaggatggtctgccgcgtgtcgtccatgctcagctcgggcaggacgttgggcacgttgacggcgtccgccttcaagtcaccaccgaaggtgacgttgaggtcgcccatcgtccacagcgcgcgcgcctcgccgcccagccggcgccgcttgcccagcgcacgggtggggtcgccgccgaaggcgttctccatcaacacgtcgcggcgcttgaagaggccgtacgcctggccgaagaggcgcaggttatcggtgacttgctggtccacctgcgcggacgcgttgaagttctgcaccgactcggagtcgttcggcgtgtagtggcagcggccgcagttgcccacggtggagatgtgcgtgccacccgggcggccaatctccgcgtccgtgaagtccgcgtccagcgccaggggcccgatgcgcaccttgccgttgacctggtgaaccagtgagtcctggttggtgtccacccggcccacgcgcgggtcgttgaagagctgcgggccgtccgagccgaagccgtagtagcccagcagcgcctccaccggaccaccacggcccgccacggtgccatgcagacgccacgtctggtcctggcccgccagcacccgggcctcggcgcccacgttcttgcccttctcgatgaggtccgacggctggcgctggatgacgttgatgacgccgctgaaggcgttggagccgtacagcgaggaacccgggccgcggatgacctccacctgcttgaggttggtgagcggcgtggtttcgtccccgtagaactggcccgtccacgggtccgtcagcggacggccgtcctggagcagcaacaggcggttggacaggtagttggagcccaggccgcgcgcgctcaccgccgccttgcgcatggagccccggcggcactccatgccggggaagtactggatggcctcgcacagcgtgaactggccagtgccttccaactcgtcggccggaatccaggacaccgtgaggggcacgtcggagatgcgctggttgcgcttgccggcggtggtcaccaccgcctcgctcagcacgcggttgacggactcctccagcgcgtcggcgccgtccagcgggtccgtccccaggcccgcgagcccggactgcggcggcaaggggcgatccagggtcggctccgcgaagggcgcgctgatgggaatgttcgacgagggcgcgggctggtgcgcgggcagcgtcgcggtggccggcgagagatgcgtcggcgcgtccggcgggttgaagtccgcgccgaccggcggcagcgcctgcggtgaggcaggctcggccgtcaggggcgtggccggcgtcaggggcgcggcggagggcggcgtgggcacgggtgccggcgcgctcgcgggcgacggatcatccgtggcaggcccgccacccaggacgggaatctccggctcatccgcgtcctcgatgggcggcttcacgggcttcttcggcttcttcgccgtcttcgcggcgggacgcgcgggggccgcgggcttcaccacccgcttccggcgtttcaccttggcgggagcctccgcctccgcggcctcctgcgctgccgcgctcgaagggacggcgagggacagcacgcacagcatgatggaaagaggcaggccggcgcgcagggcgcggcgaccggcaaccgccttcgccgcgcccagccgcggctcaccgaacagagtcgagtgcatcgttctcacatccaagggtggagcatggacacccgaggtcctgtacgtacgacccggagacgggctcggcgccagcgcttgcgtccgggggaacgcggtttctcggctggacaccaacgccatcattttcaagctaccccagagacaacgccgggccaagtcgctggctctcattctctagaaactcgggaaaggttcagtcgtccggctgttccgcggagacggcgaggtctccaacgaaggacggaagcgcggggcccagctcctccgagcgcaccagcacctcggcctccacgtgaagctcggccccttccgccagcaccggctgacgccgcggcgggccacgcgtgacgagcttgctgaactcgtcgaagtccttgtcctggagccgcgcgaaggcatcgaagggcgccaccgcgcccaccttccccagcgcgccggtgagcgcggcctcgtggttgcgcaggtccaccagcacggcacccggcacccggccactgcggaagagcacgcgcacatccttgcccttgggcacgtgcgccagcgggacgagcgccgcctccgcgcccttggcctccagcatcttcagcgcggactccacgttcggcacgggggccagcttgaagtgcttctgggcgtccaggtcgccaccgagcacgacgtgggtgacgaacttcgggtccgccgggcccgcgcccttcacgtgcgccaggcgcttgccggcgaggtccttcaccacgccgcgctgcaacgcgacaatggcccaacgctgctgcgtgtcacccgcgcgtgaggcccaggccaccggcttcgccttcgcgcccaactgcaccgcggcccacgcatccaccaccgcgaagtccaccatcccgcccgccaccgcgcgggagaagtcctcgtagcggccgaagctcttggcggccacgggcggtctgtagagcac

SEQ ID NO: 615 - DNA, 5164 bp, Myxococcus xanthus
gtccctttcacccccgccaccgggcgccgcgtgctggtggccccgggcgaggaccgcgccgcgcccgaggcggagctgtacgccgccgcccaggagttcgcccgggccgagcgcctgtccggcatccacgtcctcttccccaccgaggaggaactgcccgccctggtggcccagggcttcgccgtgcggctgggcgtgcagtaccactggcgcaaccagggctaccggacgctggaggacttcctcgcccgcttccacgccaagcgccgcaaccagctgcgccgggagctgcgggccccgaccgagcacggcatcgaggtccgcaccctgcgcggggacgcgctggcggacgcggacgcggacaccgtctacggcctgtacgccaccacggtggacaagtatccgtggggccagcgcttcctcaccccggaattcttcgctcgcatgctcgcccgcttccggcaccgctgcgagtgggtggaggcccgccgggaaggccgactggtggccggtgcgttcaacttcaccggtgccaacgttctctatggccgttactggggctgcttcgaggagcaccccttccttcacttcaacgtctgcctgtaccaccccatctcggagggcatcacctccggactggagcgcttcgagccgggcgcgggtggagagcacaagctcacccggggattcgagccgcgcctcacgtacagtgcgcacctgctcctccacccgggcatggacagggccgtgcgcggcttcctggcccacgagcgggcagccgtcgaaggaagcctgccccagtggcgggcggagactggtttcaaggagggggactgaaaatcccccgcccgttcagcaaagggagtccgaacgacttatggcgcagaagcatgagcacgacacctccgtcatcacggagtccgcccccaagcagaagctcaagaaaccgccgctctacaaggtgctcctgcacaacgacaactacacgacccgggagttcgtcgtggccgtgctcaaggaggtcttccacaagtcggagacggatgccgtgcagatcatgctgcacgttcattacaacggtgtcggggtagccggcgtctatacgtacgacgtcgccgaaacgaagattcagacggtggaggccgcggcgcaggagaacgacatgccgctgcgactctccatggaacccgaggaaggttgaaacgtggcaggaccgctgattgccaaagagttgcaggccagcttccgcaccgccctggacgaggcgcggaagatgcgccacgagtacctgacgctggaacacctgctcctggcgctcaccacggacgcgcgcacgcgcgaagtcctcaaggggtgcggcgccaacgtgaagcaactccaggagcgcctggtctccttgatgcaggagacctttgaacgcctgacacaaggggtggaccccgagccgcagcagaccatcggcgtggagcgggtgctccaccgcgccgccatgcacgcgctgtccgccgagcagaagctcatcgacggtggggacgtgctggtggccctcttccgcgaggacgagagccacgcgctctacctgctccagcaggagggcgtcacccggttggatttgctcaactacatctcccacggcgtcaccaaggacggcgagggtgaaggtgagggcgaggagagcgccggccacgccacccccgcgggcgacgacgacgagggcgagtccccgaagaagagcccactcgaggcctacacggtgcagctcaacatcgaggccaaggaggggcgcatcgacccgctcatcggccgcgagaaggagctggagcgcaccatccaggtgctctgccgccgccggaagaacaacccgctctatgtgggtgaggcgggcgtgggcaagacggccatcgccgaagggctggcgctgcacatccacgaaggccgcgtgccggaggtcctgaaggacgccatcgtctactcgctggacatgggcgcgctgctcgcgggcaccaagttccgcggccagttcgaggagcggctcaagggcgtgctcaaggccctgaaggagcagcagaacgccatcctcttcatcgacgaaatccacaccatcgtcggcgcgggcgccaccagtggcggctccatggacgcgtccaacctgctcaagcccgcgctggccagcgggcggctgcgctgcatcggctcgacgacgtaccaggagtacaagtccgccttcgagcgggaccgggccctgtcacgccgcttccagaagattgaggtgggtgagccctccgtcgaggacaccatcctcatcctggaggggctgaagagccgctacgaggagcaccacggggtgaagtaccaacccgaggccatccgcgcggcggcggagctgtccgccaaacacatcaacgaccggttcctgccggacaaggccatcgacgtcatcgacgagacgggctcggccgagcggctcaagccggagggccagcgctccaacaccgtcagcggcgcggacgtggaggccgtcgtcgcgaagatggcgcgcatccccgccaagagcgtgtccgccagcgagggcgtgcagctccagaatctggagaaggagctccaaggcgtcatctacggacaggactcggccatcaaggacctggtcagcgccatcatgctggcgcgctccggactgcgcgcgccggagaagcccattggttcgttcctcttctccggccccacgggcgtgggcaagacggagctggccaagcaactggcgcagtcgctgggcgtggagttcctgcgctacgacatgagcgagtactcggagaagcacacggtgagccggctcatcggcgcgccgccgggctacgtcggcttcgaccagggcggcctgctcacggacgccgtgcgcaagcacccctactcggtggtggtgctggatgaaatcgagaaggcccacccggacctcttcaacatcctgctccaggtcatggaccacgcgacgctgacggacaacaacggccgcaaggccgacttccgcaacatcgtcctcatcctcaccaccaacgcgggcgcccaggagatgagcaccaaggccattggcttcggggacctcgcgaagccggtggacgccacccgcgcgaagaaggcgattgagcgcaccttcacgccggaattccgcaaccgcctggacgggtggattctcttctccggcctcccgcccgaggtcatcctcaaggtcgtggacaaggaagtgcgcctgctccagaagatgctggacgagaagaaggtgaagctggcgctgacgcccgccgcccgcgcgtggctggccgagcacggctatgacccggccttcggcgcgcggcccatggcccggctggtggacaactcgctgaagaagccgctcgcccaggcgctcctcttcggggacctgaagaatggcggcaccgcccactacgacgtggcggacgacagcctcaagctgcgcacggagcccgccaccgccgaggtggcatagccccctgcccgcgctggctgcggacatgacaaggccccggtccccttccctgggagccggggccttcgtctgtccgcccgtgacagcgggcgagcgactactcgacgcggtagctcttcaccgcgctggagagctgctcggagatgatttgcagcgtggtggcggcctcgccggtggagccgatgcgagccaccgtctcgtccatcatcttggacaagtcattcaccgccagggtgatttggttgatgcccacgttctgctggctgacggcggcggcaatctgccggacggcggcggcgttgtcctggacgatggaggacagctcgcgcaggttctgcccgctggtgcgcacctgggccaggcccgactccatgcgctcggcgccgcgctccgtgattcgcaccgccaacgtcacctggttggcgatgtcgtccagcagctcgcgcacgcgcgtggtggcttcgatggactggtccgccagggcgcggatttcgcgcgccaccacgccgaagcccttgccgtgctcgccggagcggacggactcgatggcggcgttgagcgccagcatgttggactggtccgccaggtccttcaccgtctgggtgatgccaccaatctgctgcgtgcgctcgcccagctcgacgattttctgggcaatctcccccacctggacgcggatgtcgttgagccccgccatggtgagctcgatggaggcctcgccggacttggccagcgtgtcggcgcgctcggccaccgacagcacgctctccgccttctgcgcggccagcatggaggtctgcttgatttcctgcgccgtcacctgcgtctcctgcagcgccgcggcctgccgggagatggtctgcgcctgctccgtggacgacgaattcaggtgctcggtggactgggtgagtgccactgccgcctgctggaggttgagcgtcacctcgcgcagccgatccaccatctgcgagaaggagctggccagccggcccacctcatcaccgctcttcacctggatggggcgcgtcaaatcgccggactccacgatgtggccggccacctccgtcagactcttcaacgggccgacgatgctgcggccgaacagcgcggacaccgccacgcccagggccaccagcagcgccgcgaagcccaccatccggacgcgcagcgcggacaccagttcgtcgatgtggtcccgggacacgcccacgtgcaccgagcccaggcggccaccggccaccggcgccaccacgtccatggcgcgcaggcggacgcccccggcgtccgcttccagcaccgagcccgcgcccgcggtggcgaccgcctccttcagcgcgtccgggaagccgtccgggaaggtgtgggccaccacgttgccggccgagtcttgaatgaatgcataagccaggtccgaatggcccacgctggcgtccagcatgggctggagcgcgctcgcccccgccgccaccccctgctccgccgccaccgccagcccgcgggcaacgtgccgccccgcgcccaggtagctgtccgccaggtcgctctccagccgccgcgtggcgacaccggtgagcagggtggccgccgtcgcgctgatgagcgcggtgacgagcacgaacttcggcgccagccccagcgactggcggaactgctgcgacaact

SEQ ID NO: 616 - DNA, 4018 bp, Myxococcus xanthus
aacgcgttcaacccgcaggcggcgcggctcatcatcgacagcctccgctactgggtgacggagatgcacgtggacgggttccgcttcgacctcgccacggtgctgggccgcacgggtgaaggcgcgttcgaccgcgacgcggcgctgttccagattctccaccaggacccggtgctcggccgcgtgaaactcatcgccgagccctgggacgtgggcctcggcggctaccaggtgggcggattccctccgccctggcgcgagtggaacggcaagtaccgggacgcgctgcgccgctactggaagggcgatgagaacctcgccagtgagatgggctaccgaatcacgggcaacgcggacctgtacgcggaggcgcgccggcggccccaggcgagcatcaacttcgtcaccgcgcatgacggcttcacgctgcacgacctggtgacgtacagccacaagcacaacgaggccaacggcgagcacaaccgtgacggcgcggacgacaaccagtcgtggaactgcggcgtggagggtgagacggacaaagcggacgtcatcgccctgcgcgagcggcagaagcgcaacctgctggcctcgctcttcctgtccaccggcatcccgatgattgtcgcgggtgacgagatgggccgcacgcagggcggcaacaacaacgcgtactgccaggacaacgagctgtcgtgggtggattggaacctggatgagcggcggcggaagctgctggcgttcacgcgcaagctcatccacttccgccaccgccagccggtgctccagcgccgccgcttcttcaagggtcagcacctgtgggactccgagcacaaggacctgacgtggttccggccggatggcccggagatgaaggcggaggactgggagaagcccttcgtgcgctcgctggcattcctcctgggcggcgacgccatccccacgccggacgagcgcgggcagcgcatcatcggtgacgcgctgctgatactgctcaactcgcaccatgagccggtgacgtacaagctgccgcctgccgcgcagagccagcgatgggagctggagctctgcaccaccgacgacaaccggggaccggagccggtgaaaggtgagacgttcgagctcatcggccgctcgctcgcggtgttccggcaggtcgcggactgaggcagatgccgcatgctagggttccccgccgaggccttccccggcgggtgcggcatgccggtgcctaagcgaagcaggtccgccgccagggcgctcgcacgagccggaggaaccgtgtcgcgggatgcacaggaagagggcgtgaagcaggtgtacggggagattgcctcggcctacgaggtgctcttccccgccctgcaccggtacgaggaacgggtggagcggttcctcgcggcggtggtggcgcccggcgcccgcgtgctcgacgtggggtgtgggccggggcttcacacccgcggactggacgcctccatcgccgtggttggcaccgacctctccgaggacatgctcgcgctggctcggacagcgcggccgggtggcgcgtggcatgtacacagctaccaccagccgattcctcccgactggggccgcttcaccgtcgcactcgccattggctgtctggacttctgcgacgacctgcctcgcgtgctgaagcacctcgcggaggcgctggagccgggcggcaagctgctcttcaccgtgctggagcgacggccggggttggacgggcacgaggcgcccgtgcagccgattcaaacggcggggccggcggtgacgctgcacctgtactcattcgaggagaccgcccgggccgtcgcggaagcagggctgctcccacgcacgtacgcgcatgcacccggctgggttcagctcacggagcagcggaccatgtggttcgggtggtgggaggtggagcggcgctgagcgcgtggctccaggaccgcacttctggtgcctgagggccacagcccggccactccaaggtgtgcacgaggcttgcactggactcctcccaggaggcatcgacacgtgattcggctgcgttggacctgcatcggggcgtctctgctggcaatggccgtgggttgtgcggaggcccccctccgcggcgacccaacgccgccgagcgtgtcgattgcgctcgtggatggcggatgcgacccggaaacgaacttccggtgcttgtgcgtagggaacgtcggagacgcggcgccccaccttcgagagatcggcgtagacctggacgccctgcaaaagaacggttggccgtgcgtaccgggtgacttcgaccaggacggagagcaggactatgcctttccgggcgagggatactcgtgcaaccggcccgtcccggtgcgggtgctcttcacgcgaggcgggcacctgcgggaagtccagacgctgccgcggaagttgagctgccttcagcgcgatgtctccaatgacgcggccctgcccccgggacagggactggtcgattggggtgaggggaatgccacctggcgctaccggttcgacggcaagggctggctcaccacctcccatctctccgaggcgcactgattcggtacaaccggggcacaccgcgccaggccccaggcccgcctcggtgtgccgcgcgaatccctccactccgacgcggcatcgccgctgccgaggcctcttgacgatgacgttgtttcctcttcgttggttttgtgccggtgctcttctcatcaccctgagcaccgcctgcacccgctccacgccggccgcgacggtggagcggaacatccccgtgaaggcgcagtcccagggtccggacgaatacgtgctggcggatgacgtgagcgtgcggaagctcgcgcctggcgtgtggctgcacatcacggtggtgacgttggagccattcggccgcgtctccaccaacgggctcatcatcgaggacggtgaaacgtccttgctggtcgacacgggctgggatgcacggcagggcgcgctactgctcgactgggcccgggacacgcttcggcgtccggtccgcgcggcggtggtgacgcacttccatgaagatcgcctcggtggtgttccggcgctcgccccgcatggcatccccgtccatggcttggaggagacggcacggattgccacgtccctgggcctgccaggccccacggagaccttcgccaagacgagcacggtggactccctggagctcttcttcccgggggcgggccacgcgaaggacaacatcgtcgtgtggcaccgggacagcggcgtgctgttcggcggctgcttcgtgaaggacggcgcctcgacgaacctgggcaacgtggcggacgcggacgtagcggcctggcccgcgagcctgtcgcggacgcggcagcggtttccggaggcgcgcgtggtggtcccgggtcacggacagcccggtgggccggagctgctgggccacacggaagcgctgctccgctgagcgacctcgcggagcaaccgggcaggcgcgggcgatgtgactgtgcctcgcccacacggacaggagcgttggccaacacaccgtggtgggtcgtcccacgctcgctcgcctgccgctgaaggtctgtccccggacattcccacacggctccagggttcacggacatgggcgcgggcccttgccgtccctaccgtcccgcggagaagcacgggccaatgggcgtaggggacggagggagacatgaggcttgtggctgcggtgtcgctcgcgatggtggcgagcgcgtgtacctcggtgcggatggagcagcgggacggttgctgggtgaagcagacccgggcctttccctccacgctcaaggaggaagtggggccgtgcgctcggcccgtgcccatctggtccgaggaccggctcacgcggctggtgcaggagtgcgtgatgcacacggactaccggtggcaaagcagagcgttggtggcgtggaaccgaaacgaacccctgccggatcgggaatccgaggagaaagtactcgcggactgcatgtcccgggcggag

SEQ ID NO: 617 - DNA, 4348 bp, Myxococcus xanthus
  unsure (1)..(4348): unsure at all n locations
cggtcctggcatcttgcacacgttcggcagggtcgctgcggcaaccccactgcttccttcagttaccggggtcttgggcgcattcactgagaccttgggcatgggcatcctctccttacgagacttggggcgcatgcaggagcatcgccccccgcagccccccatcggaaccggccatcaccagggcccgcgggcctcgcgcatacccccgggcgaatgcccggactgcaaggacgcccccaagcactccggatgcagcaccgacatcgccccaacaggtgctcggagccctgtagctggtggacttccagacggatggcgtccgtagcacgacgaagccccactcctcgcttcgatagcgctcgccattgatgtccgtatacaggtcgtcgaccccttcatggggcaacttgagtcccgcgacgacgccctcgactgcctgggtcatcccgacgccgagagagcccgtactgctttcgcgaagctggcgctctcgtgcggtgtgcgctccccgcacgacggccaaccctgacagccccagacggcgccgcgtcccggcgctcatcagcgccagacaggcggcgccctcgccaggcgtgaagccaccgcgaatccccggctgcgcgaagcgacgagcctgctccagccagaggaacgtctccgcgtggtggtagctgtccgcacccgccaccaggaacaggtggtccccgccatcgacacactcccgcagggcctgctccaccgcccggagcgctcccgcgtggccgcgccccgcgagcacgacgcgcgtgcctgcgcttctccctcgatagcgagcctccatggcgtcgaccagccagctcgcatcctcctccaagaaaccggggcgggcttccggacacgacagcagcacgctgagccgactccgcagcagcgcttcaggccccagttcggcctcgacctcccccaacgcactctcgagcagcggcaagagccgattccgcccctccagcgctgggtcaaggatcccgtccgatgcaatcaccacgggctccccccgggcgtcggcgaagggaaactcggcgtagcgagagatgccagcacgcacggccgccgcgctgctctccgccgtatacccgacgggggttcgcgcgccgactgcaacgacctccagggaggtgctcattccgcctccttcaattctgcaatctccgtctcgtcgaggtagtccgcatccggcgcgggcacacacagcgttccctgccacaccagcgagaggcgcctggcttcaggctccacgagaaccgtggtcaggcgtgcgccgtgctcctcgctccgccggcccacatgcgtggtaaaaccaagcgagattcggggcaattcgaagcgaaggaccccttcgggcgtcatgttcatcaattcgacccgctcgccgccggtgagcggcccgtcgagtcgctggtcccccggggcgctcaacgcgaatgtggggtcgtagtcgtcgggaagcaggggcttcttcgtacgctcccaccgggcgtcgtacgtccccgcgagcttgcgtcgcggcatccaggcggcgtcgatgggcccgaaccctgcggggcctcgggtcgccggctcaccactgggatactcgatggtatgggcgggcttgcccgtcagttgggcctgacgtgtcgcgaagccacgcccgacaggattacgctcatcgatccgatgcttgctggggtcggagtccgtcgtgtcatagcccccgaacgcggcttcatagcgaatggggctcgtggtgaacggctggggccggctcactgccatcccgagcatcccccgagagtaggtgcgtggcccgtgcacgagcaggaccttgtggagcggtccgagccgcagcgagaccggcaccgtctctgcgggcttaccgcgaggcgcgtgcgcgcaaccatcgagcagcacctccgtgcccggtttcaccgccagcaggtccgaatcatagcgcaagctcgactgaccaggcgctccgaagtattccggtatcagcacaggaggaggctgttcgtccgccagttggagtctccccccgggcgcgatgtcaaaagtcgctttgaccgcgacgagccaccagtgaaccccctccttgtcacgcgtccagtttcgctccgcagcgtacgcagtgcgattcttcagtgcccacatggaacttcaccccccaaaagcacgcttcagtggacgtgtcgacaggtgctcgcgcacgcgctgtgcttcggccagttccgccccctgtcgggcagtgaacgcacgtgtttgaacgtcgtgtatgccctgcgtcctcagtgccaggtctcgtgcgtggacgtgacgtcgacgcatgggccccctcgccagcacgtccaacagcgccgcgccactgaacggcttgccgcccaggtagcgtccactccgagagtaatcctgacgcgctcgctgccaccagtcagcgactgctgcacgggccggcaccggcagattgtcctcttccttggaagaaaggtcggcttcgaggtcatcttcctccagtggcgggagcgaatccccctcctctaactccacggcgtaagtgtccttcagcaccagcccggtgatggcgctaaaggactcgccagccagtcgtgccaccgatggcacatgccccatcaactccagacaagcctccacggcagcaacccgccctgtgaagcccagtgcccacacgatgtccgcgcggacgacgtcattggccatgagcgccaccaggcgctcgacgtcctcgtcatccccgcatatcgcctggagcagtcgggccggaggtgcgccctcgccgcagccttgcgcctcctgccggcatgcgtcccatgccgcgcgtactccagacagcaggccagactcgatggccgccagtcgcacctgcggtcgattgtcgtccaacagtcgccgcaactcccggtgcccgacatctctttccagcgtgccaaggccccgcagtgccgccgccaccacccggccatccgcctggtcgagcagtttcagagcaactccgcgtggtacggctccgcggaacgaaagcacctccaatgccagtgcctggacggatgcctcgggtgccttcagcaacggaaccagcgacgcatccaacccggtgcgcccgctgagttccagcgcgcgccgcagcgaagccagtacctctggaggcgcgaccggcgccagcgcgagtaccacttccagcgcagcaggtggggattcggcgatggaggcgaacactgagcaaaacacctccccaggttccccaccgtccagggcgggactgagcagagcctcggcgacgggctcccccccgagcaccagtccgtccagatgtgccagcagccgctcctccaactgcgctgtctcttccagattgtagttcgctccccgcagtgctcgctcccattgcgagtacaggaaggccgcctcggaaaagtgctcctcgatgacgtctatcctcagcgtgggcatcacgtcagttgacctgccccgagctgtccttgcaccgggtggtgagtgcctcccccaagtgccttcccacccccgtgtcgagaagccaacccaagttcgtgcgcccaatgggattgagcaatgtcttccccaccggctgcccatccgcttgggttgccgaaacgtccatgattccccccggctggctacaatgatgccgcaagtacacctacggcacacaacggcagcctactgttgcagcccagcagttccctcaacagcaatcaagtacctccggcgttggaggcatcgcttcaaggcatggagcgagtatgagcaatcaatgcatcccttcacctggatgcagcgtccgacagcagtaccttgccaccatcacccgctgatgttgatgagcgtcagcgccggcccgaactggaagacgtccgcgacgacgatgtcgctctgaggctgatccccgaacgacgtccccagtgcggcggccatccactgacgaaccctgaaccggtccgggctcccatgaatccagaggtgattcgcaatgccgtaagccatgagctcctcaacccggatgcccaccagagacgcggcgccacgctccaaggtgattggtgccccgcccgcgacggataccaccccgggtcatggtagacagggacgcactgcatggaccgcctgtcccaactcctctggctctggatgctcttcttcgccgtcaacgccctctgggcgctggcgcagaccgncgtggccagcaccctgggggcacgacccgtgtccgtcgtcctcggctacgggcccaccctgctcttncgccgcctggggagcatnctgtgggccttccgccccctggcgcttcgcagcg

SEQ ID NO: 618 - DNA, 4003 bp, Myxococcus xanthus
ctggctgccgcgggagagggcggcccgcagtaccttgcgacgggccggtgtgagacacttcccgcttcccatggtcgaagactcccactccgagcgacaagtcattggcgaccgttacgtcctggagcggcggctggcgggcggtggcatgggtaccatctgggtggcgttggatcccaagctccagcgccgcgtggccctcaagctgatggcggcccactgcgcgcccgcgcccctggctcgccggcagttcgaatgggaagcgcaggcgattgcccgcctccagaacccccacgtcatccaggttcacgactgcgacctctccggtgagacgccctacatcgtcatggagtggctggtgggcgaggacctggaggccctgttgaaccgccgcggccggctgtccctggccatggtggagcggttggtggcgcagacggcccgtgcgctcaccgccgcgcacgccgcgggcgtcatccaccgcgacctcaagccggccaacctgttcctcgcgcgcacggagcatggcgaacaggtgaaggtgttggactttggtctggcgctgctgatgtcgggcggcgcggcccggccgcatcccgaggaggagatggccggcacgccccggtacatgagccccgagcagctccgagggctggagccgcggctggaccaccgctgtgacctctgggcgctggccgtggtggcgtaccgcgcgctgaccggacagcacccgttccccctggagtccttgcggcagatgcgcctgggcaacgtgccgccgcccgcgacgccttccagcctgtccccggagctgggcatggaggtggacgccttcttcgcgcgcgccctggacgtggaccccgcgcaccgcttccagtccgcgcacgagctggcctccgccctcaccagcgcggtggatgcgggccggccgtcgcgcccggcgaaaatcctggtcgtcgatgacgagccggacatcgtcgtgctgatggagcagagcttccgcaagcagatccgccgctctgtctaccagttcctcttcgccgcggacggcgaggaggcgctggaggagatgcgccagcatcccgacatcgaagtcgtcctctgcgacatcaacatgccgcgcatggatgggctgacgttcctgtcgcgcgtgggggagatcagctcgctgacccgggtggtcatcgtctccgcgtatggcgacatgaacaacatccgcacggcgatgaatcgcggcgccttcgacttcatcaccaagcccatcgacttcccggatctggaggcgacgctcgtcaagacactgaagcacgtgcgcgagctgcgccgcaccgtgcgctacacggaggagaacggcctgctgcgcatgttcgtcccgggcgcggtgctggagcgtctgccgccgttgctccagggctcggatgccatggcgggcgagtgggtggacggcacggtggtgttcatcgacgtggatgccttcacgccggtgctgcaccaggaggcgccgccggagtccctgcgccgtctcaatgccaacttcgaggccattgtcccggagttgctcgcgcgcggcggcatcgtggacaagttcatgggggacgcggtgatggccgtcttccgaggccccgggcacgtgggacctggcgctggaggcctggcacgccatccaccggcaactcggcgcgctggcgtcgcgtggcggcgagggcgcaccgtacgcgcatggcgtctgcatgggcctggattcgggcgacctggtggccggcagcgtgggggcgaaggcctccggccggctggacttcaccgtgctgggggacgtggtgaataccgcggcgcggctggcggcgagggccgggcgtgggcaggtgctggtcagcggtcgggcccaggcgcgcgcggcgtcacgcttccgcctgtcgcccgtggagacgggcctcttcgagctggcccgcgacgagggccacggctcaccgggccccgacgatgcgaccgccttcctggcgccggacgcggcggcagaaggccggggaaccacgcagggcggctgaggggccgcgcccgctgttccgtgctgcggaaggccggggtggtcgagggcgctccgctccctgcgcacgggagcggggcaggggacttcaatcaggcattgctgacgcgcaccgtggtcttcatctcgcgaccggacaccgggtcgcgggcgcgcatggtgaggatgccttccacgttcgcgtcgaaggtgatctccacgagcgcggggccggcgcggccgggctggatgccggagaaggtgaactcgcccagcatgtcgttgcgggccaccagctcgttgtcgccctggaagatgcgcacggcgagctcggtctggttgtccatgctggtggtggccagcaattgcttggcattggggatggacgcgttgcgcgggaagacggtgtggaaggcgccgcccgccttctccaggccaatggccatgggaatcacgtccaggagctggatgcgcaggttggtgtcgtcctggagcgagtgcgcgtagagcgcggcgccaatcgccacggcctcgtccgggtgcacgcccttgctgggcggcttgccgaagaacttggtgagccggtcctggacgatgggcatgcgcgtctggccgcccacgagcatgacctcgtcgacgtccttggtggacagtcccgagtccaccagcacgcgcgccaccatctgcagggtgcggtccacgagctggttggtgagctgctccagcatcttccggctgaacttcatctcgatgttcaggggctggccctgggacgtcatcgtgatgaaggggatgttgaaggggacctcctcgcgcgcggacaggtcgatcttcgtgcgctcggccaggtccttgatgcgctgcatcgccaccgggtccgtggcgaggtcgaggcccgtcttcgccgcgaagtccttgaggacgtggtggatgatggcgttgtcgaagtcgatgccgcccaggaagacgtcaccgccggtggccttcacctcgaagacgcggtcacggatctcgatgatggagacgtcgaaggtgccgccgcccaggtcgtagatgacgaccttctccttcagccccttgcccacgccgtaggccagcgccgccgcggtgggctcgttgatgatgcgcaccacttccaggtcgatgagcttgcccgcgtccttcaccgactggcgctgccggtcgttgaagtaggccggcaccgtcaccaccgcccgcttgatgggcatcttcaggtagttggaggcgacctcgcggatcttccccaggatcttggcgctgatctcctggagggcgaactccttcttccccacgtccaggatgacgtcgctctgcttgccggggcgcatgttgtacgccacgacctgcttcatcgtgtcgacgacttcgctgccgaagcctcggcccaccagccgcttggaaccgtagacggtgttgcgcgggttgagctgccactggcgcttggcctcgtagccgatgagttcgttccccttgtcgtcgatcgcgaagatcgaggggatggtgtactcgccgcccttgtaggggatgagcttgacgttcccgctgtcctcgacgatcgccgcgcacgagttggtcgtgccgaggtcgatgccgatgatgggctccttgtgcatcttgcttggactccgggtgggtaggccgcagaggaaggaaaagaccgtagcgcaccctcgcgccgcgcgcgagttcacacaccgcggcgtttgctgctccccgggaatgcggacccgggctccctgcttcccctggagggcgccgtagcgctccctgtgcccgcccggtggccagcagcgcgtgccccagccgacaatggcgtccggggtgctggacattggtagcccgggcggaaaacttggtggtggacgacggaccagaggagagtcaacttggacgcgaagggttatctgcatgaagtgggcgcgcaggtgaacgccgacttcgtcaagaaccggtcgattc

SEQ ID NO: 619 - DNA, 4725 bp, Myxococcus xanthus
taggtgccgtcgctcatcgcgtggatggcgcgaatgcgcttgctgaggcccgcgtccgcgaccgcgcgcttcgagggcaggcgcgtccgccatgcgtggtagccgctctcggacacctccaggacacgacagagcgtcgtgatgctgtggacggcctggttcgccttcacgagtcggtacgccgcttgggcgtcgccacggattcctgcgcgaaccaggccgcagctttttttaggatgtcacgctcctcacgcagcacccgcacctcgcgccgcagccgctcgagttcggcgcgctcgtccgaggcggcactgctcgccctcggagctggcctgctctcgccgttgctgctgggagcgctacggccactaccctccaactgcttcttccagttgcggatgctctgctcggtgcagccgaactctcgtgcgaggctctttccggagcggccggctttcaacagctcgacgacccgctcacggaactccggcgggtatgggggacgtgacttcggcatcgtgggacccttttcgcacagcgggtggaactccacgaaaccggggcaacttcagtcctttgggttcttgccgccctcgatggacttggcgaagttgtccttcacgccctccttcattgtcttcgcgagaccgtgccccgcgcttcggttgtccttccaggtctggactcggtccttgccatcctggagctgctggcgggctgttaccgtcgtgtccagcggtttgggatacgtctcccagttctcgagacccttcgaatcctgctcctctttctttggggccgcgggagctggctgtgtctggggcttgtcgttcttgggctcatgtccggggacgtagggccccatctgcaaccgcgggggcgtcgtcccggggctcgtgggcttgaaggagtcctggggcggctgtgtcgccgccgggacgggcttctgtgtggccggcgcgcgcttcgacttgggcggctgtagggtcgcgggcgaaggcttgacgggaggcggcttcggcgggtcgcggcggatagggggcggcggcatgtggaggttcctctcttcgcttcgagatgggcgtggaaggcgtcgcgccatccgccagccggcgaatggctgcccatgtactcgaggagaaagaggggaggcgcctaccggcgtcccaaaaatctcgcctcaggaggccctccagcacgagtcggttgtgcgtgagcagtggcggcaggttccgccgtgctcgtagccagcaccgcgtgcggctcgaagccccgcatggctcaacggtgatgggtgagcaggttcaccagccttccgaaggggtcgcgcacgaagaatctgcgcacgccccaaggctcgtcagccggtccatactctatcgggattcccgccttcttcacccgagtgagggccgcatcgaggtcgtcgacctcgatggacatgtctggcactggtgcgcctgagcccccttgcgacatgaagctgatctgcacagtcatcgtttcgcttgagccgtaggtttcaatccaccccatatccatcaggacgtcgagcccgaggacgtcccggtagaatcgcttggcggcggctggcgtcgtcgcgcccacattggtgacgatacgtaggaccttcacgactgcctctccttgtcgtgcttcgatggggccatctgcttgcgaagcgcttcttccgtgagcgcttccgtctgcccgccgagaagccacatgtgactgaacaggtcgcgcacgcgaccctcgagcttgccgtacggtcggtcctcaaggggaagcggttggacttcggtcagggtttcgtttggggacattggcgcaatgtgccccggggcggcccgcctcgtattgaaggaaattgccgctcgtcgagaggtacgtggttgcgagcctcctccgaccgagggcgatacgcggcgggagtggctcccgagaatgccctgaactcgcggaccagatgtgcctggtccgaaaacccgtgctcaccggccaaggtggtccaggtcatctcccccccggccgattcgagcacgcgctggaacctggcgatgcgcgcgaagagcttgggcttgatgccgacatgtacttgaaaccgctcaatgagccggcgcggcgaaaggccgagtcgaactcctacggcacggacgctcgcgccgcccatcaacagcgagcacgcgaccgccactgcttcgtcgcgaggcttggacgagcgtgcccgtgcgagcagcgccgcctcgagcacgtcgagccgggccgcgggagtggaggcttgcagcaggcgctcacgaaggatggtgccgtcacgcccccagatttcgtagaggtcgacgaccttcccggtaagttccgaggccggcatgcccagaaacggcgacgcactcgcgggggcgaagctcaccccgcagatggagcgctggcaggcagtgtcgacgactctcggtgcggtgtaggcgccctgaatcgctacaccacgagtcttgtgtgcaaggcggccgtcgagcctgtagtcccggaacgtgtcctcatgcagattgaccaggagctgcatacggccagacggcagcatgcgctcgaagccgtgggcgagctgcccgtcgtatgtccagagggattccacgagaggagccagagtggggctccgaggctggcgcgcgagaatcatggcagcgcgacggtaacagagccgggatgcaccactgcgacggatacggagtcctcctgctgctgagccagccccgatttcgtggcgctcccgctctttatgtgaagggggaggttcaggcggccagcagcacgcggcgacgcagcaagtttcagccccgacacgctgctgcggggcacctctgcgtcggagagcttccgcagcttctcctcggcccatcaacggcgccgccgtcccggggggctgaaacaatgttggtcgatttcacgcaacggtgtcgcacggcctgtctcttccagtcagcaggggggggcatgggggctccctgaggactcctgggaggacgacatgaaggcggcgacacggtacctggtgcttctgtccatgctggtggtgggttgcggcgactcaagcgaaggggagggggacgaagacggaagcggaggcggctcggactccgcgctcaagtgtgacaccgtgagttggtgcagcacgtgggatgcggacggcgcggaggtgacggatgctcccccgctgaacggggggaagctgagcgacggcctctatcgcagggagagcggttccagctatccgtttgccatgctcatcaaggggaagtccgtcctcctgattgaggcggacttgaggaacgatttggggacttggaaggtggagaacaaccgtctggtcatgaccatcacgagccgctgctcaaacactgagaaggaaacctcgaacgaatcctggacctgggagcacgccttcgcggtcaagaacggcgttctctatacgaaggatttgacctgggagaggcccgtcgtcgcttggcgcaaggtagagtcgctgtgtgaggagtccgcctcgttcaagtgcatggtgagcaactgcgcctgtgagttcaagacgaacacgtccctcctggggcagacgagttgcttctgagcgcggacatcacgggccttgagtgagggtagagccccccatcacggaggggctccgccatggggcctcctgaagcacgtggtccgctgtcgtgaggttcagttccctggcgcccgccgtgagggggtgggtatcaccggcgggcccttggggcttggagcgactccgccatcgtcttgcggttgggcgcgtcgctgtccaggcggatgaagcccgatgaccgcgcgtcccactcactcgcatggacgcgctgctgaaggtggcctcgtggcacccatgacgcagcgggcttcgaagtcgccgcctcggtcgcatgctcgagtgcctgcgcgcgaaccgccgcggagggaacgctcatccccatccacgtgaagaggcgctccatgacgagggcccgctcgggctcggcaaggccgccgatgctcgcaccgtggttgccctccggagcgaagtagcggaacgcgtcgttgtcctcgcgcacggaaaatgccgtggcggaatacgggtcgttctccccgtagatgaagagcatccgcttgccgtggttgcggacccagtgctccacccgaagcatggccctcatgtcgaacggctccgtcacagggaagctcacgtacacgtcgggcgtgttctcccctgggtagcgcagaagccctcgcaggtgattcgcggggtagcgcgaccagcccaactgcgtcgcggcttggtagtaggcgtactcgaagggggcgatgaagcggtccgagtaggtgaaggcaacgccgacgacatcgtccaggaaggcgaatgtctccgccgccggcgcgccggcggcgggaatgctcgcgcaagcggacgcggtgccgtactgccagaagtagaaggatgcctcgacggcggagaactccagcgcgcggtccggaccgcccacgacggtgaagccggtgttccacttcgtacctagcgcatccacgaagggcagcagctccccgcggcgtagcagcacgtcctgctggaaggcctccagcttcgtgcggcagtccgcatcccccagctccgcgaggaagtggacgtagcgcacgtcgcgcagcccatggttgctgggcgcgacatacggcagggtggcgtcc

SEQ ID NO: 620 - DNA, 4018 bp, Myxococcus xanthus
gcggaagccgtgggcagggtcgtcccgagggtggccgctcggcgcagggctcgggtggctccggtgtgcaacgccagccggggtggccagggcggttccaggggttcgggtggcggccgtcccgcggtggcgcaggctccggcgaaggcccccgaggcctccccgcttcctccgcgtcgcccatcgcccaagtggttctgaacggctgaggccaggcgtcggctccggcccgccgtgaagtccaggaagggagctcgcgccagtggggcgggctcccttttgcatgtcagtggaggaccatcagcgccatggagccgaaggcgagggccatggccaggatgccccagcggaaccacttctgcgtgagcagcaggtagtcgtcgaacgaggccccggtgtcgccgaaagcctcggccatggccaactgacgcgcctggatggggcgcagcgtgagctgccagacgatgccgcacagcatgaagcagacctgtcccgcggcgagcgccgggttcgtccacagggggatgtcctggaggtgcgcgcgcagcatgccggtggcggcgagcgcgaagacgcttggcaccagcaggtacttgtcggtgaactgcaccagccgcagggcatagacaatcacccggggctcgcgcgtcctgtccgcgagcaaccgccacacggccgtcacgacgatgtcgcccaggaacaccacgacggcgatgaggtgcaggagcttcaggacgttgtggacgttcatggggtgggtgtcggacgtggaatgagcgcgagcaggtgctgggcgagcaccgccgcgtgcggatcgcggagcagcgacaggtgggtgccagggacggggtaggccgagcaggcctgctgcgtcaactggctccagccgagcgtgccgtcttgcacgagcgcgtcgagcgccgccgtgctggggccactgcggtcctccgcacggaacaccgccaggggcaccggttgtccacggcggggccggtagttcagggcgtcatgggcccgcgccacgttgaggatgccctgcacgtggacgggctgcgcgccttcggggaggaccgccgcggcctggagccgtgcgacgaagaactggagccgctcggcttcgcccatggcgcgcacttcgggcagggcgaggtcgatcttcacgttgaagaacgcctccatgatgccggcgaggtggagcatccactgcgccgtgtcccaaccctcgccctgcggccgggtgacgtcggggaagggcgccagggtatccagcatggcgacgacgcccacctcgcggccgcgggccttgagctcctgggccagctcataggcgatgtgtccgcccatggagtgtccaccgacggagtaggggccttcaggctgcatgggcaagatggcgtccgcgtaccatgtggcgatggcctccaccgtgtctgggggaggcacgtcgccatgcaagacatggggctggaggccgaacacggggacgccttccatgtgtctggcgagggacaacaggtagaacggcgtcgagcctccaccgggcaccaggtagagcaccggcgtccggttcgggttcgcggcgccggcggccatgagtgcgtgggcctcgggggtgagcggcaccagcggagagacggccgcgttctcggtccggaggaccgccgtgagctgcgcgggcgtcgggttcctgaacagggacaccagcggaagcgggcggcccaggcgcttctccaccgcgagcttcatcttgagcgccagcagcgagtggccgcccaggtcgaagaagctgtcgtggatgcccacggcgcgcacgccgagcacctcctcgaagagccggaccatctccagctccagcgcatcacgcggcaggccctccagggcggtgacgcgcgcgtcggcgagctccatcgcgctcagcgctcgcgtatccacctttccgttgggcgcgagcggcagcgcgtccaggaggacgaactgcccaggcaccatgttcgccgtgagctgctgctcgacgaagctccggagctcggtgggctcggggcgctgcgcggacgcatggggcaccacgaaggccaccagccgggagtctccacccgtgccgcgcaccagcgcgacggcttcacgcaccgccgggtgccgggcaatggcggcttcgacctcgcccagctcgatgcgatgcccgcgcagcttcacctgccggtcggcgcggcccacgaacaggaacgtgccatccgccagccggcggaccacgtcacccgtcttgtacatgcgcagcgtcgggcctccggggaaggcgtgttcgatgaagcgcgactgcgtcagctccgggcggttgaggtagccgcgcgccaggccgggccccgcgagatagagctctccggggacaccctccgggacagggcgaagcctgccatccaggatgagcgcttccatccggtggatgggcaggccaatgggctcggtcgggccgtgcgcgcccacctgtccgggcagacaccggtgcgccagcgaatcgatggtcgcctctgtcggtccgtagaggttccacacctccgccttcgaacggctgaagagcgtggcgacggtcgcggagggcaggggctctccacccacgcagacgcgccggagcgccgggaggttcgcgaagccgggctcctccaccagcgccgtcagcagcgagggcaccagttggagcacggagacgtcgcgctcgcgcagcacgcgggccaggtgctccgtatccgcgccaaggccgtgcggcgccagcaccagccgggcacccaccatcagcggggcgaacagctcccagacggaggcgtcgaagctgagcgacgtgcgctggagcacccggtcctcgtgagccagcggcatggcgtcgtccatccacgccatgtggttggccagggcggagtgctcaatcagcacgcccttgggctgccccgtcgagccggaggtgaacaggcagtacgccagcgcgccgctccgtggctcgaacgactccagggtgtcgtccccgagcaccaccacgtcggtccccggaaaccgcgaggtgaggtgcgcttgcgtgatgaccacccgcgcgccgctgtcctcgagcatgaacgtcagccgctcgcgggggtaggccgggtcgagcgggacgtaggccgcgcccgccttgaggatgccgagcagccccgccatcatccccacggagcgttccacggcgagggccaccagtgttcctggcgtgacgccgcgttggaccagcgcctgggcaacggccttcgcgcgggcctccagggccgcgtaggtgagggtgccgtcctcggcctcgacggcgatggccgtcggcgtcttcgccgcctgggccgcgatgacctcgtgcacggcgggcagggacggtgccgcctccggtgcgcgaggcgtgagccgggcacgctcctcggcgcccagcaggtcgacatccacgaccttcgaccgcggctcggcggccagccgcgtgatgaagcccgtcagctggcgcaccattgcctggatgcgccatgcgtcgaagaggtcgcggtcgtattccagcacgccttcgaacccctgggccgtctcggacagcgtcagggtgaggtcgaacttggcggcgccgctggggatggccaccggggtgacctccaggcccggcagcgccatcttcgcggtgtgcgtctgctggtacgcgagcatcacctggaagagcggactggttccgagcacgcgctccggcttgagcacctcgaccagcttctcgaacgggacgtcctggtgctcatgggcgtcgagcacctggcggcggacacgctggaggagctcgaggaacgtgggctctccgcccaggtcgatgcgcaggggcagcgagttcacgaagaacccgatgagcggctccgtctccgcgatgcggcggcccgcgaacggtgagccgatgaccacgtcgtcctgcccactcacccggcccaggtaagcgccaaaggctgcgagcaatgccatgtaggctcgcactccttgctca

SEQ ID NO: 621 - DNA, 5588 bp, Myxococcus xanthus
gggccctggagttcgacatggaggcgctgcgcgccggccaggtgcagctgacccacttcaccggcatcctccccgacgggctgccggtctccttcgagtccggagacgcggaggcgccgcccgctcggcccgcggatggctacttcccgcccgcccagcgcaccctggacgtgtacctgggcgtgccgcgcgaacgcagcggcgtggagagcttcggcagcggggagcggctgggcagcagcccgcgctacacccccgcctcccgccccgtcagtgatttgacggcctccacctccatctcgcaggtggccttcggtcagcgcaacgtgcgcctgctgttcggcaccgagccgcgcgacgacttcgagtccatcaagctgtgcgagctgtcccgcgaccgctccggcaacctgatgctggtggagtccttcatcccgccgtgcctgcgcatcgacgcgtccccgttcgtcatgaacgagctgcggacgatgttgcggctgatggtgtccaagcagcggcagttgtcctcgcggcggcggcaccgggacgcctcggcgctggagttcaccgcgggcgacgtgacgctcttcctggagctcaacgcgctcaacggcaccatccccttcatccagcacgcgctggacgcgggcaacctgcggcccagggacttgtacctggcgctggcgcagtgcgcggggcaattgtgcaccttctccgtcagcgcggacccgtccacgctgcccaccttccagttcaccaacctgcgcgccaccttcgaggagctgttccgccgcctctccgagctgatgcgcgcggtggcgctggagcagtgcctgtcggtggacctgacggcgggcgcagacggcatgttccgcggccggctggaggacgaccggctggagcgctgcggccacttcatcctcgcggtgcgcagcgagctgccggagcgggtggtggccgagcagctccccaagctgtcgaaggtggccgcctgggaggacatccgcgcgctggtgcaggccgccgcgcccggcgtgccgctggcggtgacgtaccggccaccgcccgaagtccccgtgcagccaggcaccgtctacttcagcctctccatgaatgacggctactggaggaacgtgatgcgggaccgcaacctcgccatctacctcccgcagccgttcgacgcgaaccgaacgaccgtggaactgctcgcggttcccaccgccaatcgctgacgccccgagccgcccatggaccgagtcaccgaagccacgaaggattgtttcgacgccgccatccaactgcgcggctccgaagcctcggcggtgcccccgcccgagacgctgcaccaccgccttcgcggcgtggtggacgagacgctgcgccgcgccgccgtgctgggcttcagccatcaggatgcccaggacatggcctacgcgctcgtggcgctcatcgacgaggtcgtcctgggccgcccggaggagtaccgacagctctggatgcccctccagctccactacttcaacgagaacgtcgctggcgacggcttcttcgcgcgcctcaacaccgtgcgaaaggacccgcaccggcacgaggtgctgcaggtctactatctgtgcatgctcttcggcttccagggccgctaccgcatccgcggcggcgagctggagctgatgacgctcatcgacacggtgcagaaggacctggagcgcgcgcggcccttcgacttcgacgtgctgtcgccgcacggggaccggcccaccgaatcgctgctctccaagcgcaagaaggcgtcaatggtgagcatctccgccggggcgctcgcggtggccgtcctgttctacggcgtgctgcagttcttcctcaacgacaaggtcggtgagctgagaagccgcatcgaggtccacgcggcccgcaacacggcgacgagcgccagccagacgcaggcaacggggggggcgcagtgatggcgtacctgttaccgctgttgggcatcggcgcgccgatgttcgccctgatgacctacctgggcctcaccatgcagcaggcggccatcgtcgccgcgctcgcgggcctgctggccgccggcgtggtgtggctggtcaagcgcatccgcgcgcgcgccgccgccaagaagctggagggcgcgctggcggcccaggcggatgagcaggccaccaccgtgcggccggacctgcagcctgaaatcaaggccatgcagtcggagttcaccaaggcggtggaggcgctcaaggcctccaagctggcgcgcggtggcaaggacgcgctggcggtgctgccctggtacctcatcgtcggtccaccgggcgccggcaagagcaccgcgctgcgcaactccgggctgaagttcccgtatctctccgcgcgcggcggcgtgcgcggcgtgggcggcacgcgcaactgtgactggtggctgaccaacgaggccgtgctgctggacacagccggccgctacaccagcgcggaagaggaccggccggagtggctggccttcctggacacggtggcgaagcaccgccccagccgtcccatcaacggcctcatcgtggccatcagcgtcagcgagctgctgaacgcggacccgcaggccgtgggggagatggggcagaccatccgcgagcgcctggatgaaatcacgacccggctgaagatgctggtgccggtgtacgtgatgatcaccaagtgcgacctgctgcccggcttcgtggagatgttctccgacctgtcgcgcgtggagcgcgggcagatctggggcttcaccgtgccgctggagcagcagcgcgaggcgagcacggacctgttccgcgagcgcttcgaccagatgctctccgtgctggagcagcgctcgctgcgccggctgggccaggagcgccggctggagacgcgcgagaagatctacggcttcccgcagaagttcgacgcgctccggaagaacctggcggagttcctccagccgctcttcctggagaacgtgttccaggacacgcccgtcttccgcggcctctacttcaacagcggcacgcaggagctgcgcccggtggacaaggtgtccccgtccgcggcggagatcttcggcagcaccaacggccgggcgcagacggatggcgccacggacggccgcagctacttcctctgggacgtcttcaccaaggtgatgttccaggaccagcaggtggccgtgcgcagctcgctggaggaagcgagggtgcgccgccagcggatgatgttggccagcgcggcctccgccgccacggtgctgctgctgtcgctacccacggtgtccttcttcaagaaccgcaacatggcggaggccgtcaccgaggccatcaccagtgtgaatctggacccgcgtgacgacatccgccgcgtcgaggacctgattccgctgcgcaaccgggctccagagctgacggagtacgaggaaggcagcgcccccggtgttcatgcgcttcggcctctaccagggccacaagctgctgccgcaggcgcggcagttctacaacgcggcgctgcgcagggtgctgctcggcaagcagttcgagctcatccagcagcgcctggacacgttcgggaagaacccggacctgctgacggtgcgcagcgacgaggactacagcaagcacttcgacgcgtaccgccagtacttcgacgacttgaagatgtacctgctggtgaccacgccccgcgacccgcgcgagccggagctggacgaactgcagcgcaagtggctccaggacgaaatcgtcaagcactggaagcgcgtgcggggcgacgcggtggacgagcgggccgtggcgaaccacgcggagacgttcctgctgatgctcgccaacgagcagatgctccccgaggagcggaagccggcgcgcgagcagcgcatcgccttcggccgcgtcaccggcgtggtgcagtcggcgcgccgctcgctcaacaacgtgcccctggtgcggttggagctggcgcagttggtggccaacatgagcggcgcgtacccggacgtgacgctggagcagctcgtgggctcggtgccgcatatgagcgccacctcgcgcgtgcggggcgccttcacgcgcaaggcctacgacgacgtcatccgcgagcggctggacctggccttccaggaccagcagtcgtgggtgctggaccgcgatgagaaggtggacacggtgagctcgcggcgcgagctgcgcacccgctacttcgaggcctacacccaggagtggaaggacttcctcggcgccatccgtgtgcaggcaccggagaacctgacgcagatggagagcctgctgacgaacctgacgcgtggcaagcccaagccctacgggcggctgttccgcgcgctcacgtacaacgtggtgctcgacaagcgcgacgccaaggcggcggaggccgacacgggcttcctggccaaggcggggaagctgttcggctcggagcccgggaaggacgtgccgcagaagcgcgagctgctgaacgccaactcaccttccggcgcccaggaagtcacggcccgtgacctggagcgcgagttcgcctcgctcatccgcttcgccacggagacctccaagacggaggacggtgaggagtccctgacggcgctggattcgtatgaagaccagctggccaccgtccagacgacgctgctggcggtgaaggacaagccggccgagtccggcctgctgttggacaagattgagtccacccgcaacaacgtggagatgatggtccgcaagcagacggacaacgtcgccatcttcgagcggctgctgctgccgccgttccaggagatgcgctcggtggtgttcgtgggcgtggcctgcaacaagagcaagctgtggcaggaccaggtggtgatggcgtggagcagcgccttcaagggcaagtacccgtttgaccgcgcgtcgcaggcagacgcgccgctgcccgaggtcgcggagttcctgcgccccgaaggcggcctggtgcgcaagttcgtcaaggagcagctcctggaggacgtggtggccaccggacgccggtgggagttcacctcgtcaggcggggtcatgtaccggcctgacctgctcggcttcctggagaagacgggcgcgctctccaccacgctcttccccggcggcgacacggtggacccgctggtccgcttccaggtgcgcctgcgcccgggcgtctccgcggacggcatggcttcgcagatttcatccatcaccctgacgctcgacgggacggacgagacgtaccgcaacggcccggacacggtgtggaagccgatgatctggcccggtcaggcaggcaagctcggcgcccgcatcaccgtgcagagcgcggatggctccacggagacgacgctggaggccgagggtgactggggcctgttccgcctgctggagcgcgtcaagcgcatcgagcccagcgcggacggccgctacttcaccgcgacgtgggaaatctagcagatgaacggcgcgctggtctccatcgacttccgtccggagcgcaccgccaacccgttattcgggatgtcgggcaacacgtccaagctgctggccatcttccgggacccgcggttacag

SEQ ID NO: 622 - DNA, 3566 bp, Myxococcus xanthus
ctttccaggggggcacgggcgccgaggtcgcgctaaggtgccgtcctttcacgcggtcagaggagcgttggatgggtttgaatgtggaagacgtgaaggtgggcaccggcacggaggcaacggccggcaagtccgttaccgtgcactacgtggggacgctgaccagcggctccaagttcgatagcagccgggaccggggccagggcttcacgttccgcctgggcgccgggcaggtcatcgagggttgggacaagggcgtggccggtatgaaggtgggcggcgtgcgcaagctcaccatcccgccggagatgggatatggcgcgcgagggttcccgcccgttattccccccaactccaccctgctgttcgaggtggagctcctggacgttcgttgaaagcgaggacctgatggcggcggtcgaaatcaccaaggacaacttcaaggagacggtgtccaaagagggcatcgtcatcctggactggtgggcgtcgtggtgcggcccctgccgtgccttcgcacccatcttcgagcagacctcgaacaatcatccggacattgtcttcgggaagattgatacggatgcccagcaggagctgtccggggcgttcgagattcgctccattcccacgctcatggtgtttcgtgacgggattctcctgttcgagcagcccggagcgctgccggccgccgcgctggaggacctgctcaagcaggtgaaggccctggacatggagcaggtccgcaaggaagtcgccgccaagcgcggtgagccgccgcaggcctgacggctgctaccaggtgccgggtggggggccggtggcatgttcgccgccggccacccgctgcgtttcagggcccgtgcatcgggggtgctggaacgtgagggccccggggtgtgttgttggagcgtggctcgcatcggtcatgcccggatgggtcggccagcggggctgcgtattcccacctcacacctggattcgatgccgccttccgttattcgagacgccccgggtgaggatgcgccgcgtgcgcgcgtcctcctggtggacgacacgcccgccaacctgctgtccctggaagccatcctggagccgcttggccaggagctggtgctggcccgctccggcgaggaggcgctgcgcgagctgctgcgaggagagttcgcctgcatcctcatggacgtgcagatgccagggctgaatgggttggagacggcgcatctcatccgggcgcgtgagcgcacgcgctacctgcccatcctcttcatcacggcgttgagccgcgaggcggccttcgtcacccggggctatgcccagggggcggtggactacctgctcaagcccgtggacccggacatcctgcgcgccaaggtgcaggtcttcgtggcgctgtacctgcgcggcgaggaggtgaagcggcaggcggtggagctcgcggagcggcgccggtccgaggaagcggcgcagcgggcctccgaactggagcagcagctcatgggcatcgtcggccacgacatccgcacgcccctctccgtcgtgttgacgacggcgaagagtcagctcgccagtggcgcgttggagccggcgcagcagaaggcgttcgagcgagtggcgcgcagcggcgagcgcatccagcacatcgtggacctgctcacggacttcacccgctcgcggctggggggcggcatccccgtcatacctcgggcgggcgacctcaacgagctgtgccgcgaggtggtggacgagctgcaggtggccaggccgggccgcaccatccggtgcgacttctcacgcgacagtctgcacggcgtctgggacctggagcgcatggggcaggtggtggccaacctgttggacaacgccttgaagtacagcccggagccgtccgccgtctgccttgccacctgggagaagccggacgccgtcttcctggaggtccacaacgagggcgcgcccattcctccctcgctgctgccgcacctgttcgagcccttccaacggggcgaggactcgcgtgagcgggcccgcaccagcctgggcctggggctctacatcgcccgggccgtcgtggaggcgcaccgggggcggctgaccgtccgttcctcggaagccgatggcacgaccttccggctctgcctgccccggcgggcggacgcgcggctgcctgccggcggcgcgagcgacgcggggacctctcccgcgcccatgacggcgtgacacgccgtcacttcaccacggtgcagacgccgccgccgttgaggtgggcctgatccaccacgctctgggtgatgaactcctggagcgtgcgcacgtcgaacgcgccaggctggtagatgacgggctggccctgggcgtcgcgcagctcgttgccgtcgcggccccggaggtcggtgagctcctgcgtggcgagccccccgggggtgatgacgtggtcctcgcccgcggtggcggcgatggcctcgaagcgcaactgcacgccccggtgcgtgcccagccggtcgtagaacatgtgctcggcgtggatggtgacctcgggccgggccacggagccctcggggacgatgatgccctgcgttccgtccgcgccgttgatgcagttgttcatcagtgcgttgacggggaagcccatgcggaagcgcagcacgggctcgccctgcttcgtcgcgtggccttccacgaaatagctgaagccacgctcgcgcatcatcgcgaggtcctccgcggagacctgtccgtccgccagctcggtgcgggcttcgggcgggctcacccggaagcccacgtcccagcggcccgccggaacgcccgtcaattccaccagggggatgtcgcctttctgcacgtccaccagcacgtggcggctgctgcggtgggtttcgccagaagcggaggtgagggtgacgtcgcccagcgacaccaggtagcgggtgaactggatggaccagccatcctggaagagcgtgtccgggagtccacgctgcgtgccatcacccccactcatcgagacctggacgtcgcccgtggccacgttgtcacaggccgtgcccgccaggccccacaccaccagggtcgcgcaccaccacttccgggacttccgccgctccgtgttcatgcaatagatggttaattgcaacatggttgcgagtcaatcaggtcgtggtgtatctggggtgtggatgcaacccggatgcatgagttccgccccagggcgggccgctccggaacctagtgaggtcatcacccgtgtggattccgactctggtgctctgcgtgctgagcgccacgggcgagttgcctgtgacgccacccgttccgctggatgcgcctgggcccgtgctgcccacggaggtgcctccgcccgaggtgcccgccaccgtcctgctgcggctcaccatcgaccgcatgggcgaggtgtcccaggtggaggtgcggcagtccgctggcgtggcgtttgatcgcgccgcgatgagtgccgcgctgcgctggcgcttccaaccggcacggcgcggcgaagaagccatcgacgtgcgggtggatgtgcccgtcaccttcgtgcctgagagcac

SEQ ID NO: 623 - DNA, 5570 bp, Myxococcus xanthus
ttggtgtccgcggcgcttacgcccacctgcacctggacgttggcgcccgacccctcgccagaggtgacgctcgggatgtgcacccggcccaccacggtgacgatgtcgccgctacccacggtcgtgtcgctcacgctctgcagacggcagtagctgtcagtcggctcgggatccggggcctcgctcaccgccaggctgcccgtcaggtccgcgttgaatccgtccgggccgctgctgttgccgtccgcgtctcagtagaggaactcgccgccgttcacctggaagcggtaggcgaatcggtagctgcccaccacgcctgggttgggcaacgtggcctcgtactcgtcgttgtcccagaagtcgcccttgaactgggccgtcgtggtccagtcccactcgtctgacgtggccggagcctcaccggcgggtccccagccgagttggcccacgatggccgcgacttcgcccgtggtggtgttggtgaggcccgccacgttgacggacgcgatgatgacgtggctggccgcatccccggtggtgtacgccagcgactgcggcgtgttgttctcattcggccccagcttgcagtaaccaatgacgcgcgggatgacgggctggcccgtcacgttgagcgtgccgagctggtccatctcgaagttctgaccgccgtcgtccacgccgttgccgtcgcacacacggatggggccaccgtcgtggttgaagcgcaccgcgtagcggtactcgccgttgatggccgggttgggcagcgtgcccttccactggtcgttcacctcgaagttgtcctggtcgaaggtcaactgggtcgaccagttccatcgtgacgaggtgcgcgggtcctcgcccacgggaccccagccgagctggcccgccaggccaggccctgcgccttcgcggtccgtcacgcccggcaggttgacctgggcgtacaccgtcttcaggcccgacgtctgtgtcgtcgtgtagttgatggcctccggcgccgtccggtcgaggccaatcttgcaccacgtcaccgccggcttcggcgcctcgtcgcccacggtgagcgtgcccagcttggacaggctgaaggtcaggttgccctcgtcgctgtcgttgacgccgtccgcgtcgcagaagcgccacacgttctcgctgatgctgaagcggtaggcgacgcgccaggtgcccacggtgcccgggttgggcaggtcggcctcccactcgtcgttgttgccgtggtccgtcttgtacgtggcgttcacccacgtccagccgctgtcgctgcgcgggtccgagtccgccggaccgtagccgagctgcgccaccaggcccgagcccgcgccaccgccctgggtgacgcccgccgcgtacacctgaccggccaccttcacgcgcgtgatgtcgcccggccggtagaagacgttgaccggcccgaggttgttgtcggggcccagcttgcagtagtccacgcgcggccgggagatgaatacccgacgaagcatgtcctccgacacgccgttggcgctgccatcgccgtctgccatcacccacgtggcgccgttgtcgatggagaagcgcatggtgacgacccactcacggcgctcaccgccgatggtcggctggagcagcacggtgccctggtagatgtccgcctcgcggctgcccgagtcaccctcgtagctggcctcttcccaggtgtagctgtccgggttgagcagctccgcgtccgccagggcgaagcccacctgcgcgcgggtgccgccgccctgaccggtgccacgggtgatgccggccacggtgacggcgccgcgcacggtggtgcccaccggctggccgttgctgaccgcgtccacgttgccgttgagcacttcggcctgttcgatggtcgccaccggcgcgccttcgaacgtgaagccgcccaccagggtgccgtgagcgctgtccgggttcaccacgcgcacgtccaccaggccggaggtggcggtgggggtgtagccgtagatgcggtgggtgttgaccaccaccacccgcagggcctcttgctggccgaagtagagcttcgcgccttccttgaagccggcgccgtagacgttgatgagggtgtggcccgagacgggaccgcccgagggctggacctcccgcacgacgggcgcgttgtcgctgggagcaggtcctccgtctgagtcgccatcacaagcgacgaccagcagaggcaggacgaggacgagggcacggagacagcgagacgacatcgacatcaccccttgacgccgccagcggtcaaaccgccgacgaggtgtttctgaagcgcgaagaacaacgccatgaccggcgcggagacgatgagcgcgcccgcggcgaacttgccccactccaccttgtgctcgccgacgaagcgctggagcgcgacgggcagggtgaagcgggacgggtcgttgagcagcgtggcggcgaggatgaactcgttccacgccgtcatgaaggagaagagcgccgtcacggccagcgcgggccgggccagcgggagcaccacgcgcacgaacacctggaaggtggaggcgccgtccatcaccgccgcttcctccaactcgcgcggcagcgtgtcgaagtagcccttgaggttccagatgcagaagggcagggcggtggtggcgtagacgaggacgagccccgtgaggctgtccagcaggtgcagcttctggaggatgctgtagatgggcaccatcatcagcgtcgccgggaacatctgcgtcaccagcagcgcctgcatcccgccttccttgccggggaagcggaagcgcgacagcgcgtaggccgcggacactgccagcgtcaggcccaccagcgtggtggcgcccgccacgacgatgctcgccaggagctgccggccgaacacccaccgccccgccgcgtccgtgccggagagcacctgccggaagtgctccagcgtgacggtttcggggaaggggttggcggtgagcgccagcccgtccgtgggcgacagcgccatcttcaccacccagagcaccgggtagagcgtggccatgcacagcagcgtcagtccggcgtggatggcggccatcttcatgcgcgaggggcggttcatcccatcacctccgaggacgaccgcatcaatcgcctggtgaaggcggaccagaccagcagcaccacgaagatgaggaccgagtacgccgccgcgaagccgtactgctcgttgcgctggaaggcccaacggtaggcctcggacaccaggatgtcggtgccgccgcccggctccccgccggacaccaggtagatgatgttgaacatgttgaaggtccacacgctgcccaagatgacggcgggcagcatggcgggcctcagcagcggcagggtgatgcggcggaactgcgtccacttgctcgcgccgtccacctccgcggcttcgtagagctcctgggggatggactggagcgcgcccagcgccaccaccatcatgaagggaaaccccagccaggtgttggtgaccacgttggccgcgaaggctgtggagaagcgcgtgaaccagctcaccggctccaggtccagggcgaccagcaggccgttgatggcgccgaactgccggtggaacatgcccttccacatgagcgcggtgatgtagttgggcacggcccaggggatgatgagcagcacccggtagacaccccgcagcttcagcagcggatccttcaacagcagcgccaggaacaggccgatgctgacgtggagcaccacgttgaccaccgcccacagtagcgtcacggccagcgtgaaatagaaggagaggggctcggtgatgctgtagccgcggctggccaggatatccacgaagttggccaggcccacgaaggcgtatccccccgcctcgtggtggaacagcgacaggctgagacccaccgcgaaggggacgaacaccagcagcgccacgccagtcgccgcgggggtgatgtacgccaccgcctgcgccacgtcagggtaccgctgcttgaaaggcagcgtcgccgccgggcgccgcaggacccagacggagccgcccagcgccatggcgcccaccaatcccagccagggcagagggctggcgtcgggagggcgctcgcggtgcagcgcgcggtagcgccggtccgccagcgcgccggcgtcctggggcgcggtgccgccctggagcaccgcgcgcagcgccagcttcatgggctcccagacgcgcgccatctccagcgtgttgggcatgggcgtggcgtggcgggccgcctcgcggaaggaggagatgagcgtgtcctcccgcacctccttcagcgtgtacgcggccacgtccgccggaatctgccggcccaccatggctcgcacgcgagaggcctcgcccagggagatgaagcgcgccagcgcctgggcctgctccgctcgctcggagcgcgcggatacgtaggccgtctccacgcccaggaaggggcggatggggatgttcgtggtgctcaccgccggcagccccaccacgcggtagtccacctggggggcaatctccccagcgaaccacggcccgctgatgatcatggcggcacggccgtcgttgaagaggctcttcaccagcgcgcccgatgcctcctggggaatgaagcgctggtcctgcaggtccttcacaaaggccagggaacgggccatcccctgtgtgtcgaagctcgcgcggccgtttgcatcgaacagctcgccgccgaagccgaagaggaaccccgcgtggaagtagaagtcgccgctctcgtaggccagcccgaagcggcccgcgtccgcgtccgacagcgcgggcagcatcgccagcagcgcgtccgtcgtctctggcggctggggcacgagcttcgtattgacgtagagcgctagcgacttgagcgacatgggatagccgtacacctggccatccacctccagcgcctccacggcgttggggaagtagtcctcgcgcgccaggccactggcgggagccaccaggtgcatcgcgtggaagttgagcagccgctcgtggttgaagatgaagacgtccgggcccacgccatggggaatggcgttggtcagcttggcagcgtaggcgtcgtagggcagggcgagcagctccacctggacgcccgtcttcgaggtgaagagctccgtggcctggacgagcgccatctcctcgccgccgcggtacgcgtgccacagcttcagcggcttctccgccgcaggcgccgcgtgcgcgctcagcgccgtggcgagcagcgccaggccgagccaccggctcacgacgcgatctccagcgcggcgcgctgctccggatggcgcagcgccttcgcgccgtccttggagaagacgtgcagcgcgtccgccacgggggccaggtgcaccttgtcacccaccgagacgttcacgcccttgtcgaagcgagccgccaccagtccggcttccgttttgacgaaggcgtacccgtcgaagcccagtcgctccacggcgtccacggtgccggtgaggggcccctgggactccacgcgcaaatcctggggacgcaggcccagcagcaccgtggcttc

SEQ ID NO: 624 - DNA, 3648 bp, Myxococcus xanthus
gtgctctaaggaccagcgcacaactacgcgctgctcgccgccctggtggtggtggtgctcgtcgacctgctgcggaagttcggtggcgggttcatcccgttcttcaataccgacaggggcggcgcggtcctcgtgcttggcgtctccctcgctggagcggtagcgaacgcacttgccgctggggcgccattcaccctggcgctgctgctgactgcgctgcaagtcgccctgacggctgctggtggcttcaccatcatcaagcggattctattcaggagtgccgccattgcccgcgccgaacttgcgggagcgcttgccgctgggcaggtcgcggagaaagcggcgcgattgccgtcctggagcaactcgactcccggggcggcaagtgaagctcggcgcgctcgtgctggccgtactgctcgcgcttcccgcgtcgggctcagaggtcatcagcgtcgagcgcgctcagctcttccccgatggaggcacagcagccgtagaggtggagggcggctgctggctgtcggaaagccgctgcattcgaaccgcttcggagattgcgcggctgcgagccgagaacgaatcgttacgccagcaggcgggggacgtgtccttcacggtcgccgttgtggccttgcttgccgggcttggggccgggttcgccgttgcgaggctcgcgaactgatagtgggcggctacggaatcggcgcggttggtctgggacctcgcgacgccgtgaactacgtactcaccgcagccgcccgaacgccttcatacataggagggaccaacaagccaagagtggggcagggggggaccgctcgccacacggggcgtgttggcctgtaggaaataggcccactgcgcgagtatccgcgatggtagccttccgattcgggaggtcatgcgccattgctccagccgtctagattggcccttgctctcgcgctcgtatggggcgctgccgtggaggcccaaccttcagccgcagcccgcatgcggagagagcgtgttgtcacggttcctggagctgcggcagagccccttcctgtcgtccatgtcgcgcatgacacgccgacacttctcctgttcccggcccctatcaaccggaagactctgaccttcgacgagtcgcggattcgcatcctggatgctggtgagcggtccgtcatcgttcagcccgtggcggaccttcccgaaggtgagcgctacgaagtcggggtcttcttcgcggatggccgggctcctgcgcgagccgccttctcactggtcacagacccggccgaagtggacactcgaattgatgttcaacgccctgagctggcggatatggcttgcccggtagacgtgccgcgaacgcctcggcccgaagacttcgtgctgctggggtatgttgacaaggaaggcgtaacggcgacgcccatcaaactccacgctgattcggagcgaggattctcagtaatttcagcgatggcttatcgtggacagggatgggtattagtcgatgctactattcgaaactatcccgggcgggcaccttgggtgccacgagaggctatgttgacggggcgagccggcttgccgctgcgtgctcggcttgtgacagtggacgaaggtgcattcgttccaggtggattcggacgcattctcgctgttgctgagacagcgcagttgagcaatagcccagtttacactttggaagtggttggagatggtcgcacgcttacgattcccaatgtgaggttgccaaaggctgtctccgggggaactccatgaacgtgatttcgttgtttccgccccctggaacgaccatcgacggatggagtgttgttcgggagcttggaaacggagggtttgcagtcgtctacctcgtcgagaagcacggtctcagatgcgcgctcaagttggcgcgccaccgggattcgagtggggacgacaagcagactcacgcacggacgcttcgggagctttcggccctcctcctcctggaccatccgaacatcgtcaagcaccgtgggtatggatactctgagcaggggaatgtctatctcgcgcttgagtacgtagatgggtggacccttgccgaatgggcggagcgtaaacaccccacggttcaggaggttttgcatgtcttcgacaagatttccgccgcgctttcgtacatgcacggccgtggtgtcctgcatcgggatttgaaactgtccaacgttctgattcggaagagcgatggagagccggtcatcatcgactttagctgtgcaagctactcgttggccgaagagctgacggattggggcttgccgccgggaactgaccgctttcgtgcgccggaacagttcacatggctccgggagcacaaggccgaacagcgagcgaagtacgccttccaagttgcggacgagattttcgccgtcggggcgatgctctatgagttgctgaccgacccccgaccgacggaggttcaagcgcgagttacgctcaacagcaccgtcatgaagccgcctcctgcgcgtgcgttgaacgtgcgtgttccggaagcgctgaacgacctcgttgattgcatcctgtcgcgtgaaccggcaaggcgccctgtcgacactgaggcgttgcgccgggagctgggcgaactcctggcctattcgagcgcggagtacctatccccggtgcatccgccgtccgaacagcggccattggagccgccggatcaggtgatgcccgaagttgccaacccgcgccttcctgtgtcgccaacgcgttctggtcgggagaggtggggactcgcggcgggcttggctgccctcatcgcgcttaccgtggccgggagcttcttgctcagccgaggggaacccacggagtccggggcgcagaccgtcgttggtgtgtcgcgcccgcagatccctccacattccgcgccgctcacgtcgactgcccctgctatgtcaccaccaagccccccgcccatgacgctgacgggccttgcgactgccgttccgaaggaaggttcaaccgtgaagacgcctccgtcacctgagtccccactccaaggacgcccgtcacgcgggagaacgaaggccgccgctgctgccgactgcgcgacgatgactctcgttgcggcactcgcggcaggttgccccagtgcccagattcgacctgaagcgttcacttgcccggctggtgcggaggaggtgatgcaggaggatctccgctggaaggtgaatcagagtttcgcgctcaccttggatgcccgccatgagacggacgcctacgtttggttcactgcgggggcggaggtgatgggggtcgttccaaagggcgttccatcagcccaaagggcggtcgcccctcccggaacgcgcttctacggcaaggcatacttcctttccgatcgaatgggccgctctgaggggcctgcgctggtcatccgctacgatcgtgtgaagctccctgggcaggacgagcgcccggtttgcttcgtcgtcgagtcgccttccaaggggtacgaagatggcagggtgaaggcgtacaacttaggtggcggctacgtcgtagaccgttggccctgagcgtcgcgaaagacgtaataggtaggaggtcaacttcgggccgaacgcgccgttttgaccccatgacctgtgagggcgttccctc

SEQ ID NO: 625 - DNA, 4087 bp, Myxococcus xanthus
tgctccagaagctggcgaccgtgtggcctcgcatcgcggagctggtgaagcgcatggcgaacgtgcgcgagtacacgggccagccggccgaggcgctctagctgcgcgagaaggcgctggcgatgtcgggcgacgacctgacgttgcgccgcacggaggagcgcgcgaacacgggccgcgagctgctgcaggcgtacgccgtgtacggacgcgagggcatccgcgcctacgaggcggagcccgtcagcggcggcagcgcggcggccttcgtgctggatgcggcggcggtgcgcgtgtaccccgacggcagcatcgtcaaccgcatccacacggtgcagaaggcgctggagcagtcgggcgtgcaggagatcgccgaggtgaacgtgccgcgcggcgcgcaggtgctggcgctgcgcacgctgaaggcggacggccgggtgctggagccggagaacatcgaaggcaaggacacggtgagcctgcccggcgtggccgtgggtgactacgtggaggtggagtacctgctcgcggagcctccgcgcggccccgcgcagccgggcttcacggggtccgccttctacttccagattgcgaaccagcccaacgcctgggtgacgtacacggtggtggcgcccaagggcgtgggcatgaaggtggacgcgcacgggatgaaggtgccggagcccaaggtggacggcgacctggaggtgttccacttcgagacgcgccgcgtgccgccgttcatccccgagccggacgcgccgccctccgccaacgagtacctgcccttcgtcatcgtgggcgcgggcgacacgggcaacgagagcctggtgaagctctatggcgatgccttccaggagcgctggctgcgcacggcggaagtggacgccttcgcgcgcaaggcggcggagggcaagtcgggcctggacgcggtgaaggccttgcacgcggcggtgatgcagcgcttctccggccgggacgcgagcctgagccagacggcggcgtccacggtggcccaggaccggggcagccggctgacggtgatgaaggccggcctggacgcgctgggcatcccctcgcgggtggtggcggtgcggaccttcaacaccgacccgtcggcctacaccttcccccaggacgcgctgctgccgtacgcggcgctgcgcgtggaggtgcccggcagcgagccggtgtgggtggacacgtccgtgcgctacggccccttcggcgagctgccggagctggccatgggcgggcgggaggcgtggctgctgcccgaacccggccgcccgttgcagaaggtgcagacgccgcccctgaaggaaacccccggcaaggaagtgaagctggcgctgaagctcgccgaggatggaacgctcagcgggcagggcgaggagacgtactccggcttcgaggcggcgcagattgccgaggccttcaaccaactgtcggcggagagccgcaaccaggcgctgcagggcgcggtggcgcggtacttcggcggtgcgtcgctgtcgagcgtgaagctggagaaccaggagcaggtgggcgcgcccttcgtgctccgctacgagttcaccgtgccgcgcttcgggcggatggagggcggccagcggatggcgctggggcccctcaccttccccgcgcagttgggccggcggttcgtgcagctgagcacgcgccgcaccccgctctacatcgacaccaccgaggccagccgcacgcaggtgacgctgtccatgcccaagggctggaagctcgccgacccccaggcctcgctggaggcgaacaacgccttcggccgcttcacccggtccgagaagcaggacggctcgacgctcagcgtcaccgagtcgctgcgcgtgccacgcaaccgcgtcatgcctggccagtacgagctgttctctgggttcaccggagacgtggacctcatccagacgcgggagctggtcctggtgaagccctagccgggggatgaataaagccggacggcaccgcgtcttttttctacaccggccccgcactggggactctcaggggggccggtggcagaatctgtctggtaacccacggagatgacgcgatgactcctcgatggtgggcttgtctggtgaccttgctggcggcgcccatggttcacgcgcagaccgcgccggtccccgcgtcagagcctggatattccgaatacgcgtacgacgacacggagttcgaggacgaggacacggcgcccatggcgccctacgccccgccccagctccccgccgagaatccctccggccggcccttcacgggcgccgtctgggcctccggccactggtactgggatggcgacgagtggcgcttcaacgccggcacctggctggcgcccatggacggctaccggttcatcaacggctactgggagccggatggccggatgtggcggtgggtgtccggcggctgggcccgccatgactccccggtggtggagattcccatcgccgtggcgagcgaggagctgtccacgcagcaggcgcctccgccgctccgcgtcgagcacgcgccgccgccgccagccccctcctacgtctggacgcccggctactggtactgggccggcgccaactacgtgtgggtggacggcatgtgggccgccccgccccgtcctgggctcgtctacgtgtcgtcccggtggatgcgccgcgggccctcctggtacttctccgctggcggctgggccacccggggctcggtgcgtgtcacggtgcccgtctaccgccacgcgcacgtcaccgtggcgcgccggcacccgcactacttcacgcactcctggcgccgctaccccgcggtgcgccaccacgtctaccaccccgggaaccactaccggcgtggccccggcccggtgcgtcagcactaccgtggcaacaacggcaatcactggggcaatggcaactaccaccgggcgtcgcccggcgggaacgggggcgggggacatcaccgccgcgatgggggacatcgcggcggccgggactgacgcctcacggcgcgctcggggaggccccccgggcgcatcccggatggtggcctccgtgcgctgctacttcgcgccagcggcctccgccgcatcccggaagatggccacgacgggcttgccgtcctcgcccacgtagccgcggtacatgccggcggagttgaagggcatggccacgttgccctcgcggtccatcgcgatgacgccgccctcgccgccgaccttcaccagcacgtcgttgatgacgacgtcggcggcctccggcaacggcacgttctggtattccacgcgggcgcagatgtcgcgcgccacggtgtagcgaatgaagaactcgccatggccggtggcggacacggcgcagcgcgcgtccgcatacgtccccgcgccgatgatgggcgagtcccccacgcggccgtagcgcttgttcgtcatgcctcccgtggacgtggccgcggcgagcgcgcccgtctggtccagggccacggcgcccacggtgccgaacttgtggtccccgctcaccgggtcataccccgccgggagcgcggaggatggctgcggctgcgagcgctccttctccagcgcgcgctggaggccctgccaccggtcctccgtgtagaagtacttcgggtccaccaactccacaccctgcgacttcgcgaaggcctccgcgccctcccccaccatcatcacgtgcggcgactgctccatgacgagccgcgccagcgagatggggttcttcacgtgccgcaagcccgccacggcccccgccttgcgcgtcgtgccatccatgatggcggcatccagctcgttgaccccgtcgtgcgtgaagacggcgcccttgcccgcgttgaagtacggagagtcctccaggatgcggaccgcggcgctcactgcgtccagcgcggagccaccactggccaacaccgcgtgtcccgcctggagggactgggtcagcgcggcgcggacctcctcctcgcgctctggggagagattctcccgggagatgacacccgcgccgccgtggatgaccagcccccacttcggcttgggcgcgggtgcatcacgcgaggggggcct

SEQ ID NO: 626 - DNA, 4532 bp, Myxococcus xanthus
agggctcctcgccggtgtgcttggccagcatgcccgacagcgtcgtctgcggcgtgtagatggcgccgtcccgcggcgcgtagccctgcaccttggcgaagctgacgcgcagcgtgctgttggcgtcgggggccaccggcttgcccgcgtgcgccagcaccgccttgcgccactccggccgcaaccgcagcgcggcgccctggcgcttgtccttcacctcgtccagcgcggcctgctccttcgccaggtccaggccgaacgcgagcagcggatccttgcgcgcctcgagctggcccaccgactcggtggccatcttcatgcgctcgtccagcgtcagcaccttggagcccgcgtacatggcgtcaatcttcgccaggacgtccttctccgagaacgtcttgccgaagtgcttgtccaccgcggcgatgcgctcctcggcgcccagcgcctgcgcgcggcgcacgaaggccagcagcagctgacgctcggcggggaggaacaggttcttctggtcgcgctccagccggtccttgatgcggacgtgctcgcgctccatgtactccgggcggcgctccaggtccggcttcgcgcgctccgcggccagccgcgacaccaccaccgccagggccgggccccgcgccaggcgcgacgatgcggccaggaggaactcacggtcgaaggacttcgcgatggcggactgttcgacgagcagcgcggcccgcgcgtccagcgccggctgccacttcgcgcccgccttcttggcccacaccgcgacggcggcttccgcctcgcgctgcttctccacgatgtggccgcgcttcaggccggcgagctgaccgcccgagttcttgtagacgttgtgcaggcccttgagctgcgaggcgacggcaatcttgcccgcggggtccttctccccttccgcttcgaggatgcggatggcctcgccgaacacgtcgcgcatgcgcgggtagaggcgggactggcgctcggccatctcctccgcgagcagcgcgcggtacgtcatgcccgggtagcccagcaccatgacgaagtcgttgggcttcacgccctgggtggccagcgggaagaagaattccgccttgtaggggacgttcttgtcgctgtacggcgcggaggtgccgtccggcgcggtgtacgcacgaaggatggcgaagtcaccggtgtggcgcggccacatccagttgtcctcctcgccgccgtactcacccaccgcgcgcggcggcgcgtacacgagccgcacgtcggtgagctccaccgcatccaccagcgtgtagttgacgcccccatcgaaggtggccacctggcagcgggtggcggggcgcttctcgcactcggcgaccagctccttctgcttccgctcgatggccttgtagcgcgtgatgtcgtccgcgtccgcgggcaccgcggcgagcaccgtcttcgtcacatcggtgaagctgcgcgggacctggacgcgcgagcccttgccgggcagttcgtcctcgcgcttggaggcgaggaagccctgggtgatgaggtcgcgctgcggcgtgctgtgctcctggatgacgccgaaggcacagtggtggttggtgatgaccaaccccgaggcggcgatgaacgcgcccgagcacccgccgacgttgaccgcgcccgcaagcaggcccgtgccacgcttcgggtcccagagcttcttgggggagacctggaggccctgggcgcgtagccacgccgggtccagctccaggacctgctggggagtccacttgccttccccggccagagcgggggcagccacgagcgacagaaggaggagcgtcttcttcatggtgtcccctccctactccgtccggcgcccgcaagcgaatcccttcgccgtgacgcttcgcggccaggaggccgggctttttcgtggaagacgaacccggattaagtgttggggtgtcccaggaggggagcgaccgatgcggaccgccagcggtgcacagctcgatttcggccggttggccttgctcgccctcatgctgggggtgggctggtatttctgggattcacccgccctgtggcccatgaaggtgctggtggtgatgatgcacgagagcgggcacgccctggcgacgctgctggtgggcggctccgtggaccgcatccacctggcggccaacgagtcgggctcctgcctgtctcgcctgccgcccgggctgttcgccaaggtggccgtctactcgggggggtacctgggcagcgcggtggcgggcgcggggctgatgctggccaccttccgcttccggctccgccgctgggtgctgggcaccgccagcgtgtggctcaccgtcatgggcctggtgtacgcgggggacggcttcaccctgctcttctgcctgggcacggccgtggtgctggccctgggcgcgaagttcctgccggatggggtggttgacgcgctgaacctgttcatcgcggccttcacggcgctgtatgcgctgttcgacttgcgctcggacttgtggaacagcgcggtgcgctcgcagagtgacgcggcgctcctggcggacctcacctacgtgcccgccgtggtgtgggcggcgctgtggtcgctgatcgccatcggactgctggcggtggcggcgtacacgtccctgcacgccaggcccaaggggctccagatgccttccatcacggcgcgggcgcgacgggtgtagcgcctccggctatcaaccacgcgatagacttctccgatgatgcggacatttctggtctctgcattctcggtgctcgcgctgtcttttctggggtgctccaacgccgcgaggatgcccgcgcccgaggcgtgggagtccgcggaggagatgtgcaccaccgcagatgatgcccattgcggctcactgctgtgtcatggcgacgcgtgcggactctatcgctgcgaagacgtgcctggagctgtggaactggcgcgattcccgcctgcgcgtcctcccgcggcggctgcggcgcctgggcgcggtccccgaaggaattggggaggaggccagaaccttccacggggcgccgtcatggtgttccccaactggaacggcgctgccggctgggtggtgccaccttcacgtgggctcacagccgggcggtgggagaagcaccacatcttcccccaggccagagacctggcggagtggttcagggatagagggctcaggattcacgactacacacttccgattcctcgagacattcatcagcggattcacaaagggggagagagtggcggggcatggaaccgagcctggcgcgagttcagactccgcaacgagaacgcaagccccgaggagatcttcaagcacgccggcgaactcatctaccgcttccagctcatgggcgggcccattcgcgcctaccattccaagccaggtacttgagagattgagtgcatgatgcggttcttctggatacgcgaggagcggactccgtccttcaacggcagcttcgacgccacacacaagtggcgcctgcccggcgtgaagtgcgatgcctgtggagtcacgtggggtggggccgggcaccagtacccaggggtggacctgtctcacgtgcccgagcggtcacgcttcgtgcgcccctggcctgttcccgtttcggagctcgcgcaactgcgagcgctggttcgcccctgggtgccccctggcgtgccacttccgccaggcacgcatctggggcctcttgaaggcacagcctctgggcgattcggcccactgacgtcacagggggatattctgtgggtcgtgcgacgggatgccctcgagcggcttcaagccgaaggcgtcagggggctgctcggctgcaagacggaattgaggtttcgccagaaggagccgccggagttgctggaactccaaatcgaaccgcgcggccgactccatgcggactgccttccctccgacctcgctccaccatgcgacgcctgcggccgggtcacgcttcgattgccggacgcgccccttctcgacgcagcatccctgcccatcgaccgcgatgtcttccgcgtaggggactacgccaccgtcatcgtttgcactgaacggttcatggagacagtgcgccagctcggtctggaaggaatggcctttcgcgagattcccacacgcggatgacgcaggagtccgccgccgttcagcggccctccatcacagcgcgggcgcggcgggtgtagcgcgcgggggccggacggcgtcgcgccggacacagcggcccctcccacggtcgtgcggacgccccccgtgggttgtcgagtgaaggctgccgcctcatatcgaggcctccggcccgtcctgtcccgtccacctccgagcccgccggccatccagcccgcgagcggctccggacgcggcacgaggagagacgatgagacttcctggcacgtggcgcgcgtggcttcgcggcggactcctgctgaccagcgtgtgcgccgtgggcggcacggtcgccacccaggccgggtgcgcgtccgcgcctgacagcgcggcccgcgctgtagagca

SEQ ID NO: 627 - DNA, 4835 bp, Myxococcus xanthus
ccgctgctggacggtgcgcggacttccaggcccaccggcgacaacgggcgcccctgccctgcgcggcgtggacctggaggtgcgcgcgggtgaaatcgtcggcatcgcgggcgtggacggcaacggacagcgcgagctggcggaggtcctcaccggcctgcgcccgctgacgtctgggagcggagcgctcctgggaggccccttgagcgacctcacgccggcccaggcgcggacgcgcggcgtgggacacatccccgaggaccggctccaccgcgcggtggtgaaggcgctcagcgtggaggagaacgtggccctgggccggcacacgcggccgcccttcgcgaagggcccgtggattgatttcaagggccgccgcgagcgcacgcgcgagctgaccgtggcctacgacgtgcggcctcccgacccggaagtcgccctgcgggccctgtccgggggcaatcagcagaaggtggtggtggcgcgcgagctggatgcgcggccccggttgctggtggtggtgcagcccacgcgcgggctggacgtgggcgcggtggcgcaggtccacgcgaagctgcgcgaggcgcgcgaccagggcacgggcgtgctgctggtgtcactcgatttggaagaggtgctggccctgtcagaccgcgtctatgtcttcttcgaaggccgcgtgacgggccacttcctccgtcacgagttcgacgaacgcgagctgggacggcgcatgctggggaccacggagccgggccatgcctgagcgcgtgagacagatgcttccgtcggtgctctccgtgctgctggcgctgggcgtgtgctgggcgctcatcgcgctcaccatggagccgggcaccgcgacggacgcctatctgcagatgctgtggggtggcatcggcaactggcccgcgtgcctggacggcgccgcggccaccgtcatcacccgcccgctgggcgagtccgcgatgaaggccgcgattctcaccctcaccggcctgtccgtggcggtggcgttcaaggtgggcctgttcaacatcggcgcgcagggacagatgctgctgggcgcggtggccgccgcggtggtgggcgcccaggtgtcactgccgggcgtgctgcacgtgcccgcggccctgctgggcgcggcgctcgcgggcgcggcgtgggcgggcatcgccgggctgctgcgcatctaccggggcgtgcacgaggtcatctccaccatcatgctcaactgggtggcgctgagcctggtggacaactggctggtggtgggcccgctgcgcggcgcggccgaaggcggccagtccatcaccggcaccgccgaaatccaggccaccgccgtactgccccggctgctgggggaaggctcgcggctcaacctgggcttcccgctggcgctcgccgcggcgctggcggtgtgggtgtggctgacacgcacgcgctccggcttcgagacgcgcgcggtgggcctgggcgccgaggccgcgcgcgccgcgggcatccccgtggcccggcgcatgggcctggccatggcgctcgcgggggccatggcggggctggcgggcgcggtgctggtgctggggacggaggggcgctaccccggcacactgggcgcgccctacgggttcgacggcatcgccatcgcgctcatcggcaacaaccacccgctgggcgccaccgtgtccgcgctcttcttcggcgtgctgcgcgcgggcggaacgcgcatgcaactgctcggcgtgcacaagagcttccccgagctcatccagggcctcgcgctgctcttcgtcgccgggcgcatggtctggctggcgctgctgcgccggcggaacgtggcgcccgcggcgtcggcggaggtgccccgtgcttgatgtcctccactcactgctgttctccaccctggacgcggcaccggcgctcgtcttcgccgccctgggcgcggtgctctccgagcgcgcgggcgtgattgccgtgggcatggaggggatgatgcgcgtgggcgccttctgcgcggcggtggcggcgctgacgatgcccacgcccctggccgtcgtcatgggcatgctcgcgggcgcggccctggccggcgtgcatggcttcctgagcatccgctggcgctcggaccaggtggtgtccggcatcgccctcaacctggtggccctggccggcggcaccttcctgctggagtcgctctacggccccaatggcaccccgcccatccagcagctcacccgctggaacatccccgggctcggcgccgtgccggtgctgggcgcgctgtccgggcactcggcgcccacgtacctggcgctgctgctgcccttcgcattccagggcctgctgacccgcacgcccctgggcctgcggctgcgcgcggtgggcgacaagccccaggccgtggcgacgctgggcctgtcggtaccggggctgcgctggggcgcggtgctgggcagcggactgctggcgggcctgggcggcgcggtgctgtccaccgccgtactggaccgtttcgagcagcacacccccgcgggcctgggcttcatggccctggccgccatggtgttcggccggtggacgcccgtgggcgccttcctcgccgccaccttcttcgccttcggtaacgcgctgcgcatcggcctggtgtcgagcgcccccggactggtcgagctgatcccccagggcgtcctcctggccctcccctatctgctcaccttggtggtgctgaccctccagggccaacgcagcagcgcccccgccgcgctcggaacgccctacgaacaagagtcgcgctgacactttgcgcgcaacgaggtcattccatacccgggtgaaaatcgatttcgggtcaggagcgacctcgtctttcgttggccggattccagttgagataactttctccagtgtcgcaacgattcaaccccctgacgttacagggcttccaccgttggtggtgcaatgggcggctccgacgcgccaggacgaagcgcggcatgagcctcgcatagacacagcgcggtatcggatcacgtaccggactggacgcaagcgcccgggggggagctccatccagggcgagaggggtccgtaggacggcctggaacacccgggtgaggctcacctggtcaccatgtaggggtggcgtgatgctggagacgacggagaccgcgacgtatcggccccgagttctggccgtggacgtggaatcgggcggcatggagcggctgtgctccatcctcgcgccggcgggttatgacgtgctgaccgcgagcggactgggggcggccgcggcggcccatcaatccgcggacctggtgctgctcgacgtggagcgtcctggcacggatggcctcgcgacgtaccggcgccttcaggacgcgctgggaagcccggccctccccgtgctcatgctgacgcccagcgcggaccgggagacgcgccgcgaggtgctcgaggcgggcgtggatgacctgctcatcaccgagcccctggacccgctggagctgaaggtccgcatccacacgctgctggagctcaaggcgcaccgcgagcgcggtggccagcgcgccgaagcgctgcaggacccgcgcgtccgctgggtggagatggagcggctggcccgcgtgggcacgctggccgcggacgtggcgcagaacctgggccgcgtgggcgaaggcctccagcgggcgctggagcacgttcgcactcgcgcgctgcaaggcctgccgccggacgcagacgagctcaagaagctgggcgtggccggcgagcagatgcgcctgcacggccagcacctgctgtcgctgggcaccaccaatccgaaggacatccagcgcttcgacctgcgcgacctggtccccgcggtggtggagcggatgcgtgacgccggccgcctcggcaccgccgaggtgaaggtgcagctgccggacgaggccatcgccgttgtcttcaaccgccgtcagttggagcaggtgctggtggagctgctggccaacgcggtggatgcggtggaggacgtgacggaccgcccgcgtcgcatccatgtgggcgtggagcttccggacatcttcggggacttcggcccgcgcctgtacgtgaaggacacgggcatcggcatcttcgaggacgagctgcaggccgtcttcgagccctactacacgacgaaggcgcccgagaagggcgccgggctgggcctcaccgtcgcgcgcaccctggtggaagccatgggtggcgcggtgacggtgcacagccgcgtcaacctgggcagcaccttcacggtggagctgcccgagcagacgtcgtcctggtagctagaagcggtaggcgacgccgaagagcgcttccagcgtgaactcggtgtcgtcgatgtccgggatgacggcgggccccagccggacgttgaaggtgacgcccagctggcggttgacgaagtactccaggccgccgcccacgaggacggggaacaccggaccgattccctcgccgaagtagacgtggaaggggatgtccaggcccaggttcaccatgacggcgctgccggcggggatgcccaccaccacgcccacgggcagcgccaggcccacgtcggtgtcatgccggttgaagtagaagaacgggcccggctggaaggtgagcgccagcgagaagttgcgctccttgacgagctgcaaccgcatccacgcctggagcttgatgcccgggtccgtgtagcggacccagccctcgcggccccagttgaagctgaacttgccgccgatgtcgaagcgctccgagccaccgtgcagcaggcccagggagatgccgggccagcctatctggccatgaaggcggtggtgccc

SEQ ID NO: 628 - DNA, 5051 bp, Myxococcus xanthus
gacttcagccgcaagcccggtccgctgtcgcgcatgggccagaaggtgacgcaggaggagcagcgcgcggagaacggcggtccgggcctttccggcgagcgcatcatcaccccggctccgcccccggccagcagcccgggagccgtgccctccacgcagcggcaggcgccggcctccccggaggatgaaggtggaccgtcggtgcgggaaggcatgccgcctccagatggttcggaagaaccagtgcccgcgcccgccccgcagaacttcgagcagcccccgcccgaggccatccaggtccccgaggcaggagacgccgaacgcctgcgcatccagcacatcgagccggggccgagggagtagacgccatgaacctgaccgccgaccccgccctcaccagcgccgccaccggaggcacggtttccccgcgcaacgacgccacgcagctcgtggcacacggacaggcctacctgtgtggccgcccgctgggggaaatcctgcgcgccatcgtcccctcgctcaccgaggagaagctccaggaggcgctcgccatccaggacgagaaggggcagcgcattggcgaggccctcgtggggatgaaggcggtctccgaggaggacgtggccaaggccctggggcaccagttggacctgccctacctggcgcgcatcttcgccgaagaggtggacgcggagctcgtcaagcgcatccccatcaacttcgccaagcagtcacgcatcctcccgctgtccctggagggtgacacggtggcggtggcggtggcggacccgctggacaccgccgcgctggaccacgtgcgtgtgctgctgggccagagcgtcagccagcgcatcgcgctgggctccaccatcaccgacgccatcaacagcgtctacgaccgctccgtcaacgagacggaacagctcgtggacgagatggaaacgcaggacctggacgccatcgcccacgagctggacgagcccaaggacctgctcgacgaggacgacgaggcgcccgtcatccggctggtgaactccgtgctgttccgcgccgccaaggagcgcgccagcgatatccacatcgagccgatggagcgcgagctgctggtgcgcttccgcgtggacggtgtgctgcaggaggtcatcaagccgcccaagcgctaccagaacgccatcgtcagccgcgtgaaggtcatggggcagctcaacatcgcggagaagcgcctgccgcaggacggccgcatccgcatcaagctggccggccgcgacatcgacatccgtctgtccaccatccccacgtccttcggcgagcgcatcgtcatgcgtctgctggacaagacggcgacgctgctggacctggcggaaatcggcatgagccagaagacgctcgagtcgatggaagccgtcatcaaacgctcgcacggcatcatcctggtgacgggccccacgggctccggcaagacgacgacgctctacggcgccctgtcgaaaatcaatacgcccgacctcaacatcctcaccgtcgaggacccggtcgaataccagctcaagggcattggccacatggccatcagccccaacatagggctgacgttcgcgcaggggctgcgctcctttctacgacaggacccggacgtcatcatggtaggggagattcgcgacaaggagacggtggaaatcgccatacgggcctcgctgagagtccacctggagctgtgcaccgtacaaaccaatgacgtcgctggtgacgtgacacgtctggtggacatgggcgtggagcccttgctggaggtgtgctcgctcaccggcatcctggcccagcggctggtgcgccgcgtgtgcccggactgccgcgtgcccttcgagcccaccgacgcggagctcaaggagctgggccactcggtggcctccttcaagcagcgctacggcgtggaccgcatctacaaggcctccggttgcccctcctgcaaccgcaacggctaccgcgggcgaaccggcatctacgagttcctccccgtggatgacgacgtgcgccagctcgtgctgaagaacgtggacgcctccaccatcaagcggtccgccacgtccaagggcatgacgacgctgctggatgacggcgcgcggaagattgccctgggcgagacgaccatcgccgaggtgctcagcatcacccaggaggacatgtagccgaccgctcctccctgggaggggcccggggttcctgaaccatgccggtcttcgagtacagaggtctcaattccgcgggcaagcagatcaagggcctgctcgaggcggactcacccaagacgctgcggtccaagctgcgcgccgacggcatcttcctcacggatgtgctggcccaggccgaaggcagccgcgccgccgtggccaagggcaccaacgcggcgctggtggcgcgcgacatcgacctgcgcaagctgggccggggccgcgtcaacaccgacgacgtggccatcttcacccggcagctctccacgctgctgggtgcgggcgtcacgctggtggagtcgctcagcgcgctggtggaccaggtggagaaggagcgcttcaagcgcgccctctccgacatcaagcagcgcgtcaacgaaggctcgtccctggcggaagccatggggcagcacccgaaaatcttccccagcatctacgtgaacatggtgcgcgcgggtgaggcctccggcgcgctggacgcggtgctcacgcgcctggcggacttcacggagaaccaggcccggctgcagcagaagattctcagcaccatgctctaccccgccatcatgatggtggtgggcggcgggatcctcgtggccctcatggtcttcgtggtgccgaaggtgacgaaaatcttcgagacgatgaaggccacgctgcccctgagcacgcgcttcctcatcgcctccagcaacttcttccagagctggtggttcatcctgctgccggccatggcgctgggcgtggtcctcttcatgcgctggacgaagagcccctcgggaaagcccaagtgggaccgcatcacgctcaaggcccccgtggtgggcaacctggtgcgcctgctgtccatctcccgcttcgcccgcacgctgtccacgctgctcaagagcggcgtcccgctgctggcggccatggacatcgtcaaggccatcatgaccaacaccgtcctggcggaggtcgtcgagaaggcccgcgactccatccgcgagggcgagagcatcgccaacccgctgaagcgctccggggaattccctccgctggtgtaccacatggtcgccatcggtgagcgctccggccagttggaggagatgctcaccagcgtggcggacaactacgagacgcaggtgaacgtgcgcatcagcgccctcacctcgctgctggagcccctcctcatcgtggtgatgggcgcggtgattgcattcgtcgcgctctccatcctgatgccgattctgcaggtgaactcggccatccggtgaggtgtggcggaatgatgaacgacatggcggaccgttggattcaacgcgtcaccctggcggcaatggtcgccatggcggcggcgctgctgaccgtgggggcccggttgtacggtccccagcaaccgcgcccgcccgccggggcggcggacagcgtccggacgccctgacaagaagacacgacgacacaagggtggcctgccagaaagtcacccgggatggagagcacacatgcgccagagccagaagcagcagaggaagcagcgccgcaaccgcggcatgacgctcatcgaaatcatggtggtcatcaccatcctcggtctcatcgccgcggcggtgggcgtggccgtcatcccgcagttggagtccgcgcgccgggatcgcgccgcgctggacatcaagaacatccagggcgcgatgaagctctactacacgaagaaggggaagtacccggacacggcctccggcctgcaagcgctggtggaggcgcaggcgctcgagcagatgcccaaggacccctggaacaacgactacgtctacatcaacgagggcggaaagccggtcatcatctcctatggcgcggacggcgcctccggcggtgagggcaacgacgcggatatctcctccgcggacgcggcgacctccgccaagaagtgacgaacaagtcgcgcgcgacacacgttgacagggcttgggcatgaaagagcacgacgccattccatccccgacgccctcgcacgaggggccggaccgccgccggagactggggcggttcctcctcgcgttcgtcttcgtggccgccacggggcttgccttcacgctggtctacgtgacggaggaccggacgctggataccaaccagcgccgggcacgcacggacatccgccagttggagagcatgttcaagtcccaccaccggctgatgggccgcttcccctcccaggcggaaggcttcacgccgctcatccaggcccggatcctggaccgcgtgccggaggacccctggggccatccgtacgtgtactggatggacggctccacgggcgccgtcatctcctatggcgcggacggcaagccgggcggcacgggacctgacgcggacctgagcagtggcggtgtgctggccgccggttgggcggagccatgacgaagcggagccaccgcgcccagcgcggcctgacgctcatcgaaatctccatcgccatcatcatcgtcgcgatgctgttctccgcggcggtgatgggcatcggctccatcaccggcgccaaggccaagggcagcgcgggcgagctggcgggcctcatccgctcgctctacgactcggcggcgctgcgcgggcagacgtgccggctggtcttcgagattcccgaccccaagagcgagcaggccacgcgctatcacgccgaatgcgcggagggcgccgtcaccaccgcgagagaccgcgacgagacgctacgcgcggagaacagcgagcgcgagcgcgccgcgcgcaaccggagcagcggcagcggccgtgacgagcggcgcaactacctgtccggcggcagcgggacgaacgcccccagcgcgc

SEQ ID NO: 629 - DNA, 4078 bp, Myxococcus xanthus
gccctgcgggcccacgttgaagtcgtagttggcggagatgatgccgtagggcttgccaccgaagacgccgtactcgttggagtacacgagcttgtacaggccgctcttggtgacctcgggcgcgtcctcgaagtccttctgcaggtcttccttggaggcgttcagcatctccacgcgggtgttctcgcggaagtcggtgcggtccaccatgaacttcagcgagcgccacgaggactccagcttctggaactccttcgcgtggaggatttcgttgacctgggaggacaggcgcttgtcgatttcggcaatcatcgcgtcgacgagcgccttgtccacgcgctcctcggagcggttgggcgccagcatctcggtgatgaaggcctgcacgccgcgcttggcgacgtcgtaaccctcgtccttcggcttcagcttggcctcggacaggatttcgtcgagcagggacagcgaggcgtcattggcgacgcccgtggacttctgggtctgggtctcgttggccatggtgattcggttcccccggaaagggctacttggtctcttcggtcagacccagttccttgatgagcgccttgcgtccgtcctcgtcggcgagcagagcctggagcttcttgcggaacgccggcaggttgcccagggggcccttgagggcgttgagcgcgctgcgcagctcgagcagcttcttcagctccggcacctgattgacgacgctctcgggcgaaaagtcattcaggttcttgaactggagcgacacgttcatcgtggcgttcgggtccgccgaaagcttgtcggcggcggtcagggtgaccttgaggttctgctgggccatgacttcgttgaagttggccttgtccacgttgatgggcgcgcgctgctccagcggacgggcgtcttcctgacccgtgaagtcccccagcatcagcaccttcagcggcagctccacctgctcctgcgcgttgccggtggcgggcttgtagacgatgttgacgcgctcggtaggggcgacggaactctctttgctcatctgcggctttctccttgagaactgcgtagaagacgcgggcgtcgcatgagggagagcttcgccgcggtacgacgggtgtctttcaagcgccgacgcgcagcgtggcggaagagtccagcaacgctagacgacgataccggtttcgaaatttcactgccaccggtccagactccttttcggcttcggtgcgggtttgcagccacccctccagacacgcggcggcgagcgctggctcccaggtgtcgagcgcgtgggcggagacctcttcgtccagcgcgtcatagacggcgcgcgcgagcggcaactggcccgcattggcacacaaccgcgccagctccagccgggagatgaagcgggcgcggccggtgctggcggcggcgacggcggcctgcaaccgggtgacagcttcgtggacacggccttcctccagcaacgtgcgggcttcggcttccagcgccgcgctgtcggcatggacagacgggcccagcgacaggggccccagcgccagggtcgtggacaccgacgccacggcggcggaaggggcgggtgggggcgcgctcgcgcggaggacgtggtcgcgcagccagtcctgggtggcgtcgtccgtgagcgggcttcccaaggtggagatgagcgtctccacgccggtcatgcggcggagctggatggccaattcctgtaccagcgcggtgcgagccccggcgtacgcggcacccagcccctccagggcggtggcgctgtaccggtggagcgtcagcgtgaagcggtggcgggccagggccgactcggactcgtccagcagctcgccccagcgctggttctgctccagggtctccagcttggttcccagcaggtccggcagtgggtgaatctgggtgcggccattgccatccgtggcgggcggctgggtcaggtgcaaccacaggcccatgcggttgaggcggtaggagagcggatcctcggggctggcccggcgcagcgcgcccgcggctcccagcagcgcgccgcccacggtgcgcaggaagtcggtgatcgcctccacgctggacagatccggggcggcgggaagctcggggaggggcgggacttcgatggcggcgcgcggtggtgcgggtgtgccgttggcggaggcgccgccctggctggctgcgctggctttggcggtgccctgagcggtgctgattttggccggggcgggggcgttcttcgccgtgggattgcccggggcggtgttgcctttacccggggcggcgctgtttccagcaccgttggcttgagcaggtttgccgttggcgctggcattgcccgcctcccgagcggagcggttgccattgccgttcgtgggcgtttcagcgctgtccgaaggcgctcctggccgcgtgccattcgcggagtccgccgcgcgcacaacggtctctccatcctcgccggacggggtgtcctcgtcctgggacgacgcagtcccatccaccggcggctgcgaggcgtctgcgtcctccgaggacgcggtgcgtccatccggtacgctctcgggttcgggctcggggagtccggcgcggagccgggcgatggcatcctggagcggcccgaacgcgggggccatgtcggagaaccgctcgcgtgagagctgggccaggcgcttcaccgcgaccgccagcgcatccaggggctccgcgctcacggaggcctggtctacggtgggcaggatgcggcccagccggtccacgaaccaggccacggcgttggctcggccgcgcagccgcttcgcctccgggaagaggtcctgccagtagcgctccgtcacctcggcgagcacggccgtgccggtggccgcgccgtccaggcctcgcgtggcatacaggccataggccatgtacgaggcgagccagaggtccttggtggtgtgcttcagcagctcgctggcgccctcgacgacgtcatcccagcgcacggcgttgctggccggagactccaacttcgcgacttccagcgcgacggcctcgtatgcgggctcgtgcttcgcctgcacgccggccggggacgcccccggcacgggctcggcccaggggagggcacgttcacgaagctgttccagggagggaggcataggcgtggtggggcttcagcgcgaaagcgtctgcaacagctgttccagggtggtggacggcgcgtcgatgacctgtcgcgccgaggccgtgaggcccttgcgcgcgttgtcgatggcggcggggcgctcggtgcgcagcggccacacctgggcgcccggacggctgggctgggccagcgcgaggaagagggccggggaggccgctcccaggctgatgagcagccggggcttctcgccctcggaccagaagaaggccggcggctggtgcgtccacttgagcagccgcgaggacagctccagccaggccacgggtcccacgcgcgtggtcagcggacagtccagggtgacgccagccggtgactgctccttgccgcgctcgcccgcgcacgcggtgaggaaggtgtgcagcgcgtagtaacgcccaccttccggcgtgccctccaccaccgggcccagcaggtccacggtgtggtggtccgccagcacggcgttgagcagccgcttcgcgaggctgtagtcccccggccccggcaggggcagcgccgccacgcgctccagcagctgtggcacctccagctccgcggcggactgcgccagcgcaccggcggcgcgcaggaagggctggtacgcctcgggcgtcaacgcgagccgcgaggccgtctccgcggaggacacctcggtgaagacggccagggggaacgcccggcccacgctgtcctggctgggcgccatcagccccaccagtgcttgcttctggccgggcgcggtgaagacgaaacagacgggctcggcgggcaggtccacccgggctcttcgcgaacgctccacgcccgcttccatccagcagtagagctggagggccagcggggtggccgcgttgtggcggatgaattcggcctgtcggggcgtcttgcccagcaggccgatgcccg

SEQ ID NO: 630 - DNA, 4269 bp, Myxococcus xanthus
gtttcctgggactgcgcttgaagctgccggccggtgccttcctggggcccgtgttgctgggcatcccgctcacggcgctgggcctgccggtaggcgcgtggccgccgggcctcctcccgttggccttgtgggtgctgggcgtgcgcgtgggcagccagttcgatgcctcggcggtgcaggagctgaagcgcgtcgcccacgtcgcactggcggcctcggtggcgatggtggtggggtgtctgctgctcgcgtggggctggtccgccgccacgggcgtggacctgctcaccacctacttcgcgacgtctccgggcggcgtcgactccgtgctggccatcgcgctgggcacgcgtgccactttgtccgtcgtgctggcggtccaggtgggacggctgctcttgatttttctcgtcgcgccgccgttcctgcgcaggctgtctcccgcccggggcgcgtgagcaccccgctggccaggctggcaggcgtgcctgcctgagtgggcgggggcagatgtgcgtccgggaggtcccaggggacggcggacgtccggcgcggccagggacgcgcggttaatatgtaggccgcgatgactgccccgcacgatgccctgcctgtccccagcctcgctccgagcatggaggcgctggtctcattgctcacgcgccgcagcacggtggtgctcaccggggcggggtgcagcaccgagtcaggcatccccgactatcgggggcccgggacgcgggcgcgggcgcgcaaccccattcagcatcgcgagttcctcacgcgccccgaggtccgggcgcgctactgggcgcggagcctgatgggctggccgcgcttctcctcggcccggcccaacgctgcgcacgcggcgctggcggagctggagcaggcgggccacgtccgaggcctcatcacccagaacgtggacgggctgcaccatgccgctggcagctcgcgggtgattgagctgcatggcgcgctggcccaggtccggtgcctggcgtgcggcgcgcaggaggcgcgcgaggcgttgcaggcgcggctgctgtcactcaaccctggcttctccctcgaggtgctggagctgcgtccggacggtgacgcggacctgacctccgagcagctgtcgtccttccaggtccctgcgtgcctggtgtgtggtggaacgctcaagccggacgtcgtcttcttcggcgacaacgtgccggttcccaccgtggcgtcggcgttcgccctgttggaggagggcgacgcgctgctggtggtgggctcttcgctggccatcttctccggctaccgcttcctggtgcgcgcgtccgagcgccggatgcccatcgccattctcaacctgggggagtgccggggcgtggagctcgcggacgtgcacctggaggcgcgggcaggggatgcgctcccccggctcgcggcggcactggcccggagctgaagggccgtacggcaatcacctcacgtcgtacaccttgcggaccgggctccctcctcgctcgatgtcgagctcgaggtgcgaagcgccccgtagcagcatgaaggcctccagggctctgtcgggcgcgtcgagcgagacgccattgatgcgccggagcacgtcaccagactggatgccgagctgctcgtagagggagcccttcttgatggagaagaccttgaagccctggggcttgccgtcgcggaaggctggcaccacacgggcctgggtgagcaggccgtccatattggcaagcgcgtcttcgacagcgcggcgggacacctcataggtatgcgcacccaccgcgcggacgcccgtgtgcgcgggcgcggcgttcgccaggaagggcgcgtgtgagacgcctccatggcggtcggcgcggatgaactcctcctggccgtccatcaggaaggtgatgcgctcgcgctcgatggagacgacgcgagcgccctgcaggtcgtcaccggtcatcacgctgcggatgcgcttcgcgtcgaggtcttcgaccgaggcgagcgaccactgcgagtcatgcgccaccagggtgccgagcagcttcaaccgcagggatgtgttcatggccgtgccgccacccgagggcggcgtctgctccggcgatttgtcgagggtcagtcctgtgagctttgccagacgcttgccttccaatgccgcgcgggggcgtgaggtagcctcggctggcgatgcttgctcatcccgcagcatgtttgaaatgcgtggagtgaatgcgaactccacgagcaggttggtcgtactcgccaggagcagcatggcgagtgcgatgaatgtcgtcgtgacgagccagaagtgcttccggagtggggtggccatggccgagtgcctttgggttcaggagtgacacgcggcccttgagcaagcacgaggccagggcctgagtggggctgcgctcactctggacgccttgcccgcacgggacttccccagccacctctgtcacggacgcgcgacgagtgtgtgactccctgtcacgccacttggcgagtccggacacgttcgagaacgcgcccacgcgggatggtggcaccacgggctctggcacggccaaccgttcggcgagcgccgccaacggtcaggttcgcgacgacgaccaccgccatggcggtgtgggccttcgattggggagattgtgcacggcgcggaagccatggaacaggacaggtgccgcgctaggctccgcgccatcatgtcgagccccaccgagtctgccgtgcaccctcgccgcttccatgccgagtccctggtccacatccatcggcacttgctggcgtcgctccgggcggggcccgtcaccatcgaggtgccagacccggacctgggcaggggttgctaccccggcgagcgggtgggcccgtccggcgcgctgctccatcggcccctgcgcagttggtgcgacctggcggaggggctcgcgtgccggctgctcacgccccgcgcggtggatgcgacgcacatcgcgctgaccttcgagcggctggggcccgaggcgacctggcacgcgggaggccaggcggacgaagcggtgtcactgcaagaacgctatggcgcggcctccgcgttcgcgcgcctgcgcaagctggaggacgcgggcttcttgctgccgtggctcgaagcgcttgggcgcatccggttgccggagtccggccgcgtgctcgacctgggtgtcaaccgcggggatgagctggcggcgttctcgtggctggaggaggccccggatgtgcgcttcgtgggggtggaccacagcgccagcgccatcgaagaggcgcgtgcccgcttccccgatgcgcggcaccgcttcgtcgtcgccgacctcaacgcgctgccggaggacctggggcgcttccacctggtggtgtcggtgggcacactgcagagccctggcgtggatgaccatgccctgctgcgcaggctggtgcaggagcacctggagccgcgctcggcgctgctgctgggcttcccgaattcccgcttccgggatggtgaggtcgtctatggcgcgcgggtgcggaacctgcgcgagcccgacctgtcgctgctggtgaaggacctgtctttctaccgtcgctatctgcaccagcacggcttccgtacgttcctgggcggcaagtacgacctgctcctcaccgcggtgcggggcgcgagtgattgaacacgcgcgtggtccgcgttggctcaggacggccgaggctgaacggctgggctggggacgtggccagcgcgcaccacgaagtcgccaaagccttcaccgggctgacgttcgcgtgcgtagccttcgaacaatggctccagcgcggcgaggatggcgtcctcgtcgatgttctccctgtagaggtgactgaggcgctggcctcgcgcatctccgcccaggtgcaggttgtagcggcccggcgccttgcccacgagtcccacctccgccaggtacggcctcgcgcagccgttggggcacccggtgatgcggagcagcaggttggcgtcctgcaggccatgcgcccgcagccggtcctccagccgtcccacgaaggtaggcaggtagcgctccgcctccgccatggcgagcccgcacgtcggcagcgccacgcacgccagcgcgttgcgacgcaccgggctggcgctgcggaagctgtccagcgcgtgcgccgtcaccagcgcgccgatggcgtcgcgagactagggcgtcacacctgcgatgacgaggttctggttcgccgtgagccggaagtccccaggttgaatccgcgcaatct

SEQ ID NO: 631 - DNA, 6037 bp, Myxococcus xanthus
  unsure (1)..(6037): unsure at all n locations
tccgggacatcacccgccatcaaacaggcggaggcagcgcttcgcgcggaggaagagaagttccggagcctctacaggtacacgcccgcgatgatgcactccatcgacgcggagggccggctggtcagcgtcagcgagttctggctgcgcaccctgggctattcgcgcgaggaggtcctgggccgtcgctccgtggacttctttacgccggagtctcgccggtatgcgaccgagcacgtcctgcccgtgttcttcaagacgggcgtctgcaaggacgtgccgtaccagattgtgaagaagaacggcgaggtgctcgacgtcctcctctccgccatctcggagcgggatgcgtcgggccggatggttcggtcgctggcggtgctgaccgacgtgacggagcgcaagcgcgccgaggacgcgctcgccgagagcgagaagcggctgcgcgccatcctggacaacgccaacgccgtgttcttcatcctcgaccggcaggagcgctacatcttcgtgaaccgcgagtgggagcggctcttccaccgcacgctgcaggaggtcgccgggaagtccactgcggacatcttccccgggccgcaggcggcgcgcttccatgagacgagtcaggctgtcttcaccaccggggagctcgtccagcgggaggagtgcatccccctggaagacggcgttcacacccacctcacgcagaagttcccgctcatcgattcgtcgggcacgctctatgcgctgtgcggtatctccaccgacgtcaccgaactcaagcagatggagctggggcagcgcttcctgtcggaggccagccaggcgctggtgacgtcgctcgactcggagaccacgctccagcgcgtggcggagctgtccgtccccaccctgagggagctgtgcgtcgtctccctgttggggaaggacgcggcgctgcgccccgtggccgtcgccgccagttcgcccgaagggggccgcaccgttcgcgagttcctccagacccatccccccgtctccggtccgcgggatggtccttatggggtgctggagacgggacattcggagtcgtctccggatgccatgggcctgctggacccggatgggctccgagacgaacggtggagcgcggtgcgggcactgagcgctcgggcatccctgaatgtcccgctgcgagcgcggggccccatcctgggcgtgctgtccgttgtcgcggcgcatccgggacgtccgtatggcccacgcgagcgctcattggccgaggaactggggcagcgcgcagcctttgccatcgagaacgccgagctctatcgcaaggcccaggagtccatccgcgctcgcgacgagttcctgtcgattgcctcgcatgagctgaagacgcccgtcacctccatgaagctgcgtgtgcagcaactgactcggaccctgtctcggcaggagtccggacagcttcccgtggagaaggtggccgccctgctggatgtcttcggggaccagctccggcgtctgtcgcacctggtggagcacctgctggacgtgtcgcgcgtcaacgagcgccaggtggacctgcggctcgaggacatggacctggtggcggtggcccgggacgtcacgggccatctgcggggacagatgggccgtgcgggctgcgtgttcgaactggtggcgcccacgcccgtcctggggcgatgggaccggctccggatggagcaggtgatgatcaacctgctgaccaacgcgatgaagtacggcgccggcgagcccatccgcatggaagtgtcacgcgtcggggagggtgcccgcatccgcatccaggaccatggcgtgggcattcccctggaggcgcagccgcgcatcttcgatcgcttcgagcgcgccgcgtcccgcaactacggaggtctggggctggggctcttcatcacccggaggctcgtggaagcgcacggcgggacgattcgcgtcgaaagccagccagggaagggcgccaccttcgtcgtcgaccttcccctggaggctcgctgacccgtgactggaggaggacggaggggcagacttcggccaccgcatgcatccgctcgacgccgaactcgacatcgcccgccgcgtagcccgccaggcgggagccatcctcctggaggtctacgccacgcccttcgccgtccatgacaaggcgggaggcatggggcccgtcaccgaggccgacgagcgcgccaacgccttcatcgtggaagcgctgcgcgacgcatttccttccgacggtgtcgtggccgaggagtccgacaacacctccggcgcgagccgcttcgagcgctgctggttcgtggaccccatggacggcacgcaggagttcgtcaaccgcaacggcgagttcgccatccacatcgggctcgccatcgcggggaaggccacgctgggcgtcgtgtaccggcccgttggagacacgctgtactggggcgtggtggggcagggcggcttcgtggagcacgcgaaggggcgccgcgccctgcgggtgtcggacacggcggagccgtccgcgctgcggctggtggtgtcccgctcacaccgctcgcgcctgacggacgcggtggtccggcggctgggcatcacgcacgagcaggcgtgcggctccgtgggcctcaagtgcggtctgctggcggaggccgcctgcgacctctacctgcacgtcagcgacaagagctatcgctgggacaactgcgcgcccgaagcggttctgcgcgcggcgggcggcatcctcacggacctgggcgggacgccgtacgcctatgacggttcggagctccagaaccgccgcggcctgctggcctgcaacgccgccgccttcgagcacgtggcgcccgtggtggccggattcgcccgcgaggccggcatccttcgctgaggcctcgcggacgccgctcgcgtcaggacgccgtcgtctcgcagcgctggatgatggtgcgcaactgggactgcacgccggagagcatgctgcgcagtcgcgcatggcggagcgagcccgcgagcgcgttggacagggcctggagcacggagacctccgtcggcggccacttgcgctccgtccggcagtcgtcgaagcccacgaagccccaccactcgccgcccacggtgatggggcagaccagcagtgaccggatgtcctgggcctccagcagctcccgagcgggcgacgggaaggcacggggcggtccctggacggccttgcccgacgacagcggcgcgacccaggagggcatgacctccgagtaggggacgttctggagctcggggttgtccaactgcgcggaggccgcggccgcggtccactcgtagcgctggttgcacagcagctcgcccgtggggctggtggcgttctcgaagatgtagacgcggtcgacgtcgagcgcgacgcctacctggcccagggcctccgagactgtcgcggtctcgaagccgcgctccaggagtagctgcgatacgttcatgattgctgcgaatgccttcgaggccatggggtctgctccaggtgggggcgcctgttgcgatgcaggtccgggggaacctggcgggcagcgttgcatgcgggcgcacccatgggtcaaggcacggtgcgcgaggcaccgcgaactcgtaccgggagtcgtcagccctgctccacggcgcgtcgcagctcggcgaaaaggcggcccagcgcgtcgagttggtagtgcgcgttgagcccgctgggattgggcagcacccacaagcgcgtgtcgcccaggcgctccggttgcgtgcccagcgcggccttgggacggccaaaggcgatgcggtaggcgctcacgcccagcaccgcgaggaagcggggctggtagcgcgccaccttggcttccagcgccttcgcgccccgggccagctcggcggggttcagcaggtccgcggtggcggtggcgcggtccaccacgttggtgatgccgtagcccagcgcgagcaaggcctcctgctccgtgggttggaaagtgtgcggagtgatgcccgcggcatgcagcgtgggccagaagcgattgccgggccgcgcgaagtgatagcccaccaccgcggagtagaggctggggttgatgccgcagaagagcacgcgcagccggggcgcgatgacgtccggcatggtgcgaccggcggctgcgtccagctcatctcgcgaggggcgacggagcggtgtcatgggggcgcatcttcgcgagcctacctgggaaggcaaccccccagggccccatgcacggggtggggtgttgcccgtgggacggagcggcgtgggcgctcggatggctggcgaatacgcgcggggtggggcaggctcggccccttcgcgccgacgcaacccaggaggcccttcgcgatgccgcacatcgtcaccctgacgctcaacccgaccatcgacgtggctacgtccgtgccggaagtcacgccggagcacaagctgcgctgtggccccgtgcgcagggacccgggtgggggcggcatcaacgtggcgcgcgtggtgcgtgagctgggcggtgaggccatcgccgtctacacgcggggcggggccaccgggagccagttggaggagctcctggaggagaagggcctgctgcgccgctccgtgccgttgcaggacgccacccgggagagcttcacggtggcggaaggcacgggcgcgcgtgagtatcgcttcatcctgccagggcccacgctgtccgagcgcgagtggcagcgctgcctcgacgcactggaggacgtggccgtgggcgcgacctacatcgtcgccagcggcagcctggcgcccggcgtaccggaggacttctatgcccgtgtggcccggctggggaagcgcctggccgtgcgcgtggtggtggacaccaacggtccgccgctgcgggccgcgctggaagagggcgtgttcatggccaagcccaaccgccgcgagctgcgggacctgagcggcgcgtcggtggaagacttcgccacccaggccgccgcggcgcgcgagctggtggcccagggccgcgccgaagtgctggcggtgtccatgggcgcggacggcgcgctggtgacgacgcgcaccgcccagttccgggcgacgccgcccccggtgcggacgtacagctcggtgggcgcgggggacagctttgtcgcggggatgacgcttgcgctcgcgcggggccagtccaccgaggacgcgctgcgctggggcatcgcctccgggacggccgcgctgctcacccaggggacggacctgtgttaccgggcggacgtggagcggctcttcacccaggtgaaggcggagccggtgtcgcgtccgtaggcaccccgcccgcagagggaaggagggcttgccccttccattcccaggagtggcggcggcgaggccgaattcggggtgcgaggtggtggcggcgcgaacatgttgccggtgtacgagcgggctttcggggcgagggcccgcgttccacgcttcccaggtgacacgcatgaagcatccactccgccatgtctggggccggctcctcctggccggtgccctgacgacgggactgctggcctgccagggccgacaagggctgcgcagcgaggattcggagaaggtgacggtgttgcggggcgtgcgggtcatcgacgggcgcggcggtgctccgctggagaacgccgccgtcgtcatccagggcacgacgcttcagcgcgtggggccggtggatgaagtggaagtgcccgcctcggccacggtcatcgagctgccgggacggacggtgctccccggtctcatctccaaccactcccacctgngaatgacgcgaggcacggattcgggtgggcagaactaccagcgcgacaacatcgcgcggcagctcacgcagtgggagtcctacggcgtgacgacggtgacgtcgctgggtctcaacacgccgctcatctacgaactccagaaggaggtcgagcagggcacgctgccgggcgcatccatcctcagcggggacccaggcatcggcgtgccggaaggggcgccgccgatgaaggtcgtcgagca

SEQ ID NO: 632 - DNA, 3609 bp, Myxococcus xanthus
cgatgttctcgaccgtcgcgacatccagcccgtcccgctcgagccgcagctcattcgcgatggcagagcggacctgctcggcggtgattttggggtcgttggcgcgaagctcacgcgcgaagcccagccacttggaccgctccggtccacgcggccaccggtcgccctggaagatttcccggaaggcctcgtcgacgcagcgcgccatgcgctcatcggtcagcaggcccagcagggaggggagaacctccctcgcatgggccgcctgctgcatcgcgttggaagggcccagggactcgatgttgtagtggcgggcagcagcgaccggcgcggcacgctgggccggaatcaccgagccgagcaggtccacgaacgcgcgggcggagttcatgtccgccacggtccggaccttggacgcggagacagaaggcagacgctcaccaatgctcgtcacgaatcccccgggcgaatgcgttctcattgcctccggtggattaagaggccgggccggggggcgataggccctctctcaagaaaaggcatcttccggagcggccccctcctacgtggacttcctggtgaaggcattcaggcgccaggaccgggctcggaagcgctcagcgggttggccgcatcgaaccgacggacaggcgccttcagtcacagtacctgtacatcgtccccaatgagcatcccgggcgcttgccggttcccttgcagtacggtccgtccttcatcgccttgtccttggcgatgacagcctgcaggctgtctccctgggtccagtagaggcactcgtacaccggccccgccatcgggcaacagccgcagccacaggcttcatacgtatcgccgacatcgggcggagcgccctgtgccgtaatggggtgaggcattggggcgttacaccccaccgtgaacgccagtagcactcgcaacgcacgcatgtggggacaataggggtcaccacgcgggcgtgcccatccgccagttgcctgacagctgctttgcgagtgtcacacccatccggtatggaacgcgcatgactcgcccgacctcatcgacggacttcgatccacacctggccccgctcctcccgccgctgaaggggtatctgcccttgcagatgacgttggagcagctcgagcacttccgccggttgagccacgtgacccgggacacgctgattggcgacgcgcaggtcagctgcgttgactacagcatccccgggtaccagggcgccgaaatcgtggtctcggtcattgcccggcaaggccactcggttcccggtcccgccgtctatcacatccatggcggcggcatggtgatgggcacccgcttcgcgggggcgaagccgctcgtggagtgggcgctccgccatgatgcggtctgcgtcaccgtcgagtaccggctggcgcccgagcatccagcgcccaccctggtggaggactgctacgccggcctggcgtggatggcggcgcacgcggacatgctccggtttgatccgaatcagctggtcatcttcgccggaaccgccgccgaaggcctcccggcggccaccacgcttttggctcgggaccgccagggccctcggctgctgggccaacttctgcaatgcccgatgctggatgaccggaacgagacggaatccgcgcaccgatacgatggcgtccgcgtctgggaccgcaccagcaatctgaccgcatggagagccgtgctgggagacctttgtggaggccccgaggtgtctccgtattccgcacccgcgcgagcatcggacttgagcggactgccgcccaccttcatcgacgtcggaggagcggagacgtttcgagatgaagctgtcgcctatgcccgcggaatcctggcggcgggtggggagtgcgagctgcacgtctggggcggagccttccatggcttctatgacatcgcgccgcagtccgacctggcgcgcgcatgcatcgcggcacgcgacgcgtggattgcacggatgttcgcccgcggcgccatgagcccgtgccctccgtaatgaaaatgaagttggctcaacgggctgctggcgggccgtgtatccgagacacctgccactccgtcatcgtcgcgctacgtctcccctcttgcttccaggaattcccccatgttccatgcgcaccgcgtcccccgtatcctggtcttcgccctgctcccggtcctctccgcctgttcctcttccgaatgcacggagaaccgcgactgcgcgtcccgtggaccggacatcgtctgcgtggaggagacttgcgttcaggcctccctgcccgactcgggaaccgtcgacgcgggcctcgaagactctggggtggacgcgggttcggcggagccaggctcggatgacggtggcgtggacgcaggctcgggcgatgccggcgctccggactcgggcacggatgccgggagttccgcgccggaggcttcgctgcgcatcacggagatcaacccgtacgttcagcaggaactcatcgagctggtggccgtcactggtggttcgctgacgggcatctccctcaaggagctcaccaactccgatttcaccttcactttccctcagggctacacggtggagacgggcgcggtgttggtcctccaccttcgcggcacctgcacggatgcccctgggaacccggcctcctgtggccaggccgccccattcaccgccggggcatgggacttcagcatgccgggctcgctgagctactccggcaaggtcttcgaactcttcgcgtcggatggcacccccattgacggcgttccattcgtccgagcctccggggagatgccgtccaacatcgtcgccgcggtccagcgcctgcaggcagaccgggtctgggacccgacgccttgtgtgcatgacctccagacagggttcgcccgtgaccggtactgccgcaacatcgctgtggactggtccaacatgaacgcggacgcaaacgtcatgcgcatcgccggggactcgccgctgacgacgcccgggactcggacgcagtggagcagcccactgccttcacgctggggcacctactagcgaggtcggctccggacgccgcaaggagagagcatgtcgcggcactgacgctcgtattccagctcgccgccagtctggcgcccgcgctcggcatcgtggcagtggccgcgcttgcccttctccttctgcccgccgtgccaggcaccgcccgctaaaagagaagcgatggccttgccccccgcgctaccagtctcttcgggcgtccaggcggcggctgactccgcgtgagccccccatggccattgcatagagggcgactggggccccatggcggacgaactggtctgttcgtttcgccagcgcatcctcagcaggggaagaagcgcatggggtagcgcgtctcgccttcggaggcccccgcgtgcggcgtggggccccagttgcaacacccgctcacccagggagcgacggccgccaggtgacgcatgggcctcctgtcaggcgccctcatgccggcgagacgggggccggtgcgttgcccttgagcaaggccagcagtccggcgagcagcccgaccccaggcgagcctccaaggagcgctgcccccagga

SEQ ID NO: 633 - DNA, 4231 bp, Myxococcus xanthus
cgcccaacggtgagcacatcgaccagatgaaggcgctggtggaggggctgaagaagaaccccgactcgcgccgccacatcatcagcgcgtggaacgtggcggacctgccgtccatgaagctgccgccctgccacgtcctcttccagttctacgtggccaacgggcggctgtcctgccagctctatcagcgcagcgcggacctcttcctggggctgcccttcaacatcgcctcctactcgctgctgacgatgatggtggcgcaggtgacgggcctgcaggcgcacgagttcatccacaccgtgggcgacgcgcacctgtacctgaaccacgtcgagcaggcgaagacgcagctgtcgcgcgaaccgcgccccctgcctcgcatacacatcaaccccgaggtgacggacctcttcgccttcaagtacgaggacttcacgctcgaaggctacgacccgcaccccgccatcaaggcgcccgtggccgtatgaaactgtccgccatcgtcgccatggcggcgaaccgtgtcatcggcgcgggcaaccagctcccgtggcggctgcccgcggacctcgcgcgcttcaagcgcatcaccatgggccacaccctggtgatggggcgcaagacgtacgagtccatcggccgcccgctgccgggccgcaccttcatcgtcgtcacccgccagcgtgacttcgcgcccccgggcgtccaggtggcgcactccgtggacgaagcgctctccctggcaaaggccagtggcgactcggaggtcttcatcgccggaggcgcggacctctacgcccagacgatggaccgcgtgcagcgcatctacctcacgcacatcgcccggaacttccctggcgacacctggttccccgacgtggacctgtccggttggacatgcgtcgaagagcaagcacatcccgacgccgagccaccccacaccttcctcacctacgagcgctgacgccctcttcgcccggcggcgtctacatgcatgcccgggcgagggcgcgcgcccacattccttccttcaaacgttaagcgcacaatccagacctcacccgtcagtcccatggagttccggatgcacaagacgtggatgcgaggacttggattggttgcggcggtggtgatgatggcctgtggcggccccgtggaagaggctcccgtggacgaaacgggcagcgccgcgcaggagctgcgccggtgtgacctgcaggggcgctgtgccgccaacgaggtctgcgtgggcggccccgatggcatctgctacccgtgcaaccgctacccgcagtactgcgaaatcatcatcgagaactagcgcgaaggtgaagcacgaggcgcccggccatccatccggccgggggcctcccatcccgccgcgtggcacctcctgacgccatgcacacttccacgggatgcagaccaccctcctctctcgtcccatcgacgtgccgtggcggaccgcggccctttccagcgccgccgtgctcacggcttccaacgtggccgcgctcgtggccagcctccggcttgctcccttgctgcgtcaccggctcaggccccggccccgcgccctgcccgcactggccgttggagccaccgcgctgggagcgctcgccatcggcgcgctcagcatcggcaccctggccatccgagcgctgaccattggcaagctgcggggtgatgactggcaggtggattcactccgcgtcggctcgctccaggtcgtcgagacgattggacccacgggcagttctggtgtgggcgcgacctgagttcggcagattttgaagttgcttcgcaagattgaaaggccaccaccccactggtagaggggtggcatgactcgcgccgcctcgctgctgctgttcctcctgcttgccttgcctatcgcgtcccgcgcggacgacggcgcctccgaggaacgcacgtggcaccggctcatcggcatcctccagtacctggaggcggactatccgctcgccatcgagtcgcagtccgcgttcgagctggcggagcagaagagcttcgcggcggaggcggtggacgcggcgcgcggcctgggccccgcggcagcggccttcctgccgcgcgtgcaggacatccaggcccgcgtggacaagggcgaggaccctgacggcgtcagccgcgagtgcggtgagctggtggagaacctcgtcaccgccggagggttggcccgcagcccacgccgcccgccggacctggcgctgggccagtcgctgttcgccaccaactgcgccgcgtgccatggcgccgacggcagcgcgaacgtggccatcgccgccaacatggagccggcgcccgccaacttccaggacgcggagctgatggaaggcctcacgccgtacaaggccttcaacaccaccagcttcggcgtgcccggcaccgcgatgccggcctaccccaccctgtccgaggaggagcgctggtcgctggccttctacgtcttcaccatgcgcctgcccgagtgcgagggcacgccgccgcgcgtctccctggagcggctggccaacgccaccgacgcggatctggtgaaggagttcggtcaggagaacctcgcctgtctgcgccggaagatgctggacgcggacgaggagcgctcgctgctcgccgcccgggagaacgtgcagcaggccatgcgcctgggcgccgcaggtgacatcgcgggcgcgaaggcggccctgctggacggctacctcaacggcgtggagccggtggagcccaagctcagcgcgcgcgactcggcgctgacgctgaaaatcgagcagggcttcctcaaggcccggatggcggcggagcgcggcagcccgcaccttcaagacgagggccgggagctgctggccctgctggaccaggcgcggcgtgactcgggcaccaccgcgagcctgctgtccacgatgtggctgacgctgctcatcctgctgcgcgagggcttcgaggcgaccatcatcgtcgcggcgctgctggccgcgctgcgaaagatgaaggccaccgagcacgcccgcgtggtgcatttcggatggatttccgcgctcatcgtcggagcgctgtcctacgtgctcggccgccacctgctggccggcgcccagcgcgagtggatggaaggcatcgccgcgctcgcggcggtgggcatgcttgtgtacgcggcgctgtggctcaacgcccgctccaacatcagccagttcatgggcgagctgcgcgagaagatgcagggcgcgctgggccgaggcagcatgctgggcctgttcctcatcgccttcaccgccgttctgcgtgagagcttcgagacggccatcttcctccaggggctcgcgctggactcgccacagggcgtggcctggggcgcgctcgcgggcgcggtggccatggtggtgatggtcctcttcatcaaccggctggggtaccgcctgccgatgaagacgctcttcaacgcgtccaccgtcatcctggtcctcaccgccgtgatgctgctgggcaagggcctccactcgctgcaggaagtcggcgcgctgccgctcgcgcccgtgcccttcatcaccgtggacatgctgggcatctatccggacgcgctctcgctcgctccccagctcctgctgggcggcatcccgctggccatcgtgctgctgcgccgcaagggccgcccccagcctgtttccgaggcctccgctggttagggcgacgcgcgcccgtcgttgcggtagcgtgtcccaggtgaaggtttcacgagcccactccatcgggttggccatgctggtcctctcgggccagaacgccgcttgggcgcaggagctccccgcgagcgaacccgcccgggcacccgcctccgagctgacgccgccgcccctggttccagccccgggcggctgggacgcgccgacacgccacgacgaagacgccggggacgactcccgcacgagccaggagacggagggcacgacctccgtcaatgaacaggcccttcctggcaaggcccgcgcccgcgccacggaccccgtgccacgggtggcggtggagttcctgggtggcgccggtggcggcatcatcgcgggctccctgggcctcatcacgggcttcttcgtgggtgcgtccacggtgggctgcgacgagtgcggcatcgtcgcgagcgtcggtggattgacgggtgtcgtggtgggaatcccggccgggacatggctgggtggaaagctcatgggcgggcggggcacct

SEQ ID NO: 634 - DNA, 3815 bp, Myxococcus xanthus
ctaaagcttcgccaccggctgcttcgccacttctcccgctgcgctgtccaggcacacgactcgcgcggcgctgggcggaagcaccgtcttccacttctcgtgcgtcagcagtaccgacgccccggtgtcctccagcatccaccccagtcgctccttcgggtacgccgggtccaccggcacgtaggccgcgcccgccttcagcacgcccagcagcgccaccaccatgtccaccgagcgctccaggcacacgcccaccagcgactctggtgccacccccagccccctcaggtggtgcgccacctggttggccttcgcgtccagctcccggtacgtcagccgctccgactcgaacgccaccgccaccgcgtccggcgtgcgcgccacctgcgcttccatcagcgcgtggatgctcgcctcggaagcgggcgccatctcacgtccctggaagcccttcagtacctggcggcgctcgtcctccgagaggatggcgacacgttgcagcggcaggtccggcgtgacgatgacggcccgggcaagttcaatcagatggcccgcgagcctctgcacggtgccgccatcgaagaggctcgacgcgtactcgaaacggcagaacagggtgttcttgcgctcgacgatttccaggctcaggtcgaacttggaggtatccgcctcgatgccgagctggctcaacttcagcgattgatgcgccacgtccacggtgggcgtgttgaccacgttgaggacggcttggaacacgggcgtgcggctctggtcacgcggcaactggagcgcttcgatgatgcgctcgaagggcgcgtcctgatgcgcgaacgcatccagtgactggctcttcactcggcccagcaactcccggaacgacggtgccccctccaaccgcgagcgcagcgcgagcgtgttcacgaagcaacccagcagtccctccacctctggccgggaacgaccggccgtggggatgcccaccgcgaagtcctcctggcccgccgtgcgccccagcagcgcctggaacagcgccatgagcaccatgaacgacgtggcgccctcgcgccgcccgaaggcgaggaggggctccgagacatcggagggcagctcgaagcggaagctgccgcccgcgtaggactgcaccgcgggccgaggccggtccgtgggcagctcgagcgcggggacggatgtgagccgctccttccaccaccgaacctgctcctccatcaccgcgccttccagccactggcgctgccacaccgcgtagtcggcgtactgcacctccagcggcggaagcggcgacgggatgcccgcgctgaagcaggcgtagagcaccgacagctcgcggcccagcaccagggtgcaccaggcgtcggagatgacgtggtgctgcatcaggctcaggacgtgctcctccagtcccatccggagcagcaccgcgcgcgccaccggccccttgtccaggtcgaacggaagcgctccgagcgccgcgcaccgccgcagcatctccgcttcacgcgcttccggcgtctcgccggggacatcctccaccggcatcggcagcgagccctccgcgtggatgagctggaccgcgccttcttccgtgagctggtaggtggtgcggaggacttcgtgccgctgcaccacctcgttgagcgcagcctggagcgcctcgacgttcagcggaccagtgaggcggaaactggatccgttgttgtacgccgtactgctcgggtcgagctgctggaggtaccagagccgctgctgcgcgaaggacaggggcagcggccgggtccggggcacgcggggaatcgccgagtgctcgggttgcagcgctggcacggaaggcgccttgggcttgggcttctgcgcggccacgggggcctgcaccttgggcgcggcggggagggtgacgtgctccacgcggccgtccacgcggagccgcgcgtgccgtccggtccggaagagccgggccgagctgctcgacgggtgctgcacgaagcggcggcgctcctgctcgttggcgcgccacaagtcccagggaaggcccgcgccctccagggccagctcacccacgacgcctgggggaaccggcaatccggccgcgtccagcacccaggactggagcccttcggggacacgctccgagggaggccgaggcagcaggcctccctcgccagcggcgcccgcgagcaggacctccgttcccaggttccggtgcagcgacaaggccagctccgcggaggcgccgtccaggacgagcgcgcccacgggctccagggcctcgcgggcctgcggcaactccaccagcgtgcgcgcgagccgcgccgaggcatgcaacaggacggcgcccgactgccgggccagcgccagcagctcgtcgaccgccagcgttccctccgcctgccgctggaccttccgctgcgaggcgtcctgcaccaggcgctcgcgaatcacggtcagccggcgcagtccctccagcaccactggcgtgtccaggccgaagtcgatgaggcaggccacctcgtccacgtcggcttcccggacgtggagcaggcgttgcacgccgctctccaccgtgccgatgaggccggtgcccttcgcgtggtgctcgaaggtgtgttcgagcagggcattcacgtcctcctcggacaccttgtcgatttcgccctggtagccctgcgcggccagcagcgtggcggtgatctccgccgagctccggaagtagctgagcagcggcttgcggaccgtgcgcagcacctcctgttcatcgtcgccgatgaacgcgtgcagcatcagcgcgacgtgccctcggcccgggtgcccgttgcggcgccaggcttcgcggtagagggccaccttctgcttcagctcctccaaggactgcgtgagcaatccggtgagcacgccagcgcccacctcgccagccaggcggaacgtctccgggctgccggcggccgtgagccacacgggcagctccttctggacgggcttgggccgcaggcccacctccaccgtgacgccgccgccacccggacggcggagcttctcgcctcgccagagggcgcggaccgtctccaggttccgcaggaggacgttgcggcggtcctcgaagttctgcggggcgaaggtgaagtccgccacgtgccagcccgtcgcaatcgacagacccgcgcggcctccggagaggttgtccaccacggaccactgctcggcgacttgcagcgggtcatgcagcgggaggacgacgctgcccgagcgcaggctcaggttgcgggtgatggtggccagcgcgcccgccaccaccgccggctggggatagaggccgccgaacgagtggaagtgccgctccggtgtccacaccgccgagaagccgttggcatccgcgtacttcgcgccttcaatcagcagctcgtacttcgggccgacgagcgagtcttcatcgttggcgaagtagatgaggctcaggtccatcgctccctggcgcggaccgccgccctggagcacttcccactgagccgtcacctgctcggaggggaacgtcacggtcagtccacgagacagggcccacagggcctccagctcaggacgctccgccgaggactccgcggcggccacccacgtggcgccctccgaggggcgcagccgcatgtcgagcgcgtcgaagagctcggtgagcccctggtgcaccagggcccacggcgactggttggcgcccacgggcagaagccacgccagcgcttccggggctggggccggacgctccgccagggcaccggaagactccagcgcatcctccacatggagcagccgcg

SEQ ID NO: 635 - DNA, 4992 bp, Myxococcus xanthus
gcgcagggccttgaggaaggcggcgtctcccaccagcttccgcgaggcgtggtgcagcaggggcgccttgccgtagacgagcgcgccgtactccatctcatccgcgaagtggcccgtgggccggtccgcgcggccgtccttcccacccgtcatccggtacaggtggtactgccccaccagcgtctcctggcgcaccgactccgccaccttcttgccgtgcttccattccaggtagaggagcgcggcgtactgggccagcgactcgtccaccaccggctccaggatggggtccgagcccacgagccccgcgaagtactggtgcgccacctcgtgcgccacggtgaactccagcgtgcgctccatggcgccgttgagctgccccagcacccctcccccgcccccgctctgccccagcatgcccagcatcgcctccaggtcctccatgccctgcatgctaccgcccagcatctcggaggcccccgccgcgccgcgatacagttgcgtcgcgatggtgaccagccccgggaactccatgccgcccgcgcctcccgacagcggcgcctgcaccacgcggaagtgcgtgtacggcagcggccccagacggcgctcgaactccgccagcatcgacgtggcgtacttcaacacgcgctcgcccgcggcctggtccgccgcggcgtagtggctctccaccgtgacgccattcaccgtggcggtggagctggcgtagccccgcgacacgaagaggggaaagtcgcgcaccgccgcggcggcgaaggcgtagcgcacccgcccatcccgctccgggacctcgcccatgggcacgcccgtggcgtgcaccgcccagcccgtgggcacggtgacggtggccaacacgtgcgccggctcatagaggcccaggtcgccaatcccctgcggcccatcccagggctggccgttctcgcccaccggcggaacctggggcaccacgcccaccaggctgatgaaatccgccgtggcggagaaggccccgtggtccccgccggagggacgcccgtccccaccgcccatcaaaccgccgaggaggcctcccgcaccgccgcccgagggcgcggcggcgcgcggcaccaggccctccaccgcgacgtccagcaccgcagcggcgcccggcggcacgggctcggactccagggacaggcggtacagcgtgggctccggccgctccagtttgacgggccggcctcccagcttcgcgtccgacagcgtcacccggcggccctgcgcgttgggcgtcagccgcaggtacaactcggtgagcggatgcttccgggccagcacctccacctgcacccggcccttcaccccacgggtctccgggtccacctccagttgcacgcggtagagcggcagctcctccaagggccccagcgccttcgcggcccgctcacgctcggcgggcttcaggtgctggaggcacagttgcacctcgggagaaaccaggggttccgcgggcgcactgccccacgctggcgccccagagagcacacaccacagcaggcacccatggaggaaggtccgcatgcggccatgctaattgacccggggcacccctgctcatctaccctggacctcccatgcattctcgaacgctcgtcatggccgccaccctggggctgatggcctgtgcgcggcaggtgcccgcctcggctacgcccacctccacctcgaccgagccccgtgccgttcggctcctgctggacacgcccgcccgggagacacacacgctgaccaggctgcgcgaagacatcgaggtggacgccaccgaaggcgagcgcacgccgcgcgtcgtcgccaccggccagacgcccacgctgagcctcgacggacaccgggcccgcctctacggcgacgcgaagggcacgctcggcatcgccgtggacaacttcctgctgctggaggtgctggacgccagtgggcaggtgacccggcgcgccacggtgggcttcaccgaggcggtccacatgggccgggagcaggtggacagcgtgggccgccgcgccttcaacttcgaggcgggcgaagtggacatcacccacctgctgcccgactccgcccccttccaggtccgcgcgaccgcgctggacacctggggcgtgggacgggtgagcgacgtgtacctgctgctcgccccgggcagccgcgccgacaacgacgacctgcgcgaccagtagaaccgtggcgccgtcccgcccacgtcgagggcgggacgattcacgaccgcctcagaagcggatcgcgccggcgggaggaggagcctgaagccgcacacctccaccgcgcaccgagcggatgccacccagcacggcgtcacagttggcgggcctgcacacatcatcggggctcagcgggctggcgccaccaccctgtgtcgccatcaccgcgcccaccgtgccggcggcgaccaccgcgccaatgccagcccacacgtaccagcggccgtaccacggcttggagccctccacctcgggcgtctccgggtcccctgcgaacgacaggcccggggccgtctcgtcgtcggggtccagcttcgaggacggctccaacaccgggttcttcggcacgtcggcggtggccacggacgtgtccagcaggggccgcaggttgcccgtcacctcgtacgtccggcccgcgaacacggtgatgttgtgcacgtccggcttgaagcccggggcccggaactcaatctcacgcgaacccgggcgcagcaacacgttggcctgcggcacggcgcccacctgctgcccgtccaccatcaccaccgcgtccgccacgtccgccgtcagcgtgggcgaagcccatggtggcgtccatggacaccagcacctccgcctgcgtgcccgacttcacgtcgatgcgccgtgtgaagtcggcgtaaccctgccggcgcaccaccaggtggtgctcgcccggacggacctccaccggcacggtggccgatgagaggacgccgaactccttcccatccacgaacagcttcgcgccgcgcacgttgcccgtcatccggacgagcacctccgtcttcacgggcgtcaacggcgccagcagcaggtcgtcctcggccgcgggcttcttgcttcccttcgggggcgccttcgcgcgcgcgggcttcttggcgggcttcttcttgaccaccttgggcttgcccgtcttgggcttcgacggcgcggtgagcggcgccaggaagtcatcctgcgcgagcgcggccgaaggggcggccaggacagtcaccagggcgaagacgacgatgcggtggaggctcatgacgaaccgaaggttagagagtcatcccaagggaatcaaacagagtcccagggccttgcggattgggagagtatccgcaccccatgcaccgcgccctgcccacactggccctccacctcagtgtcctctccctcaccgcgtgctccgcgaaggcgccgccccggacggagcccgtgccgccccctccacccgcggtgaagattcccgccagctgtgagcagaaccagggcggcgagtaccaccacgcggggaatccagccttccggtactacggcgacgatgacggcagcacactctcactcgccgtcgtccgcgcacatgactcggcagcggtggacgccccggacgcgggctcgccgtccatcgtcctgcggcgcacccccgcgggcttcgtgggcgaaacgcgtgccaccggcttctccggcgcggggacgccctgccccgtcacctttccgacagaggtggtgcggtgcacggacgcgggcctgacgctgcgctcggcggccagcacctccatcgacgaggactgccgcacggctccgtcgggcgcccccagcgtgcggctggagcaggtgctgctgcggggcccgccggacgcgggcacttcgccggacgccggcacctagaaacgcgaaaggggtgaggcggcgcggtgccagcctcacccccggccttcccgaaggaaggatgccgctcaggccgcgcggcggggctgctcgtcggcggcgtccaccgcgggggtggactccaccagcttcatccggccggacagtccctgcaggaggctggagctgcccacgtacaggaagcccgccaggaacaggacgatgaagggcaccgacgtgtagatgcgcgcgtcgatggcgaaccacagcgcgccggtgaagtacgcggcgaacagcagctccaccagcggtagcagcgacttgctgccccggtacgccttcttgacggtgacggccttcttgccctcggcgcccgtcttcggcgtgcgcgcgaagcccgactgctggttgagcagcgcctcggccaccgccttggcgttgctgatggccatgccgatgcccaggctcatgaggaacggcaggtacttcacccgctcccaccccttcgcgccgcgctcacgctgcgccgccacgtagaagaagcagacgctggcggtggccgtgaggaagaagggcaggtccaggaacagcgtgccgtagaggccgtgctggaagcgcaccaccatgctgatgggcatcagcaccgacagcagcaccatcaacaggtacgccatgttgttggtgaggtggaagaacgcctcgcgcttcaccaccagcggcaggtcgctcttgagaatggtgggcagcagcttcttcgccgtctggatggagcccttggcccagcggtgctgctggctcttgaaggcgttcatgtccaccggcacctcggccggggagatgacctcgggcaggaacacgaactgccagcccttcaactgggcgcggtagctcaggtccaggtcctcggtgagcgtgtcgtgctgccagccgcccgcgtcggaaatcgtgtcacggcgccagatgccggcggtgccgttgaagttgaagaagcagcccgcgcggttgcgcgcggtgtgctcgatgatgaagtgcccatccaggaagatgctctgggcctgcgtcaacagcgagaactcacggttcaggtggc

SEQ ID NO: 636 - DNA, 3092 bp, Myxococcus xanthus
catccgcgccccaggggcgctggattggcggcatcgtccatccggcgaacgccgccgagaaacgcgaaggcgcgctgtggctcggctacctctccgtgcccgacgtggaccgcgctgtcaccgaagtaagcgcgcgcggcggcaaggcgctcgacggccccatcgacgtgcggaacatcggccgggccgcggtggtcgccgacccgcagggcgcggcggtgggcttcgtgcgctcccggcccggagatccggccgatacgggcgtgccggatgagggccagttcttgtggatggagtacctggcccaggaccccgtcgccgcggcggacttctacaaggagctcctgggctacgaggtccgagatcgtccactcggcggcgggccccactacgtcctcgcccagggacagcatccccgaggcggcgtgctggccaacccggtgaaaggcgcgcgccccaactggctcacctatgtccgcgtgaaggaccccgcgacgctcgcttcacgggcccaggccctggggggccgcgtgctgatggccccgcgcccggacgcacggggtggctcgctcgcgctcatcgccgacccgagcggcgcggtgctcgcgctccagcgctaccccttcgaaacgtccaagtccgcaacggcgccgtgatgcgccaccctcgaggagaaccccacgtgcaactgcgtcgacacccttccccccgctcgctgtcctggaccgtcctgatggccggtgccctcctcacgtccggatgcacggaccagcccgcgggcgtcggactcggcttcaccacgccgtcgccctggaacgccacacctcagatggagatcacgaccacctggaacggcggaccgatgtactgggcgccctgagcgcggccgcttcctcgccgcgcgcatggactgcggggcatgacgcgcgacgagcagatcatccaggaatgtcttcgtgccgcggtcgaagggccgttcttccctgactgggagttcccggccctgttcggattcgaccgagcgaaggccgccatcctcgcgtcatggcccgtgtgggatgatggcaaggcgcagagccgcgccatcaacaacacgctgaacaacctgctcggctacccgcacaagaaatgggccctgtggccccagtacatctcggcctcgcccgaagaggtcaaggccgtcttcgcacgatggcgcaagccccccctgggaggactgagtgccatcgctcgacgaaggggagaatgcctccccggaggcgggcggcggacctcaccaccgcgcctccgaggagacggcgcatcacgcctgcggggcgtgcacgccgttggacagctcgttgcggacgacctcggacacgcgctcgcggaccatctcgcccacgcgctcgcggacgtcggcgctcacgctctcacgcaccgcgctcgcgatgcgctcggggtcgacggaaccaccgccctgctgcatcggcatcatggacggaccggcgcgcatcgcctcaccgagcgcggaccggacggcctcggggagctgcgagcgaagcgccgagtccagctccgagcgcatgctgctcatgaaccgctcacgcagggagtccgccaaccgcgtgcggatggcgtccgccaggcgctccacgtcctgcatcccctgccccatcatcatgccctgcggcatcatcccgccctgccccatcatgccccggtgacgggccatggcgccgcgcagcatctcgcccatgcgctcccgcagcacctcgcgtacgcgctcgcggaccgccgagttgatgcgctcacggaggccctcggacagccggtcctgcagggtcatcgcgatgcgctcggggtcgaacgcgccggcggccatgccgccccactggcgcgtcatgacgccacggagcccgtcggacagccgctcgcgcagggcctcgcgcacgcgctcacgcaggctgtacaccagtccctcgtggagggcctcggccaggcgcccgcgaatggcgtccgccagccgctccgcctcgtgggggctgaagccgggcatgcgctccgacatcaccgagcgcagcgtgtccgccagccgctcgcgcagggcctcgcgcacgccgtcatgcgcggcggtgttgatgcgctcgcgcagggactccagcaggcgggtgcgcaccgcctccgccagccgctcggtatccggggcgccgaagccgtgggaggacatctgccactgctcgaacagcgccgcgcgcacgcactcggccagccgctcgcggatgccgtcgcggatgcgctcatgcaccacggaggcgatgcgctcgcgcagcgtctccgacaggcgggaacaaagcgcgtccgcgatgcgctccggctccggcatgccgtagccctggggcatcatcccatacccctgcggcatcccaccgccgcgctcgaacatcgcgtggcggatggcctcccccacgcgctcacgcacctcgcggccgagccggtcctcaatcgcggagacaatctgctcgcgaacggcttcgacgacccgctccttgaacgactcaccgaacatctgctgcgactggggagaaagctgctcctggaacatgagaacgctcctgactcgacgcctggactgcgaggaaacacggcaggagaaaacccctctcctgccgggcgcgattcaataaacaggcacgcattcagggtaaacgtgtcgtcggtgtgaggccccgttggcagccagacaccggcggcgcggcacaggccaatccttcctcggccgcatgcggaacgcgacgaaggcatccacgttgtcgaaggcgaagcacgggttcttccgccgcaccgtctccatggaggccatcgggacgcccgcgtagtcgtggcccggaaacagcttcgcgctatcgggcaccttcgccagcacctgggacagggagcggtacatgtcctccgggttgcctccgctcatgtcacaccggccgcagccattgatgaacacggtgtccccggacaccagcgcgtcaccggccagcaggtaatgcgagcccggcgtgtgcagtgcctggaacgtctcaggcccgacgcgcacgtcatcctccggccccaggggc

SEQ ID NO: 637 - DNA, 3096 bp, Myxococcus xanthus
tctacagacgcgggctatctcgatgatgccaagagcgtcgccgtgggccccgacggcggcgtctacctcgctggcgagacgttcggcagcctcgacggcaacgccaacaatggcaccgtcgacgtgctcctcgcccgctacgacaacgccggaaaccgccagtggagccgcatgctcggtggcgcgcagaccgactacgcgttcggcgtctccgtcaccacgagcaacgtcgtgcagctcgtcggctacacctgcgacgcgctcgacggcaacccgcccgctggctcccttgacgccttcctcacccgctacgacgcgcttggcaccaagctgggcacccgcaccctgggcaccccgttccaagacatcgcgcgcggcgtggccgtggactccgctggcaacgcctacgtggccggtaacaccttcggaggcctcggcggcaacaccaacgccggcggctacgacgccttcctcgctcgcttctgactcaactgaaatgccacacggcccgttccggcgcgcactccggacgggcaccggcggcccccttcgcgactgcccgccacggggggcgccgcagcctcgcggcatgcaccggcatctgctcctgcgccatcccgcgttcgccccactccactgctcgcacacctgaaaacgcctgtggtgttcgcagcgtcggacctcaaggtccccccaccccaagccagcacgagggtgggtttgccggggcatcccctcaactcagaacggctgcgactccatagagagtcattcgacggcttcctctttttcagcagcaaagggaaaccccacgcagcttcgccaagtgtgagcagggccgaaggtgtcgccgaacgacgagcaccgtacggcgtggtgcgtgcgggcgacgagttcgagtgcaaacccaccgccaggtcggcctgagcgaagagagcgtcgccacgctcgagaaactcatcgaggacttcatcaggttcgacctgcgcacgaggccacattcgtgcttcagctgcacgcgcgtcggtggactatcgagtcacggcggcacggactcgatttgcgctcgacccgtccacgggccaaatcgacgctcctgccgcccctccctgcactcccattgcagggcccgtgcccgcctcccccagcctgcctccagttgcgacgggagggtgtgtggcagcgctgctgtcaccatccccctcgtccgcgagggagcactccggttgcgcctgggtccgcccagcctcaaaacgtgagaggacggggcgcaggggggccgatcgcgaaggggagcgtcgtggcctgagactgggggaaacatgcgagcaaggctcaacgcgcgggcgggcacctgcctcctcgcaatggtgctgggagtgtggggcggaggggcgtgggccggggcgccaggggggcggacggtcgtcacgctggccttcgacgacggaatcgaggagcagcgccaggtgctggatatgctttcggcttcggggctgaaggcgaccttcttcatcatcagcgggcgggtcggccagacgggatacatgaacctcgatgacctgcgccgcctggccgcggccggacacgacatcgggggacacacgctgcaacactcggagctggcggtgctgacgcccgagaagcaacgacaggagatttgcgaggaccgcctgcggctgctcagttggggcttctcacccaccgccctcgcattccccttcggttcgaacgatgcggtggtgaaccagacggcagcggcgtgcggatacaacgccgcgcgcgacgtgcggggcctggtggacacctgtggctcctgccccacggccgagacaatccctccgctcgatccctacgaaatccgcacgcccgcgacggtgacgcgcgacgacggactgaagcagttgcagtcgtgggtcacctcggcggaggccgcggggggcggctgggtggtcgtcgtcttccacttcgtggcgccggactgcaccaagcgcacctattgcgtgaagcccgacgtcctccgggagttcatgggctggctctcgcagcgggcaccgatggggacagaggtgcgcacgatgcaggacatcctgggcggtgcggcgcggcccgcggtgcaccccgtgtcccagccgcccacggccacgctgaagaatccctcgctcgaggacgacgcgaacggcgacggcgtgcccgactgctggcagctgggccccgcccacggtggcgccgtgcgcgccgagcgctcagccgaggcgcacagcggcgcctggtcctaccggctcgaacgcgtggaagcctccgggggcgccgcctcgctccaggtgctgcgcgacgacggcacctgtgcaccggccgtgacgcctgggagcggttcgcgggtgagcgtctggtaccgctccagtacgccgctgcacctggaggcggccgtgaagggggcggatgggatgtggaaggtgtggaaccgcggcccgagcctgccacccgcggaggcctggacggaggcgtcgtgggagctgcccatcgcgctgccggccgacgcgttcgaactgagcgtgggcgtcgccctggaaggggtgggctgggcgctggtggacgacttcgggctggcggatgcgacggcgcccgcggcgcgcctggtgctggacgcaccgaccggcggagaagacttcgtcgtgggccaggacgtggaggtgaggtggtccacgctcggcgaggtgcggacgctggacgtggcgtactccacggagacgagcgccagttgggtgccggtagccacctcggtggagaacacggggcacctcatctggcgcgtgcccgacgtgccgagccaggaggcgctgctgcgtgtcgccagcgccgaggatgaaacggtgtcgggcacgagcgcgcccttccgcatcctgcccggggccccgcagcagcccggcatcgtggagccgccacccgaggaacagccccccgaggagatccgtggcgacgggcaggtgaatggcgagagcggtggttgcgggggatgtgagggcgcgggtacggggcaactgtttctcgcggtggccggcggactcatcgccctctcgcgttcgcgagccagga

SEQ ID NO: 638 - DNA, 3810 bp, Myxococcus xanthus
tgtggagaatcttggccgccgtggtctccacgcccgcgcgcaccacccgcacccgaaggctgccctcgcccaccacggacgcggccagcacgcggtctcccgcctcgcgcacgcggggctcggattcacccgtgagcgccttctcatccacccacgcagtgccggacaccaccgtcccgtcggcgggcacgctctcccccgcgtgcacgacgatgaggtcgccctccttgagccggtccgcccggacctgctccacctctccgtccacccgcagtcgccaggcgtacagcacctccagccgcatcagccgggagatggcggaccgggcgcggtccgcgctgcgctcaatcaacaagtcgccaatgcccagcagggaggtgatgagcgccgcggtccgcacctgccccgtggccagggatacccccaccgccaccaggtcgagcaggtccacggtgatgcgccgctccgcgacggactggaaggcgcgctgtgccagcggcaggctcgtcaacgcgacgcccgcggccaacacgggcatgggcgccgcgttcacgacgcacgcggcgagcaccgccgaattgaagacagtggcggcccattcccgccggggcggctcgggcgcggcgggccaggtggatggatcgctcgtacgcagggccgccatcaactggctcgcgttgagcatctccgggtcgaagctcaccaccagcgaatggatggccggcgaggcgctcgccttgtgcacccccgccagcgtcgcggcccaggccgccagcttgaggatgtcgtcgtcctcgagccctcggacgtgcaagcgcacgcgaccgggcagtgcgtgcagcacctccacctggaacggcttgggcggaagctggtgcaacgtgaaggcgaagtcccgcacccgcagcgcgaacgcgccagggaagcgcgaggcctcctggtagtgcaccttgaccaggcccgtgctgcgctgacacgtggccacctggacttcggggcgggactccaaccagccgagcaactggcgcagcgtcttggaatcctccgccgcgcctcggatgaggagccggcccggagccacgtccgtgacgtggacggacacgggccgctgatgcccatccaggacatcgtgcgcgcgccccttgaagccgcgcgccatgccactcaggaactccacctccgcccgcatgaacgccccccgagctgaacgcagtgcaaccgcgacctcacacgtggggccggggccggaagggcaccgtcccgctgacgcgcgcggcgtcttccagctcctgctctcgcacaccgtcacggaacacgctgtaggcccagtacagcgcgttgtcccagcgaggcagccagcccttctgcgacgggttcgccaccagcgagtagatgcccgtggccgtcagcaccacgggaatcaactcgtagaggcccgcccccgtcagctcacgcacccgtccgtccagccaccgggcgcctctcaccaggtgctcggccggagccctccgcgacttcgccatgaacttggcgtcgacgatgccgtccaggcccgccgtgtcgacgatggccgccaggagcgactccacgtcggccgcgtccgggctgtattcgacgagcaagctgcccgtgagtggggaatggacggtgccgaacacaccttgcgtctcccccagctcaccgcgcacgcggtccgcgacggccgagtcatctcggaagcagctcgcgcgcacacgaagccggcccggggagtggtgcacgagcaacaaccactccccttcgatggcgcccgagtccgggtcgagcctcatgcgtgcccctctcgactgtccgcgacgggccgggcaccactgtccgccgcacgccggctgtgggcctgatgaaggttcgcccgcgagcgcgcctccgccaccaggtcggagaggtactcacgctcggtggcgatgacccgccgcgtccacgccaccaaatcaaacgccgccgtcgccacggagacgaccgcaccgcgtgagttgtcgacggtgctccgggccatccagccgctggccacgcccgccaggaatgccaccgccgtcttcatagcccccccggagcggcatgggcgtcagcgcccagcccggcgacgggagacgacggcatccgcccgtcgcgcggctcgaacgagtcgccctgcggcgaacgaacgaccccgtgggtccggaactgcttcagcagggcctgcacccgctcgcgacgcaccggacggttgagcgcggcggcggcctgccgcagcagcagccactccgcgttcgacatggacagatccaccgcggcaatcacttcgagcgcgtgcaggaaggcatcccgcgcgggctcgggcacctcgtggagacgctcgacccactgcgcctcgtcttcgcccaggcgctccagcagtcgcttgcgcgccgcggaagggctgttgcgcagcaggtgcgccagcatgaccgtcgcctcggaactcagcaccccatccgttccgaacaggcaccaggcgccttcgatgagcagctccacgcaccgcgcgtccacggcccgcacggcggagaacgcatcgtccagggcgcggcggtagcgcgcatactccaccgaggcctcgcccagccggcgcgtgtgccgccaactggtgacggaggaggtcaggacgctggcgaagggaaggaggtttcgcagcacgccctctcccatcaagcggttgcccagcttccgctccgccgcctccgtgtcctcggtcagcatccggcccacgagccccgcaccgccgtggtccgcgtcctcccacgtctccgagcccgccgtgagggcgttcaggtggagcagatcccacgggtcatccgggtcgatgcgcacgccgaacgcggacgccacgtcgcacatcatccgggcctggatgagcgagcgcagcatcgtgtccaatcccatggcggatcctgccacggggacggccacgagcgcccccacgaagccggtgtccagggtgaacatggccgcgctggtggagatacccgcggcgcttgcccccaccagcgcagcctccttgctggcacgccggatgagggcatccgtctcggacgcacggacggcggacgtggtaccggcgcgccgcgcctcgtagtgacgcacgtaggcggtcaccagacgggcgtgccacgcgcccgaacggatgtcctcgaagcgcaactcacgcccgagcttctcggcgaagtctcgcaaagggtgcagtgcggccgccggcgtcgcggcgtcttccggatgaaatggagcggttcgtgtcatgggcttgagtgcggaacagccgtgcgcgccagacctggagggcgcgacacggctggtggggggtgcatccgatgtgggcttccaggaatcggcgcactcaagctagggagattcgaggaccgggagaaccggtcctgcggggcaacgcctacgccgccgggttgacggtggcctcagcgaacggtgatggccgcccggacagcgcgcaggagctcggtgagctcgacacgcgcctgcgccttcgccgccgggtctttctcgtcctgacctcgctgcgccaccagcgccgtcaccatggcgcccgcggcggccttggcgcgggcccagggattcgtctccgcgtccgcttcgttcgtcgtcaccgcggcccagacttcacacaggtggctggccgcgtccgcgaacccggcgacggcgggcttctgttcgaggatggacgcattgcgcaggtcccccaacgcccccgcgatgacgtgccccctggcgaggtgcctcaccgcgggcctgggcgaagag

SEQ ID NO: 639 - DNA, 3733 bp, Myxococcus xanthus
tgctctaaagggccaggttcaccggaaaattcccggaactacacatgacacggagtgcgagcagggcacgcagtgcgcgttttcaggctcttccgaacaaccccttgagccaccccatgaagcccttctgcttgggtgcaacagccacactgacagagggaatcgaggacacgggagccgatgacgcgggccgaacgagcaccggccgcgcggccgacgcggaggcggccgtggccatgggcaccttcaccggagcggctggccccgtggccgtggccccggcgtggcccgcgctccgtgccgcggctgccggcccaggcgccggcggcgcctccgactcgagctgcgccagccgcgccttcacggcctccggggtgtcgcgtgtggtgaaggtgctcgtcacctcgcggcccgacgaggcctcgcgcgcggtgaccttcagcagcgactcgttgctgacctcgaaggtgacgttcacctgcacggcgccacgcgggagcttcggcaggccctccagcttcagcgtgcccaggtactcgttgtcagcggccttgtcggagtcgccctggaacaccgtgagctccagctccgtctggccgtcgcggtgcgtggccagggtgtagctcttcgtcgacggcagcgacgtgttgcgctccatcaccgccttgaagcggccaccaggcaggcccacgccaatggccatgggcagcacgtcgatgagcaccacgccttccaactgccccaggctgtgggccagcagcgccgcgcccagcgccacggcctcgtccgggtgcacgcccttgctgggcggcttgccgaagaacttcgtgatcttctcgtgcaccagcgggaagcggctctgcccaccgacgaggatgacctcgtcgatgtcctgcggcgtcaccttcttcgcgcggaggacctcctcgcagacctggagggtgcgatccaccaacccctccgtcagctccaccagcttctgccgcgagagcatgacgtccaggtcgcacggcttgctgtcgatcatcgtcacgaacgcgacgtgcacccgcacctccgaacgctccgacagcgcgcacttggcgcgctcggccgcgtcgttgatgcgctgcagggccacccggtccccttggaacgcgcggcccgtggtcttctggaactcgtccaggaggtacgtgacaagggaggagtcgaagtcgatgccgcccaggaacgtgtcgccgccggtggagatgacctcgtagacgttgtcgttcagctccagcaccgacgcgtcgaacgtgccaccgcccaggtcatagacgagcacgcgctggttcagcttgcggccgaagccataggccagcgccgccgaggtgggctcgttgaggatgcgctcgatgtacaggcccgccagcttcccggcctcgcgcaccgcctggcgctggttgtcgttgtagtaggcgggaacggtgacgaccgcgcgggacacctgatggcccaactggttctgcgccacctcccggacctcccggaggatgagcgcggagatttgttggagcgtgtagacgtcctcgcccagcttcacgcccgcgtcgccattctcactggccgcgatctcatagtggaagcggtccttgagctgctccaccaccggggacgcgaagggccggcccaccagccgcttggcgccgtacaccgtctggcgcggattggtgagcatctgccccttggcggggtggcccaccaccagcttgccgcgcgtgttgacggcgatgatggagggcaccgtgttgtggccctcgcggctgggcagcacgcccggcttgccgttgcggacgtaggccgcgcacgagttcgtcgtccccaggtcgatgccgatgacgacaccggcgcgcttcgggtcctccgagctgaggttcaacgccgcgttggagatcatccgcggcggcgcggcggctgcctcggctgaagcactgcctggcacgggggccggcgcgtagagctcggaggcgagtgcgacgggcgcctgctccgtgggtgtgacggtgtagtccggtggccctacattgggaggaaccgggggaacatccgactgggcgtggggcagggtgacgaccagcgaatccaggaaccggcgggtgggcgcatccgcgttcaggaagcgcaggcccatgccgagcacaccctggccgccctgacctgtgacgtagtgaacgacagccgccgcgtggatgatgcgttccccgcccgccagcttgagatccaaggtgacggccgtccccggcggcttcaccgcgcgtgcgcgcaggtagatgccaccccggctcacattcgggccgtacttcgccaggaactcctcgggcgtcgcgaagggcagcttcacgacgagcccgaccgccgcctgattcgattccgtcaatgcccggttcctgagacgcgaggggatactgggttgcgattatcgcccgaactccgagggaacgggcgtcaaaatcagcgcccttctccgttgcgccggggcagcgtacctcgtatggaaccgcacccgcgggctgtggtgccccgcgggcacctgcccacgggagcgccgctcatgctcaaccccgatatccggctcgccctcactttcgacgacgtcctgctggtcccgggcgagagctcggtcgtccccaaggacgtcgacctgacgacccggctcactcgcaatctccgtctcaacatccccctcctgtcggcggccatggacaccgtcacggagtcccggaccgccatcgccatggcccaggagggcggcattggtgtcatccacaagaacatgacgcccgagcagcaggcgctcgaggtcctcaaggtcaagaagttcgaaagcggcatggtggtggaccccgtcaccatcgaaccggaggccccgctgggccgcgcgctggagctgatgcgccttcacggcgtgtccggcatcccggtggtgaagggccagcgactggtgggcatcgtcaccagccgcgacgtgcgcttcgagaccaacttcacccagacggtggagtcgatgatgacgcgcaagctcgtcaccggccgcgaaggcatcacgcaggaagatgcgcagaagctgctgcacgagcaccgcatcgagaagctcctcgtcgtcaatgacgccttcgagctcaagggcctcatcaccatcaaggacatcgagaagcgccgcacgcaccccaacgcggccaaggacggcatgggccgcctgctgtgcgccgccgccgtgggtgtgtccgcggaccgcgaggcccgcgtggaggcgctcatcaaggccggcgtggacgtcatcgtcgtggacaccgcgcacggtcactccaccgcggtgctggatggcgtgcgcgacacccggaagaacttccagggcttcgagctcatcgccggcaacgtcgccaccgccgaggccacccgcgcgctcatccaggccggcgtggacgcggtgaaggtgggcatcggccccggctccatctgcaccacccgcgtggtggccggcgtgggcgtgccccaggtgacggccgtggatgactgcgtccgcgaggcccagaagcacgacgtgcccatcatctccgacggcggcatcaagtactcgggcgacatcgtcaaggcgctggccgcgggcgccaacacggtgatggtcggctcgctcttcgcaggcaccgaggagtccccgggcgacgtcatcctgtaccagggccgcagctacaagagctaccgcggcatg

SEQ ID NO: 640 - DNA, 3527 bp, Myxococcus xanthus
ctctacagagctgctcgacttcggactcgcggagtccgcgttcgcggaggaggagcttcccgcctcggcggcgggcacggacgttccggcttcaccagggccgagccccaaagacacccggccgatgcctgggccacggcccgtggatacccggctgcctgccgcgccgggtgtcacggatgcggtgtcctcgccgggccctcgccccacggacacccggccactctccgtcatgctggggcgcgataccggcccgcgcgccgatgaggcccgccaggatttcgttccaggcacgccgctctatctcgcacccgagctgtggcgcggtgagcccgccagccgggccagcgacgtctatgcgctgggcatcctcctctacgaactgtgcgcgggccacgcgccccatgaaggcgtaccgttggagcagctcggggccgcgatacaggagcgtcccccaccgcctctctccgagcgcgcaccagggctgtcgccagccttcgccgccatcgtggaccgatgcgtcgacgcggacccggcccggcgctacgagtcgggtgacgcacttcgggaagcactcgaagcgctcagcacgcccacgcgcgccagtgccatccccaccggcaatccctacctgggactgcgggccttcgatgccgcgcaccggagcgtcttcttcggccgcgaacccgagctgcgagaggtcctggaccggctgcgcggcgacaccttcgtcctgctggcgggcgactccggcgtgggcaaatcctcgctgtgccgggcaggcattctccctgctgtcagccagagcggcctggaggatggcgggcccgcctgggcagtcatctccgggacacccgggcgccgtccgctggagacctgggtggagctgctagcccccgtggtcggagagagcgcggatgccttgcgcgcacgcctcaccaccgaggagcccggcgtcctggcccgagccctgcgccgccggccaacgaacgctccacccctgctcctcttcatcgaccagctcgaggagctcgtcaccttctcggagtccacgcaggcggcccggctcgccgaggaactggccctggtgctgcgccgcgcgccccgcttccgcctcctcaccaccgctcgcagcgactgcctcacacggatggtggccctcccgggtctgggtgatgaactgccgcgcgcgctccacctgctgcgcgccctctccgaacacgggctgcgagaagccgtggcaggccccgtccgcgtgctgggcatgcgcttcgaaagccccgccatggtggacgccctggtcgcctccgcggcccgggccgagggaggactgcccctgctccagttcgcgctggaggcactctgggaggcacgagattcccaacgccagctcatccccgccgccgcactggaggccctgggcggcgtggaaggagcgctggcccgtcacgcggacgccgtggtcgtccgtctccggcccgagcaacggcctcgcgcccgcgcaatgctcctggagttggtgacgcccgagggcacgcgcctgcgccgtacccaggaggagctgctgcgtggccccgacgacgacgccggacgcgcggtgctggacggactggtgcgcggccggctgctcaccgcgggcgaggcggaggacggagacggcgtgtacacgctggcccacgaaagcctcgtcaccggctgggacaccctgcgcgggtggttggggcaggacgagcaacgccgtgccgtgcgaatgcgcctggagcgcgccgccgcggagtgggaacggctgggccacccgcccgaactgctctacggcgagcggcagctcaccgagagccgcgccgcgggcctttcccatgtcgagaaaccgcgggagcgcgacttcctctcccgctcacgaagagccgtgcgtcggcgccgggtgacgcgctggctggccgtggccctggtgcccctggtgctgggaggcgtggtgggcgtcacgcgcgtgcaggcccgggcgcaactggatgcccgcatcaaccgccacctggacgaggccaaggtgcagcaggtcgcgttggacatgcgccgcgccgagctggaccaactgagcgccgaagccttcaccctgttcgacacgccgggccctcagaaccgcgaagcagccgaagccgtgtggagccgcgcccaacagacccggcaggcggtggaggagaccgcgctgcgcgccatgtcggagctggaggccgcctggggcctggcgcccggaaaccctcgggtgagcccgctcatggccaacttgttggtaacgcgcgtggagttcgccgagcaggaacgccaacccgagcagcgcgcgcagtggctcgcgcggctcggggcccacgaccccatgggcgagctgcgccgggggctgacggcaccggcacggctgacgctcaccagtgagcccgcgggcgctcgcgtgcggctgctggagcccacgccagagggagagcccgtcccgggacgcgacctgggacagacgcccctgcacgaggtggcactgcccgcggggtcccacctcctggtgatggaagcgccgggccggtttccggtgcgcgtccccgtgctcctcgcatccggcgagcggctggcgctggacgtgccccttccagccgcggggttggtacccgagggcttcgtgcacatccccgccggacgcttcctccagggcgcgtcggagagcgaatatctgcggcgtgcattcttcttcgcgccgccactgcatcgcgtggacacgggcgcgtacctcatcgcgcggcacgaggtgacgttcgcgcagtacatcgccttcctggagacgctgccccccgaggagcgcgccgcgcggatgccgggctcgcgccgccgcctcaccgtggtggacctggcccacgaaccagatggccgctggcggctcaccctgcgccccgcgtccgcaagctacagcgtgagggacggtgaacgactgcgctacggcaagcgggaccgtcggcaggagcaggactggctgcgcttccccgtgtccgccgtctccttcgacgatgccctggcctacgtggcgtggctgggccgcaccggccaggtgccaggcgcgcgcatgtgcacggagcgggagtgggaacgggccgcgcgaggcgcggacggccgccgctaccctgcgggcgactggctggcgccggacgacgccaaccatgacgccacttatggccgggagccctggggcttcggccccgacgaagtgggcagccacccgcgctcgcggagccccttcggcgtggacgacatggtgggcaacgtgtgggagtggacgcgctccgacgtggccccggagaagccgtccgcccagggcggaagctggtaccagagcgacctgacggcccactccgccaaccgggaccgcgtggaacgaacgcagcgagaagccctcatcggctttcgcgtctgcgccacgccgcgcccatgagtcgccctgccatcaggccatgtgctccagcagcgcctcaagccgctcggtccagtcgtgc

SEQ ID NO: 641 - DNA, 3812 bp, Myxococcus xanthus
gacggcttcgtcaccggctgcttcgccacttcacccgctgcgctgtccaggcacacgactcgcgcggcgctgggcggaagcaccgacttccacttctcgtgcgtcagcagcaccgacgctccggtgtcctccagcatccaccccagacgctccttcgggtacgccgggtccaccggcacgtaggcagcgcccgccttcagcacgcccagcagcgccaccaccatgtccaccgagcgctccaggcatacgcccaccagcgactcgggtgccacccccagccccctcaggtggtgcgccacctggttggctctcgcgtccaactcccggtacgtcagtcgctccgactcgaacgccactgccaccgcgtccggcgtgcgtgccacctgcgcttccaccagtgcgtggatgctcgcctcggacgccggcgccatctcccgtccctggaagcccttcagcacctggtgctgctcatcctcgggcagcatcggcagcgactggatgcgcatctcggggtcccgaacgatggcttccagcaaggtctggaagtgccgtatcagacgcttcgccgcttcgggcgtgaagaggtcggtgctgtactccagcgccccctccagcgctccgtcgcccagatccatcatcgacagggtgaggtcgagccgggccgtttccgtggcggacctcaacggctccacccgcatgcccgccagcgcaggcagctgcatgggcgagttctgcaaggcgaacatcacctggatgagcggcgacttgccgccgccgcgctcgacccccatggcctccaccagccggtcgaagggcacgtcctggcgcacgtaggccgccagcgcctcctcgcgcacgcgagacaccagctccgcgaaggtcggcgcgccctccagccgggcccgcagggccagcgtgttgacgaagaagccgatcaacggctccagctcggactgcgtgcggtgggcaatggggctgcccacgcagaagtcttgctgtcccgagtagcgggagaccaggacctcgtacgcggccagcagcaccatgaagagcgtggccccctggtcgcgagccaccttctccagggactgcacgagctccggcgacaccgtgaagaactggctcgagccacgaacggtacggaccgcgggccggctcaggtcaccgatcaactccagcgcggggacgccctggagatggctgcgcagctcggtcagttgggtctggatgccatcgtgcagcacccactggcgctgccacgcggcgaagtccgcgtactggacggccaggggcggcaggggagacggtttgccttcgctgaacgccgcgtagagggcggagacctcgcgcaccagcacccccaaggaccagccgtccgagacgatgtggtgcacgcacagcagcagcacatacgcgtccgcatccagacggagcagcaccgaccggaacagcggcccggtggacaagtcgaacgggaagtgggcttccgcgatcatccgctggcgcacgcgcgcatcacgggccggccccaccattgcggacaggtcctccacgggcaggtcccacaccgccggcgccgggttgacctgctgcctgggcagcccttccgtcacggggaaggaggtacgcaacacctcatgccgggagaccacctcggcgaaggtgcgccgcagcgcgtccatgtccagtggcccgaagagcttcagagcgaagggcacgttgtagacggcatgtcccttctggaactgcgacaggaaccacaggcgctgctgcgcgaaggacaagggcagcgccgcattccggggcacgggctccagcggcggcatcgacgcacgcgacgcctgcatcatcagcgcctcgatgcgttccgccaggcccgcgagcgtgggcgcctcgaacagcgtcctcagcgggacctccacgccaagctccgcgcggacacgcgtcaccaactgcgtggccaggagcgaatggccgccgagttcgaagaagtcgtcctgaggccgcacgcgttcgacgcgcagcacctcccggaacaacgtcgccaactgctgctggagcaggggcagggccgccgtttgggtgtcctcggcgggcgacaggtccggtgccgggagcgccttgcggtccacctttccgttcggcgacaggggcagggtgctcagcaccaccacggcgttgggcaccatgtactccgggagccgctggcgcagatgctcccggagggacgcggtgtccacgtcctccggtgtcacgtaggccaccagccgccggtcacccgggctgtcctcgcgcaccaaggcaatcgccgtctccacctcggagtggctccgcagcgcggtctcgatctcccccagctcgatgcggaagccccgcagcttcacctggaagtccacgcggcccaggaactggagcgtaccgtccgccagccagcgcgcgcggtctcccgaccggtacagccgggcgcccggaggcccgaagggattgggcacgaagcgctcggcggtcagcgcgggctgtcccaggtatccccgggccaggccgtcgccgccgatgaacacctcgcctggcacacccacgggcgcggcccgcatcgccgggtccagcacgtacacctgggtgttcgcgatgggccggccaatggagacggagtcacccacggcgtcgcccgccgccatccggtggcatgcggtgaaggtggtgctctccgtggggccgtagccgttcaccagccccacgccttgcgccagccgttcgcggacccgaggcgccgggagcacgtcgccgccggcgaggagctgacgcaccttgcgcagggcttccggttggtgctgctgcatctggtcgaagagcgcagccgtcagccagagcacggagacgtggtgccgctccagggcctgtcccagctcggccaggtccagcgtccgctggggatagagcaccagacgagccccgtgcagcagcgcgccccagatctccaaggtggacgcgtcgaaggccaacggtgccaattgcagcaccacctccgacggccccaggtccacgaagcgcgacccgatgagcaggcgcaccacgccccggtgcggaatggccacgcccttgggcgttcccgtggagccggaggtgtaggtgatgtacgcgagctggtccgggcccacgatcccgcccgtcacgggcgtcgacggctggcgctcaatccacgtccattcgtcatccaggacgatgacgacctgagcgcccgcgggcagttcgtcctccagcgcggcctcggtgaggatggcggccacgcccgagtcttcggccatgaaggccagccgctgtgcgggatactcgggatccagcggcacgtaggcgcagcccgccttgaggatgcccagcaggcccaccagcaggtccagtccccggtgcaggaagacgcccacgcgcgcctccgcgcccaggcccaacgcgttcaggtgatgcgcgagctggttggagcgcgtatccagctccgcgtacgtgagcgtgcggccgtcgtgctccacggcgacggcatgcggcgtcttcagcgcctgggccgcgaagagcgacggcacggtcgcatccacggggtaggcggcctgggtggcattccaggtcgagaggacctgctgccgctcccctgcatccatcaggggcaactcactgagccgctgcgcgccggccccgtccgccaccgcggccaggagcactcggaggtgctccaccatccgtcgagcggtgtccggagtgaagagctccaggctgtattccagttggccgtccagcgcgccgccccgatccatcatcgagag

SEQ ID NO: 642 - DNA, 3542 bp, Myxococcus xanthus
caggctcgaaagggcgcccgaagtcactccctctagcgaaagctcctccgccgcggcgaaggtcccgtccccgttgccgcgcagcagcaccagcgagcggttgggtggcgtgctcgtggcactcatcgcgagcaggtccattgtcgggccggagtcgaagcggtccgccagcagcttccatatgcccgggggaaccggagctgggccccggtgctcgaatccaccgcccgttcgggtgaggtgggcctggacgccgccgtcgacgagtgaagccacatcggtgtggccatcgccatcaaagtcccccgttgcgaagagccagccgatgtccggacgcgtgggcagttccaggtcccagatgacatggacggtgttgtgcatgccggagagcaccgccaggtccgtcttgccgctgccgttgaagtccgccgccaccagatacgaggggttcatccccgtggcgagcgtcctggattcgaaggttccatctcctcttccttggaggagggtgagggtgtcgctgtccgcgtgcacataggccaggtcctgcgtgccattcccgtccaagtcccccgcgatgaggtggctccggtttccgaagctgtgccacgtgtgctggtgcagacgcacgggcgccgtgaagcggccgtggccgtcacctgtcagcaggtggatggaggactcccggttccccaccacgagggccacgatgtcgaggtggccatcaccgttgaagtccgtggtcaccgcatggggcacggggccgtcaagcgtgcccaggaactccttggtgaaggtgaggagccctctgccatagaagccatggagggaggggcccaccaccatcaggtccaccagcccatcctggtcgaagtcccccgtgacaacggagcccctgggcgcgaacggctcccgaaaggccacggccagccggcctccgccggtgtggcgaagaacgagcaagctgtcccgctgggacaccacgacttcaggcgcgccgtcaccgtctatgtccagcacggcgggaggcgtgatgtcataggtcgaggagtggctgactgcgtccagcacgtagttgatgacaggttgctcgaacgcgccgtttccttgcccgcgcaagaaggagacgcatcggcagtagttggcttccgccgcaatcaggtccagcacgccgtcccggtccaggtccgcggagaccaggtgctcggccgtcacggagaggtggggggtgttctccgcctcgaacgcgccgttgccgattccgcggaggaaggtgaccccggggctgttgtcgtggcgggcggcgaggtccagcttcccgtcttgattgaagtcgccaagcgccagtccatgggacatgcccgcgacttcctgggtcacccgctgcacggggcccgtgtccagattcacctcgcagcgcctctccggtgcggtcagcgccacggtgtgcgtgcgcgtcgcggaggcggtgccagggacggtggcggtgatgcggagccgtgcctcgggcgcggtacctggcaggtccgtgggacggttccagcggaaggtgtgttcggtgccctgcgtggaggtcgaaagcgagaccaggccggacgcgcgttcgtaataggagtccgccgcttgggtcgcgcgggtgaaggcgccactgcccgtggcatcgaactccaccaggacgtccgcgcgttccccgtccacctgccgcagcgtgtaggtcaccggctggcagccacggaccgccgacggcgtgtcgagtcgggtgacctccacgggcgtgggctgcgacttcacgggctcacccgccgtggccgcggggctgtcacctacggcgttgcgagccaccaccgagattgtctgtgccttcgtgctgggcacgtcctccaacacggcgccgtgctggtccgcgctcacctcgatgcgcacgcccgacggctgagccatgacggtgtagccggtgaggcgtgagcgtccgtcggacacggggggcgcccacgctacggtgagcgagcgcactcccggttcggcctggacggaggcgggcgcgcccggcggtgcatgcgttcgcgcggaggccgtgctgctgtcaggtccctggcccacgtcgtttcgcgcggacacggtgaaggtgtactcggtgtcgtcctggaggttcgtgaaggtggcttcgctggccaggccctccacctggtgcgtggtgccaccgggcgaggccgtcaccacgtagccggagacaggcagaccgccggtgtcctcgggcggctgccaggagacggacacctcgcgcacaccgggcgaggcggccacggacacgggcgtgccgggctgggcggcgggcaccacggcggtggactcggcggacgcggggcccgcgcccacggcgttcaccgcgtgcacggtgaaggtggaggccacgccgttggtcagcccgctcacggtggttgtccgcacggggctgtctgtcgcgacactcgcgccgctcgggtgggccgttaccacgtagtgaagaacggagcgcccaccgtcggacgcgggggcgttccatgtgacacgcacctgccggtcgcctcgctccaccccgagcgccaccggcgcggtgggcacatccggcaggttcacggagtccacgcgcgccacgggactcacgcccacggcgttgcgcgcggtgatggtgaagcggtaggtgcctccggcgcgcaggccggtgacgcgcgcggtggtgccctccacctgcacctggatgccgtcctcgagaggttcgacgcccacgtcgtagccggtaatcgcgctgccgccgttctgcgcaggctcgaaccaggagagcgtcaccgtgcctgggtccgtcatcgcggacacctggcgcggtgcggacggggcggtgggctcgggcggtttgggcggccggagttgttcgcaccgggaggcatccgccacgcagacgttggcgtcggggcagcacgtccagccgtcggtgcaggggcagggccgctcaccctcattcacagggttgatgcagccggagaacagcagtgcgccgagcaacaggctcaggacgcgggacggaagccaatgcgatgtcttcatttcaagcttcacaacgaaaggtgtccacgcgttggacgaatcagaatgcgcccgtgaggcccagggccgcgccatccgagctcagggtggccagcggcacggtgtccgagtcgggccacaggaacagcagcgcgccgttcagcaccgccgcgccgccgaccccgtagagcacgccgctggcggtgttgtaggtccggatgcggcggttgtgcgcggcggcttcctgctgcggcagttcgggcgagacgctgctccggatgtctcgggcctccagcgtggcccacatgcccgcgcccgcggaggccacgcccagcgccagcgcgccccagccgagctgcctccggaggctccctgagtcggagaccttcgtcagcgtcagaggcggcggctcgcggaacgcgaagtcggtgacggtgtcgctgccgaagggcaaggtgaagatgtgctggaaggccgcgtgc

SEQ ID NO: 643 - DNA, 3073 bp, Myxococcus xanthus
ctggggctcatccagttctcgtccggttccacggtggatccgaagccggtgacgctgacgcacgaagccctgctggcgcaggtcgcggcgctggagatggcgatgccgctgggggcgggggtgccccgggtgggcgtgagctggctgccgctgtaccacgacatggggctcatcggctgtctgctgtccgcgctgtactacccgggaagcctggtgctgattccccccgaggccttcctcgcacggcccgcgttgtggctccgcgcgctgtctcgccaccggggctacatctctcccgcgccgaacttcgcctatggcctgtgtttgaagcgggtgaaggacgcggagctggacggggtggacctgtcgtcgtggcggcacgcgctcaacggcgcggagccggtgtccgtggacacgctgcgccgcttttcggtgcgtttcgagcggtggggcttctccgcgcgggcgttgcggccggtgtacgggctgtccgaggcgtcgctcgccgtcaccttcccgccggaagggcgggggccgcgcgcgctgggcgtggacgcggggctgctggcccgggagggccgggtggcggagggttcgcgtgagttggtgagcgtgggcatgcccgtggcgggcttcgaggtggaggtgcgcggcgagacgggcgaggcgctcgcggagcggtgcgtgggccgggtcttcgcgcgggggccgtccctgatggccggctacttcgcggatgcgcaggccacggaccggacgctgacgcgggacgggtggctggacacgggcgacctgggcttcatcgcggagggcgagctgttcctcacgggccgggcgaaggacgtggtcatcatccgaggcgcgaaccacgcgccgcaggcgttcgaggagccgctgcatagcgtggcgggcgtgcgcgcgggctgcgcggtggcgctgggcttcacgcccgaagggggcgaggacgaggcgctgctcatcctcgcggagcgttcggggcaggaggcggatgacgtggtcgaggagcgcatccgcgcggcggtggtggagaccacgggcgtgcggcctcacactgtgcggatgctcgtgccaggcacgttgccgcgcacgtccagcggcaagctgcgccgcgccgaggcgctgcgccgttacctggccgaggaactggcgccgccgaagaaggtgggcgcggtggggttggcggtggagatggctcggagcgcgctggcgatggtccgcgcggagagcgacacgtgaggcatcaggccgtggggccgagcacggcgtcagcgtgagacatgccatcatggggatgcgagtcccggaggagtccacgccgtgaagcggtacgacgtcgccgtggtgggcggaggacccgcggggctggcggtggccatcaccaccacgctgcgtgggctgaacaccgtggtgctggagcgcggcacctcgccggtggacaaagcctgtggcgaagggctgctgcctcccggcatggcggtgctggagcggttgggcgtcctgcctctgctggatgaccagggcagccatcccttcgtgggcatccgctacgtccaggaagatggcagcacggcggagggcaagttcccaggcaagggcgcgctgggcgtgcggcgcgtggcgctggccacggcgctggtgtcgcgggcgcgcacggtgggcgtggagttgcgcgagcgcacgcaggtgctgtcccaccagcgggatggcaatggcgtggtgctgcatacggccgaaggcccggtggaggccgcgatgctggtggccgcggacgggctggcttcaccgctgcgccgcgcggaaggtctggaggtggagccgacggggccgcgccgtttcggcctgcgacgacacttccaggtcgcgccgtggacgccctatgtggagattcacttcgcgcatggcgtggaggcctacgtgacgcccacgggcgtgcggcgcgtgggcctggccttcctctgggaggacggcgtggtggaagggcgggtgagcttcgagacgctgctggcctgcttccccaaactgtcggagcggctctctggctcggagccggactcccagccccgcggcgcgggaccgctggcccgggtggcccgagcgcgcatcgccgaccgcttcgcgctggtgggagacgcggcgggctacgtggacgccatcaccggagagggcctgtcgttggccttcgtgtgtgcggagtcgctggggaacctgctaccggaggcgctcgtccatggcgccacgcgcgaggcgctgatgccttacgagcagtgtttccagcgggtcttccgcaagtactcccggtcgacaggcgcgctgctcatgctggcgcgacggccctggcttcgccgtcccgtggtgcggctgctggggaagacgccctggctgttcgagcgcatcctgcacgccgtcgtgacgtgagcgggggactgaggggcgcggaggcgttggcgttctcctccgcccgacgccggtgcgtgacacccgctgtgcagtggcgtccccagacgggagttgccggttgccggacgggcgcaaacccggtccactgtcgcgccgagacatggacgtcgagcccgggccgcgcgggcgtcttcccagtcctgtctgaatggagcaccgcacccatgtccctggaccgttcttcccggcccatgacgaaactcctgtcgctggtgctgctgctgtcagcaccgtggcttgggggctgcctcttcgcgggcccccgccaccagggcccggtgacggagcacttcgacggtgagcagttccagaacctggagcccatcaatcgcctgagtccagaggaggtcttcaaggcgctgcgcaaggggcctcgcggcccgtggcgggactatgaggaattcgctccaggcaagccgcctccggagcgcgtggggccgggacagctccgggtgacgttcatcaaccacgccaccgtgctcgtccaggcggacgggctcaacatgctgacggaccccatctattcggaccgtccgagcccggtgcccttcatcggccccaggcgcgtgcggcctccgggcatcctttcgagggc

SEQ ID NO: 644 - DNA, 6057 bp, Myxococcus xanthus
atgctgattccgcggcgggttcgggaagttcgaaattgagaatcgttctcactctcactgcggacgtggataccccccacggccctcatccgtcaacgctcgctgagtaaaaattcttacgcgcggtggaatgcccgtccggtcgtccacggaggaatggcgcgcggaaaagccctttcgcgacagccctttacaggcggctgaaggaccagctcagcgcgcggccaccggaatacggcatgacgccatggaacggccgggggtcggcgtcgaacaccagcggcaggaagtgccggtcgccgtcccacaggttgaggccttggatatccgccacgggcacccaggagagggagccctccgggttccgctcgagcggggtgccttcgaagcggtcgatgcgaaacacgaagcccagccagtcctccccgtgcttgccaaagcccggccaggagatggtgccgcggagcaccatctgcgtgcactcgatgccggcctcctcgcgaatctcccggcgcatgcaggcggccacgtcctcgtcgcgctccatcttcccgcccaagccattgaacttcccgtagtgggcatcatccgggcgggcgttgcggtggacgagcaacacgcgatgcccgtccggtgacatcacgtaaccgagcgtgccgatgatcggggtgtacggcatgggagcaacctcgcgcggtgcggcatccaggcgtcggagccccttggccaccgccggaatgtgacaaggcgcggcactgtagttcatgccgggccagccaggtccctcctcaccccgccctcctcacacggtggggtcggggacttccctttacgccagccaacgcagcgcgttaacgtgtggcgacactgcattattcttgatgacaacccgcgtcgtcgggagaggggactcttgatgtcggcattccgccccggccggtacggcctgtatgagccagacaccgagcatgacgcctgtggcgtgggattcgtcgcccacctgaggggtgaacgctcgcgaggcatcgtcgaggacgccctggagctcctcaaccggctcagccaccgggcggccgcgggcagggacccacgaaccggtgacggcgccggcatcctggtgcagctcccccaccgcttcttcgagcgagagtccccgaagctgcccttcgccctcccgccgcgccggcactacggcgtggggcaggtcttcctcccgcccgagcccgaggcccgggccgcctgcgaggccgccttcgaggaagtcgtcggtacaagaagggccaagcgcggtgctcggctggcgcgacggtgcccggtgaacccggagcacctgggccccgtggcgcgagaggccgcccccgtcatccgccagctcttcgtggcgcggcggcgaatggtccccagcgccttcgagcggaagctgtaccgcatccgcaagctgacggagaacctcatccaggcgcgcggcgtggaccccaagggccgcttccacgtggcgtcgctgtcgtcggagacgctcgtctacaaggggctgatgctgccggtggacctgccgcgcttctactccgatttgcagcagccggacttcgtgagcgcgctgggcctggttcactcacgcttctccaccaacacgttccccacgtgggagctggcgcagccgttccgcttcatcgcgcacaacggcgaaatcaacaccatgcgcggcaaccggaactggatgaccgcgcggcgcggcctgctccagacggcgcgactgggcggcagcctggaggcgctccagcccatcatcgtcccgggcaagagcgactcggcgcagttcgacaacatggtggagctgctctacctgggcgggcgcaccctgccccacgcgctgatgatgatgattccggaggcgtgggagggcgacgcgctgatgtccgacaagcgcccacgccttctatgaatactcctccgccctgctggagccgtgggatgggccggcggccatcgccttcacggacgggcagctcatcggcgccacgttggatcgcaacggcctgcggcccgcgcgctacctcgtcacggaggatgaccgcatcatcctcgcctcggagatgggcgtcatcgacgtcccgccctcgcaggtgcgccgcaagggccgcctgacgccgggccgcatgctgctggtggacaccaccgaaggacgcatcctggaggacgaggacgtcaagcgcgacatcaccacgcgctggccctaccgccgctggctccagcgcaacgtctacaccttcgacaacctcccctccgtcgccgccccggtgcgcctgcgcggcgaggagctgtggcgggcccagcgcgccttcggctacaccgccgaggacgtgcgctcggtgctcacgcccatggcggagacgggcaaggagccggtgggctccatgggcacggacacgccgctggcggtgctcagcgaccacgcccccagcctcttctcctacttccaccagctcttcgcgcaggtgaccaacccgcccatcgacccgctgcgcgagtcgctggtgatgacgctggccaccgcgctgggtccggagagcaacaccttcgaggagacgccggagcagtgccaccggctgtccctccccggccccatcctcaccaatgggcagctcgcgcggctggcggccatcaatgacgagggcctgttcgagacgcgccgcctgtcgctcctctacgccctggacggcggcgaaggcgcgctcgaggcggcggtggagaagctctgcaacgaggccgtggacgcggtggacgccggcgccagcatcctgctcttgagcgaccgcggcgtggacgcggcgcacgcggccatccccgcgctgctggccatgtccgcggtgcaccagcggctcgtgcgtgacggcatccgcatgtacaccggcctgctgctggagacggcggaggcgcgcgaggtgcaccacttcgcctgcctgttcgcctacggcgccgcggcggtgaacccgtacctggcgctggacacgctccgggccctggcggacagcggcgagctggccgtggacgcggagaaggcgcaggaccgcttcatccgcgccgtggaggaaggcctgctcaaggtgatgtcgaagatgggcatctccacgctgcagtcctaccgcggcgcgcagctcttcgaggccgtggggctccagcgctcgctggtggaacggcacttcaccgacacggcgtcgcgcgtggagggggtgggcctgccggagctggggcgcgaagtggcggagcgccatgcccggggcttcggcgcggaagcggacgcagaggccggcatgctgcccgtgggcgggcagtaccgctggcggcggctgggcgagcggcacaagtggaacccggccaccatcgccaagctccaggcggcggtgcgcgcgaacgacgccgccaccttcgcggagtactcgcggctggcggacgacgagacgcgcgagcactccaacctgcgcggcctgctcgaaatcgcccacgagggccgcacgcccgtgccgctggacgaggtggagccggcgctctccattgcccggcgcttcgtcaccggcgccatgtccttcggctccatcagcgcggaggcgcacgagacgctggccatcgcgatgaaccggctgggcgggcgctccaacagcggcgagggcggcgaggagtcgcggcgctacacccgggacgagaacggagacctgcgccgcagcgccatcaagcaggtggccagcgcgcgcttcggcgtcaccacggagtacctggtcaacgcggacgagctccaaatcaaggtggcccagggcgccaagcccggcgagggcggccagcttcccggccacaaggtggatgagcgaattgcccgcgtgcgctggtccacgccgggcgtgacgctcatctctccgccgccgcaccacgacatctactccatcgaggacctggcgcagctcatctacgacctccagtcggtgaatccggccgcgcgcgtcagcgtgaagctggtgagcgaggtgggcgtgggcaccatcgccgcgggcgtggccaaggccggcgccagttgcgtggtcatctccggctacgagggcggcacgggcgcctcgccactgtccagcatccagcacgcgggcctgccctgggagctggggctggcggagacgcagcaggtgctggtgcacaacgggctgcgctcgcgcatccgcgttcaggcggacggcggcatgcgcaccgcacgggacgtgctggtggccacgctcctgggcgccgaggagttcggcatggccaccgccagcctggtggccgtgggctgcatcatgctgcgcaagtgtcacctcaacacctgttcggcgggcatcgccacgcaggacgcggggctgcgcgagcgcttccagggcaagcccgaggacgtggtgaacttcttcctcctcatcgcggaggacctgcgccagcggatggccgcgctgggcgctcgctccctgcaagagctggtgggccgcgtagacctgctgcggcagccgcccggcggtggaccactggaaggcgaagcgcgtggacctgtccgggctgctggccgcaccggccgcgccggacagcgagccgcgccactgcaccgagccgcgcatcaaggacgtgtccgaccacctggaccacgcgctgctgcgcgacgccagcgcggtgctggacggcggaccgcccatgctgctcaacgtgccggtggccaacacccaccgcgccgtgggcgccctgctgtcgggggagattgcccggcgtcacgggggccaggggttgccggatggccggctccacgtgcggatgaagggctccgcgggccagagcttcggcgccttcgtggtgaagggcgtgacgttggagctggaaggcgacgccaacgactacgtgggcaagggcctgtccggtggacgcatcatcgtctacccgccgcaggccagccgcttcaccgccgaggacaacgtgctggtgggcaacaccgcgctctacggcgccacggccggcgaggtctacctgcgggggctcgcgggtgagcgcttcgcggtgcgcaacagcggcgcgcaggccgtcgtggagggcgtgggcgaccacggctgcgaatacatgacgggcggcgcggtggtggtgctgggccccaccgggcgcaacttcgctgccggcatgagcggcggcatcgcctacgtgctcgaccgcgagcagtccttccggcagcgctgcaacctggagatggtggacctggagtccctggtggacgaatccgaaatctggctcgttcacggcatggtggagcggcacctgcaccacaccggcagcgcgctggctgcggcgggtgctggacaactgggagctgatggtgccgcgcttcgtgaaagtgatgcccacggactacaagcgggtccttcaaacacggcgcgcggcgcgcagaccaccggagcccacatccgcggcgctgccccagtcccgcggcggggagggcctgagccatgggtaagccaactggattcatcgagtgggagcgcgtccacgcggacaagccgggacaaggccggaccgggctggggcgactggcgcgagttcgcgctgccgctggcccccgacgaggccaaacggcaggccggccgctgcatggactgtggcgtccccttctgccaccagggctgtcccctggggaacctcatccccgacttcaacgaggccgtgtaccgcgggcgctggcgcgaggcgtatgacttgctcagccgcaccaatggcttcccggagatgacgggccggctgtgcccggcgccgtgcgaggccgcgtgtgtgctcgccatcgaccgggacccggtcaccatcgaacagatggagaaggaaatcgtcgaacgggccttcacggagggctgggtgaagccccggcctccggcacgccgcaccgggaagacggtgggtgtggtgggctccgggcccgcgggactggcgacggcggcgcagctcaacgcggccggacacaccgtcaccgtgtacgagcgggatgcccgggccggcgacctgctgcgcgaacttaga

SEQ ID NO: 645 - DNA, 5299 bp, Myxococcus xanthus
cgccgcgcctgacttgacggtgttcgaggtgctgccgattctgacgtctgtcaatgcggacgcccccatccctggcctgttcgacttcatccggcgccgcccctttgtctatgaatcagcggtgctcaagcatggtgagcgccgagtcgacctgcggggagcccaactgtcccggctcacgctcgacgtgacgggcgtccacgagctctatctgaacgacggccttgaggacctgtccctggtcggccagccggacccggcgctgaagattcacggcgaggcggatgggcgctggctgaccttgtccctgggcgctccggacatgccctggtccggtctggacacactggacagccttcatctgcgggccgcgcgcgacgtggatgcgtcgcgcatcgtgcggcgctttccgaacctgacggagctgcgcatctggggagccccgggctacctgagaaacaccgaggagctggcgaagctcccggccctggccatgctgacattgagcgacctgttcgggatgtcacccgacgagtttcccggtccggagcagctcccccacctgggcatgctgtggttgacgagcattcccgcggacgtcgccgcccaggtgaagaaagcctacaaggccgctgcgcgcgagggattggacctgtcggtgcgacagccgcgcaaggccgactggctggcggagaacctggacaacccctttcgcgtctgggacggagccgacaacatcagtccagcccaggcgaagaaggcctcggcgctgtaccgccaggcacggtcggccgcgctcaagtctgtatccgaaggagaccgctcccccgccgccttagtgtccgcgctcacccccatcgtcacggcctacaccgatggcttcaacaagctggatgcccgccacaccttcatcttcaccgaggagcgtgagcagatttatctcgcgctgatgggcatcttcgacgcagtggatgaaaagctccggtccacggaaggaactcccgccgagccgctcaatcgagatgccctggtgtcggtgatggattcgattcgagacttctagggtgattcacccgcgcaagcacgctggtgactcccttcggcgaattcacggagccctgcatacatcagcgactccgttggccagccgattgcctggggccgcgaatgccttcatcgagccctccggctattttgtgtaacagatttgtatcaatccacaggagacagccggacgcagtcattgaactttttcacatgcgcagaggcatgtagcgtccgtccgcgtactccaacaggacatctgtcctttccgtatcggaacacttattaccgtttaaaacgtgcaaatctggcgtgctatcttcggccaccatgcgcacttccctcagcttcgcgtccctcctcgtcgcatcttccctcaccgttggctgtctcggccccgagacggacactgatacggatgcggttcagtccatcgagcagcaggccacggaccccttgttccgcgtccacaacatcgtcgaggcggtgctcccggccgccaactacgacggtgtcgctggcaacgagtgcatcgcgctcgtgaaccccgagcaccgactccgcaagatcatcatcgtcgagacggccggtgccaacggcgcttgcgcgctcaatgcctacagcgctggcggcgccctcagcttcacctggggcgacaccgccgtctaccagggcccggccggcatcgcctccatccgcgcggcgctctccgacaccgatggcgccgtgcaccgcctcaccggcacgctcacctccgaggccaccaccctggcgcacctgcagtccttcctcacgcagaccaacacccagcaggccagccagctcgccacgttcaccgcggagcgcgtccactcccgctacgacttcgagggccaggagcaggtctacgccgaggccgcctaccaggccgtccgagtcacccagccctgtgagaaccccggctacccgaccctcgaggcccgcgtccacaacggcttcgtctatggctacaaggccagcaacacgggcagctgccgcagcggctggttccccctgcgctacgtctacaaccgcaactggcagctcgtcgacagctacgagtactccgagtagtccgccacgccgcggcttgatgcggcaggcagtcgccgttgctcattgatggtcatggattggcctctcgcgcgaagcggtccagcgggaggtcatccatgagtgtctcgtccagaagagcggccgggcacagcctcatgacgtacgaacagcgattcaccacgcacaaggcgcccctgacacgcgtgcccgcgcgccatggccccccatctgcagttggagcgagtcgctgcccccatccccatgttcgctgcttcgcgtccattggggccgcccgcgaacacgaacacgcgcccatccagcacctccacgtgcgtgggacgcgggcgcatccctgggaccgatttgccaagaacggggaacgtccatgcggtactgccgttcatgcggtcataggccgcgaccaggccattgaaagccgtgacgaggagtggactcgactggtgcggtgcgttcatgccgcgatccgttaccacagaagctcagagcccccgcctccgcccccggcctgagcgcacggcccccacggtgccctcggagaaggccgcgccatgggcgttgccccccttggagacggcgccttgaatacgtactggcccgtactttcgtagaatcgcgagtgagtccgggcacttggggcccctggggatgcagccacccaccccgcatgtcgtccggactcgcgccccgcatgagagccggcccggcgctggagtccgtaacgcacccgcccagaacgttggtaggactcccaacctgctggggcgcgcctaggaaactcccagattgcgctgaaatcaactatacgcgctccgtacaaatttcgcggcacacgagcgacccggtcggcgaggtcaggctcccgggacgtctctggaggattggatggagttgtcgagtctcgagtcgagtttctgggcaatcgcaccgggcgtggtcggcgccgtggggctgctcttcgctgcggtcttctacttccgcgtcaaggcgctcccggagggtgacgcgacgatgaaccgcatcgcgggctacatccgcgacggcgcgatggcgttcctcgtccgcgagtacaaggtgctcgccgcgtactgcgcggtcatcgcggtgctcatcggcctggcgctggggccgctcgccagcgggagcttcgtgctcggcgcgttcctctcgctgctggccggctacatcggcatgaaggccgcgacgttcgcgaacgtgcgcaccgcgcaggccgcgcgcaccggctccaagccgaacgcgctgctggtcgcgctcgacggtggcgcggtcatgggcctcgccgtcgccggcctgggcctcatcggcatgggcggcgtctactacgccttccaggggcatccgcagctttcccccgtcctccactccttcgccgtgggcgccagctccatcgcgctcttcgcccgcgtgggcggcggcatctacaccaaggccgctgacgtcggctccgacatcgccggcaaggtcattgagaacatccccgaggacgacccgcgcaacccgggcgtcatcgccgacaacgtgggcgacaacgtgggtgacgtggccggcatgggcgccgacatctacgagtccatggtggccgcgattgtcgccgccatggccatcgcgctgaccgccagcgccgcggacctctcccgcctcgtggtggacccctccgcgatcggaagcgcgaaggtggcgggcgtggtgatcccgctggtgctgtccgccgtgggcctggtggtcagcctgctgagcatcttcatcgcgcgcgcgctcaagcacatgaaccccgcgcaggtgctgcgcagcgccctcatcctgcccccggtcatcctggtgggtctgtccttcgtgatgatgcaggtgttcggcctgtcccaggccatcacggtggcgctggccgcgggcgcccttcggcggcgccatcatcggcctcgtcacggactactacacgtcgtccacgccggtgcagcgcatcgcggaggcctccgtcacgggtgccggcaccaacctcatccgcggcctcgccgtcggcatggagagcgtgggcatcccgatggccaccatcgccgtggtggcctacatcgccgaccaggcgcttggcctgtacggcatcgcgctggcggccgtgggcatgctgggcggcaccgccgtggtgatgaccgtggatgcctacggccccatctccgacaacgccggtggcatctccgagatgtccggcctgggccccgaggtccgcgccatcaccgatgagctggacgcggtgggcaacaccacggcggccatcggcaagggcttcgccatcggctcggcgacgctcaccgtcatcgcgctcttctccgccttcaacctcgaggtcaaccacacgcgcatcgccgctggcctgccggagatgagcctgcaactgaccaacccgaacgtcatcgtcggcctgctgctgggctccatcctcccgttcctggtgggcgcctccacgatgctcgccgtgggtcgcgcggccggtgccatcgtcgaggagattggccgtcagttccgcgagattccggggctgatggagctcaaggcggacccggaccccaagaagatcgtcgacatcgccaccaagagcgccctgcaagagatggtcttcccgggcatcatcgccgtcgccgccccgcccctggtgggctacctgctgggccctggtgcgctggcgggtctgctggccggctcgctcgtcgtcggcgccacgatggccctctacatggccaacgcgggcggcgcgtgggacaacgccaagaagttcatcgagaagggcaagctgccgggccacgcgaagggctccgcggtccacaaggccgccgtcgtcggtgacatggtcggtgacccgttcaaggacacctccggtcctggcgtggccatcctcatcaaggtcatgagcgtcgtgtccctgctcgtggcctcgctcatcgcgctgcggtagtcgcaccggtgcagcgcctcggatgccgaggcgccgcgcccccccggcagctcgcaccgcgcggccccatcagccgcgcggtgctccggagcgctggagggaagccagggcaagcctggccacctggtgtccccaccccgccggcaccgcgcctcctggcagcgggccggacctcggggggagcgaaccgaccatccc

SEQ ID NO: 646 - DNA, 4874 bp, Myxococcus xanthus
gcgctcatggggcccctggccgcgctgggggacggtttcttctggctgtccctcaagcccgcgacggggcgggtgagcgccgcgctggttccgctgctgggcgtgtgggcggtaccgctgttcctggtgctctacaatctggtgcacctgctgctgcgggtgcgcctgtactggctgggcctgacgctgggcgacaggctggtggaagcagtggctcgcgccaacctccccgcgcggggggcctggctgcgggcggtggcggcggcgagcgcggacggtgtggccgcctggctcgcggtgtcattcggggccaacgcgggtgggctgtatgcgcccctgctggcggccggatgcctggccctgggggtggcgtcctacgtgctggtcagccgtcgggtgccgaactacgtggtgctctatgtcgcggcgggcctggcctgcgtggcgggagcattcctctaaggagagtgggagtcgcgatggcaagcgtggtcgaagggacatacgagatcatcaacgcgctggggctgcacgcccgggccgcggcgcagatggtcaaggtggccaaccggttcaagagcgaggtcaccatcgaagcccagggacagcgggccaatgccaaatccatcatgggcgtgctgatgctcgccgccgcccagggcacccaggtgaagctcacctgcaagggcgacgacgcggatgcctgtctccaggagctggcgaagctcattggtgaccgtttcggcgaggcgcagtgaagggttggtcggaaaacgcggtagacgaacaggattggaaggaaccgtgagcagccaggccacccccactctgaggttgttgggcatcggcgcctctcccggcgtggcggtggggcacgccttcatcctggaccgcaaacgcatccgcacacccaagctgcggctggcggaggcggaggtcgagcccgagcggatgcggatgaagacagccattgacctgtccgaccgccagctcgccgagctgaaagaacagattacgcgcaccgagggcagcgaccacgccctcatcctcgaggcgcaccggttgatgctccacgaccccatgctcgtggacgaggtgaaccggctcatcatcgaggaccgcatcaacgccgagtgggccgtccggcgcgtggcgcgcaaaatcaagcacctgttcgacaacatccccgacgagtacttccgcgagcgccgctcggacgtggactacgtcgcggaccgaatcatccgcaacctgatggggcaggtggtggatgaggaagtggaagtccccgcggaggccatcgtcgtcgcgcatgacttgtctccggcggacgcggcgctgatggcgcgcagcggccgggtgggcggcttcgtgacggacctgggcggccagacgagccacaccgccattgtcgcccgcgcgcgggagacgcccgcggtggtgggcgccgggcgggccagcgaacagatttcgccgggcgacctggtggccatggatggcatccggggcgtggtgctggtgaacccctcggacgagcagctcgccgtcttccgcgaggagcagcgccgctaccaggagagcgagcggctggccctggcgaccaaggacctgcccgccgtcagcaccgacggcttccagattcgcctcaacggcaacatcgaattcctggaggaaatcccctcgctgctggcgcacggcgcggagggcattggcctgtaccgcaccgagttcatgttcctggaccggaagacggcgcccaccgaggaggagcactaccgcgcctaccgccaggtgttggaggccatgggcgggcgccccgtcaccatccgcacgttggatttgggcggcgacaaggtgccgggcaagacgaagcacgagaaggaacccaatccggccatgggcctgcgggccatccggtactgcctgtccaaccgggagctgttccgcacgcagttgcgcgccctgttgcgcgccagcgtgcacggcaacttgcggctgatgttccccctcatctgcggggtgagtgagctgcgtgaggcccgcagcgagctggaggcctgccgcacggagctgggccgcgcgggtgtccccgtgggcaagcgcttccccgtgggcatcatggtggagacgcccagcgcggccaccatcgccgaccggctggcccaggaggcggacttcttctcggtggggaccaacgacctcatccagtactcgctggccatcgaccgccagaaccgtgaggtcgcctacctctaccggcctctccacctgtccgtgctccggcaactgcgcggcatcatcgacgcgggccgggcggccaacatccccgtgtccatgtgtggggaaatggcgggagatccgctctacacgctggtgctgctggcgctgggcttcgacgagctgtccatgacgtcggggcagattccggtggtgaagcgcttcctgcgccgggtgagccgcgtggacgccatggagttgctgcagaacgccatggagctgaccacggcggaggaaatcgagcgctacgtgcgcacggagatggaccgccgcttcagtgagacgatggagccgggcgcgccgggagtcggcaacgcggagcccgcggaccacgagccctccgagcatggggcttcgccctcggggcggaacacggcctgaccccgcgcccgtgagggcggggcggacggcggtggcttgccaacatggctaccggacccgaaggggattccggatgcgagccgtcgtgtgcaacttgccgggacgagcacaggggctcgccccaggagcaagcatgttcaatcccgccaacatccagatgggtatgaccgcgagagaccgggacggtgagaaggtgggcaccatcatcgccgcggacgcggcgggtttctttatcggcagggggcgcctcttcatgcgcgactgccggctgtccttctcggatgtggcggacatcgacggggaggacgtctacctgcgtgaggagttgtctcacctgccggacctcaagccggaggccctggcacccgcgcggcggacctccaccacggcgggcctgccgctccagcacgatttgacgggcggactgggttgggcggacgacgacaccgacgaagaggcccaggtatcgtctccggcgcgggagtcctccggcatgcagcagtgggccagcggggagggagaagcggcgcctcgtcgcgaggcgccttccgcggatgcgcggcggtacacgcgccactgagcgcccccgccgcggtgttgctcaccagctcgacttgatgacgccgggaatctctccccggagcgccttctcacggaacgcgatgcgagacaggccgaagcgcctcagattgccccgaggccttcccgtcagcgcgcagcggttcgtcacgcggttggggttcgagtcgcggggcagtgacgccagcgcgtcctgcgccgcgcgcctttcttcataggacagggtgcggtcgcggatgcgcgccttcagcgccgcgcggcgcttcgcgtacttcgcgaccagggccttgcgctgcgcattgcgcgcgaccttgctcttcttcgccatggctgtgtctttcttgctcaggggggcgggggacggacgacgttcaggtgggacggcggcgccggggattcgtccgcgtcgtccgccccgacgtcgacgagcagcgggggcgcgaactcacggccatgaagccggtgccgcgctgcggcccgaaggcggagcggccgggtggggcgtccatcgcggcggcgcatcagagcttcactccctccgcgagcagctcccgcaccacgcggtcgatgccgcgctggttgatgatgcggatgccgtgcgtgctcacccgcagcttcacgaagcggttcatgctgggcacccagaagcggtgccactggaggttcggcagcgagcgccgcttgtgccggttgttggcgtgggagacggtgttgccgacgagcggccgtttcccggtgacctgacagaccttcgacatggtggggtcctctagagtgcttcgatggagagaaagagccgccgccggccactgctggcgatggcgggggagcggtgcacggcgccgttgccctgattgccgggccaggactcgcccttgaggagcgccacgtcgaagcgctccagcgcgtggacgggcgcgccgggccgcgtgacgtcacccgaggcgcccaatgcgccgcgcgcgacgtgcgcgttctccagccattcggtggccggccccgcgtaggtgcagagcagccggacgcctacgcggtccacgtggaagcgcgggcacatgtcgctggccaggatgtgaaggcgtacgcccagctccgccgcgccgaacaggtccgcgtagaggtgcagcaggaagtgcacgtccgtgagccaggcctcgaacgggggcccctggggcagcccatccaaccggcgccgcaaatctggcgcgtcgccccgtacgcgggcgatgacgtccagctcgcgggtggccgccacgtcgctgagccagtgcgccagcggcgtgtccaggccccggcgccacacgcagaggttgaggtcctcgcggtagatgcccgcgagcgcctcgggcgtccatacgaaggcatgggcgggcggagcgagggcgcggagggcaggctgcatcaggcgtgctcctcgtcctcgtcgggtgcgtccgtccgctgcacctgccattcggggaatgggtcttccagccgcgcccagtgttggggtccgcgcgccagctcctctggcgtgagcagacaggcctccagcagccgggccatctcctcgtggtccgcgtcctgggtgatgaagacgatttcctgccgccggtcgccgtgtgggcccacgcactcgcgctcgatgtcggcgcgcg

SEQ ID NO: 647 - DNA, 4851 bp, Myxococcus xanthus
  unsure (1)..(4851): unsure at all n locations
ttccgtgctctaagggtgagcacccccagcgtgcgctgccgcgccaccagcggcgtcaggatgagcgagcccacgcccagctcgcgcgcggccgcgtacagccgtgccgccgccgtacgggtgtccccgggctccgcggtggggcgcgccatcatccacgggcgccccgaggcgagcacctccgccagcaacgtagggctgccttcctgcggagcgaagcgcaggagctccaacccgcgcggcgccgattgtggattctcatagagcacggccagccgccgcaccacgccgtcctcgtacgaatccaccgcgcagccatccgcgaagtgccccagcgccagccgcgccacgcccgccaccgtctcctcccagtccagcgacgccgacacgagcgcgctcgcgtccgccaggagccgcaggcgctgtccggccgcctccgcctgaagccgcgcggtgcgctcccgcgcgtacagccgcgcgcgctccagcgcctggccacacgcatgccccagaccggtgatggacgcccgctccagcaccgagaagcgccgcgcctccgagaagccgaggcacaacgtgccaaaggcatgcccttccacctgcaagggcagcagcaccagcgcgggcagtgcccccagcgagggcaccacgtcccgcaccgcggcgggcgtctccagccacaccggcgccccgagcacgggcaccacatctcgcgccgcggcggacgtctccagccacaccggcgccccgagcacgagcaccacgtctcgcgccgcggcgggcgtctccagccgcacgggtgcccccgcgccgtgccccggcacaccaccgattcgccagggcggcacccggagcgcctcccgctgcgcgttggacacccccagcgcggccttcaacgccagcgtcccgtccggctccaccaggtgcaccaggcccacgtcggcgcccaccgcgggaagcccctgctccagcaccacgcgcgccacctcgtccgaggacagcgcgccgcccaaggcctccgtcaccgcctggaagcggcgcagtcgcaacacctccgactcctccacctccgctggtgctgacagtacggactggcgcagtgtttacgccatgcgctcgcgcttcagtgacagcgtctgcagcttcaccgataggccgaagcgccgcaggtcctcctcccgtggctgccacgcctcgcggaagagcacgcccagcacaccggcggcgcccatgccggaggcgaagaagagcggctgggacagcaaggccgtggcccccaggcgccgcagggcgtccggctcggaggccagcagcgcgtctcgcgacacgtgctccaccacccggggcagccgaggctcacccggcgcgggcgcctgggccagcagttgctgagcccagatggcggccagctgcgcatccacaccgtgtttggcgagcgtgctcacgtcgcccgtcccgccccaccagcacaggaaggcacccgaagcccccagcgtggcggacgcctggcaaagcaattcctccagcaccgccaccaccggcggtgctgcggacagccgctccagggcccgcgacatgcggtccaccgcggctcccacgttttttccgggcacattcatgccccactccccccggcacggacgcatggctccctgcctcgaagcctcattctcccatgccggacgaagcgtggaaaccgcacagcgcgttgccctgaagtacgggattcccctcgggtgcctcagtgctcgaagacgcggaagaaggcgaagaagatttccagcacgatgagcaggacgatgacggcctccaacgtgtgggagcggtcgatgtccacgtcgcccttgagcaggccatacgtctgggccagcaactgctgcttgcgggtgacggcggcctgccacggcgggatgcgcatgcggcgcacggcgctctcgtagaccttggccaggtagaagtcgccgatgattttgagactgttctccacgcgctcgatgaactcgttgaggtccaccagcgtggagagcgtctgccgggccaggctgcggtaggggctgcggaacaacgtggcccacccatgccgcgcggcctgcaccttctcgtggatgcgggtgatgtgcgcgtccaaccgctcgtcgtagtagcggaactccaacaactgcgcgttggcgatttccaacaggtcggggatgtctcgcgagccggacggctcgtagacgaaggcgctgttccagtcgatgacgaccaggtcctggatggtgtagctgaagcgcgactggagcacggattcgctctcacgcggagacagcggcaccgtgccgctttcgcccaggagcagccgggccaggtccgcgcgcgtcaccagctcatccgcggtgggattgccccggatgtgctcggcgaagatgacggtgtagctctcgttctgctcccacaggtgcggcgcctgcgcggcgggggcgatggtgcggcgcacaccttccaccaattccaacgccaggtcctccaacgcctggctgtcatagagttcgtccgccatgcgcgtgagcgctttcaacgaggtgcccggaacgacaggcacctggaggatgatggacacggcgccatggtcgaacaggcgcgcggtgacatccaccatgacgggcccgtcccgcagtgccaggggccggcgtcccagctcataggccagcggcgggttgggcagttggatgtactgactgttctcccgtgacagcttgagccggcgcgagtcctccgtgagcacccggcgcgcgcgctccaggtccagctcctccgcgatgtcgaaggtgcggtagcagaggacgtacgccttatcgaagagcagcggttcggcagcgtccatggtgcgtgaagcctaacccgcgcccatgacaatccgtggccggccaccctggcatgccagacagtcgtcattccctccgcggagccgtaccggaatggacggccccgcgaggcgctggactgtcttcagtcgagcgaacgttcagggccggtggcgcggaggaggcggcgtcagctccgtgcgcacgtcccacagctccgggaagaagcgcaggtccaacgccttgcgcaggaagcccacacccgaggagccgcccgtgccttgcttgaagccgatgatgcgcatcaccgtcatcatgtggcggtagcgccagagctggaaacgctcctcggtgtccaccagcttctcgcacatctcatacgcatcccagtgcgcctcggcgtcctggtagatgcgccggaacacctccaccacctccgggctcttctcgtagggcttgcgccagtcacgctgcacgtggctctgcggcaccggatgccccatgcgcgacaggtggcgcaggaactcgtcatacaggctgggggattcgaacagccgctccagctcgccatggatggcggggacgtggcggaagggcatcaacgcctgcgcgtccttgttgcccagcaggaactccaccgcacggtactgaaagctctggaagccagagaaactgcccagcgtgtcgcggaactccaggtactcgttcggcgtgagagtctccaactcgctccactgtttgaagagcatcggttggatgtgcgccacgcgcgcgaatttcttgaactacgcctccagccggtccgcctgcacgtaacgcatgcaggcgcccagctagtggatgagcagcttcatccacagctcgcttgtttggtgctgcatgatgaacaacagctcgtcgtggtgagggggttgcgagcgcgtcacctgcgccgacaagacccggtcgagctgcagataatcaccgtacgtggtccttccggccaggtcggtgatgattccaggctccaaatcgcgtttgttcatgggcccgggcattcatgctcgtgcaagcccccacgggcaagtctctcccgcatgggcggaccccgattcctctcccagcaacagagcggaacgacgggggcgcggtcactctctgcccgggccggggcagcgtaccgctggctagcctgcgtgcccagcctgagcggcagccgccaacgccttggacgcggcgcgtccacgcggcagcttgatgtcgtccacgctgtccggatcggcgtagtccttccagtcgctcgggcgacggttggtcttctccagcatgcggagcttctggtagtgggccgcgcagtagcccttggtgcggctgggcttgccgcagccgatgatggcgcacgcgcgcgagccgtcagcacccgccgccgccggcttgcggccacgacgcttgccacccacggccgcgggagccgccgtcacggcgctgcgagccgcgggagggcgacccgggccacgacggccggccttggcggccgcgggaatctgggcgccgaacaggggcccgacgacctcggccagcggggccaggcgctcggccacgttgcggagcgcgtccaagtccgccgtgccctcctccagccgcgcgaccacgtcacgcagcggcttgagctggacctcgatttcattgcggatcatgtcgcgaaacgctttatccacggacattcgttgaatcctcacctggggaacgacaagagtaatgcagtactagggggggctgatgctcgatgcttgtgatgctgcccatacccttaccttccaaaaatggttttgtctaaaggaagagataaaagttgtgactgagcaacggaccattcgccccgttgtcgcaggtctcacctgtttcccggcggcaacagtggcctagccgtcccaatacagggactccagcagggggggcctnccccgccacctgggacaccctgggggcgtgacagcaagctcgtcccaaagtgggccgataaaataac

SEQ ID NO: 648 - DNA, 4772 bp, Myxococcus xanthus
agccccgcccccgccaaggaaggcggccaggggggccaccgggagggtgacttcggccagcctgctcttgttggcgggaagcccgatgcgctccaccaaaggggacgggtcgcgccccgtcgcgcgcaggtaggcgagcatcggtcccacgagctgggagcggacgtcggttggtggccgggaagggggcggcgtctccacgcgggcgcgacgctaccgtgtctcgggcgcggggcccaccaccctggagaggcgctggacggtgcgggcaggcctagagtgggggcatggacaatctggctcactcgctcgtcggtgcgtggatggcggaggcggggctgaagcgcaccacgccgctggccaccgcgacgctcgtcatcggcgccaacctgccggatgtcgatggcctcgtcaccctggcgggctcggatgcgtcgctctactggcgccggggctggacgcacggcgtgctcgccctggccctgtggcccttcgtcctcaccgggttgatgctgctctgggaccggtacgtgcgcaggcgcaggcatccggacctgccgccggctcgcttcggaccgttgctgatgctgtccacgttgtcggtgctgagccaccccgcgctggactggctcaacacatatggcgtccggctgctgatgccctttgacgggacgtggttctacggcgacgcgctcttcatcatcgacccgtgggtgtggctgctcgcaggcgccgccgtcatcatggcggatgcgcgcacgcgcaggtccgccgcggggtgggtggtgctcggtgttgcctccaccgcgctcatcatggttcccgcgttcgtcccatggcccgcgaaggtgatgtgggccgtgggtgtggccgccatcgtctggttgcggctgcgtgggacccacgtcctctccgcgcagcgtgtggcccgggtctgcggcgtgggcttgttgctctacctgagcgccatcttcgtgggctctcaggtggccgcaccgggtgcgctggaatggcttcgctcgcagaacctccctgtggagcgcgccatcgcgggaccgctgccggccaaccccttcgtgcgggacatcatcgccttggggccggaccgctaccacttcgtccgagccgacttcctggcgggcgacgccggccgcttccgcatcagtgacgccagcgtgccgcgtgaagcccagcccgggcctgtcatccaggccgcattgtcggcgccgcagattcgagggctggccaactggctgcgcctgcccacgtaccaggtggatgagcgcgccgatggatggcgcgtcaccattcgggatgtccgttactcgcgaatgcagagcggcggcttgggcacggcggtggtggtgctggatggtgcgctgcgccccgtccgggtcgaacggccgtaggggcatgtcctccgcctctcgcgatgccgggcgggaggtgaggccggtgtcagggccggcgcccgcgagcgatgcctggcaccccagggccgccgtccccgcacatgcctcacggggacggcgccatgtacttcagcgctgcaggtcgatgcgcacccattcgccctgggtggcgccggtcagcacggtgaggcccaggttgcggtaggcggcttccacgtccgcgcgctggtgggagagcacacccgccagcacgagccggtccttggtcttcgccacaatcagcggggccagctcgatgagcgtgttggccaggatgttggcgagcaccaggtcgaaggtgccctccacctgggtcagctccttgccggagacctcgatgtccggcgtgccgttctccgcttggttctcctgcgccagctccacggagatggggtcgttgtcggtggccacggtgcggcccgcgcccagcttcttcgcggcgatggccagcacgcccgtgccggtgcctacgtccaggacggcggcgcccgggtgctcggccatgtatgcgtccaccgcggccaggcacagggacgtcgtcgggtggtcgccggtgccaaaggccatcttcggctcaatcacgagctgcacggtgcccgcgggcgcgttcgccttgtcccacggaggaccgacccacaacctgcccacatgcacggacttgatgagcgacttccactcgttgctccagtcctgctggggctgctcatccaatgtgagcttcgcctcggggaaggacgacgccacctcgtcacgggcggactcggccgtgtcgcgctcgtcgaagtagccgatgatgatggcctcgccagggttcggtccgcgcacgcccggcatgaggggcgcttcgcggtcccgcacttcgaggcccagcgcgcccgactcgtggaggaggtcctgtacggcctcggacgcttcctcgggcaactccactgtgagtgacagataggtctgggacatgcgggccctttaatcccagcgtggctagcgtggaagcgccgtgagacgcctcattcgctggtggcccctgatctgcctgactgcctgctcgggtccggacgcgccggatgccgcggtctgtcgggatgtcgtcgtccggctttgccgctcggcggcggcctgtcccggcgtggcggtgcagcttgacctggggctgggctgcgaggccaccctcctccggcggacgggctgcgaggacgacgcctttgccttcgcatccctcacgcgggagcgcgtcctggagtgccgcgagcctctgctcagttggggcacgtccacggaccatcctccgacctgtgcggacgcgacgcggtttctcaccgagtgcccggacgttgcgggcttcttccgggagggccaaccatgaagcgtctgggggcggcggtgttggtgatggcggtggggtgcgcgccgctggacgtggagcggaggacggagcgcgggccgctcttgcggacctacgcccaggagaaggcgctgaacgagcgcatccccttcgccacgacgcaggtgcagtggccccagctcacgctggcgttctcctcgtcggacatctgccgcaccgagcagcatggggagtacgcggaggacatcatctccacgcacagcaacacgggcgcggcggcggccgtgagcaccggaggcattctcacggtgctgggcgggacgctgctggtggggcgcacgctgttctcggacacgccgaaccgctccgccatcgatgaaaagggccgttacggcgcctccagccgcgacgtcgccacggggtggggcttggggctgctcatcgccggtgtgcccgcggtggtggccggcatcgttcagctctcccgtagcggcgagacgcgggagacgcgaaagacggatgagctgctgtccttgcgcgaggtgccctgccagcccaagcccgtggacggcgtggtggagctggcgggaggaccgggcccgcagcctccgccccggctcaccctcaacggggcgctggtgctgacggcggacgagattcggcagctgtccttcgtcggactggcgctggatggtacgcccgtcacgctggaagaagaggacctggaccggctggagaccttccgcacctgcgcgacgctgctggccacgccggtggacccgcaggcgctggctggagaggcgcgctcacagccggaccgcctgcggatgaagcgggagctggcgcggggctgcacgacgcttccgggcgctccggcacagcccctgctcgaagccatcgaaggcgccctcgggagcaccgccctctaggggcggcgtgtcctcccgagggactccgcgtcgctacggcccgacgacggccagcgcgctgcggtcgaagttgatgattttgcgcgccacctcgcgcacgtcgtccgccgacaccttggcgacgtggtcggcgtagtggaggaagttctccaggcccaggccgtagcaggtgtccagcgccagcagcgccgcgcgcgagccgttgcgctgcaggccaatctcgtgcgtgccaatgaggtgctgcttggcgcgcgccagctcctcggccgggatgggctcgtcgcgcacgcgctccagctccgcccggatgccggccagcgccgcgtccaccttctccgggctggtgcccatgtacgtggcgaagtagcccggatccacgccttcgatggcgaacgagctgacgctgtacgccatggagcgcttgtctcgcagctccacgaaaagcccgcccggcctgtctagacagcaccgggaagagcacctccagcgcgtgctgctgcgggtcgcccacgcggatgcccgggaagccgagcaccaggtgcgcctgggcccgcgccagcaccttcttcgcctcgcgaggcccctccaggggcgcctccagcgacaccttcggcggcggggccgccttgccgcgcgacgcgccgaagtactcgcgcgccagggccatcacctcgtccaccttcacgtcgcccaccacgctgagcgtcagttgcgacgggtccatgtgcgccgcgtgccacgcgcgcagcagctccggcgtcagcttctccacggacgcctgctcacctgtggtgggcatccggtaggggtgcgtgcggtagatggtcttgctgaacaggtcgaaggccacgctggacggcttgtcctcgcgcgtgaggatgtcctggagcagcagcgtgcgctcgcgggcgacctcggcctccgggaacgagggattcagcaggcagtccgcgaagaggcggaaggccggctcgaagtggcgcgacaggaactaaccgcgcaggcccaccgagttgcgcccaccctggccacccacgctgccctcgtacg

SEQ ID NO: 649 - DNA, 4251 bp, Myxococcus xanthus
agcccttggaggccttcttcttgcgcttgagcagggccacgacgaatgcgagcgcgggcaccgggggcacggccagcaccacggcgggccgctccagggagggcaccgtcatgaaagcggacacgtccgcggtgcgggcgcgcacggcgtcggagaggtcgcctccgtaaatccaggcgatggccatcaagctcagcgcattgccaagcagcgtcttgcgagaaggaagtgtcatccggcgagcgtgcgtgcggggtcggtggcggcggcgcggcggctggggaagtacgcgcccacgagcgcggcgacgaggcccaggacgacgcctccggccaccaccggccaggggaaggagaagaaactgtcgggcttgaaggggaagttgggcaggtaacccgccgccaggcggttgacgcccagggccagcagcagcgcggcgatggttcccgcggcgccgcccgcgagccccaccacggcggcctcggccaggacgatggcgcggatgtccgcgcgagaggcccccaccgcctgcatgacgccaatctccttggcgcgcgcccggacggaggcagacagcgcgtgggcgatgttcaccgccgcgaggatgcagatgagcagggacagcagcgccagcgcggaggtcgtgagcgccaccgccgcgcccgagttctccgccatccggcgctcctggtcgtcgatttccagccccatgcccttcaccgcgtccacgatgacaggcacctgcgacgggtccgtggcgaccaacgtgacaccggagtagttctccgagtccacgccgaacgcgcggttgaggcggatggccgcgtccaacggaatggtgataccggccaggagtgcccggtccgacgcccccaccacctgcgcctgcccggactgcgtgggccccgacgcggacgccgcggccacgtaggagcggttgaactccaccgggaagccgaagcccaccagcatgttggcggagagctgcggcagcttgcgcgccggggcgaacgtcttgttgtacagctccaggagccgcgtggacacgagcgccggaatcggctgcccctcccccgcgtccttgaactcgcccatctgcacgtcgccctgcaccagcgccggctccacgcccagggccagcacctccatgcccatgcgaagccgggtgccgaagaagacgccgtcgtagcgcgtcaccgcgggcacgcgcacgttcatcttccggtaggcggcctccacgccgggcagctcgcgcaggcgctccacggtgggcgcgtccagcttgccaccgcccagcagcgagcccagcgacaccgccggaggcaccacgtccaccagccgcgcgtccgtggggaagaccttctcccggatgacgcggccaacgcccaggcccaggcccacgaagaacaccagcgcgcccacgcccatggcaacaccgaaggcggagaagaacgcccccttgcgctcgcgggcgaggctcagccggaccagccgggacagtgcgtccagcctcatggcgcacctcccgtggccacctgaagccccgcgcgctcctccacgagctgcccgtccttgagccgcagcacgcgcccggccgccgcgctcatccgttcctcatgggtgacgcacaacacggtgagtccttcgcggtgcagctcctggaacaaggcgatgacgcccgtgcccgtggccgcgtccaggttgcccgtgggctcgtcgcacagcagcaggcggggcttgccgaacagggcgcgggcaatggctacgcgctgccgctcgccaccggacaggcgcaccggcgcgcggtccttcttcgcgcccaggcccacgcgctccagcagcgcctccgcgcgcttgcgggcatccgggggcgccacgccgaagtgcgacggcaacagcacgttctccaccgcggagaggttggggatgaggtggaaggactggaagacgaagcccacgtgcgtgttgcggaagtgcgccagggccttgtcgcccaggcctcgcagcttcacgccgcctacgctgatgtcgccgcggtagtcgacgtccaggccgcccagcaggtggagcagcgtggacttcccgctgccggacgagcccaccaccgcgacgaactccccttgcgtcacgtccagcgacatgccgtcgagcacgcacaccggggtgccgtcgccgtccacgtacgtcttcacgacgtcccgggcttgaatcacggcgcggccgacgggctggaggtggcggcggagggcgccaggcgcagggacagctccgcctggagcgccttgtccttgcgggacacggccagcgtcacggcgcgcaggtcatccacggcctccagccagcgcacggtggtggccttgatggcgaagccgccaatgccccaggcctccgacggcaggttcttcaccgcgtccgacaggcgccgcaagtccagcacggcgctgaaggccgcgtccttgccagcgtccttcaggtccgcggccaccggcccgtcgcccgagggcttcgcgagcgaggtcagcgtggactccagccgcgccttgggcgaggccaccaccagccggccgttgggcgcgagcgcgaagtgcgcgccttcgcccgcgcggtaggacgtgaggtacacgcgctggccgctcagctccgacgcctccaccttcgcgccgaagttctccgcgatgcgcggcaactgctccagcgtggactgcatcttcgcagcgtcctcggcgtccgcgagcgccaccaggtggacgaagcggaaggggttggtgcggcgcaaatccagcaccggcatgcccgcgcccagattcacggtgggcgacagtgacaggcccagcaccgtgcccggcttgaggttgtcgagcagctccgttttcacgttgaggccgctgttctgcaccgcccgggtcaggtatccgccggccagatagggccacacaccgtcgaggtgcgacgcgtccccacggaactgggccaccaggaagctgtcggcgggcagcgcggtgaggagcgtgctcgcggcgggcgccaccgcgtccagcgccgccagggacgcctgggtatccggccagggcgcgtccgcgttcagcgtcaccgcgcggtcctcgatgcggcccgtgagcgtgacgccctggacggtgcccggcggcacgagcccggcgccgcccgggagccagacgtggaagtcacgctgggccgggagccgttgcagcgacgccgccatcaccggctccttcgcgagcgagcgctcttccggctgcgtggccagcgtccccaacgtggcggcggtgggccccgcgccgagcagcgcgaagcgcgtccccttcacgaagaagatgcccagcgcgggcgtggcgctgccgggccggctgaaggtgaccaggtccccaccgtccacggaggactgcttcttgtcggacgcgcccaggcggctgcgcgcgaagttgccgaacgtctccttgagcttgcccgcgtccttgacgcccaccacggagatggctcggtggcccccgaggaacgccgcgcccgcgccgagctctggcgcgatgccggccgtttcgagcgcctgccggctgcgcaggtccacgccaatctggcgcatcaccgcggagacgtagccttccgcggtggagaagttctggagctgcgcggcgaacgaggcggccttcagcttctggaagcgggcgagcttctctcccagcgcgcccaggtcattgatgaccacggcggcctgcgcgtcgcgcggcaggtagcgagccacccccacggccgcggccggggcggcggggtccacgtccttgccacaacgggagcagcccgcgacggcgagcacgaggaggagggacggaagccagactcggcggagcatgcgggcacctcaggctgcctggggcggagagtcaaccgattcgtggggcccccagagccagtccgggagcccggaggatgggcaggcgacggcccccggccgtggagcttcaacgcacccggctgccgtggggcagcgggccccgcgtctcctcggagaactcgaggaactgctccatctgccgcacggattcctcggtggcctccgcctccgcgctcagcatggtgagctggcggttgacgacctccgggtcgcggatggccacggattgctcgtgcgtcagccgcatcaggtcctcgatgcccgccagttggtggctcaccacctcgcggctctcaccggacaagttcgaagcgcgccagccgcttgcggaggatgtccacgcg

SEQ ID NO: 650 - DNA, 4458 bp, Myxococcus xanthus
gggagacaccggcgggcgggcagcaccacgaaggcggagggcaccatgtgcggcggcagcttgtccgccagcgcgtcgcggagacggctcaccgcctgtgcactccgagccccgcgcagcggatcgctggcaaggccatcccaggaggtgacctgctttggttcgggggacaggtcgagcgtgcccacctcatcggggtgcgcgaacaccacgtccagcgcaccatcccggtgcgcggaggcccagctcacccggacctcgtagccgagctccgagcccagaacgtacaggtcctccggctccacgccgcggggccccgaccagtcatgcagggcctcgcgaagcctcgccaccgtgggcgggggcgtggcggacagcagttcaacgagccgggtgggttccaggactcgcgcgttggggagcccccgcacggccagcagtccgggccgggcgctcagttgttcgcgcagtccgtccagggtgagtccggcgccgtccacccagtccggcttcgtgcgccgggcgggagtcctggcggcgtcgccgacgtggaggatgacctcgtagcggaagcggctgagctcgttgtcgtagcgcccgtgcttcggcagcacctccacgcgctggatgcccgggatgcgctctggcagagcggtgaagaaggcaggggagaggaccagttccttctccgccaggatgtcgcgctgaacacggtaggcgaactgggacgtggccccggggcccgcggtccggtggaggcgcaccgaggcacggaaggcttcgagcagctccaggctccgcacgtcgcccaggaacacccggccccctggcttcaggacgcgcacggccccgcgaagcacgtcgagcaggaactcaggactggagaagtactggacgactgagttgatgacgactgtgtcgaacgagcccggctccagggccgagaagtcgtccacgctctggtgcagcaggtgcacggaatccagagcgccgcccatgcgctcacgctggcgctcgatgcggtccagggcgggccgggcgaaatcgacgccccagtaggcctcgcagcgaggcgccagccggtacaggaggaggccggtgccgcaccccagctccagcacccgcttgggctggaagctgaggatctgcgccacggtggtgtccacccactcacgcatctgcgcgggcggaagcgactcgccggtgtagctgtcctcccagccgacgatgttgaaggtcgggtcttcgctctccgtcgtctcgcgtgcgtaggcctcgtcgtagatggcctgccactgggaggacgcgtcgacctcctgcgctgccgccgcatcgtccaggacgacgtaggccaccagccgctggtcacccgtcgaatcctcacgagccagcaccacggagtcgtggacggccgggtccgcggcaagcgcggcctcgatttcacccagctcgatgcggaagccgcgcagcttcacctggaagtcggcccggcccagatactccagcgtgccgtccggcaaccaccgcgccacgtctccggttcggtacaggcgcgcgcccggaatgccgctgaaggcgtcggggatgaatcgctccgccgtcaactgcggccgctgccagtacccgcgtcccacctgcacgccgccaatgtgcagctcgcccggaatgcccaccggcgccggctgcccgtgcacgtccagcacgtacagcactgtgttcgccaccggccggccaatgggcacccggtggaagtcctctccacgcgggcagggccagtacgtgacgtctactgctgcctctgtcgggccgtagaggttgtgcacgcgcaccggggcgggcagccgcgcgtacgccttcttcaccaactccgcgctcaacgcctcgccgctgcacaccacccgccgcaggcttcccagtccctccagcccgggctcctccacgaaggcgcgcagcatggacggcacgaagtgcaccgtcgtcacgccctccgccttcatcagcttcaccaggtacgccggctcctggtgccctccgggccgcgccaccaccagcttcgcccccgccagcagcggccagaagaactcccacaccgacacgtcgaagctgaagggcgtcttctgcagcaccacgtccgtgccgctaagcccgtactcctcctgcatccacttcaaccggttgacgacgccttcgtgcgcattcatcgcccccttcggacgccccgtgcttcctgaggtgaagatgacgtacgccagcgcctgggggcccacctgcaccgccggcttcgtcaccggctgcttcgccacttctcccgctgcactgtccaggcacacgactcgcgcggcgctgggcggcagcaccgtcttccacttctcgtgcgtcagcagcaccgatgccccggtgtcctccagcatccaccccagacgctccttcgggtacgccgggtccaccggcacgtaggcagcgcccgccttcagcacgcccagcagcgccaccaccatgtccaccgagcgctccaggcacacgcccaccagcgactctggggccacgcccaggccacgcaggtggtgcgccaacttgttggccttcgcgtccagctcccggtacgtcagccgctccgactcgaacgccaccgccaccgcgtccggcgtgcgctcgacttgcgcttcgatgaggtccgtcagcgtgccgaacggaggcgcttcaacgcggggattccagccgtggagcgcgtgctgccgatcggcctcgctcatcaacggcagggtggtcagcggcgcctccggcgcatccaccattccgcgaatcacgtgctccagatggctcaggagccggtccgctgtctccgcatcgaacaggtccgcggagtacttgcagccaatcagcaggccttcaggacggtgcgtcgcctcgaaggtcatgtccagctctgccgtgtggttgtccaccagggacacgtcgagcgtcagcccgccgcgaacggacaacgcgcgcggcagctcgtagtcgtcaaggatgaaccccacgttgtacagctcgcgccgctccgccccaggcagttgcacggccgcgagaatctgctcgaacggcacgtacccatgcgcgagcgcccccagcatccgcgacttcacctcggagagcatgtccgcggacgtcgcggcttcggacaggcggacccgcaacgggatgaagttggtgcagtcgcccatcagctcgcgagtgcccgccgcgtcacggccggagatgacggtgcccacgacgaagtcggactggccgctccagcggtgcagcaccgtggccagcgcggacatcacgctcatgaacggcgtggcgccctggcgccgtcccagcgcatgcagccgggccatgagagacgcgggcagcaggcgcaggcgacgagcaccgtggacggacaaccgctgcggccgagaccggtcggtgggcagggccagcaactggggcgcgccggccagcgtctccttccaccacatcagctccgtggtgagcgcatccggcgtgaagtacgcgcgctgccacgcggcgaagtctccatactggaactccggctccgccaacggcgacggccgtccctccacgaacgcgccgtaaagggccgccagctcgcgcatgaacagcgcgacggacgtgccgtccaccaccaggtggtgcaggacggtcagcaggacgtggtcctccgggccgaagcgcagcagggagcaccgcaccagcgggcctgcctccaggtccatggggtgttgcgcatcgagcactgcctgggcttcgagcgtcgcctgccgcgcgtcacccctcacgcccatgaagtccaggcacggcagggagacggggcccgccgcctgcacgcgctgaagcagcgcgccatcgcgggacgcgaagcgggtgcgcagcacctcgtgccggcgcagcacctccgacagggcccgttccagcgccgccacgtcgagcgtcccgcgcagcgtcagcgccaccggaatctggttcgacgtccaggatggatccagttggaggaggtaccacagccgctcctgcgtgaaggacgcgggggtgggcgcgtcacccgcgggacggcgctggagcgggggcaaccggcgccccgtgccctccgcggacacggactccgccagcgaccgcagactcaggtcctgcaacagcgcggcgatggagacgcgcacccccagccgcttctccacgcggccttggaggtcggcggcccccagcgagtccaggcccagcaacgtcagcggcgtgctggcgtcctgtccaacggcctcggcgccgagcaccgccaccagttcctcacgcagcgccgtctccagttcctcctgggagagcgcgggctggatggccggagcgggcgcgggcagggacgcgggccccgagatgacacccgtcccgctgtgccacacgatgggcagcttgccggacaccaaggcggcacggcag

SEQ ID NO: 651 - DNA, 3296 bp, Myxococcus xanthus
aacaccaaggtgcgcatgtccgtgttcacctccacgggatacagcgcgtccaagattccgacctacgaccgcgacgtgctggccagccggggctacatgcaggcggcgaacgactggcggaacatcgagatgactggcttcgtgaaggtcaactcggtgtccgacgtgtcggacaacttcgcgtggtacgcgcgaggcggcaagcacaacgacaaccactcggggtgcgagggcagcagctacaagggttcgctgcactatgacggccgcgtgcgctggcagaaggagacgtggcacgtctcctacaaccaggcgtcgtacaagtccggtacctcggcgctgcgcggccgctgggtgggcttcaagtcggtgatgcgcaacaccaaggtcaacggaaaggaggccgtgcgcctggagatgtacctcaacgagaacgccgacaagaagacctggaagaaggtctacgacatggtggactcgggcagttggggtggtgacgccagccactgcggcggcgcggtgaacgcaatgcccatcacttggggcggccccatcgcggtgttccgctgggacagcgccaacgacgtggacttcaagtggctgtccgtgcgcgaaatctcgccggagcagtgagccgctgaccacgtgacgcccgccccggtgctccttccttggagtgccggggcgtggcgttttcagggcattcgatgagcgccatcaccggggtccgagccctccctggattcccccagtcgcatggaatgcccgcatggattcgcgagccctcccgcacgctgcgggagatgccctgcgggacgaggagtacgccgaaaaagtgttctccactgcgtggaggtcacggcccccaaggcggttgtgatgaaagcggcagcacatcatcctccgtagccgcaacaattatcggaaaggcttgcggttcatgcagcctgaccggttccggggggtatcatgaacacactgaaacaaaatgtacggatggcttgcggtctgattttcggctcgctcctgatggcggcctcgccaggctttgcccatccctctgatgcagccggctgcgcggaccgtcagcgtgagggattcaaagacatcgcgcgctggcctgacatcgcggggtgcgccggtgcatggcggattccgggcctgcacacggacaacccggggattgctccggcctgcccgggcctcgtgaccttcgacaccctgacccccgcctgcggccgtaagggcggtgacgatggcccgaagccgggtggcgccggctgcaacgtggccgacctctgcgcgagcgggtggcacgtctgcacgagcgacgccgaggtgatgagtcggtcctccaccggttgcaagggagccaccaaggcgggagaccaggccctcttcttcgccacccggcagagcaccaatggctgcggcgcctgtgccaacgggacctcgacaggtccggagtgcgactccgagagctgcactcctggctgcctgcagaccgcccggacgtcgaacgacttcttcggctgcggcaacttcggaaccgaggccacgtgtggccccctcaaccggttctcggagaacctgtgctcggggcttgaaggctcaccatggtcatgtaacgccgcgacgaccgccgacgacaacggcctctgcgaggcctacacggccatcaagacgggctcccgctttggcgggtgtgctctgctgccgcgacacctgcaccgattccgacaaggacggcgtctgcgatagcgcggaccgctgcgcgggcaccgtgctccccgagtccctgtccacgggctccctgccgggcatgaaccgcttcgccgatactgacggcgatggcaccttcaacacgctgtcgtcgaacgacggcgagccggagcgccgctttaccctcgtggacaccgctggttgcaactgcgcgcagattgtcgatgcgctggggatgagccaggagcacgcccaatctggatgcagcctcagcaccctggagaactgggtgtcgcgcgtgaaagagaactaggggctgtccctgatctcgtgttcgagagtcgacccggcgtgccggcctttctggcacgttggggcagggcctcaatcggagttgctgcctggcgctaggcatgatcaacgcgggctgtgcgccgacatgaactgagcgatgtcgagtggagccgcatcgagcccctgctgggctccaggacgggccctcgctcgaagcgaggggaccgtgacttcatcaacgccgtggtgtggcgggtgaagaccggggtgcaatggcgggatttgcccgagcggttcggtcactggaagacggtctacaatcggttccatcgctggacgaagactgggcgctgggaagccatcttcaaggcgctgcggctcgatgtggatgagcttggctcccttgctgacgcatcggtcgtccgggcgcatcaggacgccgcgggcggaaaagggggatccgaagcaatgctttggggcgttctcgaggaggtttttcaacgaaagttcacgccgtcactacgacgggaggtaagccgctccacgtcgcgctgacgcccggccagcagcacgagtccacaatggccgaagaacttatggtgcacgccgagggcgccgctttcattgcggataccggctatgacgccgaccgcatccgcgccaacgttcgaaagctcgggatgaagcctgtcatccattcaaacccgagccgtaagcgggcgttgccgttagaccgcaccctgtaccggatgcgctaccgggtggagtgcttcttccacgatctcaagcgctttcgggccgtcgccacccgctatgacaagacggcgacgagctacctcgccgtcctgcacgtcgcatccatgcttctttggctgcgctaatcagggacagcccctagagcgggtccgggtgggctgactaggcaatcgccacgtcgagaatttccggggcctccgtgttgaacccgagccgttgaaggagcaggccggtcgacaccggtggacatcgagagctgttggcaacgctcgatacctcacgtgatggcatcgcccgcgaccaggtccgagctgcatccgcgcatcacgatgccgaggtcatcgccgcgttcgatgaagagggcgttggatgatgtctggtaggtcaatggaaggggcatcgtcgccttccttgggcttgccgcgccaatccacccgaaggagcggcttgtccggcgtcaacgcccagtcgatgaggcggcgaacgaagccggggcccacggcggtggagtcccaggtgggacc

SEQ ID NO: 652 - DNA, 5497 bp, Myxococcus xanthus
  unsure (1)..(5497): unsure at all n locations
gtggagagcatctatgcggtgggcgacatcaccgaccgcatcaacctcacgccggtggccatctcggaagggcgtgccctggcggagacgctcttcaacgacaacccgacgcagatggaccacaccaacgtaccgtcggctgtcttcagccagccgcccgtggcctccgtggggctgacggagcaggaggcacgggagcgtcatgggaagctggacatctatgtcaccagcttccgccccatgaagcacaccctgagcgggcgtaacgagcgcaccatgatgaaggtggtcgtggagcgcgagtccaaccgcgtgctcggctgtcacatggtggggacggacgcaccggaaatcatccagggactggcggtggcggtgaagtgtggcgtcaccaagaagcagctcgatgccaccgtgggcatccaccccaccgcggccgaggagttcgtcaccctgcgcgacaagcggccggaccccgacgagcggctggcggcggagctgggccgtgatgcggcggcgtctacccggcgctgaggcccgcctcgggtcgggtcaggggggcgctcgtcccgccgtccctgggcggctttcgcatcgattcgagaggtgatgaccccatgagtgattcatcgacggaggctccttccccaggcggcgcgcgcatccgggggctggagcaggtggaccggttgtcggtgccgctgccgcacggcaccgaggtgacgacgcgcgtggagcgcctggcctcgggaggccgccgcattccgcagggcgtcgtgggccgtgtggtccgcgcgcatgatggcggcttcgacgtgcagattgtcggcgtgggggaggtgtggttcgcgcgggacgagctggtgccccggcgcccggggcaggtgcagttcgcccagcgccgcgaggcggcctggagcgcgctgacgccatgtgtggtgctggagacgcgcgtgggcagccatgcatgggggcttgccgacgagcgctcggacgtggatgtgcgcggcgtgttcgccttgccgctcccctggcggttcggactggtcgacgcgcccagggatttggtgagcgcggatggcagcaccatgtactgggaggtccacaaggcggtggagcaggcgctccgcgcggacccgaacacgctggagacgctcttcgtgccgggcgcgaaggcgttggacccggtgggcgagtggctcctggcggagcgcgacgccttcgtgtccaaggccctgttcggcagcttcgggcgttacgccatgagccagctcgacaagctcacccgcagccagcggctggcggagcatcgggacctgctgctcgaatggctgtgcgaggagcccgcgccggacctggacgaggtggcgcgccggctgtcggccgtgtcgccccgcgaggcgccgtcggcgcaggacgcgctgctggcggcgaagacgtacgtgaagcagctctaccgctcgctctgggaccaggggctgttggcggccaacgacttcaaggcgctcaccgcctatgcgcgaagcggcggtcagcggcctccctccgcgcgcgagctgcgcccgaagaacgcctacaacctgctgcggctggtggccacggcgacagggtggctgcgcgagggcgcgcccgtcttcgaggcctctggcgcactgaaggcgcggctgctggacatcaaggcgggccgcgtgccgctggaagacgtgctgcgggacgcggaggcccttgcgccggacctggaggccgcgcatcgggagagccgtctgccagagcatccggactacgaacgcgcggaccggttgctgcggcgcgtgggcgaggagttggcgcggcgctgggtgctgaaggaacccgggccgctgggacgtgacgcgccggaggccccggccatggggtggagggattcggaatgaagggcactttgacggaacatcaacgcgcgatggcggaccgggtgctggacgaggagtcccggcaccgcgcgcatctggtcgtctccctgtccggagcgcacgcctatggcttcccctcgccggacagcgacctggacctgaagtccatccacgtcgcgcataccgcggcgttgttgacgctgcagcccgtgcatgtccccacggagcgactggaggtgctggagggcgtggaggtggactactcgtccaacgaactgctgccggtgctccagggcatcctgcaaggcaatgggaactacctggagcgggtgttgggggccatccccctgcgcgtgtctccggagctggagtcgctgcgtccgctggtgcgcgcggtgctgtctcgcaagatgtaccggcactacaacggctttgcccagggacagcttcgcgagtgggagaagagcggtttccgttcggcgaagcggctgctctacgtgctgcgcaccacgttgacggggacccatgcgctgcggactggcgtggtggagacggacgtcacggagctgctgtcgcagtacggcttcgtggaggcccatgccctggtggagcagaagctgcgcggggagaagagcgagcttccggaggctctgagcgcgcggtggcgcggcgaggtgtcgcgtgcgttcgaggtgctcgaagccgcgcgggcggactcggtgctgcctgagtcgccgcccgacgaggccgtggccgcgctggaggcgtggatgctggacctgcggcggaggcgcttcgacggatagccgctggttcagggggccagcgccgcccggatgaggggcttcacctccgtggagaggtgcatcgcgaagctgacgacgcccgcgcccgggtcatcccgctgaaggtgcatcccgaggacggcgtagtagcccgcctcccggtccacccagggcgtccatccgaacgcccctggcgagctgatgacggcgcagccctgcgcgggcgtggggcactccagccacgccgtcaggccatagcggaggtccaggcccatgtccgccgctggcgaattgccgacgacgacgccagggaagggctcgacggcctgtgcgtcgaagagctccggcgtgccgatgacaccgccgggatgcgtgccccggtggaagacgagcgccagcaggggcgcgtactcattcatggacgcgcgcagcccgcccgccaccaggggattggtggtgcccagcgggtgattgggcgcggtgaagtaggtgacgcctgaaggcaggcccagcggctgggccagcgtctcggtgaagagggcgttccacgtcttgcccgtgctcacctccgccatgcgcgcggcgacttgcaagtgggtgctgccgtagtcgaagcgcgccccgggagccgcgacttgtggggtctgggcgatgctggcgacacagtccgccagggtgatgccggattggaacgtgcagaggtgcgagggttgcagtcccgacgtgaaggagagcaggtgtcgcagggtgattcccgccttgttccccgtccagccgagcacctggcccgtggtggagtccaacgagagacggccttggcggatgagctcgaagagaagggtgccggacaccatcttcgacgcggaggccacggccacccgccggtccggcgcgaagtccccgacgatgtgttcgtacaccttgcggtcctgcgcgtcgtacaccgcgaggcccagtcccggaacggaggcacccgcctcggcgacgcgtgcctccagcacggcggtcaccgtggcccatggcgagccggcgtccggctccggggttcctgcatcgtccagagggctccccgcgtcgggctggggaactcccgcgtctggggcgggtggagacgctcctccatccggggtgggcgcgtctgattcaccacaggcagccaggacgactccaaggacgaccagcagcgttctcaacatgcccgtcatcttcgcatccgctcccttcaacccgctacccgggcggaggttgcggcgaattcagcaggtccaagcgctgctcgcggtcccagaccacctggtggccccgcttgaagtaccagacgcggtgccagggaatctcgccgtccggaacgaaggccgcgaatggcatctcctcgcgcgtctcaccatgggcgtcgtagccgatggtgaactcgcgggggtcgaaccgcgggtcccactggatgcggtggtagacctcgcggctggtcgtgaagcgttcgtcggacatggcggactcgcgggaagcggggaggggagacgcgcatgtcctcatgacatggaggcatggcgcgccgcacccgacgccccaccacggggccgcctgacgtgtcgtccctaggacggattcacacccgccaccagatagaagcggaactcgcccgagttgacgctgtaggccgcgtccacgcccaccaggggcagcacgatgttgcgcaggtacagccgcaggccggcgcccacgccctgggccaccgtggcgttccccagcccgtcttccgtatccggtaggtagctgcgcaccacgcgcccattgacgtcccgcaactcccggtccccgggcagcttgcgccacatcatcatccccgtgtcggagaaggcgacgccgcggaaggacagcgggttcaccgtgaagagggggaagtggtactcggcggtgaaggacaggcgcgtgtcgccccggaactgacggtagacgaagccgcgcagtgaattgccgcccatcacgaactcctgatggaacggcaggtccacccccgccacggcctcgccgcgcagcaccaggttgtgttcacccaccagccgcaggccatggcggtacagcagtccgaagcgctcgtagcggaagtcactgccgacgccgggattggagagctcgtaggaagcctccaggttgaggccctccatcaccgcgtgcaggttctgccgcgtgtcgatgcccaccatcagccgcagggacgcatcctgctgcgacgggcccagggagaacgcgggcgtcgtcacctcctcggcggtgtcgggggacttcgcgtcgatggacatcagccggtacttggccgccgcgcggacgcgctcgaacagcaggaagcccagctctccggcgatggacgcggagttcatccgcgtccgtcgcaccacctctgggcgccgctggccggagccggcctggtactcgtctacccggtcgctgcgaagctggccttccaggctgaagcggagctggggcagcccgaagaggttcgggtccaggaagcccgcgaagatgccgctctccgccgtgctcacctgggccgcggtcgcgaacttcttgctgcggccccagaggttgttctccgcgtacagcacgccgccgccgacgttgtcggattgcagcacgaaggtgggcgccaccacccaggatgccttgtcctccacctncagaatcagccgcacccggcccggcccggaaggctcgtagctgaccttcacctcctggaagaggcccgtggcgaccagccgccgctcgaccttggccaggtcctcgagcgtgagcgggtctccttcccccacacgcgcataggcg

SEQ ID NO: 653 - DNA, 4339 bp, Myxococcus xanthus
ttcagacgcgcgttctccttctccaactccctgagccgcgtcgcgtcgcctgcctccatgccgccgaacttctgccgccaccggtagagcgtctgctcgacgacgccgtgcttccgggccacctccaccacgctggccccaggcgtctccgcctcccgcaggatgcggaccatctgctcctcggtaaacctgctctttctcacgaccgccctacctcctggccgcgaggactctctcacgcttcaactggtccgaaaatcggggggcagaccatatcgaatccctatggagttcacccctgggagagggcgatgagcggcggagaagcttggcggggcgacttcaaggcacgcctgtacgaacgggtccgagagcgaggctacgactcactgaccgcttttgctgaagcgcgccctgccgttccgctgtacgtcctggccgacgagttgggcgacgacgttgctgccgtacagattctaagtggcctgatgttcgaggcggagcagcgcaagcaagtcacgcgcttggttcgtgacgtcctcgtgcgcgagttggccgagcggttcccgaatggctggccggacgtgctggatgaggcatcccgtgtcgaagctgcgatgggtctcgggtcctggttcgcctacaccccactaacccacagggggcgggttgaccgggcagggaatgcgcttctcgccaatccaccgcctaccggctggagaccactcggacccgacgacgagcttctacggatgcttctccccgacgaagaagcctgaccacgagggcggctggtgagtcagcgccgatgccgccatgtgtccccagtgtgcccctccagcgtggttcgaggtggcacaccggggagctacatggggcgggacgggatgacgtctccgagcgaagccggggcaccagcgggtaacagcgcgtcctgcttggggtttcctggtgccttggcgaaggtgacgctcatctacgtcatcgagtccgcgcggtagttccgcgaggtcatcggcaggaagtcccctggggattcagtcaccgcgtcgcggggctgaatccccagcgtcgtttcaaggcgaaggtccgtgcgtgaatcgcacggacgcttcactcacgggaacgcgacggtgaagatgttcgcggggcccaggttgatggtgtcggtgttgacggtcactccagcgccgccgccgttcaccgcctgccagtacttgggatagcccggagtgagtgtgcccaggaccacgccgtcgccggtggcgatggtggagagacccgtgccggccatcttccaaatgcggaaggtctcccagttgccgggagccatctcccaggcgttcagcgtcgagccaccaccgttcgtcgcctggacgaagttgccgttgatggtctggagttggacaaggtcgcccgtcaccaggtcattgccgtccaggtccaccaactggaaccgctcccaaggccccactgcgacgcgattggcgtccaccatggcgccaccgccgccctcggccaccaggtagtcgccgtttgaagcacgaagcgtgatggtcctcgaatagagccgcgtcaccgtcacgacgtcgagcgtgctcagcgcgttgcgctgcccgatggtctgtccaccccggccctcgatggtcggccgcccgttcttcgagccctgcatcgggccgtagtgcatgatggagccgaagtcatagccaaagaagtcgtcgtcctcgttgttgttctgctggaactgggacgccgcgcccgccaccatgttctcccaccggatgatgacgtaggtgtcgcggtcctggcggttgtgctcgtggttgagtcccaggctgtgtcccagctcgtggatgatggtgcccgtgctgcaactgccatccagccacaccccttgttgcccacccagacggccatagtgggcggagcatccggtgcccgactggatgcgaacgtagtcaggatattgcgccgcgttgttcgccgtgcggagcacgaacgagatgtgggtccggtcatgccagtgattgatggcgtcctggattcgattctggttcgcaacgcccgagtcgatggtgtacggaaccacggcgttgggccagcgcgagttcaggtcggtcttggcgaggccctgggctcgggggcccgaggcatccagccccagggccttcacctcgcgcacgcgcgcctccatctgctgcaccgtccccaggaccatgtcgccctcttggatggccagaccgtccacctcggcatacgtgaccgggacgaacttctcccgcatgttgctccagatgtagccctcgcgaatcggggcccccgctggtactcgggccatttccgggtccaggttgagccccggcgccaggttctcctctccacaggcgatgagcagcaaactcgggatgaatagtgcggacaacgccaacctcgaaaggtctcgtgacatgatttctccacttcttgtgaggatttcggggcggcgtatatcagaaggagtctggttttgttgcgaggattcggggcacacctctgccattgccttggtgacgcgtcagggctgactgggtcgaggttgactcgtgtgggtttgtggaggtgatgtgcatctccaggggttcggcttggattgggtgcgggctggggccctggtgtggagacgaccttcaagaagcgcgggtcttcgatccaccaaagggaggagccgatgaccgatggacattcatggcggggaaactggaagtcccgcttgtatgagcgcgtccgagaacggggctacgactcccttacggcttttgccgagtcccgtcccaccgcatcgctggtggcactggccgaggagcttgggccggacgacgttgccggagtccaggtgtacgatggtctggtgatcgaggcggtgcgaagcaagcaagtgacccgcttggttcgtggacaactcgtgcgcgagctgtggggcagcctccctgatggttggcctgccgtgttggatgacgacaaccgcttcaaggtcgccaaagcacttggcctttggtccggtatcgtcccagacacccacagggagagggtgcggctagccagggaggcgcttcgcgccaaccctcccccggctggctggcgcccgctcggacccgacgacgagcttctacggacactcctccccgacgaagaagcctgaccatcaggggggcggtgagtcggtgccgaagtctccatgtgtccccagtgtgcccctccagcgtggttcgaggtggcacaccggggaacgacatgggacggggcgggaggatgaacccgagggaaatcaaggcgatagggggtaacagcacgtcctgcttggggtttcctatcgtcctgcccacgggttcaagtcccgtactcctcgccaatgagaagggcccggaatcgcaaggctccgggcccttcgtctccgcggggagcgacttccgccccggcccttgctcagctcaatccctgctcagttttgatatggacagggaaccaccttgcacgggaacttggtgcaatcgtagcacttgaactgctggtagaccccgttatcacacgacatcatgatgtgcttgtaataccgggtcgtgacaccccagtcatcgttcgagccgtcgcagtacagggtccgctcacccaccatcttcgcggggtcgaacgccgagctcgtgtagtaccaggtacgaacctcattggccgggagcgtctgagattgcgagtcaagagtgctgccctcatccacggggccagcaccggtaccacaagccgccagcaggccggagaccaccacgaatgccaacacggacggacgcatcatcattgttcctcggttgaaggagtacccacctcgggcgggcctccggattgagtcagacatgtgccttccgaggggttgttgcgtccaacgcattgatggcatccaagttcatgcagtagcctcatgacatgtcccaggagagcaccctcgaggcgcgagacctccgcctcatccaggccatcgtcgaggagggcagcgtgacgcgcgcggcgcggcggctgtacctgagccagtcggcgatcagccaccagctttcagggctcgaaacgcggctcggagtcaccctcttcgagcgcgtgcgcaagcgcatggtcatcacgcccgcgggccaacggctggcggcgctcgccgccgaggtgctgccgaggctcgcacgggaacaggccctgctgcgcgccgcgctgacgcccacgccgccacgtcccttgcgcctcgccgcccagtgctacacctgctaccagtggctgccgcggttgctgacggggctgtccacagcgcacccagaggtgg

SEQ ID NO: 654 - DNA, 3657 bp, Myxococcus xanthus
catggccgttcggacgatagtggcaggcatcaagaacaggcggcgggtcggcgcgcacggggcccagccgagcgtacaggccagcaaggggcgcaagacgatgccccacgacgacgcggccgcgctgcggcggcagaagacgctggagcgcgtgacgctgggccccgccgccgaggcacatgagcccaagagtcatcggcgacgcgcaacccccctcaagggccgcaagaaggcccccagcgagatgaacgtgaagcacctcggcgggccgaagaagcgcctgccccttcacggcggctagcatgtacacgtcgtgacgcggcccgcgccccgcgacctccgggcgggggccgtgcccgtttcaagggcccggtggccacagcgcgctggcgcccgggtcctccgccacgtagacggcccacacgcgctctcccgggcgccgcagcaggtccgacgcatgcggtgaaggcacgctcccttcgacgcgctggccatgcaccgtgaagacgtaatcgagttgcaccacgcgtccggcatgcagcgtgggcgccacctgacgctccacccgcgtgagttcagccgcggccggcaagccccagacccatgccttcaactgacgctgctgctcgcgccgcagcgacaccggccagctcgtgcgccggaacaacagccccatcccgatgaagatggcggactgcaggagcaggggccgcaggaagaacagtcccaccgggagcagcatcacccccgcccacagggccagcgttcccaggacgtagtgcttgtgcagcttgggccgcgagacggccgcgcgctgtgcccgggtcaaccggcgcggtggcaacggaggcggcggacctcgcgcggcgctcaaggccgcctccaggctcgcgccgcatttcatgcagtgtgcctcggcgccctaccgtgacggcatgcccacagccaggacagacgatgcggaactcgcccgactccggcgagaggtacggcgcgtccaaggagattcgagcgcggcgcatggccccaccatcggagcacctccccccgcgccgccgcaacccgtcccggaatgccatgacggacgttccacgacaccaccagacctgggcaccagggcccggctgctccactgccccctggcatctcccacccggcattcctacctgtgtcgctggaggtcgaatgccagagaagagtcagacggagcgcgtgaagcgcgcgaagcggcagggaacgacgttggagctcaagcccaccgacgtgcatctcgccagcgcggacagcacgcaccatgcgaagaagagcggccggcggaccctggggaaacggaccttcgcggaccgcagcgtcagtccccgccacgcgccaggaaggggcctcacggcgaaaagccgcaagctgcccgaaccggagccaggccagagcagcacctcgcggcgcaagacactgccgtccgcggccgcagtggcctaccgcaaggagggccgccccaagaagacgacagatacgacgccgctgaaggcgggcaaggtctacaagcgcgcgggtgcacggaagacgagcatccgcgcctgaggcccttccagcctggagccatgcgcgatgagtcatgactccaggccgtggaaggcgacgacgcggccagcacccaccgcatcgcctacgaggcccgctcgctcgcggacttcgaggcgggactcgtgcagctcgccagcgagaaaaaacccgcccgttcacaagcctgcggccggacctcagcgcgagcggtgtaggacacccgcggcgtccgttccccctcgcgctcattcctcggggacgacgccgttcacctcctcggccagcctgcggacctcgtcgtgcagctcgcgcaactgtcccaggttgcgctgaaggagcgcgtcaatctgctcgccccgctgcacgtcgccttgtgccacggcgtcctcacgctcgcgcgccagccgcaccacgtctcgctccaccagcgccgccagccgcgccgtcttctccagctcccactgggctgtttgtggcagctcgggctcgatgtcgtcgttgtcctcaggcggaggaaaggactcctctggcgagggcaccacgggctcgggcgccatccgggccaccgtgacctggggcgcctcttgccgaggcacgggggcgggcggcgccacctcgggggccgtcaccggcaccacacgggggggcggcgcgggaggagcaggaggaggcacggccatggcgagcagcgcggcgggcagcggctccggctccggctggggccagaactccacggcgcccagcgccacggcgagcacgcccgcaccggtcagaatcaaacggtaacgaatccgcatggcccccctccccgccccggcgctcagaagcgcacccgccaatcgccatcctggcgctccacccgtagcaaccacggtgccggacgttcgcgcccaccatgggccacccgggcccgcacgaggacagcctcggcgtcacgcccgtccaccgtcgattcgacaatccccaccagcgtgaggccatgcccccgcagctcccgcaccgtctccacacacggtcgcgcgcttcctcccgtgaccagcagcggtgccaggacctcgcagtcaccctcgggcagcgccgagaagaagtggcgcaccaccgcctccgcggcccgcgtcttcgacgcgtcggaggaacatccgagcgcggccagcatcagccaccccatccacctcactggcgcggggtgtcgtgacatgactcagtagcagttgggggcgaacagctcgtcatccacggcggcggtgaattggtcattgcaccagccgctcaccaggatgtggccattgcgcacgcaactgtcgtggttggtggcatccaccgtgtactgggtgtcgccgccgcacgtgctgccgcagcgcccgaagcagttacccaccaccttcggccggtgccagtggttgggcgaaccgcagtgccaggtatcgccggccagaaagaactcgtccccgttgcaggagtagtggtcaccgagctgggccaactgctggttgccgggccagtcgaagccgccccggtcacagtcgtgcgtcgcgtgggcgtaccagttgtagcgcccctcacaactgcccgagttgcgcccgttgcactgcgcatagctgcacaacatcgtgtagccacgccccttctcgcccatcaccgcgcgccgcagccccacggtgtccggatactgggaccacacgctcaccgcgcggcgcaggtacatcgccgcgggggccgccgcgtctccgctgggaagcgcctcattgagctcgcgatagagggcggtgagcagcgcgcggtccgcgacgcccatctgcgcatccctggcattcgcctccgcgaaaccatccaacgtggagacgccgcgggccggctccatcaacccggtgagcgtcaacccgcgcagccggacctccagccggtacacccctggctccacctcgcgagaggagaacgtcaccgtctcgtcctcatgaacgaaggtgccccgggcgtctcctggcgtggcggagagcgacagccccgcttgccgtgagcggagctcgtcgcccgtcttcgcggcgccgccacacgcacacgccggcagcaccacgctccaccacagcttcgtgcgca

SEQ ID NO: 655 - DNA, 3999 bp, Myxococcus xanthus
ctctaaaggggccttgtgtgatggccttgtccagcgagtccacctcgaagccactggtgaggctctcccggcctacctgcggccggaacagccccacgctcagccaggcacgctggggcatcacggtgaaggtgacgctggcctcatggagggccagcggcggcccctggagcggaccgggcaggaggacgagccggtcgaacgacacctccagtccgccccgcacccacggcgacccggtcaggtggagccccacccgcccacgtcgcaggctcacggcggcggcgcccgcggcgctcagcccctggtcgattcggagctggagcgcctccctgaattccagccgcggcccctcctccaccacctcctcggcccggcccggccgcgccatgccggccagggccaggagacagagggacagcacggtccgcgtcctgcgcgtcgcgcgctccatgggggccacgactcgctagtagcggatgacctggtagccctcggccaccaggcgcgacagctccgccacgccatcgtccaccacgtcagcctggggctggagcttcttcgggtcgatgccaaacttctgcagcgcggtgccgcacgccaccagccgcacgccagcggccttcgccgcctgggccgcctcacggacctccgccggcacggccttcaccgtcgggtccagcgccaccaccgcgcggccgtaggtgagccacaccacgtccgagaggtagcccgactccttggcgttcttcacgtgccggagggagctggagagggtgccgaggtcctccaggcccgtggtggccacgaagacgagcttgccctggcgagcgggcacctccttcttcgcgggctgggacggcggcgcggcgagcgaggccaggggcgcggtgacgagcgcgatgacgagcaacggcaggaagcgattcatctggatggactccgatgtggttcgaggacgacgggttcgaggactactggatggacagcacatggatgagcccccaggcggccagcgcgagggcggcgaagccaacgaggcccgcgtagacgacccgcatgcccgcgcggcggaccatgctcaggtgggtgccaagccccatggccgccatggccatcaccatgaggaagacgctggcggtggagagccacgccttggcggcggcgggcaacacgcccaccgtgcccagcacgcccaccgcgaggaagccgatgacgaaccacggaatgggtggctccttcagcgaatagcgcacctgcccgcccgcgccggagaccagccccagcaccacgagcgcgggggccagcagcaccacgcgggtgagcttgaccagcgtgcccaggtccccggcggaggtgccccaggtgaaggccgcggccatcacctgcgccacctcatgcaacgtggcgcccgacaggatggcgagttgcgcggtgctcagccccagcagcggccccacgaagacgtagaagaggacgcccaccgtgcccaggattccgcacagccccaccgccagcgtggtgtcctcctcctccgcgcgggtgacggagctggcggccaccaccgcgctggcgccacaaatggaagtccccaccgccagcagcgtgcccagcttctccggcacgccgaagcgcttcgtcacccagcggatgcccagaatgccgccgacgatgacggccagggccagcagcagcacgcgagggcccaccttcgccaccagcccgaagtcgagccgcgcgcccatcaacacgatgcccaaccgcagcaccgtgcgcgccgagtagcgcgtgccctccatcaggccgggggccagccccagggccgtccgcagtgagatgccaatcagcagggccaccgtgaggggccccaccaccttgaggccggggagtgtggccagcccgtagctgaccaccgccagaccagcggcgagcccgagccccggcagccgccggcgccaggggcctccaggcggaggcgcggcggaaatcgagtcggaagtggcgagaggtgcagtcatttcagggggacggtggggggaagtcgcgctcacggttgaacctgctgggtgcggagcacggccggcaggtccaggcccaccgcgcggccctccagcgactcgcgcagtcgcggcttgccagcgaggaagcggcgcaccgcctcgtgcgcgtccatgtcgagcacctgcggatcctggaccccggggatgcggcagagcatgtccggcgagtccccctcccgctcgcaggccgtcacggtgtagaggcgctcatccaccaccggctcgccagcgacctccagggcgaggaggcgctgccccttgggggcctccgagcggaagcgcaccgtcatccccgaggggcgcggcagccacccgccgaagcgcttctccgggtccttcgcgaaaacgttctccagctcctgctcccagaaggcgcgaagctgacggccactcaccttgcccgtcttcagcttgttggtgatgggaaagaagttccacaggtccgcctcacgcacgggcccgggcagcagcggcgtgccgaagcggaagccgttggagaggccaatctccgtcccgccagcggcgcggatggcgtcagccagcacgttgtccagcgggttctccaccaccgcgtagcgcgcgagcgtcacgtcggtgtgccccaccggcgaggacagctgctcgtcataaggcgcgagcgcggcgtccacgagccgcgccatctccgggtcctcggggaagcgcgacgcggtcagctcgatgagctcccagcggcggtccaccaccttcccgtcctccagccacaagtccatccggccgaggaaggagccgaaggcgccgggctccaccacccagcttccgccctgctcgatggggacataggtgcgctcatgcgtgtcgctggacaggtgggcgtccacgcccggcacccgggcggcgatccccacggccttggcgagccccacgtgcgacatcaagagcaccacctgggcgccctcgcgctcgcgcacctcgcgcaccagctccggcagcgcctccgggccgtcgtagcgcagccccttgctgtaccccgggggctgacggcgcgggacgtccgggtccgtgaagcccaccacggccaccttcaccccgcccacctccttcaccaggtacggcgggaagagccgttcaccgctggccgcgtcacgcaggttggcagcgaagagcggatgcttcagctcacgcgcgcgctggcgcagcaccgcggggccgtacaccacctcccagttgccgggcaccgcgccgtccagcccgagcgcattgagcggttcgatgaggacgccgccctcggtgagagcagccgcgcccgaaccttgaatcgtgtcgccggcgtcgagcaccagcacgtcaccaccgcgctcggcccgaatctgttggatggcggcggcgacgcgggcgaatccgcccgccatctcgatgcgctccttcccatcgttccagaagagctccgggtgggcgcgcagttgcgcgtgcaggtccgccacgtagatgacggtgagctgctggcgctgagacgtgggagcgctggcggtgaccggaggccgggatgaagcacagcctgaggccaggacgagcagcgcgccgagcgcggacaggagacgggacatcgtggagcaccttgcgaggagtgaaaggagacagcggaagtgacacgaggtgcgccgcgcgaagttcccggacggcggctcacctcgaacgcctcgcgcatcacggccacgtcgacatggggccgagattgaagacgtcctggaacccctgctccttcaacaggcgctcggcacggccgctgcgtgcgccactgcggcagtagacaaccaggggcgtctgcagcgagccaagctctccgaaccgccgtgccagttcatccaccgggatgttcaccgcgccgggcaggtgaccggaggcgaactcctcgggcgtgcggacatccaccagcgtggcgcctgccgcctgagagcac

SEQ ID NO: 656 - DNA, 5163 bp, Myxococcus xanthus
ttctcgaacaggtcctcgatgaggtactggtactccggcggcgtctcttcccggaggaagcccagcagctcggaggagccggtgtacggcgggccctggaagcggaccttctccacgtagcggcgcagggcgcggttcacccgctcctcgccgatgaagtcctgcagcgcgtacatgacgaggctgcccttctggtagtggatgtacagctgctgttccacccgtgccagcggcacctccttcttcgattcgaacgcgcgggccgcgaggtagcggtccagctcgaacttgaggaagcgcttcatcttcatcggcccgaagcggtgcttcatcaccatcagcgcggcgtactgcgacatcgtctccgacgtcatcgtggcgccctgcgcgcgcgcgcccaccacctggtgcgcccaccactggtgggcaatctcgtgcgcggtgacgtagtacgggtagtccacgtcgtcggcgcgtccgtcctccacgcgggcgatgaagcccagtgcctccgaatacggaatcgtattggggaaggactgggcgaagctcgcgtagcgggggaactccaggatgcgggcctgccggtgctgatacggcccgaagttctcgctgcagtactccagcgtgtccttcatgccgcgcatcatccggtccagcgcgaaggtgtgcgtggggtggtggtagatctccagcttcacgtcgcgccacgtgtcgcgcatcacctcgtagcgcgcggacaggacggagaagaagttgaggatgggtttgtccatccggtagtggaagaagcggcggttgccctcggtccactccttctccaggtaacccggggcaatggcaatctggtccttcgccgtgctcaccgtggcctcgaaggcgatgaagtccgagtcctggcggatgtagttgtcctgcttcgccttcgggtcgtcgcggtccggcaggcgctcgcgaggcggcaggccgtagtccttgcggtcccggtcgtcctccaactcggcgcccgtctggtagccgagcaccggcagcttcatgttgtcgaagaaggtgccgttgcccacgatgtccgtgcgcgccccgccgtgcttgaagcccttcgtgccgaactccaggtcgaacacgatggcggagtcggcgccgggcgccagcggcgtgggcagctcgtagatgaagatgccgagctcggcgtcatgcatcgcgggcttcgtcacgccggcgagggacaggccgcgcacccgggcgtcgtccggaaggttgagcatcaccttggagatgggcgcgtcggtcttgttgcggatgcggtagctgcccagggcctccaggcgcagctcttccgggtggatgtggaaggtgaccttcgcggcggcgatgcgtgggtggggcatggcggcgtaggacgcgtactctttttcgtatcgggcctgctgccgctcccggtccttccgcgtgatgtacgggttgaggatgtgggtgttgtagtagatgaacgcgcccgccccgatgaagacgcagagcgacagcgccgcggccgccgtccacgcgcccgtgcgccgagccttggctgctgcccagcgctgcttccagcgcgcctccaggcctcggaccgtgagcaggtagcccaccgccacgagcaacgccgccagcccgtaccagtagacgcggtgccacacgagcgcggggatgatgctgccgaagcggttcaggtcggagtagcgaagcgtgggctcggagccgtagcggaccagcaagtcttccacgcccatcaggcccagcgcggcctggaggacgaagtagagcaccatcaccaggtacgccaggtacttctgatggatgagcacctgcgcgaagaaggccagcacgcacaacagcgcgtcatgcgggaagtccagcaggaagagctgtgtggcgtagaggttccactcgatgtcgacgtagccgcgaagcacctgggagagcagcgcggacagcagcgccacggccttcagggagaaggccacgagcagcagcgcccccagcttcgcgccataggtgacccaggacggcacgcgcgtggcgtccacgatgtcggccagccccgcgtcgcgctccttccacaccagctcacccgcatagaaggtgatggtgatgagcaggaagggctggaacgttcgcgtggccgtctccagcacctgccacgtcaccggccaggtggcggtgccgtatatctgcttcgaaatggagatgcccatggtgcccatggccagccctgccacgacgaaggaccagaacaccggggagcggaggatgtcgcggtatgccagccaggaggtggcgaaggccgtgcgcagccaactgcccgtcgtgggcgacgccagggtggtggggatggcgaccggggcgggggcctccttctccttgcgcgtgccgcgtccccgctgctcctccacggtggtgcggaagcgcaggacggccagtcccaggagcgcggcgcccaccacactccacagcaaccggttggcgagcagcagcccggcgaaggggacgtggtcctggttgcgctcggccgcccgtccagtagcgggtcgcgttctcgaaggtgaggaagccgaacgggtccagcagggacgccaggtcctggtgctgcacgtcggacatggcggcgctgagcgtcaggtaccccatcaccagcaccacgacgcccacgttcacgggggccatgcgccgcgtcagggcggtcagcgagaagaagactgcgcccgcgaagaagagcgtgggccacacccccatgacgtagggccagaggtaggaagtgagctggaaccgaccgagccgatcggcatccaccagccacacgcacgcggcgcccaccatcagcccggggatgatggccagcatcagcaccgcgctgaagaggtacgcacccaggaaccggccgagcaggtacgggcccttcttcacgttcttcgtgaagatgagcatccacgtgttgtggccgaagtcctggtaggcggcctggccgaagacggcggccaccatgaagaggccgaagtaggccaggctgatggtgaagctgaagacggtgtgcgggctgttgacgcggaccagctccgggcccgacgccaccgagaaccccttgaacacggcgccaatcgccagcgtcatcagcgcggcggcggcggccagcatcagggcgtagacccaggtggagatcatcttcacccggcgccgcaattcgaaggtcaggagggcggtgaacatggtgggccctcagggctgcttggatgcccgggcgagcgcgtggaagtacacgtcctccaggtcggggctggcgggctcgaagccctctggcggggactccgcgtagacatggaccagtcgctgaccggccacgcgccgcacggcgatgacctccaactgtttcatgagcgcgtccagttcctcctggtgggtgacgaagcgcttccacacgcgctggtgcagggactccaccagcttcagcgggtggccgctggccacgacgttcccctgggcgaggatggccatgttctgacagaggtccgccacgtcggagacgatgtgcgtggacaacagcaccaccacgtcggtgctgatctccgccagcaggttgtggaagcggaagcgctcggcggggtcgagcccggcggtgggctcgtccacgatgagcagcttgggattgccgagcagggcctgggcgatgccgaagcgctgcttcatgccgccggagaatccaccgagccgccggtcgcgatgctcccagaggttcgtcttctggaggagcgccttcaccgtgtcatggcgcgggccgcgctgggccaggcccttgagctgggccagatggtccagcatgtcccaggccgtcaccttggggtacacgccgaagtcctgtgggaggtaacccagtacctcgcgcagccggtccttgtcccggcgcaggtcgatgccgtcgaaggtcatggtgcccgcgtccacgtcctgcagtgtggcgatgctgcgcatcagcgtggacttgccggcgccgttgggcccgagcagcccgaacattccgcgcggaatcgtgaggttgacaccctgcaacgcacgggtgccgttggggtacgtcttcgacacgccttccagtctgagctccatggcggcgaacctagcccagtcctcgggaccgatgcgtggagcgcgtggcgtcgttaccatgtaggcatgcccttttctcgccggacctccaccgcctccgcggccgtcgccttcctcctgggggcctgcggagagggggacccggtcatgctggaggcggtggccgcaagctgctcgggcggtccggcgcaacacctggaccggttgccgtccggcgccatggtgctcaacgcctacttcctacaggaagaggccacccgggacgcgcggcggggggcggcggagtccccggtgctggaagaggtgctcgccaaggcctccgcgctgggcgtgcgcgcgctgcgcaccaatggacacaacgacgcgctgtcgaaggtgggggacaccgccatccaggtggcgccgctggagtacgacgaggtggccctggtcggcctggattgggtgctcacccgcgcccgcttccatggcgttcgcctggtgctgacgctggggaactactgggatgcgtatgggggcgcgcaccaatacgtggagtggcgagggctcccccggcccgtggaaggggatgctcggttcttcaccgacccggtggtggtggcgcacttcaaggcgcatgtggcgcggttgctcaaccgggtgaacacggtggacggcatccgctatggcgaccacccgcccgtcctggcctgggagctgctcaacgagccgcgggaacgggggctggacaaggaaggggcgcggctgcgcgcatggattgatcacgtggcgcgcgaggtgaagacgcacgcgcccggccacctggtggggacgggggaggagggcttcgagccgtctcccgacgggtacgaccctggcttctggtcccgctccgggtcgccggtgcttcgcacgccgggggccagcttcacgcgcaacacggcgtccccgtacatcgacttcgcgtcggtgcacttctatccggagtcctggggcctgggcggcatcgacacggccgaggccggcgctcggtggattcctttagagcacagc

SEQ ID NO: 657 - DNA, 4575 bp, Myxococcus xanthus
tctaagggcctggaggagttgagcgcacacctgcggcccgaagcgcttgtcggacgtagcgttgtccgccaggaaccactgctcgccgcccgacctggtcggatagatcatcgtcacgccgaacttgtcctggccctgctcgccaggcgggtcggtgggcggattggtgggcggggtcgagccggtgccgggctgcatttccgcgatgctggcccaggtgttcatcgtgctgccgttcacggtgatgcgcacgtagcgcgcgctcactggggagaacgagtagcgctccagcgcggcggtgttgccggatgacctgccggaatgcacctgcgtgaaggtcgtgccgtccgtggaggtggagatgacgaagttgttgacgcgctcgttgccacggtgccagccgatgtccatggcgcccaactgcgccacggtgcccaggtcgccggtaatccattgccccacgccgtcgctggaccaccgcgtggcggggtcgccgtcgatggcgttggcggggacgttgccgtcatctccgctggcggcgacggaggtgaaacgctcggggggagcgccgggcgggttcgagccgtcggtgacggccgccagctccgcgatgctggcccaggtgttcatcgtgctgccgttcacggtgatgcgcacgtagcgtgcgttcaccggggagaacgagtaacgctccggcgcggcggtgttgccggacgagctgccggagtgcacctgcgtgaagttcgtgccgtccgtggagatggagatgacgaagcgattgacgcgctcgttgccacggtgccaggagatgtccacggcgctgagtgacttcaccgcgcccaggtcgccggtgagccattctcccacgccgtcgctggaccagcgcgtggtggggtcgccgtcgatggcgttggaggggacgttgccgtcatccccactggcggtgacggaggtgaatccctcggcggctagcgcgggcgtcgcgagcgcaagggcagtcagcgcgagcacacgggcaggctcgcgcaggtgcatccatcccccccgggatgaggtcctgtggtgtggattcaagttgatacctcaagtgagaccaccaggagccacgactcaccgggcggacgatgccggaccggcgcgccgcggtcccccagcggcgcgttggctttcagaccgcaggcccgcgccccgtcagcgacccacgccccgtgctgggcgtctcgcttccgtcaggtccggcggtgtttacgacgcgatagcggtgttgcgggcgcgaatacccttccacttgaaatggtattcccattgccattcctcaattgatatcgagctcgccctgcagacaagcgtgctgcaatccctctcagtcccgctgaaaattctcaccattgctgtggatgcgccctctcatctcaagaccccacccgcggagaccgtgattcgacagccccccaaagcaggcgaggaggcgaggatggcgccccagtcagcggcgaggaagccgcgagtggacggggctggactgatgaggaggcgcttcgacttcgacgtattcgcctgagggaggtgtggaggcaggcttaaggggggacgtgaaggaggcggaaggggggcgcgcgatgctggagcacctgcgaggccgttccgtacttccagcaggccagcgcggtctcaccctccggtctgcgcttcccggccccggacggttccctgtgccgctgggacttcaaggcccaggacccggcctccctgcgcgaggaaatcaacaagcggtccttcgcgcctatcccagcaaccgccggaggtgcagcaggcgcgagccggggacgggagcggcgggaccggcttcgcgccgtttacagcatccttgctgcaagacgccccgaggcccgaaaagacgaaggccggcagtcccgagtttcctcaaggactaccggccttcatgggtgagcggcggaagggattcgaaccctcgaccccgagcttgggaagctcgtgctctaccaactgagctaccaccgcaggcgaagcagggcgcaaagtacgggccgccctgtggcttgtcaacgggaagtgaggtgctactccgtctcctcgacggtgagctggtacgagtcctggaagttggactcgcggttgcgcgcgtcccggacctcgaagaggtagacgcctggctcggcgctgtagcggatgctctccggctggtcgcccttggcccggtcagccgtctgcacgagcgacagcttcccgtccggctgcacgcggtgcaggtacagccccacatcgaccttcaggatgcccagcagcgtggcccggatgggcgtgcgcaccggccggtccgacaggtccaaccggaagaagtccgtgtccttcactggatacaccgtgccccgcaccggctgccccagcatcaggtcctgcgcccggtccgcggtgttgttgggctcgcgctcctcgccgccgttgtccggcaccgtggtgacggtgatgcggtagggctgctcggcgttctcgaagtccttcacccacttgccgtccaccttgcgcgacgcgccctccactcggaagtagcaggcgccgttgcaggcgacgttgttgaggcgctcgggctccttgatggcgccgtcgttggcgcgcagcagcaccgtctcctttccggattccccctccgggggctccaccatggagagcacgaggtccagccgctcgacgccggtcaactccaccttcgccagcaccggctcggacgtcttcaggacgaagtggtccacgtcgcccttgggagccaggaagccctggcggtagccgccggccgtcaccggggtggccttgtggagctcgtcgttcggctccagctccgcgctggcgccggcctcctcctgcgacacggtgagcgtgtacggcatggtggcgttgaacggcctgcgggcctccttgccggtgcccacccagctcgtcttcaccaccacgtagacgacccggtccatggcgcgcacgccgatgtttcgcagcgacagcgtctcgccctccttgccgcgcagggtgaagagcggcgcctccgccgcggacagcacggacagctccggtcgcacaccgtccacgccggtcagctcgattttcagcgccaccgagggcggttcgggaggcactgccgtgcctgcgtccagcgcacgggcaatggcttcgcccaccgcctggctgcccacgggcggcggctcgctgcccgcgaaggtgccctccacggcaggggagggcggcgcctcgtcacgcgcgaagtcatccactccaccctggccgagcgacgcgccccgcatgccctcctgggctgtgaggccgggcgttccatctgcttcggcgccccggggggccgcgccttcctcggtctcgaaaccgttgccggtcaggtcctgcctcgcgccagggttgccctgtccgtgctgggcgccagcgccggtcgtgccctgttgaccggcgcgaccgccgcccatcgcgtcgtcctgccccagaggggcgcctgtgccgccagttccgggcagcgtgccgcccattccctgcggcgcggtgccatctcccggggacggcgtgccctgcgacggcgaatcgccggaaggcgcggtcgcggggtcctccgccgacccacccgggcccgcgccttccggagccgagggctgcgtcgggtccggcagctcgatgcggtaccagtcctcgtcgccggcatggcccaggaaggccgtcaccgtctggcccaagggcaggctcaccgcgtccacggcgcggtcgttgggttcgcgctcctcgccgtcctcgggcgcgcgcatgcggacttcgagcgtgtacgcgccgcccacacccttgcgggtgggcaccacgcgaatgaagcgctcgttctccacgtagaggttggggaaccgctccggcttgccctcaccctcgctgttgatgcccaccaggcggttgcggtcgcggtcatacacctcaagggtgatgtctccgccgggcaggccggacacggtgacgtccgcgatgcgcggcgcgccgggcgccagccggtaccagtcctcgtccgccttgttcggctgcgcggtgagttccgcgctcaccgtgctgttgcgggtgatatccaaggcctggtcgggccggtcgttgggctccttctccgtgagagcggccggtcctgtctccaccggacccgcgtccggagcttccggcgccttgtcttccttgcagccggccagcatcagccccagcacacaggcccacccccagcgtctcatcacggtctcctccagcacaggccgccatccttcccgtcggggacggagtgtcaagcaccccaacatccgcgcgggcgctttcatccgcatccacccggccgctccgtgcgtgctcggactggagccgcgctcgcgaggcgatcaaagatgcggggacatgcgacgcctgctcctcgcctccctcctgtccgccacgggggcctccgccgcacccaatgtcccgccaggctacgtccaggcctccgactggctcgaccgcacccgtcagccggagcgctacgggcctctcaacgtgctcgac

SEQ ID NO: 658 - DNA, 4416 bp, Myxococcus xanthus
  unsure (1)..(4416): unsure at all n locations
aggtgctggtggaccgcgcctcgcgaggcgacagcgcctggacgtcccacctgctgacgtcgagcgcctggctcggtgcgagagtggacgcggcgacgggcgccctggagctgagcttcgaccacctggtgatggatggcaccgcgatggccgagctctcgcttgcggcctcggagggcttgccgcgcagggagggccgcgcggcgccgggcgaatggctcaccggtcccgaggagccgtcgccgctgctgcgagtggagctgccggaggggctcgacttccggaacctcgcctgcgcgatgctccaggcggtgcagcgggccggcgagggcgtgttccccgtcgacaatcccacgctgctggtgccggtgctgcccgcgtcgccgcacaccgtggcgcggaagtggcggcgcattggtatcgcggtggtgccctcgcggacgcgcacagggccgatgactcccgcgcacgtcgcgcacctgctggagcagacccggcggggcggcggcgtgctgaaggacatcttctccacgttgtactcaccggcgctgccgtggtggatgccctcgctcaccacgcacggcttcgccttcacgcccttgctgcggcaggtgcccgccgccctgggaggcaatgccctgctgtccaaaatcaccttggaggtcgacgatgatgaagcgctggcgcggcactcctcgctcttcttcaacacgatgcggccgctgtcggccgtggggggcggcgtggccctctgcgtgacggaggtcctccacgcgacgccctcgggcgtgcgcaagcgcttcttcgcggcgctcgcgggcagtggtgccctgggctcgcgcgagaagctgctggccttccgggatgtgctcgtcgcggaggccgtcagcagggcccggccgcggcgcccggcactcccttgaatgaaccttcctggtcttccgtcacgagagcactccatggtctccccccacgaccccggacgcatccggccgcgaccgcacctccagttccccttcgacgcgagcttcccgcgcatctggcaccgcaacggccctggcaccacgcacctgtggaacgggctcaacatgctcttcccccagggcgagcggttcttcgtgcgcagcgtcaaccactacatgccgcaactggcggacacgcccgcgctgcacgcgcaggtgaaggccttcttcgcgcaggaaggcaagcacgcgcgcgagcaccaggactacatcgagctgctggagtcccagggttacgacatccgccgcttcatgcggcggtacgagtcattcctctggggcgtcatcgacgcgaagtttccgccgtcgctgcggctgtccatcaccgccgcgctggagcactacacggcgctgatgggcgagaacacgctgacgctgggcgtgttcgcggacggccacccggcgatgcgcaacctcatcgagtggcacgccgccgaggagattgagcacaaggcggtggccttcgacgtgctgcggaaggtggcaccgggctatgggctgcgcgtgctgggcatggtgctgggcgtgttgtcgctcttcgccctgtggttcgccgccacggtgacgctgctgcgccaggagcgtgggctggggtggacggggctgctgcgcgagctgtggcgcgctcaccggaaggacccggtgctgttccaggtgctggggaggggcttgcggcagtacctgcgcccctccttccacccgctggacaatgacaacctggagttggccagggcccacctggcgacactggaggcgccgcctccggaggtcccggaacgcgaagcggcatagcggcacgaatgcacgcctggtgagggggtatgccgcgcgggggttgttccctggaggaacgtgaaggttgctggctcttgcgatgccccgtcctgcgccctgggggaccggtacgtctgttggcggtgcttcccgctttgtcacgagcgccgcgcaggctctgacgtgcggctgacacctaccgtggctcctgcccgcatgtccggcaggcgtcccggcgcgaactcttcacgcgccgggacgacacacggtgataaggacggccccgctgttacccagagccacgatctcgacccatgtccagcatgcacactctgcgtggggctccggccctttctgacttcaggctcgccaagctcctggcccagtgccgtgagcgggtgccctccgtctcatccatctatgcggagttcgtgcacctcatcgacgctccggcgcccctctccgaggcggacctggccaccctgggccgcctgctcgactacgggccccgcgtggccacgggcgcgcgcatcggcagcctgctgctcgtgctgcctcggccgggcaccatctccccctggtcctccaaggccacggacattgtccacaactgcggcctgggcgaacgggtgcggcgcatggagcgcggcaccgccttcttcatcgcgggccccgacgggcaggcgttgcaggatgcggagctggagcgcctgaagccggtgctgcatgaccggatgacgcaggcggtggtggggcgtctcgaagacgcggccatcctgttcgccgggcacacgccccggcccttcacgacggtggacgtgctgggcggaggccgcgcggcattggtgaccgccaaccgcgagctgggcctggccctggccgacgatgagatggactacctggtggcgcgcttcaccgagctgaagcgcaaccccaccgacgtcgagctgatgatgttcgcgcaggccaacagcgagcactgccggcacaagatcttcaacgcgagttggaccatcgacggcaagccgcaggagcgttcgctcttccaagccatcaagaacacctacgtccagcacaaggaaggcgtgctcggcgcgtacaaggacaacgcggccgtcatcgaaggcttcgaggtggaccgcttcttcccgtcccccgaatccggtgagtggggctccgtgcgcgagccggcccacatcatgatcaaggtggagacgcacaaccacccgacggccatctccccgtacccgggcgccgccaccggcgcgggcggcgagattcgcgatgaaggagccaccggccgtggcgcccggcccaaggccggcctcaccggcttcagcgtgagccacctgcgcatcccgggcttcgagcagccctgggagcagccctacggcaagccggaccgcatcgtctccgcgctggacatcatggtggacggccccctgggcggcgcggccttcaacaacgagttcggccggccgaacctcacgggctatttccgcagctacgaggtgcaggtccccacgcccggtggcgtggaggtgcgcggctaccacaaacccatcatgattgccggtggcctgggcaacatccgcgcgtcgcacgtgcagaagggacgcctgcagccgggcgacaagctcatcgtcctgggtgggcccgcgatgctcatcggcctgggcggtggcgcggcgtcctccatggcgcagggcgcgagcgcggcggacctcgacttcgcctccgtgcagcgggacaacgcggagatggagcgtcgctgtcaggaggtcatcgacagctgctgggcgctgggcgacaagaaccccatccgctccatccacgacgtgggcgccggcggtctgtccaacgcggtgccggagctggcccacgacaacgacctgggcgggcgcctggagctgcgcgcggtgcccaacgcagagccgggcatgtcgccagtggagatctggtgcaacgaggcacaggagcgctacgtgctgggcgtggcgccagaggacctggcccgcttcgccgcgctgtgcgagcgggagcgtgcgcccttctccgtgctgggtgacgccaccgccgagcagaccctgaagctgggggacacgcagttcggcaacgcgcccatcgacctgcccatggacgtgctgttcggcaagccgccgcgcatgcaccgtgacgtgacgtcgcgcccggtgtcgttcgcgccgctgacgctggatggctcgctggcgctgctggcggagcgcgtactgagtcaccccacggtggcggacaagagcttcctcatcaccattggcgaccgcaccgtgtccgggctcagcagccgggaccagatggtgggcccctggcaggtgccggtggcggactgcgcggtgacgctgtccaccgtgacgagcaccacgggcgaggccatggccatgggcgagcgcacgccgctggccctcatcgacgcggcggcctcggcgcgcatggcggtgggcgaggcgctcaccaacatcgccgcggcccgcatcggcaagctgtccgacgtgaagctgtccgccaactggatggccgcggcgggcagcccgggcgaggacgccagcctctacgccgncgtncacgcgggggggcatggagc

SEQ ID NO: 659 - DNA, 4494 bp, Myxococcus xanthus
ggcgtactgggggaccaggtcctccgggggcccctcgcggttggccttgtacgttggatcaatcttctggcgctcggtgcggctctccttgtcgaaggcgagcgccacgtgcgtgggcttcagctcacgcagggccttgagcaccatgcgcgtgaagcccaacacggcgttggtctgcacacccttgctcgtcgtgagcggagggatggcgtggtaggcgcggaagatgaagccggacgcgtcgatgaggaccagggtgggcgcggagcgcgaagggctggtgtcgaccatgcccccgtgcctagcgcgcccgcccggccctgtccacgacgcgtgctacttgcagcccagctccgcctgcttcgcgacgaccatctcctccacaccgtcgcccttgacggcgtagtccagcgccaccgccatgtcgccgcagcccgacgccgcacggaaggcctccagtgccctcgaggagcagaaggccgccgccttgttcaggttcggattgcccgcgtagaagctgaaccccagcttccacacgcggcaggcgcggcggcggtcctcgcggtcggcccagtgcttgccgcgctggtacgacttctccgcgatgtcctggaggatgttgcgccggtagaaggacggcttggactccgcgagctccagcatcaccgccttgtccgtggccagcgcctcgcggaagggctccgcggccttctccggatcctcggcggccagatagctctggcccaccttgaagagctgatccacggtggacatgatcttcatcagctcgtccgcctcggcgtggtactgcgcggcctcgtagttggcgcgcagcttctgcatggtggccagcgcctcgctgccacggccaccccagtagtccaggagcgcggcctgcatcagcttgttggggaagcgcttcttcgccgcctccatgacgaaggtgcgcgggtccgcgacccgctcgtcaccggccagaacctccgccaccgggcacacccagggcgccgcgttggcgtccatcttctgccgcgcgatgaggaacttcacgaacatcggatccttcggccgccactcgtcgcggcgcaggcggccctccagcttcagcgtgaagcccaggggcggctgcaggtcctcgcgcggcttcgactggcaccacaccgccatgtacacctcgcagcgtgacacggcggcgctccactgcgagtcacgcaggtacagcttgcagtcctcctgtgcgcgcttcgtcaccgcctcggcggcctcgcgcgccttggcgcgggcgcggcggaagtactcgctctccttctggatcttccggaacgactccagggcctcttccggcttgaggcgctgcaggagccgctcgccctgcgagtagtactcgaaggactccttctccagcttgatgcgccggatgagcgtgttcgcctccgggtggatggggtccaggtccaatgcctgggtgcagacctcgtgggccttctcccagttgggggcgcccagctcgctggatgcgtaggagcggcactcgctcagcaggtcctggatcttctgcgtcggatccatctgcgcggccccgcccggcccctgaacgtccaccggcttggggttcaggatggaggacaccatgcccaccatcagcagcacgcccaccagcccggccggcaccatgatgagcttcttgcgcttggcggcgggatcctcgtccgcgcccccacgcgccgcgcccgccgcggccccggcgcacgggcaccgcggacggttcgggctcgaaggtcatctccaccacgccgaactggagctgatcccccggctcgagcgggaccggcgtctggtccaacggctcgccgttgagcagcgtcccgttggcgctgcccaggtcccgcaccgtcacgcccgagctggtcgcttccagctccgcgtggcggcggctcacggagtcgtcatccagcatgatgccggcgggcggctgccgccccaccagcaccttgccccttgagcggatatgtctggcgggcccagggaccgaccatgccgcgaagcaccgggccacccgccggcgccggacgtgcgccgccacccggggcgggacgtgccggacgcgcgggccgcttcgccagcgccgcgccgggctcgctcttcgctgcgccggagcccttcttgatgctgggcatggcccgggtggcgcgtacaccgccgccctcgtcgcccaccggcatgggctcatcgccccccgccgcgggcctggccgccgagcgccgggccccagaaccccgcaccgcggccggtttgagacgcagcacgtagtccccgaggaggacctccgactgcggcgtcagggccgtgggctccatgatgcgctggccgtcgacgaacgtgccgttggcgctgcccacgtcctcgatgaagacggtgccgccttcgtcgaagacgcgcgcgtgcgtacgcgacacgcccccttcggtgatgaggatgtcactgccctgctggcggccaatcttcagctcgcccgtgatggcgaattcgttctcagtgccgtcggggtgacggacgaccagggtggccatgggcgcgtcagtcctcgcggaagatgctcatgttgacggggatgcccttacgctgcagctcgtcgtagaacttcggcacgaagccggaggcgacgtagcggccacggaccttgtggtcctccgtgaagccatcctgtttgaaatagaagatgtcctggagggtcacgatatcgacctccatgccggacacctcggtgatgtagcagatcttccgcgtgccgtcggagaagcgcgtctgctgcacgatcatgtgcaccgcgctggcgatctgctcacggatggccttcaccggcaggtccatgccggacatgagcaccatcgtctccaagcgggcgatggcgtctcgcggcgtattcgcatggagcgtggtgagcgaaccgtcgtggccggtgttcatggcctggagcatgtccagcgtctcaccggagcggcactcacccacgacgatgcggtcgggccgcatgcgcaggcagttcttcaccagctcgcggatggtgatggcgcccttgccttccaggttgggcggccggctctccagctgcacccagtggtcctgcggcagttgcagctcggcggcgtcctccacggtgatgatgcgctcaccctccgggatgaaggagctgatgatgttcagcgtcgtcgtcttcccggagccggtgccgccggagatgacgatgttgcgccgggccttgacgcacatctccaggaactcggccatctgcgccgtgacggtcttgtacttgatgaggtccgcgatcttcagcgagtccttcttgaacttgcggatggtgatgcagggacccttcagcgccagcggagggatgatggcgttgacgcggctgccgtccttgaggcgcgcgtccaccagcgggctggactcgtcgatgcggcggccaatgggcgccacgatgcgctcgatgacgccgagcaccgcctggttggaggagaacgtcttctccgacagggtcagcttgcccttgcgctcgatgtagatctggttggcgtggttcaccatgatctcgctgatgtcatccgacgcgaggaacgcctcgaggggcccgagccccagcgcctcgttgatgacgtccgtgagcagctcctcgcggtccacgtcctccggaagctctccgtccgcttccatctggtcgatgatgtcgcggatggccttctcggtgcggcgccacagctcgtcgtcgccgagccggtccatgtccatgcggcgcagatcgaggtactcgatgagccggtcatggatttccttctggagccgggtgtagcgctcctgacgcggatccaccttgcgcttgttcttcgccagggcggacgccagcgacgccggcatgcccttgggagcgggcgcgggaggcggcgcttcttcttcctcctcctcgtagggctcgtcttcttcgtaagccccttcctcgtcctcgtagggctcctcgccctgctcgtcgtagtactcctcttcgggctgacccgcgcgggtcatcaccgggccctcgtcctcgagcgcctcgacgttgaggatgtagtcgccgatgtagacctggtcggtcggcttgagaacctggggcgcggcaatcttcttgccgttcacgaacgtgccattcgtggacttcatgtccacgatgatgaacttcccgtccttggcaacgattcgcgagtggtacttggagacgttgcccttcgcgaggatgatgtcattgcccggcagacggccgatggtgacttcattcttgtgatactcgcgctgctcggtcccgccgcccttttcagcgagggtgatgagaaacatggggacggatgctagcaagccccccttcgtcctcaaagcgtgagaaccgggttgcatgcttgcccgcaaggggacgggccggcatccgcccccggaaggggagaagccggcccgtgccgtgggcctcaa

SEQ ID NO: 660 - DNA, 3941 bp, Myxococcus xanthus
ttggagttgctggagaacattgagaaccagggcggtggcgcggggtcggagaaggccctggtcttcgttctgtcccgggcgatgcaggacctgttggcgcagctcatcgcggagcgattccgtctggggcgtgtcgacatcgtcaacggagagccagacagccggaaggcggcgcttcagaacatcgacgccttttcgcgggccaagggattccaggtcttgattctgagcccactagcggcgggagccggactcaacatcgtcgcggcgaatcacgtcatccactacgggcgttggtggaaccccgcgaaggaagaccaagcgacggaccgcgcccatcgcatcgggcaggtgcgtcccgtgcatgtgtactacccgctgctccaccgccagggtcgtcccgatatgggcttcgacctgcggcttcatgatctggtcgagcgcaagcgcgccatcgcgcgtgacttcctgtcgcccacgaacgacgacactcagcagtactcgggtgtcttccagagggctcatgaagagggggagggctgaagcatggatacccttgcggcgttatggcgagatccggagctgcgccatgcgatcggcatcatcgcgatgctgtcgctgctggctccgatcctggtcgaggtgcggcgacgaaagttgcgacgcgccatcgagttgctggatacgcatcttgaagacgtgctcgaagggcggcgggaggagccagggcctcaggtagaggcgcgggcgctgtggcgagccattcgtgagcagctcgtcttcccgccaggaggtcagccgatgccgcggcccgccctcatccgggcggagccctctcagggcttgcgcgagacgtgcagggcactgttccggcattcgtgggggcacgcgctgggaaagaacctgacgggcatcgcactcgtcatgacgttcggtctgctgggaaaggtactggtggggcccgtcagggaggcgctgatgggcggcggcgcggcgggggccacgcaggcggtgttgctctccgctgccatcgggcagatgggagccaagttctttgtctcagcgatgggcttggtggggtcgttcttcttccaggcgatcgcgtcggtccaggagagtcggttgctggcgaggctggatgccatgcgtcctcgtttcgagtccgctacccagacgctggatgcacacggcatcgtgttggcgaccgcgaggcgggacgcgctgagcgcgctgaagggtgagctggtccagacacgtcgcgagctctcggagcggctcctccatctggagagcgtcgaggtctcactccaggacattggcacccaggtccagacgagcttcggcaccatgatgaaggagcaggtcggtgacgtcatcacccggcagctctccgcggtggagaaggccgtgcgggagatagccaccgacctccagcgctccatcgcctccggattcgcggcgacgctccagcaggagatgtccacagtccgtgacagcctgggctccatccagcagtcgctctccgagcggcaggagcatgacctggggcgcatcctcgaacagctccgggacgccgtgtccggcggatttcattcccagtcccaggacatggcgaggcagatgcaggagctgctgggcgtgcttccccggcttgaacagcagttcgaggccatgtctcacatgatgggaacccaggcgcgtcagtggggcgcggagaaccagcgcgcaatcgacgtgctgggggctcgcgtcaccacggtcgtggagagcttcgactaggtgcgggatggactggaggtcgctgtctctcgcgttctcaaggcgtccacggagtcgtcacatcggctggggatggagaatcagcaggtgctcgggcagttggagcgcagcgtggagtccgtcgtggagcgcttccagcaggtgctagcgggcatggatgcgagcacccagcggctcgtgcaatccgcgtcgcattcagccgagcacatccatcagcaggcgggaactcagtcgatattgctgtcgcaacaggtggaggcgctccgctcggccgcgaacgtagacatgaacagcttccagagccggtccgaggaattctccaaggtcatggggacgacccaggatgggctccggcagctcacggagcaactgcgaaacacagccagccagcttgcttccgcgacccggggggccggtgaaacgcatgacaaggcgaagggggcagctgttcagttggagcaggtctctcgccagctcatcgagactgccaaggagttcaatcaggtcacccagggccgccgcgaagtcgtcaaggtggaggagaatctgctgaacgcgcagcgccaggcgattgaacgtattcagcccgtgctcaacggattgacgcgcagctacgaggagtccgtcgagaaacaggcacaggcgttgagtggccagtggaccaaggtcatgcaggacctgagaggcgtggtggagaagacgtcgggggaactggctcagggcgtcgatgacctcagcgagacggttcaggaactcagcaaggcgctgaagacgcaggtgcggcggacatgagcgcctctggagatgggagtgagaagtcgctggcggacctcatggcgggcgtcgcggtagtgttcctgctgttggcggtcatcttcattctcgaagcgcatgagcagcgtgaggccgccatccgcgacaaggaggccgccatcgagaaggtggattcgcagaaggagggcgtccaggaatcactcatcgcgctgcgggaggatttgatttcacttgatgccatgctcgatggcggcttcatcgcgctcagcgggctggatggtggcgtgaatgccttggagattgaattcaagaacatgcagttcggcctgggccagtgccggacgcctcttgcctatgtcgagcagttcgagcgcggcgctgttccccttattcatcgcgtctgccaggcggtggaggccatgcgggacgcgggcgcggagccctccatcatcctggaagggcacaccgatgaccgtccgttcctggggacgagttgggagtgcggtgtccgggaaggggtggcgcggtacagcttcgagaacaatgtgagggcgagtgccgcgcgcgcccaagaagtattcttcacggtgcgtaatcaactccgcgacgcgggctacgagcgggactgcttcgattcgaacttcgttgtctcagggcgtgggcagaccgcgccccggcctgggacggatggcagcgagcctgagaaccggcggctcgtcatccgcgtgcgcggcgacctgcgcttgtaggaactctgatgggactggatgcatggcttacaggcgtgcaggagaggcagcggaccgcgctcgcgggtctcggcacgtttcaacagcaggtggagagcgggctccggcagcttcgcgtcagcttggatgaggcacagcggcgcacggatgaacgggagcctggacgcgcgcttcgagtcctcgaatcgctcgacgtcgaaggcgtgctcgggaaggtgcgggtcggggacttttccgagttgtcccgtcgtgagcgacgagccgttccctggctgtggcgccgggtcgagccagcgtccatggaagggttcctgagtcacttcccggaaagttggccccggctcgtgaggcaacggctccgggactggtgcctggcggacggggattcgaagcgcatgcgtgaatggtcacaactgaccagtcgctattccacggactcccgcctgcttcggtggaacttgcctgtgtccatcgaaatggcgctcagtccggagggaccgaagggggtcgcggccaggtggggggaccgcccgctgcgagaggtcgtcgacttgatggggcacgcaggcctacggcccgcggtcggctattcagggcatgtcgttgcggagtatttgctgcaacggtgtgcggcgcggc

SEQ ID NO: 661 - DNA, 3616 bp, Myxococcus xanthus
atgggctccacaggataagcggggcgagggaaactggccattccaggtcatcgcgggcagctcggggggaggtaaattaatcaatcgcaaaaaccaaacacgtttaccgggcatgaacaacaaggtactgaccaaccctgcttcaccgtcatcctgagatgccggaagtgtgggcgaggtactaggggcagactcaggatacggatctgcaccgaccacaccggccggaatcggcttcatgggtcgcgagtgggacagcgacaagggcgggcgcgacgcgtggattgcgtggctctccggcgtgatgcgcgaagctctgcgggtgctcaagccaggggacacgcgctcgtctgggccctgccgcgaacgtcgcactggacggcaacggcgctggaggacgcgggcttcgagattcgcgatgtcgtgacgcacctattcggcacggggttcccgaagtccctcaacgtcagcaaggcactcgacgcagcggcgggcgctcagcggcgcgtcgtcggcccggggaagtacgcgaaccgggggcgacgctccgataaccaggtctacagctcgggcacgccctctcacctggaagtcgagacgcttccggccacggacgccgctcgcgaatgggagggctggggaacggcgctcaagcccgccgctgagcactggattctctgccgaaagcccctcgggggcactgtcgccgcgaacgtccagcgctggcgcacgggggcgctcaacgtcgccgcgtgccgaaccccccacgcagacccgacggacctcgccgaatcgaaggcgcgtaaccctgggcggcctgacacggtgacgagcgccgtctacggcaccggacgcccgcagcagcgagtcgacgaatccgggcgctggccagcgaatgtcacgctcgacgaatcggcggccgagctgctcgacgggcaagcgacgaatggcggcgcgagccggttcttctacatcgccaagcccaccaggacggagcgggacacgggctgtgcccacctgccgttccgcacgggtgccgaagcgtgcgggcgcaaggaaggcagcgcggggatgaactcgccacgcgcgggggcgaactcaggaggcgggcgcaaccaccatccgacggtgaagtcgctcgcgctgatgcgctggctttgtcggctcatcacgcccccgggcgggacggttctcgacctgttcgcgggtagcggctcgacaggtgtcgcggcgctcgccgagggcttcgatttcatcggcatcgagcgcgagcccgcatatgcggagattgcgcacgcacgtctgtgtcatgcgattgagccactcccgaaatccgcacgcatttagagaaggtgacgccttccgtcgacctccccaagcacggcccctcggtgatcgccggggtcatccagcgactgagcgtttcccagctcaagcgccacaagctgtgcccgcgcgcatggttcttccagaaggtcatgcgcgtccccgagcccagcacgggagcgcagcaggtcggcaccgaaggacacgcccagcttgaacatttcctagtgacgggtgaagacgtcctgggcacgttcgcgagggcaggcgcccatcttctgcccacgcccggtcccgacctgctcgtcgaacagcccctgaacggtgaaccgccgctgatggctggcggcatccccttcaccggattcatcgacctcgtagacgctcgacggctcgcctctgacggcgcccttcgcatcaccgaccacaagttcaccagcaacgtcgcgacgaatgccgcgagcgctgaacagctcgccgacgccgacaccgaacccggcttgcagatggtcggctatggcgcgtgggcactcagccaggttgagcgcttcccggggctacgcacgctggagcttgaacacctctactaccagacccggggacagcgccttgccgcgtccgtcgtcgcaacggtgcccgccgagcacgtcgagcgcgagtggcagacaaaggtcgagccccaggtcgaagcgatgaaagagcacgcgcaagccgcccgcgcttccgacgtgcccgcgaactacggccccccctgcggcaagtatggcggatgtccgttcatggcgaagtgcctcacaggagagaacaagacgatgtccctgcgtgacaagctgctcaacaaggcttccgaatccactccacttaccgttgccgcggttgagcgcgatgccccggagccgcccgccgttcttcccccggacgcgcccacacctacgcctgtgcagacggctccggaggtcgcccaggccactgagcagcccgcgccgaagcgtcgcggtcgccctcgcaaggcggccgagtccgagcagcccaccgacgcggccccgtcgcctccgagcgcgcttcgcgtgctcttcgtcgactgcatcccgacgaccatcgacggaccgacgcctgagtcgcttacgagctacgtcgacaccatgcatcgcaaggtggccgaagcgggcggcgtcgacgacgtgcgcttcgcgggctccgactcggcgctcgggttcggcaagtggcgcggggcgctggccatggcggcgcgcgccgagctgcccgcccccggcagctacgtcgcgctcggggtctcccagtcggagctgatgcaggtcatcgtcgaggcgctcgaaccggcgttcgacgtggtcgttcgaggtcttcgctagctcccctggcgctatcgcaagtaatgtttcccatgccaatgcctcaggatttcccacccaaggcacgacactcgcaatccactactcatccacaccagtctcagaactcatgcgccgagcaatctcttcggcaaccaacgtctgcaactccgcctcagacacacccatcctccgtcgaaactcaacagacacctcagtggcaagcgcgtctgcttcacgcagtttttcatgcaccacccgcagctcatcaatcatcacaccaatgccacgcgacgtcataatcgaccaatcatgtcgcctaaaaaacgcatgcgccaagtcattccgcatatgcagatactcacgcagtttctccgcaagcttcggtgctggatctggctgtttatcaagcgccccaaccaactgcccgagagtccgacgtgagagttgctcgtcaagtgcatcaagctcctgcacagtcacctcattcacctgaaatctcttcagtatgagatggagcgtaaccaactcagcctctaagagttgtgctgcgtacatagcgccgccatgccaagcaaacatctccttcttgagttccgatacgtcctctgcgctctccatatgacctccacaacccaataatactgaaaacccccatcgattcgaccaggtccttcgacgtcgaagtcgagggaccggcattccatcctaatcaacgccggttcctttgagtgtttgggactcttcgggttcgagcccagagagccgaccgtctcattcaaatcttccaatcccagggctgaatattaaaggagacgagagtcctccagtaagccctgcgtacaggctccctacacagacggcttcttaacgggcgcgaacagattgaccagtcggctctcgggggggggggcatgcaaccaaagaacatacccagg

SEQ ID NO: 662 - DNA, 4819 bp, Myxococcus xanthus
aaagcttctggaatgaccggctggatgccctggagcgggagctccgcaagcccgagcgcggcagcgccaggaagggcgcgcgacatgagtgagggccggatgcgtccggccgtcctgtcgcatgcgacgtccacccgcgaggaggtggacgtcattctccagcgcatgggcttggggccctggcgccccgcttagcggtggggccagaagcgtgccgcgaagggcgccgtggtggacgagccttcgtcggcgcggaggcccgccacgcacattgagccatcggtgtctagcgcggcggcgagggcaacctcggcgcccggcaggttggtgcggtgcgtccgcaaggcggtcttcccatcggcggacaggtggatgaggccgatgccatccgtggcgccattgatggtgctggccaccgccaggaccagctcgccgccatgcaggatgcccgtgcccaccagccgctcctgctggactcctggcgcggaccagtgggtgacgctatcgccatcccagccgaagctcgtatcagggctgccgcttgcgtggacccgtgtcaccgcgccgctgttgggggaatcggtgcccgcattccaccgcccgctgccgcccaccagcaacttgcccccgtccagcaggtgcagggtccggggggtgaggcgaggccaatccgacgcgcttcggtacgtgaagctcgagtcgggcgtgccgttgacgttgtagcgccgcaaggccatgcgattgcggatggcattcgtggttcccgccaccacgatgcggtcgtcggccagggtgacaacggccaggccgtcctcgtctgcgcccaggtcatcccaggccagtccatccgagctgaaggtcgtatcggcggcgcccgtgggcgtcaggcgcatgatgacgaagtccaggtcatcgtgctgcacagtgccggcaccgacgatgcgccccctcgaatccaccgtgacggcatgcagcgtggcgttgcccgcggaaatctggaaggtacgcacccccgtgtcgccaaaggtggtgtccaggtcgcccgccgaggtgtaccgggcgaagagcaggctctggtactgcctccccgagcagctcccaggacccgcgatggcgccccccgcgacgaggattcgcccgtcggacagcacggtgacggcgtccacgtagtcatcgccgccacagacgtccagggtgacggtgccctgggtgccaaaggcagggtccaacgtcccgttcgggagcagacgtgccaccaggacgtcgcgcaggccggtggagcccgtggcgcccgccaggatccacttgccgtccggctgcgccgccagggcgtggatgcgcacctccgggtggccgaaggcgggcatcgccacgccattgccgccgaacgaggtgtccagcgccgccgggccgggccggatgacgaggttcaggggatgctcgacgcgagcccctccgccgctcgcgaccagcgttacgggcacactgccgtagcgggcgaactcctgggcggcgagcgagagcgtggcttcggactccgtggcggcgatgacgtcggtggtcacgtgcacatgctcgggaagcccctcgatggagaggtgcacggcatcggtgaacgtgggctcgcgggtgatggtgacgttcagccccgcgcttgcctccgggatgaaccggagtgtcacttcggacgcggtttggagcgtgaagcccggaggcggctctcccgcgtcggggtcctccgtcccggcatccgtgcccgcgtcgttcgtcgatgcccccgcgtccggccgctgggggcccgcatcgggtctgggggagggcgacggctccgaaccaccacagccccaggtgacgggggccaggcacaggagcatcaacgccaggagcgacttcacgcgcggcgatgggaagcccatgacattggaggagcctcgacggcgggaatgcgcactgtccgtggaaatcatatgagccggcctcttaagcgaggactcggcgactcgtaaagacagacgcctcagtgttcgccgtgttctcgcgacgcgtcatccgtcccgggttgcgtgccccggagctgcctgaggaggtggcgcggccagaagaacagcgccattccagccatgacgaggaagaggatgacgaagggcagcacgagcacgccgccgacgaagccggccgccatgccgcccagtccccacaacaggccatggggaaatcccaggacggcgccggtgagggtgcccaccaccgcgcccgccaggacacagggttcaatgaggttcactatgagctcccacgttgatgctcgtcacgagcctgggcgggaacacgcatgagcaagtcgcgacgcaaggtggtcctcatcactggcgcatcctctggcatcggtcaggcctgcgcggagctcctgggggcacatggccacgccgtccatggtaccagccgccatccccgcgcggatggtgcccaccaccggatggccgtgttggacgtcacggatgaggattccgttcagcgcgcggtggcgtcggtgctcgcggccgagggccggctcgacgtggtggtgaactgcgcgggcttcgtgatggccggcgccgtggaggacgtgtccgtcgaagaagcccagcggcagatggacaccaacttcttcggcgcgctgcgcgtctgccgggcggtgcttcccacgatgcgcgcgcagcggtcgggcctcatcgtcaacatcagctccatgggcggcgccgcagggcttcccttccaggggctctatagcgccagcaagttcgccctggaggggatgacggagagcctccggcaggaagtcgcggccttcggcatcgaggccacgctgctgcagcccggggatgtcctcacgcgcgtgcgtgagtaccggcagcgcgcccggcagtccggtcccgggtccgcctaccaggaggccttcgagcgcgtcatgaacctggtggagtcaggagaaggcgcgggcgttcctcccgagcacgtcgcccggaagctcctggccctggtggagcggcagcgcgtggacgtgcgctactccgtgggtcgcctgtcgcagcgcatcggcctggtgtcgaagcgcctgctgcccgggcgcaccttcgagcacctcgtgatggcgctccacggcatgtcgcggcgctgagctgggcccaacgggttgcacattcctgacataggactgtcaggggcgggtcccaggatggcgtccacgaagccccttgggttctcccgacccaggggcgttcgcatcccacgcccaggtgccacccgacatgattcccttcttgatgatgttgccgatgctcgtccccgcgggtgtcaaacgtggacgctccagcaaggcacggagggaaggggggctgagtccagtgccttcacccacggaggaatcaggaagcgcgccgcctgtccgcgcctcctcgcggcggcggctgccggcccaggtcctggggcagcgggccctcaaccgggccctgctccagcgtcagtggctgttgcagcgttcccgggcgggcgtgatggaggcgcttgagcacctggtggggcttcaagcccaggccacccatcctccctacggcgcattgtggacgcggctgaacggcttccagcaagaggcgctgacccggctcatgaccgagcgccaggtggtgcgcgccgggatgatgcgcgggacgttgcacctggtgaccgcgcgtgactgcctcgcgctgcgtcccgtgctgcaacccgcgctggacagggggctgaagcactcctcccatggcaagcagttggcgggcgtggaggtccaggcgctggtggcggagggacgggcgctgctggaggcacgtcccagtccccggggcgagctgggccagcggctccaggagaggtggcccggccatgatgcgagcgccctgagcctgggcttctcgagcctggagccgctcgtgacggtgccaccctgtggaacgtggggccatggcgagcggatggtgtacgccaccgccgagtcctggctcggccagcgcttcgagcccgccgcgccgccagacgcgctggtgatgcgctacctcgccgcgtttggccccgcgagcgccaaggacctgcaggcctggtcgggcctgccacgcatgggcgctgtcctggagcggttgaggcctgagctgcgcgccttccgtgacgagcacggcgtcgagctgttcgacatcccgaatgcccggaggcccgacccggacacgcccgcgcccgtccgcttcctgtccgaattcgacagcgtgctgctggcccacgcggaccgcacgcgcatcatctccgatgccgcccgcaagcgcgtcttcaccatcaacggcatcgtgcgcgccaccatcctcgtcgatggcttcgttcgaggtacctggcgcattgaacgtgcgcgcggcaccgcgaccttgtgcatcacgcccttcgcgcggctgtcgcgtgaggaccgcgccgcgctgagcgacgagggcgggcggctgctcgccttcgccgcctcggatggccagcacgccgacattcgcttcgagcgggtggggtgagcccgttccatgtcgagccggtgcggggaggcggcgctccagccgggccggactggagcgccgtcgtcttccccaggaaggtgtgaggctcaggcgttgagggtgctctcgtcgacgccggcctcggccatcagcgtgaccagcgcgagcttgagcttgtccttcgcccgaatctccaactgacgggcgcgctcgcgggagaatccgaagtgctcgcccagctcgctgagcgtcatctccgcgtcacccatgacgcgctgctc

SEQ ID NO: 663 - DNA, 5099 bp, Myxococcus xanthus
tctaaagatgcgcgccgggtcgtcgaagaagagcgcgaaggacgccagcaggtccgcgcggccgaagccgaggaagccctccaactgcccgtacagccccgagcgcgccttcacccgcgcccgctccagcgtcgccgcgtcgatgggctgattctgcagctgcgccaccacgccgtcgatctccgcgaggagggtctccgtcgtcgtgtccgcgtcatggaacaggtacgcggtccactgcatggggccgttgtagttccagtggttgcccagctggttcaccccgccggagacctcgcccgtcaggcccttcttctgcacgagctgctggtagagcgcgctatcgttgccttgcaggaggacctcgtcgaccagcgccatggcgaagtactcgggcgtgcccacgtcgggcatgtggtagcccaccgcgagcgccggacgctgcgccagcttgtcctgcttgtcgtggcgcttctccttcgtctggcggggctcggagatgtccggcttcgacggctgcgccacggtgggcagcggcccgaagtacttctgaatccagcccttcacctgctccggctcgaagtcaccgacgatgaccagcgcggcgttgctgggcgcgtagtacgtcttgaagaaggcgcgcacgtcctccagcgaggcggcctccaggtccttcaagtcgccgtagaagttgtgggcgttgtaccagttggtgttcgccacctgcggcatgtccagccacgggaagccgccataaggctggttgaggacgttgaccttcacctcgttcgtcaccacgccctgctggttcttcaggttctcctccgtcacgtcgagcccgcgcatgcggtcggcctcagcccagaggatgggctccagcgcgttggaggggatgacttcaaagtagttggtgaagtcgaagcgggtggagccgttgagcacgccgccgttcttctggatgaggcggatgaactccatcttcccgaggttcgtcgagccctggaacatcatgtgctcgaacaggtgcgcgaacccggtgcggtccttcggctcgatgcggaagccgatgttgtaatagacggcgacgacggccttgggcgccgagctgtcgcgcgagaggaccaccttcaagccgttgtcgagcttgtagtaatccacggggacctgaagcttcggctgttcggcgggagcttccaccttcgccgcttcgacggcgggcggtgtctccggcttctgggcttcctgcgtggtcgcgcagccggtgaacgcggccagtgctaccgctccgaatactttcctcatcggacctcccctggatgacctggcatctcgtcgaatgacggagccactacggcgctgtgcgccttccgattgccaaagattcagggtcccggcaacccgaacgcaccgaaagggaaggtctgttgtcctacgtcacgaggaatggcgcggcgcagtaggagcaatccaccttgtcccccggctggacggcctccgcactcacgggggcatcacacgaaggacaacgcaaggccacgttcttcccccgctccaaagcttcgcggtgaaggtaaacacgcgagtcggcgaggtagacgaggtccacctcgtgacgggcgatgagcgtggtgagcatcgccgcgacctcctcctccgggagccggaactgcgaggccacgtcactgacgcggatgcgcgtctgcgcgcggatgaagcccagcaactgctcgtggcggcgcgcggtccggaagggagacagccccttcttccacgcgaagcggcccacggcgacgaacaccgccgctaccagcaggatgcccacgccatccgaggtcgtcttcccctcgtccggagagacgctttgcacggcgcccaccatcacgcccagcgcgccgacgaagacgaggttcgccccccacagggccagcagggcccccagccccatcttgagccagtcccagtatctccgcggcgcgggcgctcgaacggcatgcggacgggggacggctgtcacggagggcgacggggcatcacgaagatgtggggcgttcatggggtctcgcggaacgagccggcgcattctagggggcgacgccggcgcgtcacctccgggaaaaacagtcagcacggcagctcccgcccgccgggcccggctcaactccatgttctcaaagaaaaacctgcataacgagagggattccgcatggccagacagggtgtgcccctcgtgtgcgggctggaatctgcctacgctccaggtttccaccaggaggtggcgcgattctcccttcgacctcccagacctcccccgccggctggcacgacacgctcgtgcgacacctggaaccgctccttggcgggttcaccgcgaagatggccatccagaccgccgccctgcggaccctcaagcggccccccgagcagctcaagcgagaagacctcccgcagttgctcgaaggcctcaagcccatgctgaacaccttcatcggcgccctgcacgcgaaggtcatcctggcggagatttccgcctccttggagaagctgcgatgagtactcagtcgacgggccgtgcggccggaagcatcgtgccctggttcggcgcggtgctcgtgctccagttggcgcacgccttcgcggcggcctccgcgctggacgcgccgcgttcgctctcgctcgtgcatgacgtcgccggttggggcagcggcgtgctggccgtgctcgggacgctggcggcggcccgttcgttcgcccagggcgactacctgcgcaaggtgtggggcggcctggccgcgggcgcgctcctgtcgctggtcagcaccgcgctgcgcagctactggctccacgcggtgccggacgtgcccttcacccagtcaccgctgctgcccgtccgcatgctcgtcgtcgtgctggcgaacgtcagcacgacgtacgcgctcatcctgctggcgatgacgtaccggcagtccggactccagccgccgtccagcgtccgctccaacgcgctgtgggtgggaacggccgtggccgcgctggccgtgggcgtgcccgtgctggccaccgaggtccgccacctgggcacggacgccatcagcaccatgtccgccgtcatcagcctggcgtcgacgctggccgacatgacgaccatcctgctggtggcccccatcctgggcgtcgcgtacatgctgcgcggcggacggctggcctgggtgtggtgggccatgggcgtctctggcgccatgtggctcttctacgacgcccgcgtgtggctggggcccctgctgcccggagacgcggcgcagaacgcggagttgctccgtacgctgcgcacgtcgggcctggtgctcctgggactcgcgggctggctgcagcgcaccgccctggcgccgcagcagtcccccgtcgctgcccaaacgcacgccggggtgtcctgagccgtcgcgcgcgcggctacgccccttccagggcggccgccggctccgtcagcaccgtgagaatgggcttcgcgtcctcgagcgagggcgcgaagagggagggctggccagggtcgtcgaacacggtccggaagtcctctggcgtcagcgcgcgcaccagtcgcgcggcgaacgtctcacgcaggagccgcacgtagtactccacgtcgtagtcgcgcgggtcctcctcgcgtgacaggggccgcgccgtgcccgggtcatccgcctccggaatggggagcaggcccgcccggcctcccacggcgcggtagacgcggacctgctcacccaaaggccattccttccggccgctggccagcatggcctcgtaggggagctcgcgccggcggggccggagggcgaggtactgggcgcccgtcttcgtcaggcggacgtgcgcgcagacctccggcgtgggcagctcccggcggcgcagggccatcaccgtcgcgacgtacacctcacgaacgcccgggatgtcttccgccaggagacagcgcaacgcgcggcgcaggaaggcctctccgaagggctccgcgcggctggagcggaaggccacgccccggagcaccagcggtccgtcatacggctggagcgcgtagttcttcggttcgtgcgacagcatggcggcgtagcgcccgtcgaactccagttgcacgcggggcggcagcagcgcggcgacctccgagacgacccggcgctcgtcggcctcccgccagtcctccgggacggcgaagtacacgccgtcggtgtccgcctccagcagcgtgacgccccggcgagccagctcccggcagaggaggcccagcacctcgcggccctggcgcgtcacctcgttggccgcgtgcacgtccgagaagcgcgtgagccccaccgcgcccagatagccgtaggcggagttgacgacgattttcatcgccgccgacagcgcctcgttcgtgaagcgctcctgcgagccaggcgccgcggcacgcgccctgcccttcgccgccagccgctggtccaccaggcggtccaccaacgccagcagcacgcccagcctgtcccgcttggggccaatccggtactggcgcatcagggagggatagaggctggcgacgtccgccttcacgatgcgccgggccacgcccgtggcgaacaggtggagcgccgcgccgctgtgcggcgtgccatccccctcctggtgcgcgggcagcgccgcgccctcccggagataggcccggacgagcagcgggtccaacacgccggtggccggccccgcgtccgccagccgctcgtagcggcggggcgccatgcgtgcgagcgcaaaggccgcgcccccgagcagcctcgcgaggccgcccgcctccgtcacgtcatcacgcgcatagcgccgcacgcgcgccgggtccgtgcggaagacgtcatatacgcgggcaccggggatgtgctcgcgctcgggccccgccaggcccaggtgcttcgcgacggccttgaggccatggcccggcaaatccctcgtggagaagtcatgccgcagcaccgcgtccagcgtgtcgatgaactcacggcccggcacggtgtagcgcgcacggcgcatcgcatgcggaggcccgccgggcaccggccgtcccagcgcggcccccctgg

SEQ ID NO: 664 - DNA, 4162 bp, Myxococcus xanthus
  unsure (1)..(4162): unsure at all n locations
cggaaggatcgacaccggcgccggctgggcgggggagacggtgcgcttcccgggcggcggcggcgcgcagtggatgttaagctgcgcccccgtcccgtgcaggcggagctgcccgtgtggctcaccgccgcgggaaacccggagacgttcatcaccgcgggccggctggggtgcaacatcctcacgcacctgctggggcagacgtgggaggacctggagaagaagctgtcactttaccgtcaggcctggcgcgacgcgggccacgcgggcgagggccacgtcaccctcatgctgcacaccttcatcggcgaggacatggcgaaggtgcgcgaggtggtggagcagcccttccgcaactacctcaagagctcggccgacctgatgcgcggcctggggagcacgctgggcatcgacatggattcggccacggaggcggacctggaccggctcgccggccatgccttcgaccgctacttcgagacgagcggcctgttcggcacgccgcgttcggtgcgcgagcgcgtcgggcagctctactctctgggcgtggacgaggtggggtgcctcatcgacttcggtattcccgcagacacggtgctggccagcctgccgctgctggacgaagtgcggcagcgctgcgtgcgggacagccgccgcgcgggcacggcgaagacgattcccgagcagctccgcgagcacggcgtgacgcacctgcagtgcacgccgtccctggcgcgcgcgctgctgtccgagcccgagtccgtcgaggcgctgggcggcctgcaacggctgatggtgggcggcgaggcccttccgggcgcgttggccgcgtccctgcgcaaggcgctgccggagtccgccgagctgctcaacatgtacggccccacggagacgaccatctggtcctccacggcgcgcgtgaccccggaggagacggcggccgtcgtctccattggcacgccactgctgcgcacgtgcttgtacgtcctcgacgcacggatgcggccggcgccggtgggcgtggcgggtgagctgtacatcggcggcgcgggcgtggtgcgtggctatttgggccggcccgagctgacggcggagcgcttcattccggatgcctgggcccgtgagcccggggcccggctgtatcgcacgggggaccgcgcacggtggcggcccgacggcaccatggagttcctcggccgtgtggaccaccagctcaaggtgcgtggcttccgcatcgaggcgggggaaatcgaggcggcgctcaccgcccagccctcggtgcgcgaggcggtggtggtggcgcgcgaggatgtgcccggcgacgtgcggctcgtggcctacgtggtgcccgcgcagggcgccacggtggaggcgtccgcgctgcgcgacgccctggctcagcggttgccggagcacatggttccgtcgctcgtcatggagctaccggcgctcccgttgacgcccaatggcaaggtggaccgcagggccctgcccacgccgaacgtggtgcgctccgcgaaagcggccttcgtggcgccgcaggggcaactggaggagcagattgcccaggtgtggcgcagcgtcctccgtgtggagcaggtgggcgtgcacgacaacttcttcgacctgggcggccactcgctcctgatggtgcaggtgcacacccagctcaagtcggtgctgggccaggacctgcccctgctgaagctgctggagcaccccaccatcagcaccctggcgcgtttcgcgcggcaggggcccgcggcggcgcagtcccaggtggaagccgcgcaggaccgggccaagcggcagttggagagcctcaagcgtcagcgtcagcgcgccaggaagtagcggcgcggggagcgcgcgggctacgcgcgcgtttcgttcagcgcctgccggatggcgcgtgccaccggcgaggcgtcgtcctccgggccctgtaccgagaagggggcgcgggacaggagcggcggctgggccatgaagcgcggctgggttccctggtgcggctgggcggcatggaccaggaaggggtggcacaggtacacggtgccggcctctcccgtggcgagcgcgagcggccggtgggccgacacgtccaacttcccggcgagctccatgaacgtcaaccccgcgtcccccgcaggggccaacacgcgggcgacgtcccggtgggagcccacgcggatgcgggtgggggcgtcgtcctcgcccacgtcggagcagaggaagagcatcagcagggcgcgggctttcgacgccacattcacccgccaggagaaaaacgagctcgggtcgtcacctgggaagctggcatcgacatgccagccgtcgtctccaggcgcgtccgggctgggaaagcgcacggggaaggtgcccaggctgcctcgagggagccagcgtccggggcccaccaactggtcgaacgcgcctcgcagccggggcgtgttcgccgccagccggaagggctcctgcgcatagtccccgagccggatgaccggctgcttccaggtggccggattgtccggggcacaccccgtgtcgcgccacagcagctcgcggcacgcgtccgccagctcgcggggaaacgcctggtccagtcggacgaatccacgctcgatgaactgctccacttcgcctggggaaagctccattcgggttgcctcctcgtggtccggggccagtcgcccgcagcgcggtactgtattgatttatcataagaattcatacgtccggtgattgcttcgcggcgtggagctcgggctgcccatcaggtggagccggctggcgtgtgcaggacacatccaggccattgcgtttgctggtggaatcccctgggcatcggccctgggggacgctgggcgactgataggctttatgtatatgggttctacgatttccccggaatggaggcggcgcgcactctgactggcgggtgagtcatgtctggggagtgttttgttcgcaattagttctactgaggtcatccatgtgtttgcttcggggtttgttgattttcaagtcaggcatgcatcagtcgaagtcttggtgattgagagacatggggtgctccgtttggagtgtccggttctcgtgaaagtgcacgaaacggcttcgtgctgacgggcttgcgccaacgttttggatttggcattgatccgttcttccttgtatcgggtctatcgagggggaggcggactgcgtccgtcgtcatctcgtttgccgaggaaaagcccggctttcgagcgtgccagttagaggtccgagtgtcgccacaaaatgggttgtcgaaggcgggtttggccgaagtgcgggctcgtttgaccgcggtccttgctcagcgattgggaatcgaggctcacacgctggatgtccgagagcgcttcagcctgtatgggcttgattcgctgaaggccaccggcttcatcgcggaagtgggggcgatgctggggcgttcattgtcgcccacgcttgcctgggaatatcccacgttggatgggttggcccgctacctcgcgggggagcgggatggcgcgtcgtcgcattccctggcacgtatcgcccgggcccatgagcctattgccattattggattggcctgtcgttatccccaggcggcggatccagaggccttctggcgcctgctcgtgggcgggacggatgccattacggaagtgccgccggaccggtgggacgtcaaccgcctttatgatcgagaccccgcggcgcccggcaaggtgatttcccgctggggcggctatctggatcgcgtggatggttttgacccgctcttcttcggcatctcaccgaaggaggcgctccacatggacccgcagcagcggctcatgctggagctgagctgggaggcgctggaggacgcgggcatcgcagcggaccggctgcagggctcacccacggcggtctgcttcggcgccgcgtggatggactacgagatgacgctgcagcgtttcggcatgaagcgcatctcctcgtacacgtccacgggttatcaccacagcgtcctggccaaccgggtctcctacgtcctgnggctgcgggggccgagcttctccatcgactcggcctgctcgtcctcgctcactgcggcgcacctggcctgtgagagcctgcgcangggcgagtcgacnctggccct

SEQ ID NO: 665 - DNA, 4094 bp, Myxococcus xanthus
ggagacacgaagacgctgttggctcgggtcgcggaggtcgaggagaccgcacgcgaagcgccgctgtggacggaccgcgtccgcgcgctggtggccccggccgaaagcccctagcgggacggccacgcccagtgcggggccgagaaccgtgttagcacggggtgtcaccgcaaaggcacggagggatgtcccatggccggtgggcccccacgcgaacacgccatatcgctctacggagacgagctggaacccggagcgctggtgggcgactgggtcatcgagtcacgcgtccacgcgggcgtgaccgcgtggctctatcgcgcgtcgcacctgtccacccgggctcccgccgcggtgaaggtggtgcgtgccgagttcaaccacgtcaccaacgtgctccgccgcttccagcaggaagcggacacgctccgggcgctgcgccatccccacatcgtggaggtgctcgagcacggcgaccttcgcgacggacgcccctggctggccatggaatggctggggggcgaaagcgtggaccagtggctcacgcaccgaggtcccttctccctcgcggaggcgctgacggtgatggaggaactgggcgccgcgctgcacttcgctcatggccgcggcatcctgcaccgggacctcaaggcccagaatgtgatggtcatccccctggcggagggcttcacggtgaagctggtggacttcggcatcgcccgcgtggagccaccggaggggctcgctggcctgacgtccggcggcgccgtgctcggcacgcccgtgtccatggcccccgagcagattcgtggacaggccctggacgcacgcaccgacctgtacgcgatgggtgtgcttctctaccaactcctcaccgggagcctgcctttcgagggcaccagcgtggtggaggtcgaggagcagcacctccatgcgccaccaccgcacctggatgaacgggtgcacgcaccgccagcactggacgccgtggttcaacggtgtctcgcgaaggccccaggggaccgctggccggacgtgcccgccttcctcgatgccttgcgcgcggcgctggcgcccaccccggatgcgacatgggccgtggctgtctatgtggacctccgcttcccggtggccctggatgagcccaccgacgcggacctggatgccagggacgccacgctggacgcgacgctcaccgaactggagacccgaggctggatgctcgccctggagagtggcaacgccgtgctcgcgtggaagtcactgcctcccgcctccgaggcccgtgtccctgccctggtggaagcgcgccaggtggcggattcgctgttgcggcaagcgtgtgaggccgcgggtgacagcgtggaagtccgcgtctatgcgcacgcggccctgtgtgagctgaacacggacgcccagggccttccgcggttggcgggtggtgagttgctgcgcctggagtcctgggcttcgggaggcacggcgggcgaggtcctgctgtcggatgcactcgccagccggtgagcgggctacgtccgcagccggtgccggcgcagcaggcggtacaggtacacgcggtccatgtccgcggcggtggcggcctgcgacaccttgcctccgtggagcttgaggagcgcatccaggtactcgcgctcgaagacctccagcgcgcggcggcgggcctccgcgtagggctgcttcgggtccaccaggctgcgcagcaccgcttgcgcgctcacctcctcggcgtccggcggcatggcgtcctggaagacgaggcaacgctccaggtggttgcgcagctcgcgcacgttccccggccacgcggcgtgctggagctgcgcgatgaactccggcgtgctcagcgccgcgagctgctcggagccggccccgaaggccatgaggattcgctccgcgatgagggggatgtcctcgggccgctcccgcagcgcggggatgatgatgcgcaccaccgcgaggcggaagaacaggtcagagcggaagcgcgccgcgttcacctcggcgcgcaggtcccggtgcgtggcggcgatgacacgcacgttgacgggctggtacccgttggcgcccagccggcgaatctccttgttctccaggacgcgcagcagcttcggctgcagctccgcgggcagctcgccaatctcgtccaggaagatggtgccgccatccgcctcctcgaaggcgccaacgcggcgctggatggcgccggtgaaggagcccttctcatggccgaacagctcgctctccagcaggttgccgggaatggcgccgcagtccacggtgaggaagggccccgaggcccgggcgctggcctgatggatggcgaaggcggcgcggctcttgcccgtgcccgtctccccctccagcaacaccgtcgcgtcgctcgcggcggctcgctccatgagggcgaagctggcgcgcgtcacgggcgacgaacccaccagctcaccgaacgtcgtgcggtcggagatgagcagccggttcgtctccgggctgaagtcgaaccggacgctcacccggcccaggcgcaggatgctgccgccacgaaggtacgcgtcgcgcacgtggacaccgtcgagcaccgtgccatttcggctgtccaaatcccgcaggcgggcgccgtcgtggtcgaccttcacctcgcagtggaagcgcgagacggtgggctcctcgatgacgaagtcgttgagcccatgcgagccaatggaaaacgtgtccgcgttgctgtccttcgactgcccaggctgcggaccttcgaggacggtgaatcggaagcggcgaacagcgcccgaggtcccgggccttcctgtacctgtgggccgcgtctgctggacggaatcaggcccttcggctggacggcccgccccctggggtcgctcggtgtgactcataaggaatggacgctatcaccgtggacgccacgccagcgggcccggtggccatttgacctaccggaggccccattcgacgacgaagtccggcccgtcctccacgcgagacagccgggcaaacgactccgggcgttcgtcccccgtccacagaccgacgacgtcgcccaacagccagtgggacagtgagcgcgccacccgctgcaccccgtctcgcggcacacccgacagcgagcgctgcgattccatcatcgcgcgcaccgtccgcgacggaaccacccagcactcggcccgaggaaacggaggcgccaggaacaggcagaacgcggcatcggtccgcagcaactgcgcgtccaggtgctcccggcccagccggaatgcgggcagccactgaccttctccgcgctgttcgagcttcaccacctgcacggacaccacgcgccgcgtgcgcaggaagtcgcccaccgccacgtcgaggacgaaagccacctccacccccagccgcgcggcggccaaaggcggaggcacggcctccggagccacctcgccgtccaccgggacaggctcgggcacgggctccggttcacggcgccggaccgtcatcgatagttcccacggcgagggctgcccctgggccatcaacgcggcgacgtccgccttcacccgcgccagctcggcgcgcagtgcttcgagcaggtccgccgccagcgtctcggtgtcctcgcggaagcgctccggatagcgagaagagaactccgcctccactcgaccgaaggcgcccagcaacagctcctccaggtcccggtcacgcagccacgtccggcctccgagcggcaccgcgcgcgtcacatgcaggtgccgcaacgcctccgtcaacgtcgcggggcctgaagcctgcgaaggctccacgggggcacccggcttccccttcgccgacgggccctggaaccaggactggagcgtccggacgcggaggcgaacacgtgacgacgggtgctccttcagccgcttcacctgtctccggtcggtcgcggtgcgcaccagcgccagcaccgtgagctccgcttcggacgaagcggcatccggcgcgcaccagaggaagaactcgatggccgccttgcgcagcacgggcttgcgccccacgcggtcggcgacttcctgacgccacgccgccagctctttagagac

SEQ ID NO: 666 - DNA, 3297 bp, Myxococcus xanthus
cctggcggagtggaagaaggaccgcgtggtcatcacgaacgcggcgggcaagccggtgcccaaggaggaagcagacgaggtggcgaagcacctgccggagctcggcaagccccaccggatggaggccgcctttccgaagaatcctctggcggtgggcgccaccctggaaggcttctccgatacgctcgcgaagcaaatcgtggacgagcagggcgataacacccgtgtcacccaggcgcgcgcacggttggtcgaagtgcgtcaggacccgcgcggcgccgtgggcatcttcgacgtggcgatgacggtgttacgccaggaaaccaaggcaccgttcctgctgaccattccgctgcaagggcagatgtccgtcctcgcggagggcatccagttgctggagctcaccttgtccgggccggtgaaggtggagctgaccgacgacgccgtcgagcagggcttcgaggcgcgcggcgagggcgcgatgcggctgcggctcatgggccggaaggctgacgccgcgcgttaggtggatggcccggcaggtcgtccgctgggcgcgaaggcgcggaggcgtgacagacggctgacagagttttgggaggctgcgcggttagagggttctgaatgtacctgcacgcgctcggccacttccatcctcccaaccttctgaccaacgccttcttcgaggagctggggctggagaccagcgatgcgtggatagtggaccgcgtgggcatccgcacgcggcacacggtgctgccgctggactacctgcgggagacgcgcaatcgcgacgtgcgcgcggcgcaggaggcggcgctcttcagcaacgcggagacgggacgccgcgcggcgctgatggcgctggagcgcgcggggctgaagccgtccgacatcgggttggtggtggcgggcggatgcagtcccgacgagtgcattcccgccgagtccaaccgggtggcgcagttgctgaacatccatgcgccggcggtggacctgcagagcgcttgctcgtccttctgcatgcagctgcacttcctggcgggcatgcggccggagcggctgccggactacgtgctggtggtcaacatggacaactccacgcgtgtagtggactacacggaccgctccagcgcggtgctgtggggagacggcgcgtccgcggccatcctgtcgccgcgcgtgccgggacgctggcagctcacggagacgctgctggccggagacccctcgggcgcggacaaggtgcgcgtgccgcgcatggggcacttcacccagaacggcggcgaggtgcagaagttcgccatccgccgcgcgggggagacgttccaggccctgcgcacgcgcttcatggagcgtcacccggacaagggcgcgggggccgtctccttcatcgggcaccaggccaacctgcgcatgctggaggccgtgcagcggcggtgtgaggtgccggacgcgcggcacttcttcaacgtgcacacccgggggaacaccggcgccgcgggcgcgcccggcgtcctgagcgagcactgggacgaccccgccgtgggagacgcggtggtgctgagcgtcgtgggcagcggcctgacgtgggccggcgccttgctggagcgcaccccggcgcagtgagccgcccggcgggccccacgcggttgattgcccgacgttgagcctctcgggacctgtccccgtccactgctgtacagcgttgcccttccgggcgttggcggtgcccgggagcgtgtgcagcgtatgtcctgtcggattcagtggggtctggggtcgggggtcgggcgcatgcgtactcaagcgtggggtgggaatctgcggtgtctcgtggcgggcatgctgctcgtcgcgggcgccgcgcaggcgggacagaagcaggttggcggcgtgcacatgccggtgtcgctgaacctcaaggggcgcaccgtcgaactcgcccacatggagctgcacaagcaactcttcttcaaggtctacgtctggagcctctacatggaggaccggccacgctccacgcacgaggccatcaactccaactccgtgaagcggctccacttccacttcctgcgcaacatctcccgggaccagctcgtgggcagcttccgggacgggttggagcacagccccgccctgcgccgggggccgctggcgaaccacctgcgcatcatgctcgcgtcgctgaaggacgtgcagaagggcgaggacctcgtcatcacctacaccccgggcgtcgggctcgaagtcggaggagatgcctccggtggcgtcttcatccccggcaagaacttcgcggacgcactcttctccgtctggctcgactctcatcctatttttccgcgctgactgacacaccgggctgtcccgtcagccattcattcgtttcagcacaaaatatgtgcgaggttcttcctgacccagagcaccaccagcgataggctggcgcttcattcacaggtgtcaggaggacacgtacatatgcggaaaccgctggttctggctgcactcgtcgcgctctccaccacgggctgtgtttcgcaggggaagttcgacgccaaggcgctcgaggcggagaacttcgccaagggcctcaacgacgagaagggtgctcgcgaggccgccgaagccaaggtgaaggcgctggaagagaagattgccgagttggagcaggagcgggaggcgctgaacacccgcctgggcaccgctgagtcccgcctcaccgcgggcgctgcggagcgccgcgcgttggaggagaagaactctcaactggccgccctcaacgatgagctggcgcgcaacacgaagaagctggcccaggcgaaggaggagctggagaagcgcagctccgagtacgagaacctggcccagagcctcaagcaggagatttccgacggcaagattgagctgtccgagctcaagggcaagatgaccgtccagctcaaggacaagattctcttcgcctccggctccgcccgggtcggcaaggaaggcgaggaggcgctgaagaagatcgccgacgcgctcaagacggtgcaggggaagatcatccgcgtggaaggccacacggacgacgttccgaccggcggcggtcagttcccgtccaactgggagctgagccttgcacgcgccatggcggtggttcgttcactccagaacgctggcgtggacccgacgttcctctccgccgcgggctatgggcagtaccagcccatcgcggccaacgattcggcggagaatcgcagtctgaaccgccgcatcgaaatcgtgctcgcgccgaagtaggcgccgcac

SEQ ID NO: 667 - DNA, 5051 bp, Myxococcus xanthus
tgttcttatgttcaccaggcgctggccgcaggcgtccaccgtggcccacaacgtgtctgacgggcggtgctcaccgagcaccagcagcgccaggaggcagcccgcggcgcccgcgcccacgtccagcaccgtgtccttctccaccaggggccgcagccggcgtacgtaacccgcggcctcgtccaggagcgcatcgtccttccacagcacgcccaggtgcgtcagcgcgtagaggatgccgccccagccattgaggatgcccagccccaccacgctggcgggctcctccgccaggaggcgcgcctgggtgcgcagcgtggcccgcgccagccgcgtgaagcgcgcgtcttgcgtgacgtccgccaggtagcccagcgcgagcgcgatgcccgcgcgcccctggaacacgtccggccccggagaaccgagccgccagccgccgtctcccgcgtccaggccaagccaatgcgcttcgtcgcggcgttcgaaggccaatggcagcagccgttcacccgcgcgtcgtgcttccacgagcaacgcgtcgcggaggccgggctgggtgtgctcccggaagggatatgtcggacgcgccaccgtctgcgagctcagcagcaggacatccagcgagcgctccagcacccagcgctgccgcgtctggtcctctggcgacaggcccaccagccggcggcgcacgcgcgccatgcccgtctcctggaagaagtccggcaggcgctggcccgagcccgcctccaggtccttcgagtcggcgcgcgcggtgaagtacggcaggtctccccgctccaactgctccgtttccagaggcacgagcgccgcgaagtccggggcaggcaccacggcgcgccacaggtggtcgaagaagcgttggcgctcgagcccatccgtcagcgcgtgcgggtggtagctctcgaagaggagcgcgccgtacaccgccgtgttgcggaagaggacgcgcatgggcacgtgcgcgaaggcggccagcggcccgtcctcggcgagcagcgcctcgcggtgctccaacagcaggccgtacatgcgggtgaagccgtcggccagcgcgtcgcggtagtccagcacgggcgcggtttcgccctccaggcggggcaggttgttggacccgggcatctccaccggccgccgctcgaagcgcatccggtccgttcctcgctccgtcgtcatcaagtaggcctgcggcgtgagctgacctgcccgagcgcccagcccgctcaggtccaccccggccttctttcgcgtgccccagaactgctgcggcagcagtccgctgcggagcaccgacaccggcggcgcctccaccgcgtgctcggagtctcgaagcgtgcgcgtgcccgacagcgggtggaagagcgtctccacgtccaccagcaccgggtgctcaccggcggcgatgaggttctcgaagtgcaggtccgtgccgtccagcgcgtgcatcagcgcgacgtaggcgccctggcgttcgtagaagcgccggacctcctctgccgacgcgcacggcgcggggtccacgtactccatccacccgtattcgcctcggtccagcgcctccgcgcccttcatcatgggcgtggcgccgcgcgcgttgagccacgtgaggagctgctggagcccggcctctgctcccagtgagcgcggcttgtagacaatccgcagcccggactcgaagcggaggatgaagacgccttggccgccccggtgcgggtcggagaagccgccgcgtgcctccaccagcgcgccgggggactggcccgcgttgaaccgctgccagagcaggggcgcgtcccgcgtcaaccgcttcatcagccccaggcagttggactcccactccccgatgcgcaggacgacgcagcgggccagcaccgggtagcgctccaggatgtccagggcgacctgcggctggcgcagccgtctcgtgaagtcctggaagcgcgcttccggggtgtctcccgcgagcagtccctccaactgggcggcatggagctccaccaccatggcacggcccagcactggtgccagcacctggggcaggtggcccagcatcgtggagacgacgacgctcggctccaggtcgagcccaggcgcggcgtgcttcatgggcttcagcgcggcggtgagctgcgtcacggcgcgcgacaccagcggatccaccagcggcaggaaggccgagcggtccgggccctccgtgcgctcgggccaggggacgggcgcgtgcgagggctccgcgtaggtgtgctccaacacctgcacccagcgcgggacttcagcaggcggggtccaaggcgcctcggtgggtacctccagcagcgtgagcagctccgcctcggtcagccccgacgattgcagtctgcgctgccaccagtccgcctgtccgaagggctcctgctgacgccatgcatccaatcgcttgcgcgccgcgccggatgtgtcttgttgcgtcgtattggctttgagagtgaattcgacccgctcggtgagtggggtggcccgtgcccagcgtgcgaaccgggacggagtgttggctcccggcatcgccttgtcctgcctctgcgtgatttccacgcgtcctctcgtttcctgggcaaaacccggtgagctggcttcgttggagtagcagggagatgactgtgatacaggtaagtcatttcatctttgcctgtcaatgctgggcgcccgtgttcgcttggcatgcaatccaagcgggacggtgggagtgatttgtacgacgcgctcatcatcggcagcggcgcgggcggtgggccgctgccgttgaagttttcccaagcagggcttcacgttctggccaacagcttccggagcgcggaccccatcgtccgccgcgtccaggcgggggatttcgcctgagccggggcagggggaggccgcctgccacgcgacggtgcgcgctcatggccgttgcgcgatgcattctcggggcgtagggaagcaacgccccatgtccgccaccgcccaactgctcgaaaccgtccggaaggaagccaagccgggaatctggtccaacggcgtgaacctcgcccgctccggagccgtggtgctccagtcccagaaagggggcgagctggagctgagggtccgcgccaaggggcgcccggtcgccctcacggtcgtcctgtacccgaacgacgacgcctgggagtgcgactgccccagtcaggtggacccctgcgagcacgtggtggcggcggccatctccatccagcaggcggagaagcaggacacgcccatggagacggcggccacccgctgggcccgcgtcgtctaccacttcacccgcgtggacggcggcctggagctgcgccgctccatcgtccaggtggacggcgcggagacgccgctggagggcagcctgacgtcgttgatggcccggcccgcggaggccgcgaagctccaggtggagaacgcggacctgctggccgaccgcatcctggagcagcggcgcacacgtggcaccctggcgccggagacgctggaggcggtgctcaaggtgctggagtcggcgcgcaacgtgttgctcgacgggcgcccggtggcggtgtccgacgagcaggtgctgccacgcgcggtggtggaggaccgcagcggccagattgtggtgacggtgagcaaggacccgcgcgtccaggaggtggtcagtcccggggtggcgctcgcgagcgatacgctggtccgcctgggcgagacgaccatgtccggcccctggctgcagaacctgcccatcgtccgcacgtactcggcggaccacctgggtgacttgacctccaaaatcatgcccgagctgggccgccgcctgccggtggaggtccgcagcaagcggctgccgcgcctggaccgggagctgaagccgcgcatcctgctggagctgaaccagctcgacgccggcctgtccgtgctgcccacgctcgtctacggcgcgccgccggtggtgcgcatcgacaatgggcgcatggtgtacctgcgcggcgcggtgccgctgcgcgacgaggccgccgagcagcgcctcatccaccaactgcgcgacgagctgaacctggtgcccggccgccggctgacggtgcagggctcggagatggtgcgctgggcggacaagctgcggcgttggcgcggcgacctcgccggtgacgcggcggggctggtgagccccgacgtcaagctgcgcccgtcgctccacctggagtccagcgtcacggggcagggcgtccccgacgtgcgcttccagctctccttccaggtggagggggccaagggcgaggtcaaggccgtggacgccgccgccgtcatccgggcgtggacggaggggctggggctggtgcctctggacggtggtggctgggcgccgctgccccgggcctggctggacaagcacggtcagcgcgtggcagacctgctcaacgcgcggcaggaggatgggaaggtctccaaccacgcgctgccggagctcaccgcgctgtgcgagacgctggagcagccgcctccgccgggcctggaccggctggcgccgctcgtctccggcttcgagaagctgcccccgcccgagctgcccgcggagctcaacgccacgctgcgccagtaccagctccagggcgtcagctggctgggcttcctgcgcggcgcggggctgggcggcatcctggcggacgacatgggtctgggtaagacgctccagacgatttgcgccctggggcccgggtcgctcgtggtgtgccccaccagcgtgctgcccaactgggccgcggagctgaagcgcttccgcccgtcgctcaaggtgtgcgtgtaccacgggcccggccgcgcgctggagccgtccgccgacgtgacgctcaccacctacgccatcatgcgcctggacgcggcggtgctcggcgcgaagacgtgggactcgctggtgctggacgaggcgcaggccatcaagaatccggacagccaggtggcgcgcgcggccttcgggctcaaggcgaacttccgggtcgcggtcagcggcactccgataaagaggtttagag

SEQ ID NO: 668 - DNA, 5822 bp, Myxococcus xanthus
ctctcaagcctcacctcatacatcatcaatgaatcctgaatccagcatcgcggcggccgagtccccctggctcgtccgccgctaaccccaggcgtcgcctcgtctccggctgttctgcttcccctacgcgggagccggcagccttccctacttccgttggcctgacctgctcccctaggcggacatcgaggtgtgcgcagtgcagcctcccggtcgggagaaccgcctgcatgagccgtccgtggaggagctcccacaactgctggacgcgctcgtgcgggagctgtcgcccctcttcgatggcccctttgccttcttcggccacagcctgggcgcgctcatcgccttcgagctgacgcgcgaactccgccgccggggccttccgctgcctggcaccctgctcgtctccggctccgaggcgccctcccggcgcagtggacttcccccactgagcggcctgcggcgagacgacttcatccgcgagctgtccgctcgctacgacggcattccgcagcaggtcctggcgcagccggagatcctggacctcatcctccccatcctgcgcgccgacctgaagatttcagagcgctacacctaccaggaggagcctccgcttccagtgcggctgtgtgccttcggtggcactcgcgaccctcgcgtctcggaagccgcgctcgacacgtggcgactgcaaacacagcagtccttctcgatgaagatgtttccaggcggccacttctttctcaacgagctgacggcccaggtggtccaggccgtccatgccgaactcgcagtcggagcaaccccagcaccatgaacagagacgacctgctcgatgtcctgacccgctatgtcgcgaatgaactcctggacggggacgcggaggacctcgattcctccacgcccctcttggagctcggcgtgctgaactcgctggagaccgcccggatgatgggcttcgtccagaagaagtacggcatcaccattccctcggagtcgctgaaggtcgaaaacctccagacgatctccgccatcgccgacctcgtctacgacgcgaggccccggcagccgtagccgctcagcggcctcgacgcagcatggcctggacggtgtcatcgtccaggctgtcgacgtccgccaggagcgactccagctccgcgtcctcgggagcctcctccacgggcgcggctgcctcttccttcaggcccaggacctcggccgccaggtagtccaccagcccgttgacggtggggttgtcgaaggccaccgtcgcgggcagcgaggtgcccaggctccgctgcaggacgttgcgcagctccacggacatcagcgagtccatgccgaactcgaagaagccctggttcgggtccagtggctccgtcgtgggacgccccagcacgccgttgaccagctcgcccacgtgcgcacgcaaggcaccgcgccgctccttgggctcgagccgctccagccgctgacgaatcccctcgctcgccgcggggctggccttctcgatgaaggcctcgaacagcggcgaacgtccgcgccgcccgagcaccgcccaatccacgggaagaacaccgagctgaccgctcagccccagggactgctcgaacacctggaggccgtcttccggaggaatcacgccgaagcccacctgctccatgcggcggcggatctgctcctccgcggccgcgcccacctcggcccaggcgccccagttgaggctcagggcgggcagcccgtcggcctggcgggagcgggccagcgcatccaggaaggcgttcgcggccacatagttggcctgtcccgccgatccgatgagcgacgccgccgaggagaacacgacgaagaagtccagcgccgtgccttgcaacgcacgatggaggttccacccaccggagaccttgggcgcgaaggccttggccagccgctccggcgtcatctgcacgaagaggccgtcatcgatgacgcccgcggagtggatgacgccacgcaggggcggcacgcgtcccgacagcccggcgaggacgcgctccacgtcagcggccacggccacgtcgccctgcacgcagtggatggtgacgccgcgctgctccagcgcatccagtcgagtgcgcgcctcgggccccggctcacgccgccccatcaggaccaggtggcgcgctccgcgttccgccagccgctccgcgacgatgagccccagtccgccaaggcctcccgtgacgagatagctcgcgtccggcttcagtgcggcctcgccgctcgccccacggagcttccggctgcgcaccaaccggggcacgcggcgcgtcgttcctctcagcgagagctcgtcctcgccgctgccaccgagcaactccgcatgaagctgcgcgacttcgtgctcggacgcactggcatccaggtccacacgccggcaatggaggtccggatgctcgcgcgtgatggacttgcccaggccccagaggaccgaactccccaggtgggtgatgcgctccttctccgaggtcgcctgggcaccgcgagtcaccaaccagagcgaggtgctctttcccttggccctcgacgagcgcctgggcgagcacgagcacccgcgtgccgtgcccaagggcctgcgcggggacgtcgtccccaccaccgtccaggctccacaggtcgatgacatgcaggggcccttgcagcgcctccgggcgcaactggcccaggagcgcgagcgctgaatcgcggccatcgaccgtggctcgcgctccagcaggggaccgtcaccacgtgcccagccttgctgcgtcagtcgctcggccaggcgcgcgcccagccccgccgcgtcggcgaggatgaggcactgtgtcccggcgtgcgccgcctccgcccctgccgctggagcctccagcggccgggcctgccactccagctcgtacagccagttctggtagcgcttgctcttcgcgcccaggagtccctcccgcgtgatgcgccggagcagcagcttctccaccgtggccacgcgctccccatccgccgtgagcaactggatgtcgcacacgtagcccgggcccttcgggtcatcgctccgcgccagggtcgcatgggcccacacctcacccagcccgccgcgctgcacctgcaccttgccgacacccacggggaggtaggcggcatccccttcctcgtcgagcacggcgcccaccatctggaagcacgcatccaggagcgcgggctgaagctggtactgccccgcgtccgccgcagcgctgcctgacagggccaggcgccccagcaccgcgttctcaccccgccagagcgcctggatgcctcggaagctggggccatacgcgagccccgcctgccccagcttcgcgtagtagccctccaccggcacctcgcgagtcagcgaggcccgcagacgctccacgtcgacgcgctctgctggcgcggccgtcgtcgcggagagctttccgtgggcatggaggatccacgcgggctcaccctctcccgtgcgctcctcctggctgtggatttcgaagcgcccggcgcgctcgccttccggcgagtagagcaggtgcacccggcgcgccccttcctcggggaggaagagggcctgcgagaaggtgatttcgtccaccgtcccgcccaccgcaccgaagagcgaagctcccgcggcgagccccatctccacgtaggccgctcccggcatcaatatctgtccgtagacgccatggtccttcaggaaggcgggcttcgcggcgcccacggaggactcgaactgccgcacctgtgaaggcgacgcgtgcggatggcccaagaggggatgtcctcgcgtggcccctgcctccggcgcggtgctcacgcccgggatgtcccaggtggacccgttgaggtccatccagtgattgcgccgctggaagggatagacgggcaacgcgaccttgtggcgctcgcgcccctggtccacgccccgccagtccacgggcacgcccgctacgtgaagggccgcgagcccctccagcatctgctgccagtccgagcgctacggcctcaagctggccacccagagcgtgtcctcctgcgtgatgcaggactggcccatggtcaccagcgtgggcttcgggccgacctccaggaaggccttcacaccggcctgctgcatagtctgcatgccccgggcgaacatcaccggctcacgaagatgctgcacccagtacccaggcgtcaggatttccttccccgcctcgtgcccgctcaggttcgaaatcagcgggatggacgggggctggagcttcaccttcgccacggccttggagaacgcgtcgaggatggggtccatcagcgcggagtggaacgcgtgcgagacgcgcagcatcgtgccgcgcttgcccttccgcgtcagctcggccacgcattcattgacggcggcctcgcgccccgaaatcaccacgttgcggggaccattgagggccgcgatggacacctgcccgtcataccgggagagcagcgcctccacctccgcggcatccgcggacacggcggccatcgtcccgcccgcaggcagggactgcatcagccgggcgcgcgtggcgatgagctccagtccttcttccagggtgaagacgccggccacgcaggccgccacgaactcacccacggagtgccccatcacgtagtccgggcggaggccccactgcatccacacctgcgccagggcgtactcgagcgcgaacaacgcgggctgggtgaagcccgtctcgtccagccgggctcgcgcctgcgcgtcccgctcggcggggtgcagcaggtcgatgagcgactggcccatcaacggcttcagcaccgcgtcgcaacgcaggagcgtctcgcggaaggtgggctcggtgcggaagagctcctcccccatgcccaaccactgcgcgccctgcccggtgaacaggaaggccagccggggcgccccgtccgccttcccgcgcagcaccgacgatgacgtctgcccggacaggaaggacgtcaactgcgcctgcatggcctcctgtgagctccccagcaccgcgagccggtgacggaaggcgtcccgcccggtgttcgcggtgaagcagatgtcctccagcgactgtgacgcgagccccgggccgccgagcgcctgcgcatgccgctgcgccagctcgttcagcgcctggggactgcgcgcggacagcgtcaggacgtgcatcggccgcggcgtcgcatccggcgtccgggcaggcgcgggcggagcttcctcgatgaggacatgcgcgttgacgccactgagcccgaagccgctgacaccggccacgcggggcttgtcgcccttgggccacggcgtcacctgcgtggggatggcgatctgcaactgctgccagtccacggccgggttgggcgtacggaagtgcaggtgcggaggaatctcgtcctgtcccagtgacagcacgaccttgatcatccccgcggcacccgcggcggactccaggtgtccgaggttcgtcttcgcggagccgacgagcaacggtgcgtccgcgccgcgcccatgccggagcaccgcgtccagcgcccgcagctcaatcgggtcgcccagcggcgtccccgtgccatgggcttcgatgtagttcacgtccgctggggccaggctcgccgactccagcgccttgcgcagcagcttctcctgcgcgggtccgttggggaccgtcaggccgccgctgagcccgtcatggttcaccgcggagccacggatgacggcgaggatgcggtccttgtcccgctgcgcatccgagagccgcttgagcaccaggacgccgcaccttcgccttagagca

SEQ ID NO: 669 - DNA, 6430 bp, Myxococcus xanthus
  unsure (1)..(6430): unsure at all n locations
taccgcccatgcggaagctcgacgacggcagctacgtcagagtcgcgtcggacggggaggagagcgccgtggaggtcgcggacatgaagaagctcatggaggacgtgcgcgagaccgatgcgcggcgtgtcgccgaggcgcatgccgcggaaatggcggcgtgggaggaggattatcgccggcgcaagcagggcggccggttgttcactcgggccgccgcggactgagccgggccagacgaggcgcccggccaggcccgcgtcgttggacgcgctcagaagcctcgctgcgcgccgccgtccaccgcgatggactgcccggtgatgtaggacgcctgctcggaggcgaggaacgccgtgagcgcggccagctcctccgggcggcccagccgccgcgcgggaatctgcggcgccaccttctcgtccgtcagcccgagctgctgcatgcgctcggtggcgtggtagcccggcagcaccgcgttcagcgtgacgccgtgctgcgccacctcgttgctcaccgtcttcaccaacccgagcaggcccgcgcgcaggccgttggagatggtcaggttgttcatcgcctcgcgcgccgccagcgacgtcaccaggacgatgcggccccactggcgctcctttatccccgggagcaccgggtggatgccatccaccgaggccatccacaggctctggaagccgagctgccactgctctgccgtcagggattcgaagccacctgacggtggcccgcccgtgttcaccacgaggacatcaacgccgcccagcttcgcggtgacagtctccaccagcgccttcgcggcttggggctgcgtcaaatcgcacgggaccgcgagcgccgcgcccagcgccttcgccgcgcgctccagcttctcgccaccgcgcgagcagatggccaccgtggcgccttccttcaccaacgcctccgcgatggcgtaacccagccccgcggacgcgcccatcaccagcgcgcgtctacccttcagtccgaaatccatcagcgtgctccttcatgaatggtgtcagccggctccggatgagctccgccgcgcgcttcaggtccacgtcttccgcccgaggcaggccctcgctcagctcggagacgatgccgtccgtcagcgcacccatctgataggccagccggtaaggcacgtggctgaagctcaccagggagtagcggctgacgaactcgcccgggaaggcgttgagcagcaccttctccacggccttccgaaacaggaagcgcgggtcgccagtgctgtcgcgcatctcgacgaagttctccaccgccatgtcggcgatggcgtccgcgttcgtcttgcgcaggcgttcgaagtccgtgaagacctgctcccagccggcgccctgtcccagcagttggtccaggacgacgcagtcctcgaagccgcagttcatcccctggccgaagaaggggacgatggcgtgcgcggcgtcgcccagcagcagcgtctgcccacccgcgtgccagggcgcgcccttcaccgtcaccatgctgcccgtgggacgcgagaagaacgcctccaccaggtccgggatgagcgccttcgcatctgggaactgcgcgccgaagaacgcctccagcttcgcgggcgtgtccagggacgcgaagctcaccggcccctgccagggcaggaacagcgtgcaggtgaagctgccttcctcgtcgggcagcgcgatcaacatgaacgtgccgcgaggccagatgtggagcgcgtgcttctccatctggaacgcgccgccggggcccgccggaatcgtcaattccttgtacccgtggccgagctgctcctgcgtccccttgaagtccggccgcttctccaaggcctggcggatggcggaggcggagccgtccgtgccgaacaccacgcggccgggctcctggcgcgcctctccggtggcgtcgtcgtgcaccgtgagcgcgcccgagccgaagtccacatccgtcacccgctgcttgaagcggatgcgcaccttcccggtggcctccgccgccgtcatgaggaaggcgttcagccacccgcgcgacatcgcgttgatgtgctgcgagtcgtccttgccgtagggctggtagacgagctcgccttgcggcgggtgaatcatccgcccgcgcatggggatggcgtgcttcagcgcctcgttttccaggcccacctgccggagcgcatgcagcccgcgcgtggagatggccaggttgatggagcggcccccgtcgactgtttcgcgccgcatgtccgggcgtcgctccagcagctccacggtgtggccccggcgcgccaggtagatggagagcagcgagcccaccagccccgcgcccaccacggtgacggtgtccttgcgcgcctcactcacgggcgtggccctccagcgtcttcacgaagcggtacacgtccgtgaaggagttgtagagcggcgcgggcgcggcgcggatgatgtccggcttgcggaagtcgcagatgatgcccgcgtctcccaggcgcttcagcaggccctggggctcgccgcggaagcgcagggagagctgggccccgcgctgcttcacgtaccggggcgtggtgatgcgcacgaatccctcgggcagccggtccagcaggaactccaggtagccggtgagccgctcgctcttggcgcgcaacgccggcatgccagcctggtcgaacagctccagggacgcgcgcagcgccgcgagctggaagatgggcgggttggacagctgccacccctccgcgcccggaagcgcgctgaaggtgggccccatctggaagcgcgtctgcttgtcgtggccccaccagccctcgaagcgggggaggtccttcgtgtgcgcgtgccgctcatggacgaacacgccgcccagcgcgcccgggccggcgttgaggtacttgtacgagcaccacaccgcgaagtccggtccgtcgtcgtgcagcgacaacctcaggttgcccgcgccgtgcgccaggtcgaagccgacgaagcagcccttggcgtgcgcggccttcgtaatcgcggccaggtcgaacgcctgcccggtgaggtagttcacgctgcccagcatcaccagcgccacctcgtggccgtgacgctcaatggtttcgaggatgtcctcggtgcgcagcgtctcctcgccctcgcgcggcttcagctccagcacggcctcgcgcgcgtcgtagccgtggaagcgcacctgggaggcgacggcgtactggtccgacgggaaggcgccggcctccaccaggattttgaagcgctgcttcgtgggccggtagaacgacaccatcatcaggtgcaggttcaccgacagggtgttcatcaccaccacttccaacggcttggcgcccaccagccgcgcggcatgctcggtgacgagctcgtggtagtgcagccacgggtggcggccgtggtggtgtccctccacgcccagccgcgcccagtcctccagctcctcctggatgtagcgcgcggcgttgcgcggctggaggcccagcgagttgcccgccaggtacaccaccggcttgccgtccgggccgggcgggaagtggaacgcgtcgcggtagccgcgcagcgcgtcttccgcgtccaacttccgcgcgaaggactcggagtcctcgaagaggtacggcgtcgtcatggtgcgaagtcctcgggggcgcgtcccagccaatcgaaggcgttgcgccagagcagccgctcccgcgcggcgggttccagctcggtcagggactcgatgagcgtgcccgggcggtcctcgcccagggggaaggggtagtcactgccgagcgccaccttgtcctgcccgaagagccggacgatgtagcgcagcgcctccgggtcgtggaccagcgagtccacccagaagcggcccaggtagtcccggggcggcaccttgttgtccacggccaccaggtcaggccgggcctcgaagccgtgctgaatccggccgagcgtgtgtgggaacgcgccgccgccgtgcgcgaaggcgaagcgcagcttgggcagccgctccagcacgccgccgaagatgacggagcagatggccagcgacacctcggccggcatgcccaccagccacggcagccagtacttctgcatcttcgcctcgcccatcatgtcccacgggtggacgaagacggacgcgcccagctcgctggcggcctcgaagaaggggaacagcgccgggtcggacaggttccagtcgttgacgtgcgagccaatctgcacgcccgccagccccaactccttcacgcagcgctccagctcgcgcaccgccagctccggggactggagcggcaccgtgcccaggcccacgaagcgcttggggtgcgcgtgcaccacggagacgaggtggtcattgaggaagcgcgccaggtccgctccgtgctcgggcttcgtccagtagccgaacatgacgggaatcgtggacagcacctggacgtggacgccggccgcgtcgcactcctcgatgcgcttcaccgggtcccagcagttgctttcgatttcgcggaagaacttgccgtcatcccggagcatgcgcgcgcggcagggcgcatggtggtccagggtgatgaagccgccgtagccgtagcgctcggcgaagcgcggcaggtgggcggggaggaggtgcgtgtggatgtcnactttcatcgggcgggacctcccttgaccaccttcatctgagcgcttcttgcaggtgcagttgtcggggttgccgtagaagtgctcgaagatgggcggaagctgcgtccccaggttggtgacctgcacgaactatgtgcagagcttatccccgttctgcacccgctggcccatgaagccatccagctccttcggctggcggcggcgctccagcaccaggcccactgtgcccgcgggacgctggggcgagtggggcacgttgggcggcagcaggaatatctccccttcgtggatggggatgtcctgcacctggccctcgtcgatgacccgcaggttcatcgtgccctcgagctggtagaagaactcctcgccctcgttgatgtggaagtccgtgcgcgcattgggcccgccgacgacggtgaccatgaactcccggtcctcccacacctgctggttgcccacggggggcttgagcaggtggcggtgctcatcaatccacttcttgaagttgatgggggtcaggcggcccattcattcacctccgatggtggcgatgcacttgagctcgatggcaatcggcgtgggcagccggttgatttcgagcgtggtgcggcacggcgggttgtccttgaagtactccgcccacagccggttgaaggtgggaaagtccttcttcatgtcggtgaggtacaccgtcacgtccaccagcttgtcccaggacgcgcccgcgtcctccaggatgtagcggacgttgcggaacaccgagtggcactgcgcctcgatgtcgtacgagacgatgttgccctccgcgtccagctccacaccgggaatcttcttcgtgccgcgctcgcgcgggcccacgccggacaggaacaggaggttgcccacgcgccgggcgtgagggtacaggcccaccggttcgggggccttctgcgaatcgactcgtgcgctgtcactgctcacggtgtgctctcctcacgtgggggggtagggggctcacagcttgatgcagacgttcttcggctcggtgaagaagcgcagcgcgtcccagccgccctcgcgtcccacaccggagtccttcactccgccgaagggcgtgcgcaaatcgcgcagcatccacgtgttcacccagacgatgccgctgtgcagccgcgaggcgaagcggtgcgcgcgcttcacgtcctgggtccacacgctggcggccaggccgtaccgggtggagttggcccacgcgagcacctcgtcctccgagtcgaagggcatgatgctggccaccgggccgaagatttcttcctggttggtgcggcaccccgcgtccaggccctcgatgagggtgggctccacgaaccagccgttgcggcagcgtccgggcacgttggcgcgctgtccgccggtgaggatgcggccaccctcctgcttcgccaggctcacgtagcccagcaccttgtcgaagtgctgctgcgacaccagcgcgccctggtccgtgcccgcctccagcgggtctcccaccttgagcgcgcgcgtgcgggtgaccagcgcctccttgaagcgctcgtagaggggccgctggacgaagatgcgcgggccgcagagacagatttgcccctggttggcgaaggacgagcgcagcgtggtggccagcgcctcatcgaagtcgcagtccgcgaagatgacgttgggattctttccgcccatctccagcgacagcttcttgaaggcgggcgcggccacgcgggcaatctccgcgccggtgcgggtgctgccggtga

SEQ ID NO: 670 - DNA, 5033 bp, Myxococcus xanthus
tgatggggatggccatcatcggggccgagggcatcagcggcggatgagtgcgcgcgcagcacacccatgcctgtgcgaagtgaagtgacgccgtgaacaagacgctgctgtacatcaccgtcatcgtcatcgcgacgtgcgggctcatctatgagctcgtcgtcggggcgctcgcgagctacctgctcggcgactccatcacccagttctccaccgtcattggcggctacctgttcgccatgggcattggcagctacctgtcgcgctacatcgagcgcggggtggcgcagcgcttcgtggaggtggagctggcggtggcgctgctgggcggcatctgcgcgccggtgctgttcctcaccttcacgctgacggacctgttccaggtggcgctgtacggcagcgtgattgccattggcgcgctggtgggcatggagattcccctcctgctgcgcatcctgaaggaccaggtcaagttcaaggacctcatcagccaggtgctgtcgctggactacgtgggggcgctcgcggccagcgtggccttcccgttgctgctggtgccgaagctggggctggtgcgcacgtccctgctgttcggcgtgctgaacgcggcggtggcgctgtggagcacctggttgctggcgccgctgctgggcaacccgctgcggctgcgcatcaaggcggtgggcctgacggtgctgctgctggcgggcttcgtcatgggcgaccggctcaccaccttctacgaggaccagctctacgcggatgacgtggtccacgcgtccagttcgccgtatcagcgcatcatcctcacgcgcggcaagcggggcttctcgctgttcctcaacggcaacctccagttcgccagcctggacgagtaccgctaccacgagtccctggtgcacccggccatggtgcgcgcgggcaaggtggagaacgtgctcatcctgggcggtggagacggcctggccgcgcgggaagtgctgcgctacccggaggtccgctccgtcacgctggtggacctggacccggtgattacggggctggcgacgaactacggggagctggcgaagctgaaccgccacgcgatgacggacccgcggatgcgggtggtcaatggggacgcgatgcagttcctcaccgagggcggcgcgcagtacgacgtggtggtggtggacttcccggacccgaacaacttcgcgctggggaagctgtacaccacgggtttctacaagctgctcaagaagcgcatcgcgccggacggcgtggcggtggtgcagagcaccagcccgctgttcgcccggcgctccttctggtgcgtggagacgacgctcaaggccgcgggcttctggacggagccgtaccacgcgctggtgccgtcgttcggtgagtggggctacgtgttgattgcgcacgagccgcccgcccggcaccggccgctgcccgaagggctgctcttcctggacgacgcgacgatggcgtcactcacccagttccctccggacatggggcccttgcccgtggaggtgaaccggctgaacaaccaggtgctggtgcactactacgaggcggagtggcagcggtggaactgacgcggcgggagctggtcgccgcgttcctcggttccgcggtggcggccagtgcgtgccggaagtcggggtcacgggagcgtgtccccggcgcggtggtggaccaggccgtggagctggggcaccggctgcgcggcgggccgctgccccgcgcggacatcatggagcccgtggaggtgctggtggtgggcgcgggcgtggcgggactgtccgcggcctggcggctggcgagcgcgggcgtgcgaggcgtgcgcgtgctggagctggaggcggagccgggaggcacgtcccgctccgggcgcaacgccatctccgcgtacccatggggcgcgcactacctgccggcgccgctggaggaccggggccctgtcgtccggctgctgcgggagatgggggccgtcaccgacgtggatgacgcgggccggccgcgcttcgaggagtcgctgctcatccacgagccggaggagcgcttcttctaccggggccactggtacgaagggctttacctgcacgcgggcgccagcgtggaggacctggaggagctgcggcgcttcgaggcgcggatgaacggcttcgcctccgcgcgagacgcgaaggggcgccgggccttcgcggtgccttccggcctgtccagtgacgacgccgaatggacggcactggacgcgctgagcatggcggcctggatggagcgcgagggcttccgctccgcgcggctgaagtgggtggtggactacgcgtgccgcgacgacttcggcaccaccgccgagcatgtctccgcctgggccggcatctggtacttcaccgcgcggcaggacgggaatggggagcgcagcgagggctacctgagctggcccgaaggcaatggccggttggtgcggcagctcgtgtcggcgctgccgaacggggcggtggagcgcagcgtgctggtgcacaccgtggagcccgtggagggtggctgccgtgtggacgcgctggaggcgggctcgggcaagccccgggccttcctggcgcggcaggtggtgctggcgtgtccgcgcttcatcgccgcgcacgtggtggcgccgtggcgccgggagcgtccggcgtggctgaatggcttcacgtatgggccgtgggtggtggcgaacctgacgctgtcgtcgccgccgcgctcgcggggctttccgctggcctgggacaacgtcttctatgagagccgcagcctgggctacgtggtggccacgcaccagacgctgcgccaggacgagcagggccccacggtgctcacctggtacctgcccatggacggcgcggacgtgaaggccgagcgcgagaaggcgctgtcggccagctacgcggactgggaggccctggtgatggcggacatgcggcccgcgcaccctggcatctccgggcaggcgcagcggctggaggtccagcgctggggtcacgccatggtgcggcctacaccgggcttcatgtgggggcaggcgaagcagtccgcgggggagagcctggggagttcactgcacttcgcgcactcggacctgggcggcatgggtctcttcgaagaggcgaactggtttggcgtgcgggccgcggagcgcgtgctggcggagctgggccggcgtgaggtgagctggctgtagtcgccggctgccgcgttccattccaggcgcccatggaagagttcttctgctgcggtgagcacccttggcatgcggtgttccgcctgcccgtgcccacctgaaggacagggggcattgtcggtccccatgtgcatctccctccacgagggcccgcggcacgttcattcccgcgcgtcctcgtggaggccgcgccatgtcgctcaaggaataccttcccggaacgccattccctggtgtcatcggccggacggatgaggagtcctcgcctgcctggcccgcgccgctgcgcgcgaagccgggggcacccaacgtcctcttcatcgtcctggacgacacgggcttcggtcagctcggttgctatggctcgcccatccgcacgcccaacctggaccggttggcgaagggcgggctgctctacaacaacatgcacaccaccgcgctctgctcgcccacgcgctcgtgcatcctcaccggccgcaaccaccactccaatggcatggcggccatcaccgaaatctccgtgggctaccccggccgcaacggcaccatccccttcgagaatggcttcctctccgagatgctggccgggcacggctacaacacctactgcgtgggcaagtggcacctcacacccgcggagcagacgagcgccgcggggccctactcacgctggcccctgggccgcggcttcgagcggtattacggcttcctcgggggcgacacgcaccagtactaccccgacctcgttcacgacaatcatcaggtccggccgccgaagacgcccgaggagggctatcacctgacggaggacctggtggaccgggccatcggcttcatcgccgacgccaagcaggtggcgcccgacaagcccttcttcctctacttctgcaccggcgccatgcatgcgccccaccatgtcccccgggaatgggcggaccgctacaagggccagttcgacgacggttgggatgcctaccgcgagaaggtcttccggcgtcagctcgagacaggcgtgctgccgccgggcacccggttgtcgcggcatgacccggacgtgcaggactgggacagcctgtctccggaggaacggcggctctacgcgcggatgatggaggtgttcgcgggcttcctggagcacacggaccaccacatcggccggctcatccagtcactggaggcgagcggggagttggagaacacgctcatcatggtcatctccgacaatggcgccagtccggagggcggcctgcatggctccgtcaatgagctgaagttcttcaacaacgcgccggagtcgctggagcagaacctggcggcgctggacgagctgggcggaccgcgccacttcaaccactatccctggggctgggcctgggcgggcaatacgcccttcaaacggtggaagcgcgagacgtaccggggaggtaccacggaccccttcatcgtccactggccccgaggcatccaggcgcggggcgagattcgctcgcagtactgccacgccatcgacatggtgcccacggtgctggactgcctgggcatcgatccgcccacggagcttcgcggcgtcacacagtcacccatcgaaggcgtcagcttcaagtactccttccaagacgcggacgcggagagccggcaccacacgcagtacttcgagatgttcagccaccgggccctgtaccacgacggatggcgggcggtgtgcccgttccccggaccgtccttcacggagtcgcacgagccgttcggcatgctgaagctcaccgaggccagactgcgcgagttcgatacggagggctgggagctgtaccacgtgggc

SEQ ID NO: 671 - DNA, 3608 bp, Myxococcus xanthus
tctaagtctcgctggagtgcgtggccgcgttgtccaggatgaagtgcaggcgtctggccatggggttggcctcgctcaccgcgcgcaccaactcgatgaagagagcactcgttttccgctcccccttcacccacgtcagctcgcccgtacgtgagttgagcgctccggccacgtagcgcttctggttgttgcccggagtgacgacctctcgccgctctccaggcagcatccaatcgggccccaccttggggttgagatgcacgtccatctcgtcctcgtagcagacgggctcctcgggccgggcgtagaccgcccggcacttcagttgccacagccgctgctgccgctgacgctcgggccaggggcagcgcaccacagggcggggccgcttccgccgcgcgcccaccgaggccagcgctcgtcccatggtcgcaggcgagaccgtcgcacgatagacgccggagtcaggcttttcttcctggcaaaccgagtttgtgccctgaccttgctttttccgaagccaccgtcgccaacagtaccagcgacaccaggacactggccgcgccgacgcttgggagctgatccagcgaaccgatttggatcaccacgccgcccgcaatcgctcccgcggccatgccgaactggatcatcgaggtatagcaactgaagatgatgctggtggattccggagctaggctgatcaggcgaaattgcagggcggggccggaagaccaggcggatagggaccacgtgatcaacaacgcgtacatgatccaggcggactgtccgaagaggaagaacaaccccagcgttgcgcagtggacggcaaacccggcaagcagcgtgggtgcgtagccggacttgtcggtgaaccaaccgcccagcctggaaccgatgatgcttgcgatgccacagatcaacagcatgatgctgatggtgccgtcagccatgcgggcgacgttggcaaggtacggcgatatgtaggaatagataatggaaaaggcgctgatccagaaaaacgtcatgacatagacgatggatatctggccattcttcagcagcttgagttgatgcttcagcggcacggcggcctcgccccgggtgctgggaatggcacgaacgaccaggaccagcgacgcgagcgtcagtacgcccagaccggcgaagatgtaccgccagtccatgatgccggaaattacgcgccccagcgggacgccaacgaccaaggccgcgctgaaaccgatgacgaccatcgcaatggcgccggccttctttccgggtgcggcgagcgtggcggccagggtcaacgcgatgacttccacgacgcccgcgctcagtccagaggcggcgcgcgacgcgttcaaccagccataatcgcttagtgccaaggtaaccagattggcggcggcgaagacgagcatgaagaagatcagcaacttcttgcggtcgacgctggacgtgagggtgataacgagtggcgtgccgacggcgaaggcaatcgagaacacggtgatcatctggccgatgaccggcacgggcaaattcaggtcttgcgcgatctgatcaagaatgccggcaatgatgtattcggcggttccgatcaaaaagctgataaatgacagcagataaattctggtggagtttttcatatttaacgtggttggcgggaagtgatggtcggccgatgagggcgggagatttggtttgataattagctaaatgactaatcgttgatgtgcagtcatcccctgcaaggggattcaggtccttatgcggtctggttcagtgggagaaatcagcaggcgcgcaatcgcttgctcaaagcttgcggatctcttcggcgaattcgtccatcgcggcgggcactcgcttgaagtaagtgaattttccgatccgcaaagaagtcaggaatcccgcctgggtcagcactttcaaatgcgcggatgcggtgggcgccgaaatgcccaacttctctgaaatgtacagaccgcacacgcccgcgctttcgtcgaattgccctgggccaaagtgcaggcttggggcctccagcagttcgaggatctgcagccgattggggttcgcgagtgccgccgctttggcaaggattggcttcatgggatgaggattagtaaatcgacgaatcgtagtcaagtgtagacggataggagccctgttgagggcgtcgggctggtgaagaggggccaagaagggccgcaggagggtgacacgcgggctgtgcgccgggccggagcagaggctgtgccgcccctcggggcacatgcgggcccaagcgtcccatccaggcgtcaggctgcaggggcgtgggcttccaggccactgtgggtgcttgggcttaaaccaccgctcgtgattctcgatcgaggttggtgagcgggcaggcgcgcggggcgacaggaagaggcaggggcacatcccgctcggctctgtgtgcgcagaagaccaggaatcagaaaggtcccgcccagggacaaaggtaggccccgtctttcgcggctgcagcgtcgctccctcatccgttggggtgaaaggagcggctgcccgctcaccctgcggcggtgcatggcggtggtgggagtgtcgcgcggcgaatcgcgcaggcaggtagcgcgtgctctggcgtgcgccacctccacagttgtctctgcggtcaatcgctacctgaggggacggcgtaaagccctggtggaccgcagagcggccaatggcgaggcgaaggtggatgagcgcttcctcgccattctctcgcgcgtgctggcgggtactcccgaagaggtgggttggtgccacccgacgtggacacgggagttgctcactcttcatccaactgctttggcgcatcgccggtgagtaccctggcgccccacgaatccacctcatcctggacaacgcctccatccacagcagccagaatacgacaaaggcgctcgagcaactcggcggccggattgtcctccacttcctgccgccttactgcccggacgccaatcgcattgagcgcgtctggctggacctccacgccaacgtcactcgcaaccatcgctgccgcaccctccagaagctcatgcggcgcgtccatgcctacctgcacgctcgcaacgcccagcggcgtgccagtcctatcctccgcaaggtccatctgcggcgcgccgcctgagcgcgtgcgagattcatgatcgggcgtttagaggtagcggatccgctctccgccccgttttttcctctcgtctggagtcaccatgggctccccttcgctcgacgtgatgggcgatacagccgcgctgctgctccggaccacggggcttgtcttcctcccctcgggatttgcgcccagcggtgactcgcaggcgcgggagcaaggcatggatgccctggaggcagacctcgcggggggggggctacacgctggacggcgcgctccgggaggcgctgctcgcgctgcccaccgagatcatggcggcttccggccgcttcatctacgacaactgtgcggcgctccggggagccaaccggcccttcgttccattgttccggaacttccccgagagcgtgccgcacgacacccggcagttgtacgtgcagcggatgct

SEQ ID NO: 672 - DNA, 5353 bp, Myxococcus xanthus
cggcgcgcggtgtcctccgaccccgcgtggcgcatggagagcggggagggcttcctccgggccctcgggccttcgccatccccttttgacaattccctgtgttgggcccacacggatgaagagaacgtggaggcggtcatcgcggcacagatggcgtatttccgctcattggggcgcgccttcatgtggaaggtctacacccaggacagccccagtgatttggagacgcgtctactccgagcagggttcgaggttcaggcgcacgtgacgctggtcgtgctcgacacggcccgctcgcagcccgcgaccgcgcttcctccgggcgtcgaaatccggcgcgtggacgacgccaccgggctcgcggcggccatgaaggtgcaagaggtcgtctggagtcaggactgccaatggttgcacgacgcattgaaggaggagctgcggacgcagccggacacgctgagcatcttcgtggggtggtcggaaggacggcccgtgtgctccagttggattcgcatcgaggagggggcgcccttcgccagtctttggggcggctcggtcctcccggacttccggggcaggggcttctaccgcgccatggtggcggcgcgggccgaggtggcgcgtcaacgcgacatcgcgcacctctatgtcgaggcgggcgacatgagtcggcccatcctcgagcgcctcggcttccaggcgctctcccaggtggccaagtgcatctaccgtccgcctggcgtcgcgtgaggcgaagctcgcccaggcgccgcacggggtgagacctagcggattcgtttcaagaaaccgccggggttgctggtgaagaggagtttctcccggctgctgtcccgctcgaaatcgggcgctgtcgggaggaacgcctcgatggcctccatgggcccgcgctccacctggaacgtgtgcagagggtggccgatgttcgtgtcctccacgatgaggtaatgccctggcgacaccagcgggctgtataggcgcagctcctggagcacgtgctcggcgctgtggtccgagtcgagcaccaccatcgttcgggttccgggagcgatgcggccgcggacacgctcgaggatttccggcgcgaccgaggacccctgcatgtattcgatgcggtggtgccggggcacgctctcccgttggtcgaggtcgatgctgatgacctgaccgtggcccaggaggtcacacaggtgcgcgaaatagagcgcggagcccccgaacatcgttcccgtttcgatgatgaggtccgggcgcgtctcgtggaggatctcctggtagatccacaggtcatgcggcaccttccggatggggactcccatccaccgctcgcctccgccgtggtactcccgcgtgacaagcgctccgaaatacaacgcatggaagtcgtcgatgatctgcttcatggcgtcgtgttcctttcactgcgcgattcggcgaggtgtcgcactcccgccaggtaggtggcggcgagccgttccacggtggacggctcgtgcaattcgttgctgtaccgccattcgaactgcagcaggccgtccaccacggcggcgatgagctgaaacacatggctccgccgggcggatgggtcccggtcggtgccggtcgactcacgggcgagccggaacgcagggttctccgtcagcattcgttggctcatgtaatcgaagctcacctcggcgcctggcagtgcgcccagcctccgcgccagcccctccgtgccgttcatgtagcgcagcaatccgtggcccaggccctggccgggcagttggcgcagtgagctggccacccactcgagcgcctgggacagtccgctggcgccgacgacatccagccggacagggacgtccgccgccatgcagcccgcggtgcgcgtgggttcgagcccctccagctccgcgcgtccgtgtcgccccaggtcgacgcgcagggcggcgccccccatccattgagagagcgtgtgcgccagcggtgtcagcaagacggcttccagaccgcttcgcgtcgcggaggcgtgctgaagcagccgctgggtctcatcctcgcgcaagctcatgcgcacggagcgcatcgaaccctctgagttggtgcctggatggtcgtgcgggagtcgcccgcacgcgccttcgagctgactcagccatgccgttgcctcctgctccaaccggggcgtgtgggcgagcgcgtgcaggtgttcggcccacgccctgaacgagaccggggctggaggccgctggatcgactgcccctcaaggatttgacggtaggcctcctgaagctcgtcggtgagcagggcccaggtcacgccatcggcgatgaggaaatggaagatgaacagcagccttccaggtcggtgggcaccgaggtcgaaggccgccacgcggaacagcgggccgtctgtcagcgtcaggcttcgttggagggcctgcgcggcggattcgatggccggaggtagcgcggtgtcggggacggaggacaggtccacgcgcgagaaggggggcgtcgcggcgcttcccgcgtcgaactgcttccagccgctttcgtgccgcacgaagcggagccggagcgcatcgtgacgcgcgagcagcaagcgaagcgcctcctggaacgcctctgtctggagtggctcgtgcacatcgaggagcagcgagcggttccaatggtgcggcgcgggcacgtccgactccaggaagcgccgctgggaaggtgtcaacgggatgggccctcccactgcagtgggggccggtggttcgggttggtcgccgatgacctcggagagctgggcgatggtttgatggaggaggagctggcgcgcggtgagccgcaatcccgcatcgttcgctcgcgcgacgacccggatggccaggagggagtcaccgccgagttcgaagaagttgtcgtggattccaacctcgcgccgcttgagcacctccgtccagacccggaccagcgtctcctcggtggcgttgcgaggcgggggacgcggcgcgtggagcgcctcggaggcctgccagccggacaccgcgcggcgatccaccttgccgctgggaagacgtggcaaggactcccgcatcacgatgcgcgcgggaatctggctggagggcagcgtcgccccgaggcgcaggcgcaacgtcgcctctgccaatccctggacggcggggaccacgtgcgcttccaggtggccgtcgcccgcgggtgcttgccgatgcagcaccaccgcttctcggacctccgcgagctgttcgagcgcgcactccacttcgcccagctcgattcgaaagccccggaccttcacctggtggtccctgcggccgaggaactccacatcaccatcaggcaacagccgcgcgaggtctccggtccggtacatccgtgcgccttcccttccactgaaggggtcgggcacgaacgccgccgccgtgagcgcgggctgggccagatatccacgcgcgaggcccgcgccgccgatgaacagttctcccggcgcgcccgcgggaacggggtgcccggatgcgtcgaggatgtacagacaacctcccgccagcggccggccaatggggacccggctggcctccacacgcgccgtgggttcgcacaccgtggcggtgatggtggcttcggtggggccgtacgcgttgagccagcggatgtgggagggaacacgctcgcgccagcgcgccagccgctcgggggacggtgcctggcttcccgtcaccagcaggcgcaccgaaggcggaatcgcgaccggaagccggggcagctcctccacccattcatgccagtacggcgctgggatgttcaccacggtgaccgtggcctgctcgagcagcgccaggaactcggccacgggtggggctgctccgggaggggagagcaccaccgtcgcgcctgctgccagcgtggggaagagttcctccgcggcgacgtcgacactgagcgtggcgaagtgcaacacccggtcctcgggacccaggccgtatcgctgctgcacggccagcagatgattcatcagggcgccatggggcacgacgacgcccttggggcggccggtggagcccgaggtgtgaagtacgtaagccgcgttctccgggcacacgtcgacgtccagggggaccgccggttcgagcgcggcctgggctcgcaggacgtcgaggtggatgacgcgggccggtgtaccggatacgcctgccgcgagcccggtttggacgagcaccaccggcgcctcgacgccttcgatgagcgacagcagccgctcgcggggcgcggtggagtccaggggaacgtaggccgctccggccttgagcacgccgagcatggcgacaatcgcgtcgacggagcgctccgcacacagggcgactcgcgtctcggggcccacacccgccgtgcgcagcacccgcgccacatgggtcgcccggcggtcgagctctccgtagccgagcacctcccccggtgccatcaacgcgaggcgctccgggtggatccgtgactgccgtgcgatgaactgatgcacgccaggaaagggagcggcgggcgcgggggacgtggtggacgccgcgagcaacgcctgccactgcctgccttggggccgcgtcaacgcggtgaactcgcgttccggtgtggccgtcaggcgctccagcgcctgttccagggcgtgggcgagccgcgccaccgtggttggctcgaagagttccgcgttgtactccagcgcgcccgagtagccctcgtgcgtgggcctcagccagagcgtcaggtcgaactgagtggtccgggtgcctcgctcgatgggttccaatcccagattgtcgacggtgtgcgcgccgcccgtctcctcttggagcgagaacatcacctggaagagcggggtgcggctcgcgtcgcgctcggggttgatcgcctccacgagcttctcgaaagggaggtccgcatgcgcatacgcacccagcgccgcctcgcggactctcgcgagcagctcctgtccggtgggggttcccgtgaggtcggttcgaatcaccacggtgttgaccaggaggcccaccaggccctccagcttcgcgtgggtccgccccgcgatgggcgtgccaatcgcgaactcccgttgtccactgaagcagccgagcaccgcgctgaaggccgtcagcaacaccatgtagggcgtggccccgtggcgccgcgccatggattccaccgcttctgacacgggacgcggcagcgccaccgcatgggtccccgcgcggaagttcggtacggcaggaacgagaacgatccgtgggcagatccagcaagggaaggccagccagccgctgcttccagtaggtgaccagagtttccagcacgggcc

SEQ ID NO: 673 - DNA, 4410 bp, Myxococcus xanthus
gcgccagcccatgcggccttcgtgcgggtcgaagtacgcggccgtcaccggcaccttgcgcccgtccgcggtccgcgccatgccgcgcgcctgcctgcccaccagcgcgtcgcagatgcgccgcacgcggtcggggtgctcgatgcgctccttccacaccggccgcgtctccggcgggagcagcaggccgttgtcacgcagcgcctccagcacggagacgatgcggcggcccgcgtccaggggcggcgccaggaagcgcatgctcacctccggcgcgccgcgcacgtccatgacctccacgtccagcgccgtggcccatcgctcgccatggcccaacaccacggaggcggtatcgcccggcttcggcgccgcctgcgtaccgaggttcagcgtcaggtgctccaacgacagctgcaccagccgacacggcgcctggaggtttccgaacgacgccaccgccgtcagttccgtccccatccggtaaccgagcatcgacgcccggccgctcaacccttccagcgtgtccgcctgcatgacagctccgttgtctgaaggacgccgattgtacggcttcacaggtgcgagacttgagaattctcactggaagcgtgagcacgaacgagccgcgcgtaacctgttctccaggacaggactggatgtctgatttttcaagtgtcacacggacggtcgtttccctctcagacgggatgtgtgcccgcatcccatcgggtccgtgtgcacccaggttttttgggggtgaggtggtgtggcatggccaccgggggggtgagcgctcgtacgcctgctcgctgaggtggaaccagttccgtcagcgggttaggggaaggaccatgccgcgcaacaccctctgccttcgttgcggcatgtgctgtgacggaacgcttttcacgcacgtgtcgctccagctggaggaagccctggcgctccagcggcggggattgcccgtgggctcacgcacggatggaagtctcgccttgatgcaacactgctcggccctggatgagcgcacatgcaccatctacgaggaccgccctgcgagctgcaggcgtaatcactgccaagtgtgctccgcgctggctgagaaggaagtctcgctggaccaagcgctcgaggaggaggacgagggccatgctctagtggacgccgaggcgcgcacgctggcgcctgcttaggaaggggcgccgcgctcggtgctgcaacgtgcccggggcgcgaacctgctcgatcacggtggcccgctgtccgcgacggacctgggcacctaccagcatgcggagggctatctggatacacacttccgggggcgcttcggacggcaggattgagtgcggcgacgcggtgaatcccagccgcctcgcacacccgtgtggctacgatgcgggcgcgataatccgggccgtgcttccacggcgccgcgtgacaccgaggacttcgatgaagacgaacgcgtccgtgctggcggtgatgacgtgctccctgctgacggcgccgctggccatcgcggataacacggcccctgtgaagtccgcctcggtggatttgaacggtgatggcacgccggaagccgtgtccatccagttcgacgaaccgaagaacgagttcatcctcaaggcgggcagcgccaccatccggggccctggtgatgacaatgagcccgcgggcgtgttcatcgtggacctggacagccgggacaagcgcaaggagctcgtggtgcgcaccgggcagacggactacgaccagcgctcgtacatctacggcttcgacggcaaggcgctgaagctgctgggcaccgtgcccgcgctcaccgaggccaagggcaacggcatcatcctgtccgactcatggcagggcttctggaaccggcgcgacaagtacgtcgtggatgcgaagacgggcaaggtgtccgaggtgccgcaggacctgtacgccgttggcgtcgaggccacggtgaagcagtcgttcccgctggcgcgcagccgcacggacaagagcgccgtcgcgacgttggcccagggctcgaagattcaggtcctcgccgccgcgcccccgggccgcaagggtgagggctacctctacctggtgaagtcctccacggggctgctcgggtgggccaccgcgaaggatttgacgtggaagacggacggcctgccgatcgcgggttgagggccggtggctagcgctggacggcgagaatgcgccagccccgtatgtcgatggcgtaggtggctgcttcggtcgcggtggctccttcgctgcgacatgcgccttccttcaccaggaatctgacgagcacgacttcatcgttcagtggagccgcctcgacatcgtaggagtcgcgacgatggaggcacacgtcatccggcgtggcgtcccgaggcggcttcacatcccgaggaagcatgtcgtccatcgcgagttggatggcagcggacatgttcgccggcacccgcacacgtccttccgatgggagccacaaggggtaaggcagcttcgccgcctcctccttggaggcatgctccgggcgaaagggccgctggaagagagcacaaccggggagcatcaccaacgccagcaacaaggctcgacacttcatgacccgctcctagtcgcccacatccgtgacgatgccgaatggcttgtgctccggcttgatgatgccaatgagttcccaggccctccccatgcgaagatagacctcaccgggctgaggctcattcgcatggggaaccagcttcatcacatgacagtccgtatcgaactggattcggatgagccatcgctggttcttctcccatctgtcttccggtgtcagtggcgacggtgcccagggatggctgtggtagtcggcgatgccgaccgcacgtccacgctcatcccgcacatagcgcggtgaagtacatgacttgcgcttgttgggaccgattcgctgcatctcaccgaggggcgagggatagctcgcgtagaagacgccgtctccgagcgagtagaggacgccgcagtattcctggccgtagtccttctctcgcgctccatccatctccatgatgatgggacagagctggtcgatgacgtcatccacgttcctggagggttggatggcaggccatgggcctcgaacccatacctgaccgccatcaggcccgaagtagacgtccctcccagcgtaccgatagcccgccccgccgcaggccgtcagcaacatggcaaccttggcccaacgaaggctcatccgggcgtccctcccatacctgcgccggttactcgaccagtgacagctcaatgcgtccaagctgctcgtcggtggaggtcaccttcaccgtcaccggcatgcccacggtgaaggtccgctccttgcccaccagggacagttcgcgcgcgtccggccggaaggggcctccggacagggcatccgcgggcaccacaccttccaccaacatgccgtccaactgcaccaccaggccgaagggccgcacccgcgtcacacgcgcctggaactgcttgcccacgtgccccgccatccaccgcgcctccaactcgcggtgccggtcgttctccgcccgcgtcgacgcgcgcgccttcgcgttgatgtgcaccgcgagcgcctccatccccgggtcttcatccacgaagtcccggcgcccacgcaggtaccccttcaacgtccggtgcaccgccaggtccgcgtaccggcgaatcggtgacgtgaagtgcaggtacagcggcgctgccaggccgaagtgcggccccggcttcaccgtgtagcgcgacgggcccagtgagcgccgcagcaccgaacgcagcgccggctccgccaccgcgcccgcgatctgccggtcgaacgccgccagcgcgagcggcgtcagctcccgtccgaagcccgccgcgaaaccagacgtctccgcgaaggcattcaggtccgccacccgcaacgggtccggctgctcgtgcacgcggtacaccccgggcaggccgcgcgccagcagccacccggcgatggcctcgttcgccgccaccatgaagcgctcaatcatcgcgtgcgccgacgtcggcttctcactcaccagcccggacagctcgcccgtcgcctggtcgaaggtgaagcgcgcctcgtcccgcgcgaactccatgccgcctcgcgcggcccgcgccaccgccagccgggccgccgccagccggaaccacggcatcacctcgcgcaccggctccatgggcgccgacacctcaccccggtccaggaaggcggccacctcgtcgtagttcagccgcgcccacgagcggatgacactctcgtacacgtccgccgccgtcacccggccctgcgggtcgatgcgcagctctaccgtgaggcacagccgctcctcgcccggcatcaggctcagccagtgtcga

SEQ ID NO: 674 - DNA, 3612 bp, Myxococcus xanthus
gtgctctcaaggccgtggtggacgtggtggtccacgtggagccggaccgggccgcactggacatgcccgcgtaaagacgatggccgcctccccgacaagggaggcggcccatggcatcagccgatgcgcgggatgcgtcaggccgtggcggccttcggctccggcgtcatgtagtcctcgatgggcgggcacgagcagaccagcttccggtcaccgagcacgctgttgagccggcccacggagggccagaacttgttgtcgcggacccacggtgtggggaacacggcctgctcgcgcgagtagggacggttccactccggcgcggcgacgacacgcgcggtgtgcggagcgtgcttgaggacgttgttgtccttgggcatgcggccctcctcgatgtcccgaatctcctgacggatggcgatcatcgcgtcgcagaaacggtccagctccgccttggactcgctctccgtcggttcaatcatgagcgtgcccgccaccgggaaggacacggtgggcgcgtggaagccgtagtccatgagccgcttggccacgtcctccacctccacgcccgccgtcttcttgagcgggcgcaggtcgacgatgcactcgtgcgccaccttgccgcgcttgccccggtacagtaccgggtagtgggcgttgagccgctcggcgacgtagttggcgttgaggatggccagcttggtggcctgggtgaggccctcgccgcccatcatcgcgatgtacatccacgagatgagcaggatgctcgcgctgccccacggcgccgcggagatggcgccaatggcctccgagccgcccgtctggatgacggggtgccccggcaggaacttcaccaggtggctggccacgcagatggggcccatgcccgggccgccgccgccgtgcgggatgcagaacgtcttgtgcagattgatatggcacacgtccgcgcccaccaacccgggcgaggtgaggcccacctgcgcgttgaggttggcgccgtccatgtacacctggccgccgcgctcgtggacgatggcgcagatttcgcgaatctcctcctcgaacacgccgtgggtggacgggtaggtcaccatcagcgcggcgagcgcgtccttgtgcgcctccgccttcgcgcgcaggtcatccaggtcgatgttgccgttctcatcgcacttggtgacgacgaccttgtagccggccatcaccgccgaagccgggttggtgccgtgcgcggaggacggaatcaagcacacgtcccggtgcccctggccgcggctctggtggtacgcgcggatgacgagcaggcccgcgtactccccctggcttccggcgttgggctggagcgagcaacccgcgaagcccgtcacctgcgtgagcatctgctccagctgctcgaagatgaccttgtagccagccgcctgcgaggtgggcgcgaacgggtgcagccgcccgaactggggccacgtcaccggaatcatctccgcggtggcgttgagcttcatggtgcagctgcccagcggaatcatcgagtgcgtgagggacaggtccttcgcctcgagccgccggatgtagcgcagcatctccgtctcggagtggtagctgttgaagaccgggtgcgtgaggtacgcgctcgagcggcgcagcgcctgcgacacggcgctctccacgccgtcccccaccaggtccgccaacaccggcgcggaggacttgccggtaccggtggcgaaggccgccaggatgtcctccacgtccgcgggccgcgtcgtctcatccagggacacgcccagcgtcttctcgtcgatgcggcggaagttcatccgcgccgcctcggcggcccccagcaccgcgcgcacatgcgcggccgacagctccacgcgcagcgtgtcgaagtactggtcgttcttcagcttgagacccagcttcgccagcccgcgcgccagcagcaccgtcaggccgtgcacgcgctcggcgatggccttcagcccggaggggccgtggtagacggcgtacatgctggcgatgacggccagcagcacctgcgcggtgcagatgttgctcgtcgccttctcgcggcggatgtgctgctcacgcgtctggagcgccatgcgcagcgcgcggcgtccctgcgcgtcctcggacacgccgatgatgcggccgggcatgacgcgggtgtacgcgttcttcgtggcgaagtagcccgcgtgcgggccgccgtagcccatgggcacgccgaagcgctgggcgctgcccaccgccacgtccgcgccgaactcccccggcggcgtcagcagcgtcaggctgagcaggtccgcggccaccacgaacaggccgcccgcggcgtgcacctgctcgccgaaggcccggtagtcatgcaccgcgccgtcggtggtcgggtactgcaccagcgcgcccacgaacttcttcgagctcaaatccaccgtgcggtggtcgcccaccaccacctccacgcccagcggctgggcgcgggtgcgcaccacctccaccgtctgcgggtggcagccgtcggagacgaagaaggccgcgccggactcctcgcccttctggtgcacggccagggccagagccattgcctcggcggcggcggtgccttcatccagcagcgaggcgttggccacctccagacccgtcaggtccatgaccagcgtctggaagttgagcagcgcctccagccggccctgcgcaatctccgcctgatagggcgtgtactgggtgtaccagcccgggttctggaagacgttgcggaggatgacgttcggcgtgtgcgtgtcgtggtagcccatgccgatgaaggaccggaacacctggttcttcgcggcgatggactccaaggccgccagcagttcgtgctcgccgcgcgcggtcgcgagcttcagcggctccttggcgcggatggcgggcgggacggcctggtcgatgaaagcatcgagcgagtccacgcccagcgcggacagcagctgcttcagctcggtgtcatccggaccattgtgacggccggcaaacggctcctgatacttccagttcaaggacatggctttgtagctcgcaggcgagtcgtgcgtcgagaagtcgaggaccgtccctaacaaccagtccccggcccttcactctcagctgttctggagcagggcggtgtacgcggcggcgtccatgagtccgtccacctgcttggggtccgagggctcgatttccacaatccagcccgcaccgtaggggtcggtgttcacggtggaggggttgtccgacagcccgtcgttcaccttcaccaccttgcccgtcagcggcgagtacagctccgacaccgccttggtggactcgatgacgccgaactgcttgccctccgtcaccgtggagcccaccttgggcagctccacgtagaccacgtcgcccagggactcctgcgcgtgctgcgtgacgcccaccaccaccgaggtgccctggacgcgggcccactcgtgctcacgggtgtacttcaggtcgccggggatgttgtcggccatgtcgttgctcctggttggaacgggaatgattcagggcttcttgtggaacggggtcttcaccaccactgcgggcaccgtgcggccgcggatg

SEQ ID NO: 675 - DNA, 5418 bp, Myxococcus xanthus
ggcggtatcgatttcgtagcagctcgggtcggacatcaccttgcgcaccagcttgtggttgagcgcgtggcccgtcttgtacgccgtcatgtggccgatgacgggccggccgaacagcgacacgtcgccgatggcgtccaggatcttgtggcgaacgaactcgtccgggaagcgcagcccgtccgggttgaggatggagacctcgtccacgacgatggcgttctccagcgaaccgccccgggccaggcccatctgcttcagcttctccacgtcccgcaggaagccgaaggtgcgcgcgcgggaaatctcacgcgcgaagtcccggtcaccgaagtccaggtcgaaggactggccctggatgacggggtgctcgaagtcgatggtgcagctgatgcggaagtgccgggccggcgtgagcgaggcctgcttgtcgccgtccaccaccgacaccgccttgcggatgaccagcagctccttgggcgcctcctgctcccgcacgcccgcgctctggatgagcgccgcgaagggcgccgcgctgccgtccatgatggggacttccggaccgtccagctccacccggaggttgtcgatgcccatgccggccagcgccgccatcaggtgctccaccgtgcccacgcggacaccgtcacgccccagcgtcgtggccagcgacgtgtccaccacgtactccgccagcgcggggatgctcaccgggcgggcgaggtccgtgcgcacgaagacgatgccatgccccgggggcgccgggcgcagggtgagcgtcacccgggcacccgagtggagcccgacgccctgcagggaggcgatcttcgagagagtgcgctggttgtaggaggacggtcgcattgtgggtgtcgcctcgtggcttctcggtgctgcggagcttccgctccagacccgccggagggctggaaacgttcatcagtggtctgatgtgacgcgcgagtccagcaagcagcatgccacttccgtgtgacatgcctggcagcgccgcgggcttgaaattcagctccaaccccttggagttgctcggctttttcgtgcgtcttcaggggcaccggttccggcctggcgcccctccccccgtagcggattgctgattccctcctgaaccgcgacaccgatgtcggggatttgtcatccccgtccttggcatccccgcgccctccccctcgtcaccaacccgtgtcttccatgcaacacgggcgcgtccatagcgcaaggaactcaacgacgcaaacacccgccgtgacaactccccccacacaggggccgccatgcggggtggccagtagcaccacgacggggctgtatcagcgtgcgggggtggtgaggaacctgtcccgtagggcttctgcgtcctggcgatcaaagccacggccctggaggtgcgtgcgacggctgacggagtggaaggtggactccagcgtctggatgaagcgccgcaggtcctcgccgagccgggcgcggatgccaggcccttctggaggccagggcagctccaccagcagcgaggtgaagcggtcgaaggcgtcgtagtcgccgtagcgcagcagttggtagctgccgtcgtggaagtagcccaggaagcccttgagggcgtccagcacgcgctcggcggcggggacgtcctcggcgcgcaagtgggactccgcggcgcggcacagctgggcgtatacccacaggtccttgcgcaggcgcagcgcagcctcctgcgggctcatcagttcgtcgaagacaccgtcggccaggcccccgttgggcgccaacgcctccaccagcgccaccacctgcgtgcgcagcaccgccgtgaaggcggacgcggcgcgcaggggggcctccgcgtcgcggtccaggttgaccagcacctcgcgggccacgcgctccgtctcccgggcgatgtcgcgcgcggcgcgcagcgtggcggcctgcagggacttggagccagcattgggagacagctccgagtgcatccacgacgccagcgcggtggcctcgctgcgcaccagcgccagcagcacgcgcacacgacgggagaagggcggctgctcctccgcgtccacgtaggccaggtagtgcagcagccggaagaggcccaggaaggcggtggtgaaggcggtgcgctgctcctcctggagggtgaccagcgtgtccagcagccgcaccgaacggagccggtcgtattcgacgcggaactccaacgggcggaaggggcggaagtagcggttgaggacgatttcccgcagagacagcttgcccacgtcctggaagaggccgaggttcgccgccggcagcttgagcaggtggtccagcaggttcttcagcgcgtcgaaggcctcgcgcagcacgaagaggctttcgggcggcgtctcctggtccagttgctcttcgatgagcgcgcgccggacgcggtcgtccgcgagctgggtctccacgtacttgcggaagaccatcttctggtcgctgtccgggtcctgcaggtggcgcgcgacacggatggcgcggtccatggcgtcgcgcacgtccgccagctcctcgcggaagtcacgcgtgacgagcggcctgtcgcgcgcgtccaccaccgtgttgaggttgaggtagcgctccaccgcgcgcagcagcatctcgaactcgaacagcagctcctcccgcccctccacgggcacgccgcgcagccagcgctcgcgttcggcgaggaagccggcgcgcgacgtctgggaagcgcgcatcaggtcggcgtagaagtcgcgggggacgcggggcggtgaggaaggcgtgtcctggctcatggcatctcagaagaggctgccctggggcgtgggcggtggttgcttcttgaaatattggtacgtgcggtgcgtggccatccggccccgcggcgtacgctggaggaagccttcctgcatcaggaagggctcgtacacgtcctcgatggtatcgcgctgctcgcccacgctggcggcgatggtctccacacccaccgggccgccgccgaacttgtcgagaatggtcagcagaatcttgcggtccatggagtccaggccgctggcgtccaccccgagcctgtccagcgacttctgcgccagctccagggtgattctgccattgccttccacctccgcgaaatcacgcagccggcgcagcagccggttggtgatgcgcggcgtgccccgcgaacggctggccacctcgcgcgcggcgtccttgtccaggggaatgcccaggatgcgcgcggagcggtggaggatgctctccagcgccttggcgtcgtagtactccagccgttcctgaatctggaagcggtcgcgcagcggcgaggtgagcaggccggtgcgcgtggtggcgccaatcaacgtgaagggcggcaaatcaatcttcatcgcccgggcggcgggcccggtgtcgatggtgatgtccagccggaagtcctccatggccgggtagaggtattcctccacggcggcgttgaggcggtggatttcatcgatgaagagcacgtcccgcgcgtcgaggttggtgagcaggcccgcgaggtcccccttgcgctccagggcggggccgctcgtgacgtggattcccacgcccagttcgttcgcgatgatgtgcgccagcgacgtcttgcccaggcccggcgggccggagaacaggcagtggtccagggcttcgccccggctgcgcgcggcctgcacgtagaccttgagcttttcgacgacgggcccctggcccacgtactcgtcgaacgagcgcggacgcagggaagcctcgagccggacgtcctcgggcaggacgtcttccgagagtgtgtcggacttcctcgccatgaccatccggaccctatacaggaaggccgcgcgtgtcgccgcacatctggcggcgatacatccagacggccgccggccctgccagccaggcgggcgcgggcaggggaaggtagggccccctcccagcgttccaggcacagcccccgccgatactccgaggcgattgaagtgcgcctgccgtatgcgagagtcgagcctggagaccgcatgaacacgagccctgcgtttcgtcccctcccctccctggccggcgcgcgcgccgaacccgtgcccgggctccggctccagaagctccgccgggccgcgttggatgcgcgggaggcctttgtgagggaaggcccggtggccgcggtggccacctgcgacctcgtcaccttcccctaccccgcccagttcgccttcagcggcgcggcgtcgtctccggcgccctacgtcatgctgacgaaccggatgcaggtagtgcagttcgtggaccgggagggcgcgcggcgaacgctgctgttcaacccctccgactacgagcgcggcgtctccgcccccttctaccgcgcgctgcgcgagcgctacggcggcttcgtttcagacaaggtgatgtccacgcggcacggctcggtgcagagccacctggccgcgctcggcctcatcccgtcggatgtggactacctggccttcgaccacctccacatccaggacctgcgcggctggctgggcggtgacggcatgcccgcgtacttcccccgggcccggctgctggtgcagcgcgccgaatgggaggtggccctggagccgcaccccatgcaggcggtgtggctcgtcccgggcggcgccgacatcccccgcgagcgcgtggtgctgctggacggtgacgtgtggctgggacagggcgcggcgctgctgagcacgcccggccacacgcgcggcaacatgtcgctggcggtggccacctcgcgcgaggtgttcgtcaccagcgagaatggcgtggccacggagagctacacgcgctcccagtccgccatccccggcgtgcgccgcttcgccgagcacatgggctgggaggtcgtcctcaacggcaacacgcgcgaggactccctggaccagtactcctccatggtggtggagaagctgttcgcgggcacgtcctccgtggagggcgcgttcatcaacttctacccgtcctcgcagctcaccgcgcacgtcatggcgcccgggttgtcgcccaccatcgtcctgcccgcgcccaacttcggcgacgtgcggcccacccccgcgtcacggcgggccgcctagcgctcagcagtcccggctgaagcagagccaccaggggcggaagggcaccgcgtacagctcctggtccctgtctccatccgacgcggcgaagaagatgttgaagccggcgcgcacgaagttgaacgggttcgacgacgcggcccccggcgcgatgtccagcagccggctcgtcacccagggcggccggcgctgtaccagacctcgcgcccgtgccccgccgtctccgccgagaagaacagccagccggactcggccttgagccccgtggggcacgcttggcccaccggccccg

SEQ ID NO: 676 - DNA, 4377 bp, Myxococcus xanthus
gtcgccacctccagcaggcgccgcgcatccacggagacgacgaagccgttctgctcggcccgaagcggccaccgcccgcccgtgggcgccggcacctcggccggcgcctcgaggtcccctgagcgcaatcgctccagcctgcgcgcgacgcgcagcgtgtccacgcgcacccgttggacgatgttctccacgcgcatggactggagcgtatggagcacatggaagacgagcgcgccttcacagacgacgagcagcaacatggccagactgagcgccgggcgcggcgcgcgctcggcgcccgccacgagcccgaactcgtgggtggccacgaggcagaagacgctcgtggcgacgaacaccgggatgaccacgcggatacccgcgccgtgcacgaagtggcgcagcagtcgcggcgagaactgcccagcggcgttctgcaccacgagcatggagagggacaggacgatgctcaaggacgtcagcgcgatccccagcacggtggagagcatgtcccgcgcctccgaggaggtggcctgccaggcgacgccgcgcagaacccttgccgcgaacacaggtggatccacgaacaccacgcccaggcatgccccaaccaccgcgcccaccacgggcgtgagccacaaccgatgccgcagccaccaacggagcggcggtgcatctcgcggaggaccggaactggggactccacgtcccagggctgtgcgggggagtgcctggatgcccgccatgcgcagtacctccgccaccgcactggccctgagccagtgcgctcagaccgaccgagcacggcggccgggcctgcttcccggctccggcgacggggctgcccctcagagactgggaacgctcatgcccgacggcaaggcgcacgcgaaggcccggggaactggggcccgacagcccctacgcccacctagaactgcaggtacacgtacggccgcgcctccacggcggacaggtggcggatgcccaggccgagcaccaccagcaccgcggcgcgcaccggcacgggcatgcggacgaagaggtccgacgacaccgtgtagagcttcatcggcacggcatggaagaagacggccgcggccagcatgccccacaccagtgggctcacgttggcgatgccgggcacgcccgccatcatcctttcgtagaactcgcccgcgtgcgccatgtccgctgcccggaacaccacgcgcgtcagcacgacgatggtgaacgtcgtcaacatgcccagcgccacgcgggggatgcccggggactcgggcttgcccaccgaccactcccagcagcgcgacacacacagcgccacgccgtgcaccgcgccccagaccgcgaagcgccagtccgccccgtgccacaggccgcccagcaccatcaccgtcatcaggttgaacagcacgcgcggtttcgacacgcggttgccgcccagcgggcggtacaggtagtcgcgcagccacgtggacaggctcaggtgccaccggttccagaactcgccgatgttcttcgccaggtagggccggttgaagttctccgggaacttgaagccgaacagcgccgccacgccaatcgcgatgtccgagtaccccgagaagtcgtagtagagctcgaaggtgtaggccaccgccgcgacgatgcactccgcggaggcgtacttctccggcgcggcgaagacagggtccaccagccccgcgcccagcacgtccgcgatgaccagcttcttcaccaggcccaccgcgatgcggaagagggcgtggccaccggcctcgggcgtgaggctcggcgtctggcggaagtgcaccatcagctccgacgcccggacgatggggccactcacgacgcgcgggaagaagagcaggtacagcaggtgctcgatgaacgagtgctccgcgctcgccttctgccggtacacgtccaccgtgtagctgatggcctggaagacgaagaaggacaggcccaccggcatcagcaggttgaagggctcggcgcggacctcgatgccccacggcgccagaagcgacagcagcgactgccgcagcatctccaggtacttgaagcccgcgagcaggctcaggttggagacgaccgacaccgtgacgagcgccttgcggaccccctgtgactgcgcgcgggccatgcccttcacgcacaggtggtccaccgtgacgcccaccaggaagatgaggatggggaagggcgtgaaggccgcgtagaagaagaggctggccaccagcagcacgccgatgcgcggccagtagtgccggtgcaccgcccaatacagggcgaacaccgcgatgacgaagacgaggtactggacgctgtgcgacagcacgtcagttgtcctccacgcgcgaggtggggcccgccttcttgtgggcctcgtacgccgtgagcagctcccgggagaaggcccccgccagccgcgcgtagccttccggtgtcaggtggacgccgtccgcgtggcccagcgcgggctgcgtgcgctgccagcgcagcatggagcgctctccacccatggccgcgcgagtcgaccagtacgcgcaccccgcgtctttcgccacctgcggcagcgtgttcagcaccgacgccagcgagggcgcctcgctccaccggccgttggcgtcctgcgtgagccggtccgtggggcccatcaccaggcactccgcgttggtggccttgcgcaggcgcgtcagcatctccgtgtagtcccggcgcagcgccgaggcgtccaggtctgtccgacccgcctcgttggtgccgtaccagaacacgagcaggtccggccgccgcgacgccaactgcgcgtccaccgacgccgcgtccatggcccccaatgtcgaggccgtggcaccgggaaggcccagcgcgtcgtacacgacgcccggcgtgtcgtattccagggacgcccccagcaccgtgacgttgccgtccttcggcgccgtcacctccacggtgtgcgaggaccccgtgacggggaacgagcggatgcgcacggtgggctcggtcaacggctccggcggaggcgcgtccggcggcagcagctcgccgtcaatcgcgatgtccggcgcgcgcacgtccggcgcgtccagcgcgtacaaatccaaccggcccgaggactccttcgcctccgggcagtccttgcagaactggatgcgcagcttcgcgcccggaccgcccacggcgcggatgcccgtcagcccccacaggcccccggggggggcgtccttggcggcgtcctcgatggtccagtccccctccagcgcgcgcgtcacgcccgcgggctccaggcggggggaggccttgccggcggcgatgaagccccggcccgcggcgccgaagcgcttcgtcagcacctcgcgcaccgcgtccgtgaagtagtgcgacgcggtgtgcgaaccacccaactgcgcgacgcccacgcgaagggcctcgcccgcctcgcggcgcttcagcttgtcgaacgtgcgcgccagcgcggtgtccgcgttctgcaggccggccgggtccaccacggccaccagcggcgcccggctcttcgcgaacgcacgctggagggacaggtcgaagaggtggcccagcaaatccgagccccgggcgcgcgggtggacaaggtcgtccagcatcagcccttcctcgagccagcgcagcgcggagccctcgccgcccatggcggcataggcgtcccagaacgcgcagccggccgcgcgggcctcctcgcggtagatggcgccaatctcctgggtgccccggcgtgacaccacctcgccgctcatggtgcgcacgcccgcgtcgatgggggccatcagcaggcacgcggcgttcggcacgttggtgcgcacgcgagacatcaactcctttatctgcgcgcgcacctcgtccaacgtggtgcggtctcgcgagtagaagaaggcctcgttgccgcccaccatcatcaccaccagggacggcttgcgctggcgcaactgcgcgcggaaggcggcgggctgggcgcgcaggtacacctccgccattccgcccagcaggcccaccgtgtcgtagacgacgcccggcgcgcccgactccagcgtcatgccgtgcagctccaccttgccggacgtggtgagcgtcagcgacttcgcgccctgcggcagggtcacgcgggcgaaggccgcctccgacttgttcttggagaagcctcgcgtgtggatgcgctggagcggcttgccgtccacggagaactgcacggagccactggcgggctgcgccaggaagaagagctccgccacgcgcgagccctccacgtcataacgcgtgctctgggagcccttctccgagctgaaggccacgccggtccagcccacccggtcgcgaggccacttggag

SEQ ID NO: 677 - DNA, 4486 bp, Myxococcus xanthus
ctaccgcgcggcgctgccggcctatgaagtgcccaccgaggccgaggcctacgagatggagtactacttcgaggtcgcggacgcggcgcagcgccggctcgcgggccggggagactccttccagccgctcatcttccaggtggcgccccgggccgtgcgcgccggcgccgccgccgacccgtcctcccgtccctggtacaagagcccctggctctgggtgggcgtgggcgcggtggccattggcgccaccgccggcatcgtggcgctgacctccggcgaagagcggggccgcgttcccatcaccatccgcgtggagccccccgccccatgagcctgcgcctcctgtccccactgttgctgctcggccttggcgcgtgcggccctgacgccgagcccgcgggtcgctttccgctcgccctgacgatggagcgcgcggtggccaacgacgtccaggcgctacaggtggccgtggtgtcacggggctccagccgcagttgcaccgagattcagcgcacgtgcctgggcacccaggtgcggcgtgacgacctggtggtgctgaaggacgcccaggggcgcgagggcagggccctccgcttcccagtggacctggcgaccctccagtcgggaggaagcctggagctggcggtggacgtgccggtgggccgagattacgcgctcgtcatcgaggcgatcaccacggggaccccgcccggcttcctggggagttcgtgcaactacctccgtgaggtcaacgcgggcgacaacgccccggtgattgccgcgcccctgacgctgaccggtggagattgcaatccgtccatcgcgccctgagcgcggagggactcgagagggcttcatgtcgcgcatcctgattatcgaggacgagcaggacctggcaggtctcgtcgactacaacctgcgggccgcgggcttcgagacggagacggccagcaccggcgcgagcgggctcgccaaggcgcgcgcgcatccgccagacctggtgctgctggacctgatgctgccggacgtggcgggcagcgaggtgctgcgcatgctcaaggcggacaccgagctgcgcaaggcgtccgtcatcatcgtcagcgcgaagggccaggagtccgaccgggtgcagggcctggagctgggcgcggacgactacgtggtgaagcccttctccgtccgcgagctccttctgcgcgtcaaggccgtgctgcgccgcgcggacgcggaggacggcccctccgcggtgctcgcctccggcgacatcagcctggacaccacccgccaccaggtgcgtgtgaagggcgaggaagtgctcctcaccgcgctggagttccgcctgctgcgcacgctgctggagcgctcggaccgggtgcagacgcgcgaggtgctgctgtcggacgtctggggcatccaggcggagatccacacccgcaccgtggacacgcacatcaagcggctgcgcgagaagctgggccccgccggggacatcatcgagacggtgcgcggcgtgggctacaagctcagccctccgtgaggccgccccgcccatgcccctgcgcgccacactccttccgctcctgctgcccgccgtcgtcgtcgcgacgctcgtcgccctcctcgacgggccgaaggaggtcttcgccgcggcgctcgtcgcgctcgccggctccctcatgtccctgggcgtgagccgcggaacgatgcagcggcagctcgacctgctggcccgccacacccgggagcgcgccgagggcggcgcctccaccgccgcgcctggcgtccctgagcggctggacgaggtggccgggctcgaaggcgccatcgactcgctgcacgcccagctgtccgcgcgcaacgcggcgctcacccaggaggcgcgcaccctcaccgccgtgctcgacggcatgacagaaggcgtctgggtgacggacgcagagggcacggtggtgcgccacaacgacgcgctccgccccctgctggcgtccacgaacagcccgctcaccggccagcgccccctggccctcatccggaacgaggcgctgcacgacgccgtgatgcgcgcctgccgggagagcgcatccagccacctggagctcacgctggacggccacttcccgcgcacgctctccatccgggtgacgccgctggccaaggatttgccgggcagcgccgccgtcttccacgacgtcaccgagctgcgccggctggagaaggtgcgcaaggacttcgtggccaacgtgtcgcacgagctgcgcacgcccatcaccgccatccgcggctacgcggagacgctccagggcggcgccctcaatgaccccgtcatggcgccgaagatggtggaaatcatccaccgccagtccgaacgcctgtccgaactggtggaggacctgctggagctgtcccgcctggagtcgcgcgaggtgagcctgaagctcgcccgcgtcaccctggccgacgccgccgcccgcgccgccgacaccgtgcgccccaaggccgggggcaagggccaggtggtttcactccacgtccctcaagacctactcgcagtgggggacccccgtgccgtggagcaggtgctgctcaacctgctggacaacgcggtgaagtacacgcccgcgggtggccgggtggatgtttacggtgagtacgagcaaggccgctgcgtggtgcgggtgaaggacaccggggtgggcatcgaggccaagcaccagtcgcgcatcttcgagcgcttctaccgggtggacaagggccgcagccgggacatggggggtaccggactggggctcgccatcgtcaagcacctgctgcaggccatggacggcgaggtcaaggtggagagcgaacccaacggggggagcaccttcaccatttttctgcccctggcggcttcatcgagcgcggcgacagggtaggatggagtgaccatgcgggtcgccatcctcgcggacatccacggcaatcttcccgcctgcgaggccgtcctcgaggacatcgcccgctctgtatcgcccgactacatcgtcgcggccggagacctggcgctgcgtggcgcccatccccgggagacggtggacctgctcttcgaccggtgtgactccgtcctgatgggcaacaccgactgctacctggcgggcaactacctgggcggcgcctaccgggagaaggaccactggaagacggagctgctgcgctggacgcgggaccagttgggcggcgcgctgctggagaagctgggcgccctgcccttctccgtgcgctacacgccgcgcaagggacaggacctcttcgtctgccacgccaacccgcgcaacctcgaggagtcgctggaccccacgctggatgacgtcgcggtgcgccgcttcttcagccacctggacgcggcggcctgcgccttcgggcacctgcacttcccctaccgccgccgcgtgggccgcatgctcatcgcggacgtggccagcgcgggcatcccccgggacggagacctgcgccccgcctacggcgtcttcaccttcacgcccaagggttggcgggtgcagattcgccgggtgcgctacccggtgcgcaaggccacccaggccctcaccgcgcgccgcgtccccggcggaccgctcctggtccacaagctggtggaggcgcgctaccgccaccacaacgcgctgatggaggccgcgcggcgccactccggcctgccaccgccgggcccggtgctccgcccgccgccaggggccgcctcgcgcgccgcggccacgcccatggacagtcgtccctccccggaggtcgaccccgcctcgttgcccacggacctggacggaaccgtgacgggcgcggcgccgctgcccctggacgcgctcaacgatttcgaagggtagacgttgtcgccagtccgttgcttgcgcgggaacgcccggggtgattcacggcgctcaccatgtctgcacgcgagctgccgctgctgttcatccgccacgccgtcgcggaggactctcacgtcctgggcgatgaggcgcgcgccctcaccccggaaggccgcgccgccttccgccaccatgcacgcaagctggcacgcctcacgccactgcgcggcatcatcaccagtccgctggtgcgtgccgtccagacggcggagctgctcgccgaggccttcggcgtgtccggcgtggaggtccaccccgccctgctgccccagcgcggcgcgcacaagcgcatcgtcgacctgggccgcgagcgcggagcgggctgggccctggtgggccacaacccctcgctggagcgcgcggccattcgcgccctggagcatgagctgccggacaagctgcgcaagggcgcggcgctggcgctccatcccctgaagaacggcggcttcacgctcgcgtggtgggccacgccgggcaagcccgtgaagcgccccggcgacctgcgctgacgcgcctcagtgcgccgcgcccagcaggaaggacaggacgagcatggccagcaccgtggc

SEQ ID NO: 678 - DNA, 5187 bp, Myxococcus xanthus
  unsure (1)..(5187): unsure at all n locations
tcagcgtcagccgccgggagtagacggcggccgttcgcggtgtcccggtgggttggacaggcgctgcccctttcgctacgaggtgggcagacgcatcacctgacttcccgaggagattgcacgatgacgctgcgcacgctcggcctgacgctgctggggaccgcggggctgctgaccctttctgcctgtaagaaggaggagccggccgccgcgccacccgccgccgcgcccgccgcgaagaaggagccccacgcggcctcgcccatccaggcgccggaaggtgccgccgcggcgcccgtggctccagcgggcaagggcgtggtgaagggcacggtgaagttcaccggtactccgcctgaggccgcggacatccccgcgagcaatgacccggcgtgcgagggcatggcgacgaaggatgcgtcggtcctggtgaaggacggcaacctccagaacgtggtggtgcgcgtgaagggcaaggtgcccggcgcgcctcccgcgcctgccacgccggtggtggtggaccagtcgaagtgcacctatgtcccgcgcgtgcagggcgcgatggcggggcagcaggtggcgttcaagaacagcgacggcacgctgcacaacgtgcgcggcatcgcgggcacgaagcccgtgttcaacgtcgcgcagcctccgtccggcgccccggtggagcggccgttgcccgcggacgcggacgtgctgaagctcaagtgtgacgtgcacccgtggatgtctgccttcgtcgtcagcaacgagaacccgtacttcgcgacgacgggcgcggacggtgctttcgcgctcgaaggactgcccgcgggcacgtacacggtggaggcctggcacgagacgctcggctcgaagacggccgaagtcacggtgacggacgacgcgccggccgaggccgcgttctccttctccgcggaggacgcgtccgcgcagaagtgacgaacgcgctacgcggtggggcggccctctgaagccggagggccgtttttccgcacggtgaagcccacccgagcgccgccgccggggcggttctccgcgaagacgtctccgccgtggacgtgcgcgatgcgctggaccagcgccagacccaggcccagggagcccgcctcgcgcgcttcggtgccttggtccctccggtagaagggccggaagatgcgctcgtcctcgccgggctgcagcccggggccccggtcttccacgcagaaggccaggtgttcgcctcgctcctggatgcgcagtgcctcggcgccggtgccgtgcttgcgcgcattctccaggaggttggccagggcgcggcccagcagcgtcgcgtctcccacgagcccggcgcgctccacgtccatacccaacagggagctcgccagccccgcgcgctccagggcctgcgtggccagcgtctggccatcgaggacacgcggggtgagctggccgaagtccagccgggagctggccagcagctcccccaccagggcatccagctccaccacctcgcggtccacctggtccaacgtcttcgggttgccgcctccgtcgcggagcagctccgtcagcacgcgcagccgggccagcggggtgcgcagctcgtgggacacggcggcgagcagctcgcgctggtccgccacctgcttctcgatgcgccccgccatgtcgttgaaggcatccgccagcacggcgaactctcccgtgacatgcggcgcgacgtccgcgcgcgagtccagccggcccgagcccagctctcgcgtggcccggaccagcgcatccatgggccgtgcgagccgccgcgcgagcttccccgaggccagccacagcaccatgcacgacagcgccagcggcagcaccatccgcagcgggttcttcggacggaagctggcgtagcaagcgcgcaccgagcccagggtgatgccatcgcgaaccacgggcaggttgagctcgggccgccggcacggcacctggctctgcgccagcatcgcgccggacgcgtcccgcaactccacgcccacctgcaagtccttctcgatggaggccaccagcgcgtcccgccgtgcgggctcgtcccagacctcctcgaagcggtggcccacgaaggcgcgcacgcggtcgccttcctgtttccaggtgcctccgcccaccaggctcatcaccgtggccaccacggcgccggtggcgaggatggacaggccgaaccacatgaacaggcgccggtgcagccgggcgcgcacgaagccgcccaggcggcccatatgccagtaaccgtgcggcggatgccggtgtccccaggggccgcattcgcgcggctcgccccacgcgtcccagccgcgcttgtgcgcccggggcctgccgcgtttcacggaccctccttggcgaacacgtagcccacgccgcgcaccgtcttgatgaggcgggtgcccacgtcaccgagcttctgtcgcaggtgggagatgtgcacgtcgacggtgcgctcgcccaccaccgtgtcactgcggcccgcctcgcccagcagggcgtcgcgcggaacgacgcgtccggccctgcgcaccagcgcgacgagtaaatcgaactccaggcccgtcaactccacggcgcgctcctccacgcgtacctcgcgcccggccacgtcgatggacacgccgcccgactctagccggtccgccaccgccgagggctgcgagcggcggagtacggcccgcagccgcgccagcagctctcggggactgaagggcttggggaggtagtcgtccgcgcccagctccaagcccaccacgcggtccgtctcgtcgcccttcgcggtgagcatgatgacggggatgcggctcttggcgcggatgcgcttgcagacctccaggccgtccatgccgggcatcatcacgtcgagcagcaccgcgtcgaaggcactggcctccagcgccgccagcccccgtccgccatccgccgcgtgggtgacgctgaggccgttctgcccgaggtactgctcgagcagttcatacatccgggtgtcgtcgtcgatgagcaggacgcgcgtggacatgaaccgccttctacttcagggggaggccgtgtggatggacacgcgagtcgccggcgggggggccaccccctcgctggctggaaggctcccacctgccgtgggggctcccatccgtgttcccaggcgccatggtgacagtggcgcaggtaatgncggtggcggtggcgggccacgctggcgaacccggaggcatagcctccaacggtgcccagggcgagcaggacgatgaacaaacggcggcgcatggagtctttccttcaaggacgacgaaagggggcgttggtttggggctcacaccccacgcgcgtcatcgcgtccccacgggccgtggccgtccccgtggcgatggccaccgtggccgaatccgccgcctcgccagccgccggggccgccacagcggcggtgccagccgccatggcctccgtgccagccgtaggcggagccgaagccgtgctcgaggaggtccgcgagctcacggcgctgccgcgggtccagcgcctcgtggacctgggcgagcgacccctgcaccgtgcggcgcacgttgtcgatggcgacatcgtggcgagcgaagagctcacgcagcgcggcgccgtcgaagtgctcaccgcgcagcgcggcgcccagggcggtgcggctggggcctacctcatcacgggccttggcgaaggcctccatgacatcgtcggcggccttgaggaggaccttctcctggccaggtgatgtatccagccgctcgaagagccagcgcaggcgtccgcgcgaactccagcgacctccgcggcgatacccgtggcgtccgccacggaccgtgtagatgagcccggcgaggcaggcggttccgaagagaaacccgaacatggctccacgctcccaatgaggccgtcccctggggggcggcgctggtggtgacgagcgggaaggtagagggcgggtatgaaggccacgcccgcgcgcggtgaagaagtgtgaagacggccccgggagaggggtggggggagtgaggggaagaagacggcttgtcgccctggcgggaggggcgggggaagtggagtgtccggtggcggacggctgcttgcccggaaggcggttgcccggtggacaggcggcgccaggaagtttgtcgttagggggccggggcggtgtccgctccgcacacgtcgatcgggcagcccttggcggcggcctcgaagcagaaggaagaaggtcacatggcaatcggtaccgtgaagtggttcaacgacgccaaggggttcggattcatcgcgcaggacaacggtgaggacgtgttctgccaccacactgccatcaacatggatggcttccgcaccctccaggaagggcagcaggtggagttcgaggtcacgcgtggccccaagggcctgcaggcgcagaacgtccgcgccgtctgacgcacccgcaggccacttccgagtgtgcccgaggcccggtctcccagcagggaggcggggccttcgcatgtctggctcctcgtgcgccgggctggcggcccgcgccgagtgcccgtcggcacctggatgccttccttaccttttccggcagacgcgcggcacatccgccgccatccaacggagacgaaggcatgggcgacaccagcgtgaagaaggtggagagtcggcactctcccaagggcgaaatggggcagaagtacctggcgtccggcgtccgcctgtcgatgcggctgtgggaggacgaaccgcccggagaaccggcacccgccaccgcgagggactacgaaaccgtgggcttcgtcctgaagggccgcgcggagctgcacctcgagggacaggtcatcctgctcaaccctggagactcctggctggtgcctcgtggctccagtcacacgtacaaggtgctggagaccttctccgccgtggaagccaccagtccgcccgcggccgtgcacggccgggatgaaagcaaggacgcggggacgaagccgcccgcgaaggcgtgagcctgacggtccgcgccgtttactcaggttgtgatgggggcgacgctgcctggacgctgcacgcgtacctgggatggcgtcctgcttcagggcggcaaaccagcagcggcgatgtcggcaccccctctgggtgaggacaggtgggcgttgacgtcaacggcatagctgagtg

SEQ ID NO: 679 - DNA, 4387 bp, Myxococcus xanthus
gctctccagccgtcttccccttgtgggggccgaacgccaccaccacggcgctcggcttggggcgtggcgccgcgggctccggattggcggcgggcaccgcctccagggtggattcgcggggctgcttgggctggagcggcacgtcgatgtccaactgcgccgcggcggcctgggacgcgcgcggctcctggggcgccagcggcgggaaggacgccttgagggggccgggcttggagcccagtacctcgtaggggccgctgccgtgttcgtccgagtgcgactcgtagtcctcggcgggcatttcctcccgcacatagagtccgccgaaggcctccgggtacgccttgcgcagggcggccacgcgggcgcacttctcaatcatggtggtgggaatcttggaccacagcggcgtctgctggacgtagccgctgaagtccaaccacaccaccaccggcagcttgtcctcgcgcaccacacgcgaccaggcacccaccagcgcgccctttcgcttggcggggttgaagcggtgcaccacctcgcctcggccctggtccacgacgatgtcgtcctcggtgaacaccgcgctcgcctggatgcccttgaagtccgggaagcgctcggcgcgtgcgagcattccggcctcggagggctggaactcgtacttcgtcacccagttgggccgctcgcggttgccggcattctgccgacgcgccacgcagaaggcctccttgaggagcgggtccaggccactgcgcttgcactgctcgatgaagagggcgaactcgtcctcgctgatgccgcgagggcagatggtccgcttcacgagctccacgcgctcccgtgtccacccggcgtgctggccaccctggccggccgccgttccttccgccttctgttgggggttggcttccatctctgtcttctcctgctacgtcctgcgcgaaaagggcggacgacctccgtccgcccgcatggttgccgcggggtgctcggtgctctcgaggtgactgaccgcgagccatcactcgctcgccgtcccgccaggctgggacgaacagcgtgctacggccatgttgaacatcggagtggggcgctcgcttcacatgcctgcgtcacgcgccgggcccggctgaagggcatgcggaccagcatcggctccggaaagcaccggagacgaaccgccacggacaggaatgaaggggggcgtgaaaaaacgttttgacacagcaggcggcgttctgtagttaccgccgccacctggacgccgcgcaggcggcggaccggggcagtgccgggagcgtagctcaattggcagagcaatggactcttaatccataggttgtgggttcgattccctccgctctcactgtgaggcccctccagaaatggaggggcctttttgtttttccggcctctgccgtcccgtggatgtttcgcggtaagacggtgcagtgcacgacggcgcaacccgggcgggtggcgaaactggtagacgcgccagacttaggatctggtaccgcaaggtgtgagggttcgagtccctcctcgcccatttcgcgttgacccgttcgtgcctatcccctaaaggcgcacgtcccacttttccggcaccgcccgaaacgactgattgtccggcggcggtggcgagcgaggcccgcatgaaggtccaggtcgaggagctttctcccattgagaagaagctctccatcgaggtcgacaatgcccgcgtggcggaggagctgtcccgcgcgtactccaacctgggccgccaggtgcggctgccggggttccgtcagggcaaggtgcctcgccgcatcctggagcagcgcttccgtgaccaggtagaggacgaggtcatccagcgcgtggtgcagagcgcgtacgtggaggccatccgcgagcacaacgtggaggtcgtcgccacgccgcaggtgaccaactccggcctcaagcccaacaccccgttcaccttcgaggctcgcgtcgaggtgaagcccaaggtggaggccaaggactacgtcgagctgccgctgacgaagtccgacaccgccgtcaccgacgagcaggtgaacgagcagctggagcgcatgcgccagtcgatggcccggctggagcccgtcaccgaccgcgacaccgccgcctccggcgactacgtcaccgtggacttcgacgccaccgtggacggccagccgttcgcgggcagcaaggcggagggcatcaccgtgcaggtgcagcccggtgagctggtggagtccaagattgccgccctggagggcgtgaaggtcggcgagtccaaggacatcgactacgccttcccgcaggagtaccgggtggaggaggtgccgggaaagacggcgcgcttccacatcacgctcaagggcgtgcagaaggaaatcgtccccgagctgaacgacgacttcgccaagcagtcgggcgtcgcccaatccattgacgagctgcgcaccaagctccgtgaggacatggagaaggcgcgcaagtcccaggtggagggcgaggagcgtgaggcgctgatgaaggcgctgctggagcgcaacaccttcgacgtgccccgcgccatggtggagcgggccatggactccatgctgcgcggcgcgctgcagcagctccagcgctccggtgtggacccccgccagctgaacctggacttcaaccgtctgcgcgaagacatgcgcgagaaggccctccaggaagtgaagggcacgctgctcttcgagtccatcgctcagaaggagggcatccaggcctccgacgcggacgtggacgcccgcatcgagcagctcgccaacgaggcgggccagccggtcgccgtggtgcagaagtacttcaagggcgccgacgagcggctcgggttgtctctccgactccgggaggaaaagacgattgaattcctgaggagccgggcgaagtattcgtaaggttccctcaccgaggtcgacatgcccttcatgcccgttccctacgtcatcgagcagacccaccggggtgagcgctcgtacgacatctacagccggctcctgaaggaccgcatcgtgatgctgggcacggagatcgacgatgacgtggccaacgtcatcgtcgcccagttgctgttcctggagtcggaagacccggacaaggacatcaacctctacatcaactcgccgggtggctcggtgacggcgggcctcgccatctacgacaccatgcagtacgtgaagtgtccggtgtccaccatctgcgtcgggcaggcggcctccatgggggccgtcctcctgctcgccggtgccaagggcaagcgttacgccctgccgtccagtcgcatcatgattcaccagcctctgggtggtgtgcgcggtcaggcaacggacattgaaatccaggcgaaggaaatcctccggatgaaggcgaagctcaacgagctcatcgtcaagcacaccggacagtccatcgagcgtgtcgagaaggacacggaccgcgactacttcatgggcgcgtccgaggcaaaggcctacggcatcatcgatgagatccagaatccccggaaggtcgtgggactgggtaaggaagagaagaagtaggcggattgccgaggcttcggggcctcggccggcagccggagccgcgggaatgcgcccccgcgactccggctttctgctttctgcgtcacggcacaggtcctgttaagtacccggaaggcgcgtggacgttccggacgggggctgactagattggtccgagccaggaacggggtggagttcgggggcgggggcctttcaggcgcagcgagggacgaaatggcgggcaagaacgtggagaagcgagacaaccagaccctctgctgctccttctgtggaaagtcacagaaggaggtcaagaagctcatcgcggggccgacggtctacatctgcgacgagtgcatcgggctgtgcaacgacatcatcgcggaggagatcgaccgcgaggagacgaaggacacgaagctgcgcatcccccggccctccgaaatcaaggcggtcctggacgagtacgtgattgggcaggagcgggcgaagaagacgctctccgtcgccgtgcacaaccactacaagcgcatcgagtccaaggtcgcgatggaggacgtggagctccagaagagcaacatccttctcctggggcctaccggtagcggcaagacgttgctggcgcagacgctggcgcgcatcctcaacgtgcccttcaccatcgccgacgcgacgtgcctcaccgaggccggctacgtgggcgaggacgtggagaacatcatcgtcaacctgctgcaggccgccgaccacgacatcgagcgggcccagcgcggcatcgtctacatcgacgaaatcgacaagattgcacgcaagtcggagaacccctc

SEQ ID NO: 680 - DNA, 3924 bp, Myxococcus xanthus
  unsure (1)..(3924): unsure at all n locations
tgcgcctgccctacggtgagaagacggtgccggtgaaggccttcaacttcaccgaagacgtcgtgggccaccacgagcgctacctgtggggtcacgcctccgtggcgctcaccagccgcgtggcggactcgttcgccaagttccgctggagcccgaacatcatcggtccccagtccggcggcgcggtggagaacctgccgctgcaccagtacgaggccatgggggagatccagaccaagattcccaccgaggtcatgctcaccgagcggcgcgagttcgagctctccgaggagggcttcatcggcctggtgttccgcaaggactccgacaacgcggccttcttcagcgccaactccacgcagaagccccggttcttcggcaacaccccggagggcaaggcggcggagaccaactatcgcctgggcacgcagctcccttacatgttcatcatgacccgcctggcgcactacatcaaagtgctccagcgcgagcagattggtagctggaaggagaagtcggacctggagcgcgagctcaatcactggctcagccagtacatctccgacatggacgaccctgctcccgccgtgcgctcgcgccgccccctgcgcgccgcgcgcgtggtggtggaggacgtggagggtcagccgggctggtaccgctgcagcctgcaggtgcgcccccacttcaagtacatgggtgcatcgttcaccttgtccctcgtgggcaagctggacaaggagtagagcccgtttcacccagcgtcggtcatttcagctagtttaggggctccaacaagcccaggctcagggtgagcctgggtccaccagcgcgcggacgcgcgcaaagcgacgaggttgaagtcatggctgaatcagtacacctgtacctgaaggcgaacggcagcgacatcaagggcgacagcacgcagaccagcctgggccgcgcggactccatcgagtgcgtcgcgtacagccagaaggtcttcaccgctcgcgaggccggttcgggtctggcgacgggccgccgccagtacgagggcatcgaaatcaccaagcgcatcgacaagtcgtcgccgctgctgatgaaggccctctgcgagaaccaggtcatcgacgcgaccttcaagttcttccgtccgaacccgacgggcgacggcaccaccgagcagttctacacggtgtccatcaagaaggcccgcatcaacgccatccaacagacggtgccgaactccttcgtgccggcgagcaccaacctgcccccgatggagaccctccagctggtgttccacaccatcaactggaccatcacccagggcggcgttacgcacgaggacacctgggacacccagcgttgatgtcagtccctccaccggccgtccgtgcaagtgggctccgcgggcggccgggggttggggtactccgttgttgaaggaaatccatgggctcccgaggcttgttgtcgcgcatcgctgaaggcaacggcacgctcgccccgcctggcgacgtcgttgaatccatcgccgagcacctgcgcaacctcctcaacacgcgcaagggagagtccgtggcctcacccggctacggcatcctggacctgaacgacatcgtccactcctacccgtcggcgataccgcggatgacgcagtccatccggcaggccatccaggagttcgaaccgcgcctgaagagcgtggtggtgcactacaacgcggacccggtggacccgacggcgctgcgcttcgacatcaccgcccagttggccacgcgggatcgacgaggcatggtgcgtttccatacccaggtgcacccgggcggacgcgtggacctgtggtgagccgggtgaatccaggggtgcgtggcggagggcgaggatgttcagcaagtattacctgagcgagctgtcgtacctgcgggagatgggacgggccttcgggctggccaacccctctgtcgcgggcctgttggtggagcgcggcgcggacccggacgtggagcggctgctggagggcttcgcgttcctcgcggcccgcatccgcgagcgcgtggacgacgacgtgccggagctggtgcacgggctcaccgagctgctgctaccgcactacctgcgcccgctgccggcctccaccatcgtcgagttcaccccgcacctgcgcgcgctgcgcggccgctcgcggctggccgccggggcggaggtggcgtcgcagccgattgacggcaccagttgcgtcttccgcaccaccacggacgtggacctgctgccggtgcagctcaccgacgcactcctggaccggtcgtccatcaccgcgccggtgctgcgcctctatttccagacgacggagcagggccgcgcggaggtgttgcgcgagcaaggcctgcgcctgttcatccacgccgacctgtccgctgcgtcggtggtgctgctgtggttgctccgctactgccgccaggtgcgcgtgcgcggcgcgtctggccagggagacggcatcaagctgccggtgaatgccatccaaccggtgggcttccaccgggacttcaagctgctgccctggccgcgcgccagcgagggctaccggcacctccaggagtacctgacgctgccggagaagttcctgttcttcgaggtgcgcgggctggacgccgccgccgggctgaaagaggaccgcttcgagattgccttccacctggagcggccgccgcccctggatgcgcgcatccaccgggagatgttccggctacattgcgcccccgtggtgaacctcttcagcgtgccggcggaccccatcctccaccgcacgctggaccgggagcacctgctgcgcgcgtccgacctgccccccaaccacgcggagatttactcggtggactcggtgacgggcctgaaggccggacgcaacgagcggcgcgtctaccggcccttctacgagttcacccacaccgcgggcggggacgccgagcagtccttctatcggctgcgccgggcgccttcgccgctggacgaaggaatcgacacgtacattacgctggagacgccgcggaacatcgcgccggaggtcaacgccgaggaagcgctgtccatggacctgacgtgcaccaaccgctcgctgccctcgcggctgcaggtgggtgacttgacggcatccacctccgccagccccacgcaggcgaagttcaagaacatctccccggtgagccggcccgcgcgcgcgccgctgggcaccgaactgcactggcggctcctgtcgcacctggccatcaaccagcactcgctggcggacgcggccgcactgcggcggctgatggacctgtacaacttccattcgctcaccgacaacctggcggcgcgcgccagccgcctgcgcatcaacgccatccgcgcggtggagacgaagccggtgacgcgcttcctggagggcgcgccgctgcggggtcaccgcacccgcgtggacctggacgaagagaacttcatgggcgtgggcgattcgttcctcttcggctccgtgctggaggaactgctcgcctcccacgtcaccatcaactccttcaacgagctgagcatccggcttcacccctcgcagacggagttcgcgtggcttccgaggaacggctcccagacgcttttgtagagacggcccagaagctggccgagctggcgccccgggtgggcttctttcccctggtggcgttcttggagcggctgacgtcgcaggccacgcgcgtgggcggcgcggggcccgtcaacgaggagatgattcgcttccggcacgacccgtccctggggttcccctcgggcgacgtgtcgtccgtgacgctccaccaggtgccggtgcgggcggaggacccgtattcgaagcggccgctcttcgaggtggtgacacgctttctgggcctgacnggcgcggtgagtcccctgccccactacctg

SEQ ID NO: 681 - DNA, 4491 bp, Myxococcus xanthus
gcgcagcgcgccacgcggctcgggcggctgaacctgctgctgccgggcagcagagtgccggcgcctcccggcatggagcaccccgcctccgccgtggaccgcacgacgtggcacggcgcggcccacctgttcggccttcaggatgtgtgcttcctctgccttccagacctgccggagctggtggcggatgcgcccgagccactccccatcccccgcctgccacccgcgggtgccacagggttcgtggaatgcgccacgcatggcgcggccaccgggtccgagtggaagacgccggagcgcgcggcgcctcgctgcggactcacagcctacctggactgggcggccttcctcgccgtagtggccgagctcctccgcgacaggcgcctgcgggagacgcacctggtcgcggcgctgccgctgccctcgacaagcctggtcttcgatacttccgcgggcaagcgcgccgcgacgcaggatttgggcgcgttcatccatgccagcggagtgctcaccccattccagagcgcgttcatccagctcgcctatccgtggctgaggaccgcgtcctcggagggacttccggagcggttggcggcccctgacggggcgctgacgggggtgctggcacgcaacgcactgcttcgcggcaccttccgaagcgccctgggactggggctcgcggaggtacgagaggtcttcccaatcccaacacgcctggaccaggaaccacgcgatccggggtcgccgctgcgcgcactgggcgagcgcgtcacgttgctggggcccacgccccgcggaatgcaggtgttgtccgacgtgacgtccagccagagggtcagccaccgccaggctccggtgagccggctcatctcctcggtgctgcgagcggcgaggcaactcggcgcggacctgacgttttcaccctccaacgaggacacctggttggcgctgcgctaccggatggagtccgtgctcggccggttcttcgcagagggcgctctgcgaggagcgacgccgcgcgaggctttctccgtgcggtgtgaccggacgaccatgacgcaggacgacctcgataacgggcggctcatcgcgctggtggaattggctcccgcggcggcaatcgaacgggtgcaggtccttctctccgcgttggagggtgacgtgtcactccagcaggaggaagccgcatgagcggagacctctggccactgcacaccttccgcttcgaactcaccttccagcccgagccgctgtcgggcagtggcccggaagaggcacccgtggacggggccttctccgagtgcacgggtctggaagccaccatggagccgaaggccattcgcgtgggcggccacaacctgggcgccgtgcagcgcgccgggccggtgagctttggcaccgtggtgctcaagcgaggcctctcgtcgggcgagcggctggctcgctggttcatgagggtgacggacggcgactacgggtaccggtgcaccgtgcgaatccgtctcaaggccccgtcggagaacggagggacccagacggtgctcacctacaagctggagcgcgccatgccggtgaagttcaaggcggccgacttcaacgcccgcgcgacggacgtcggtatcgaagagctgcacctcgtgcacgaaggactctccctcgaggactagcgcgccatgccagatacgactcccgagagcgcgagcttcatcaacgagagcaacggcgaggaggtgctggtgcacttcaacccgagctcgctccagtacaccgtcaccaacaagctccagaacgcccagggccaggagaaccagcagttcgtctcggagagcagcgcgaagctcaccctggagctggtcttcgacaccaccggcacgggcgccaacgtctgcgaccacacgatacgcattgcccagttcatgggcgccaagagccagattcctccggacgtcaccttccggtggggcgccttcgaattcaccggtctggtggacacctatcgggagaccatcgacttcttcgcatccgatggcatccccctgcgctcgaccgtctcggtgggcatgacgcggcagcaacgcgtcttctccaggggagccgaaggcgaaagttcgcggcagatggccgctgcgcgcaaccagcccatctcgcgcgccgtcgcggagcagaacagtgaagacaatccgcgcttccccagccaggacgtgatgaccgtcgacccgtccgtgccactggccccgcccacagcgtttgcaacaggcggagccctgagcgcgggcctggcgggtggaatcggagcgggtgccgggttcggtgttggaggtgggttcagcgcgggggcgggactcggcgttggcggtgggttcggggcgggagtgggaattggcgttggaggtgggttcagcgcaggggcggggctcggcgttggcggtggaatcggagcgagcggcgtgttcgccgctggtggtggattctcggccggcggtggcatctcagcgggtggcggattctcggccggcggggccttctcagcgggtgcgggcgtttccgcaggtggcgccttttcagccggtgcctcgttcggaggcagtgcctcattcagcgcaggggccatggcgggaggctctgcctcattcggcgtaagtgcgtccgcatcgagccccatcttctccgcgggagcgtccttctccgctggagccaacttccccgcgaccacgggggcatccgcctcgggctggagcgcgaatgcctggtctggcgcgcagtcctccgcgggcctctcggccacagcaggcgcgttcgcgggactgcgtgccagccctccacgcacctccgtccgactggagaccgtgcgctccaccgggcacgtcgacacctacacctacgaaaccaccggagacggcctcttcgagctcggaggacgcgcccgggtcaccaggcctcgcttcggcgcgaccctgcccccccggggccgcctccgcttcgagggagattgagccatgtccatcgtcttcgacgaggtccaggggtccgtcgtctcaggttccacgccagacgcgagccagcgcccggccgcggagccagcgctcacgccgcctcccgtggatccgacatcgattgcccgcgccatccggctcatcacgcaacgcaaggcccggctcctcgcagactgagtccgctccccgttctccatgactgacgccacgtcacagccagaacatcaccgccccacggtgcgcatcttcggcaaggccgacgcacgcgtcaccggtctggtcagcagcatgcgactagaggaagccgaaggcggcctgtgctcgctcgagctgcgcttcgaggcaatcgcacgctacgccgacaccgtggccgagcaggtcttcgaggacgagcaactgctcaggctcggggcacccatcggcatctacaccggtcccgagagcgcccctcaggagatttttcgcggcgtcatcaccggaatcgaagccgtgttctcgcacgactccgcgccggagttcgtcgtgctcgcagaggacgcactgcagaaagcaaggctcgcgcggcgcacgcacgtccacagcgacctcaagctggccgagctggcggagaagctcgcccgggacctgggcctgacgcccatcatcccaggccttcgcgagtccctgggcctccaggtccagtggaacgaaagcgacctggccttcgtgcggcgattgctggccacgcgggatgcggacttgcaggtgacgggtgacgagctccacgtctccgcacggagcgcggtgcgccggggcatcctggagctgaccctctactctgaactccgccgggtgcgcgtcacggcggacctggcgcatcaggccacccaggtcacttgcaccgggtggaacgccatccagggcgccagggtctccggccagagctccggctcgcgacccggcccgggcgcggggcgtaccggcgcggagctgctccagcagacgctgggccctcggaccgagcacctcggctcgctgcccgtgtccaccagcgacgaggccaccgccatcgccagggccgccttcgatgcgcgcgcccggcgcttcgtccgcatcgacgccactgcggagggcacccccgcgctccgcgtggggacccacgtgaggctccgcggcctgagcgctcgcttcgacaacacctactacgtggtccgtgccagccatcgctacgacaccctccacggctacgagacggacttcgaggccgagtgcgccttcctgggagagccatgaccgacaccgcacacgctcaggagcgccgcctgctgggcgccatgctcggcacctatctggcgaaggtcgtgtccgtggaggaccccgaacacctggcgcgcgtcaaggtccgcctgctcaccgcgcccgagggcctggccgatgcggacgtggccttgtgggcgcgggtcgccgtgccgttctccggcagtggctggggcgcgctcttcctcccggacaaagatga

SEQ ID NO: 682 - DNA, 6744 bp, Myxococcus xanthus
  unsure (1)..(6744): unsure at all n locations
tggctgggggccctgcaccgtgaaggtgtctaggttgtacagcggcgagatgatgcttttttttgccagcggtccctgccggtcgagccgctcgaagagagccgtgttctccaccatgaagcgggccgcgtcccgcagttggggagacaggctggcgtccgtggagatgcgctgcaggtccttcttcgacagcgagccgttcttcttgccatccaacaggtccaactgctggaagttcgcctccagcaccttcagggcgtccgagtagtcgagcatcttcggatccaacggactgctgcccggattcaggatgggcgacgaggacgcggagggcgcgtagccgctgtcggccttcgagctgcccgaggaggacgcgtggtactccgtcttcgcgggcgggttcttcgacaactcctgcgccacgcccatggcgccactggccgccagcatgacgttgcccgtcgcggcccccgccgcggccttgatggagttggtgatgagcggcggcaatcccagcgcgttgcccgcgaaatccaccgcggtggacatggggccagccagcaggttggccgcacctttgaggaagtcgagcatgaaccctctcgcgcgacggggttgaagtagacgccgcgcagtcgtccttcggacgggaccgctggattgcagcggcggtgccgtccgtgggcgtgggaggcacccagcgaattccggcggttagcactcaccgaggcaggggcacgtccccaggtgcggacggagcggtccacgacgaaggattgcggttaagttccgcggcatgcgcaccatgggcctggacctgggcaccaaaaccattggagtggccgtctcggacggactgggcctcacggcccaaggcatcaccaccgtccgccgcacgtcgctcaaggcggacctcgcggcgctggccaccgtcgcgagcgaacatgaggtgacccacgtcgtgctgggcctgccgctcaacatggacggcagcgagggcccgcgcgccnnnnnnnnnnnnnnnnnnnnnnnnnncctggcccagtcgctgggggtgacggtggagctatgggacgagcggctgtccaccgtggccgccacacggaccctgctcgaggcggacgtcagccgggcccgccgccgggaggtcatcgatcagggtggccgcgcagttcatcctccagggatggctggatgcccaccggccgccggataccgactatcaccccgacgactacgattcggagccctgagggactcgagggcccctccaggtcaccgcgctacggctgacgccggtacacgtgaagcggcgcggtgaagccatccagcttctggtaggccacgccgtccagtaccagcgagcgctcctccagcttcacgccctcggccttcgccagcgctccaccgtcgaagcggaccagcacctccggacgggcctcctgcatgcgctggcggaaggtgtcccagcgcacgcgcgccagccgctcctcggggaggccggagaagaaggccagttgcaggtccatgtagttcgggtcgacgtcgagcgcggcggccccacccttggcggcgacctccgccttcaggaacttcgccacctgcatcagcgccacgggattcgtggacgtggggctgatggggcgcatcgtggactgcagcggcccgtcggcgcggaacgtatagacgcccatcgccaccggcacggccacggcgaccagcaccgtcacgcccgccagggccttgcgcagcatgggccctccacgcgttgccaccagcccggcgaagccgaaggccacgaagacggggagcagcgcgacctgcgtcaccgtgaagcggcccagcggaacgaaggtcagcagcaccgccgcccggaaggtgaagtaggcagcgggaagcaccgccgcggccaccagccagcgcgtgtccggacgcgagcgccacgcgcgaaccatgcccgccatgcccagcagcgcgacgagaggcgacagcgtgagcaaggcgatgccgggccagaaccccagttgctgcaaccgccagagcacgttcgaccccgagcccagggacgacttcacccagttacggtggaagtcctccaccgccaccaccgggaagaacgggttaccgtgcatcagctcatttccctgcatccacaacagggggaacggcaggcacaccaggccgaagcccacggcccgggtcagcgacaccaccttgtcctggctgctgaagcacagcgccaccgtgagcagcgggatgtacatccacgcgtcgtagcgaagcgcgcacgccaggttgagcatcaacgccgcctggaacaggggcaggaagcggttgtcatccacgccttccgcgtacagcgcgaaggtggccagcatgaagaagagggacaccgcctcgctgctggccgtggtggagaactgcatgtgcatgccccacgccgcgaaggacaggcccgccaccacgcccgcgcgccagccgaagagccggcgcgtcagcgcgaacagcggcaccaccgacaacacgccgaacagcaggctcaccacacggcccgcgacctcccggtcgaacaccgacagcgccgcgcccaccaggtacatgtgcaacggaccgaactggtaggccccgtccccataggcggtgatgatgtgcggcgcccgcaaccagcgctccgccagctccgtgcgcaccaccgcgtcaccgaagaggttctcgttgacgaagaacacgcccagccgcggcaccagcgccgccaccagcaacagcccgacgagcagccgggtgcctggctcgtgctgaggggcaggcaccgccgacaggccaggtgcatggggaggcgaaacggagaagggggcgggggcggtggccatgacgcgcggcaggatacgcaggcacggcccaaagccaagccaacgcccattgttcccttgctcggggagcgcggccgatttcacggtgcgcgaacctgctccccttccgatatccagggggctgcaatcatttcagggtgcgccggggccaaggggctgccggactccagcgtcacccgcgtgcggcggaccacctccagccgccgggcgccctgcgtccccagttcggcgcgcgacgtgtaaaggacctccagccgctcgggaaatgggcggcgcaggtcgaagcgcagctcgccctcggccctgggagccagcggaccttccgctccctgggactggaggaggaaacgcacccggccgcgggccccttccagctccaccaactcataggtgacgacggccagcccttcctcctgggctcgcgccacgacccagcgcgctcccgcgcccaccggctcttccggaagccgtggggtgacgagccagtccgaggacagcgccgcccgcaccaggctgctcaatgccgcggaagccccgggccccagttgcacccatgcctgaaccggcacccctcggtcggagagcaccacggcgccatcccggccactcaccgcgcccagttcctccgccaaccgccacgctggctccatcccctcatcatccacggcgcggacctcgggacgccccacccgcacgcgataacgagcctgtcccctccccgcccccgcctgccattccacgtagagcggcaccgcgacctcggggccatactccgttcgcagctcgcggccggcccccacgcccagcaccgtctcaacctcgggtgagaccgacaccaccatgccctggccccaccctcgccgctgctccagccgcagcgcgcggcgaggtgagcgccctgcatcgagcagtgccgtcgccaccacgtctccctccgcatgagggactgttgcctggccccatgcgccaagaagacaggttgcgacgagcaggaggacgggcaccaggaggctccaaggaaggacaggcgccatgccccactgcatacgccatgctcagaggtcttcctctcgtgcacgcccccgagccgtccagaatgagagacccttcgagtgaagcatgggctgcgccgcgccagacgcggatgcgccgtgtcgcgtttcattcacagcaaagcgcgcctgcgacgagccactttccgcaggccttgatgtctcatgcgatgagcttgaatgcgggggacaagccgcctgcccgccagccttgaggtcccatccggcctctagcggcaccttttcgagccacaggtcgccttcctacacgccctgatgtctcacccggcatgcctggtggcgacgagcgcctggaccacgggcccattcccgcatgcccgatacctggcatggcatgcgccgatgtccgtcgcgcctcgccgtgacgtgagcggcgaatcatccccttgtcacctcgcgggacgcgcgtccggcgcacaacactcactcggtacccgacgcccatcccgcacaaccgctcgcctgctttcatgcatgcgacgccagcctcgtccgtgaaggctccgcgccgacatgtggagtgaaagggcacgctgccccacaacccacacgagcattgctgctgccgggcgccggggaaatgaccgttcaggcgttcactacccttcgtgcagccggtgtgcgcctacccccgtgggcgagggcccttataatcaagatgccttttcaccccgtggagggggtgcgccttcgggtgttccacccctgacacgagcgtaacgcgcggtcccactccgcggcggggtcccgaaggggcagcagggctgtcgtgcctgggacctcgtcggggtgggtgtggaatggcagtcatgccctccaggttgaccattttggcccccctgtcggcgcggctttccgcgtccccgggtggctccgagggagagacatgaaggacgctgagaagggttcgtgggtctccagaatcgccgcgctgcaggacgtgaagacctacgcggagctcaactgggaaggctcgttcgaggagtacctcgaaatcgtccggcagaaccccaaggtcacccgcaccgccttccagaggatctacgacatgatcctcagccacggaaagacggagtacatcgacaacaagaagaagctcatccgctaccacttcttcagtgacgagaagttcggcggccgtgacgccatcttcgggctcgatgtcccgctcatgaagctggtcaacgtcttcaagtccgccgcccagggctacggcaccgagaagcgcgtcatcctcctccacggccccgtgggctcgtccaagtccaccatcgcgcgcctgctgaagaagggcaccgaggactactccaagacgccggagggcgccgcgtacaccttctcctggctcaccgacaagaagggctcggacggcgccccggtgaaggagaagatgaagtgcccgatgaacgaggagccgctcaacctcatcccccgggagtggcgttccaagatctacgccgagctgtctgcgcccgagtccggctacaccattccggatggctccgagctgtgccccgcctgccgcttcgtcttcaaggacctgatgacgcagtaccagggcgacttcgccaaggtcatgagccacatccgcgtcaaccggctcgtcttcagcgagaaggaccgcgtgggcatcggcaccttccagcccaaggacgagaagaaccaggactccactgagctcaccggtgacatcaactaccggaagatcgccgagtacggctccgactccgacccgcgcgccttcaacttcgacggcgaattcaacatcgccaaccgcggcatcatcgagttcgtcgaggtgcttaagctggacgtcgcgttcctctacgacctgctcggcgcgtcgcaggagcacaaaatcaagccgaagaagttcccgcagacggacatcgacgaggtcatcctcggccacaccaacgagcccgagtacaagaagctcgagaacaacgagttcatggaggccctgagagatcgcacggtgaagattgacgtcccgtacatcaccaagctgtccgaagaggtgaagatctacgagaaggacttcaactcccgtgccatcaagggcaagcacatcgctccgcacacgctggagatggccgccatgtgggccgtgctcacgcgcctggaggagcccaagaagcacaacctgtcgctgctccagaagctcaagctctacaacggcaaaacgctcccgaacttcaccgaggacaacatcaaggagctgcgcaaggagagcaaccgcgagggcctggaaggcatctccccgcgctacatccaggacaagatctccaacgccctggtgagcgacaagggcgagggctgcatcaaccccttcatggtcctcaacgagctggaggccggcctcaagacgcactccctcatcaacaacgaggacacgcgcaaggggatgaaggagctgctcacgtccgtgaagcaggagtacgaggacatcgtcaagaacgaggtccagcgcgccatctccgcagacgaggacgccatcgccaagctgtgcggcaactacatcgacaacatcaaggcctacacccagaaggagaaggtcaagaacaagtacaccggcctctacgaggagcccgatgagcggctgatgcggtccatcgaggagaagatcgacatccccgatacccgcaaggacgacttccgccgcgaaatcatgaactacatcggcgcgctcgcggtggaggggaagaccttcaactaccggaccaacgagcggctccacaagtcgctggagctgaagctgttcgaggaccagaaggacagcatcaagctcaagaacctgg

SEQ ID NO: 683 - DNA, 3684 bp, Myxococcus xanthus
aggcggacaagaagggcctgcgctacctctacctggacggtcgcaccaaggaccgcatgggcaaggtggacgagtacaacaacccggacggtccgccgctcttcttcatctccctcaaggcgggcggcaccggcttgaacctcaccgcggccgactacgtcatccacttcgacccgtggtggaaccccgccgtggaggaccaggccacggaccgtacgcaccgcatcgggcagacgcgcgccgtcatcagctacaagctcatcacccgcggcaccgtggaggagaagatcctcgccctccagcgccgcaagcgggagctggccgctggcgtgctcggtggggacggcgacgagatgggccggacgctcacggagcaggacatccaggagctcttcacggaaatctgaggacttgcaaggttggggccccaacgaggccccttcccctcccgcccgccatccgtgcgctcaacccgaacgcctgtgcagtgtcagtcggacctgctagggtgttcaggtaccagagccgtcgtacggacattggagggcgcgcgtgctgctgggtctgcggatttcgaacgtggcggtgatcgaggaggtggaggtggcgttcggagccggcctcaccgtcctcacgggtgagacaggtgcgggcaagtccatcctcgtggatgcactgggccttttgctcggggggcgcgccgacgcggatgtcattcgcgccggttgtgaggaggcgtccgtggagggcgtcttcgcgcggactcccgcgttggagacccggctggaggagctgggcttgccggacctgggggaagaggtgctggtgcgccgggtgctgggacgcaccgggcgcggcaaggcctacgtcaacggctcgctggtgacagtgggcgtgctgggcaagctcacgcgtggggcggtggacatcgccggccagcacgagcacgtcagcctctttgattcggggctgcaccgggtgctgctcgaccggtacggcaacctggaggatgtgctcgcggccttcttccgggagtacaccggcctgcgcgagatggacgcgcgcatggaggcgctgggcggagacgaggcgaaggtgcgcgagcgcgccgagttccttcgcttccagctcgatgaaatcacgcgcctggacccggaggccgacgaggacgcgcggctggacgcggagcgcaagcggctgggcggcgcggagaagctcaagcgccacgcctcggaagcggagctgctggtgtccggcgaggagcagtccgctgtggagacggtgggccgcgcgctggggctggtgcacgaatcggtgaagtgtgacgccacgctggcgccggtggcgcaggcgctgagcaccgcgctgtcggagctggaggaggcgcagcggcggctcaaccggtacgtggaggggctggagtcggacccttcgcggctggcggacgtggaggagcggctggacgcgctcaagcgtctgtgccgtaagcacggcacgcacctggagggcctgctgaagaagcggggcgaaatcgaggtggagctgggcacgctggagaaccggaaggaaatcctggaagagctggccgccgaccgccgcaaggtggaggagcgggcccggaaggccgctgcggcactgacacgggcgcgtgcggccagtgcggtgacgttcgccgcgcaggtgcgcgagggcctggggcaactggccatgggcaaggcggccttcgaggtgcgggtgacaccatcggattcgctgcgcccggacggcatggatgacgtggagttcttcttcagcgcgaaccctggcgagccgccgcgagcgctggcgaaggtggcttctggcggtgaggcgagccggctgctgctggcactcaagaaggccctggctgacagtgacgggggcgggtgctacatcctggacgaagcggacgcgggcgtcagcggcgccatcgcggacgtggtggggcggatgatcaaggacgtgagcagccaccgtcaggtgctctgcatcacccacctgccgcaggtggccgcctatgcggatgcccacctgctcatccgcaagggcctcaagggcgagcgcactgtctcggaggtggtggtactggatgcaggggcagaacggacccgggagctggcgcggatgatgtcgggcgtcgaggtgacgcgtgaggccctgggagcagcggaggccctggtgcgttctgccaacagggcgctggggactcgggcccgcagggagtctggaccggagggggccccccggggtcggctccgacgcaccgcgtgaagtgcgccagattgcatccgtgtccttgccccgtccttgggcctcacatagcatcccgggtgtgtccagcaccgcagggcagaccgcggcctcccgcttgaagataatttccgccggcctgacggatgtcgggcgcaaacgtaatcacaacgaggacagcttcctcattgatgatgagctccagctctacgtcgtggccgacggaatgggcggccatgcgggtggcggcactgcgtcccgcatcgcggtggagaccatcgacaaagagatgcgccgggcgcgggaaggcaaggacaaccccttcctttccgtcccgaatctccaggactctccgattccggaggcgctgcgcaccgccgtggagcgggcctgtctggccatcttcacggccgcgcaggaagatgcgcggctgtccggcatgggcaccaccgtcatctccctggtggtgcgcgacgagcacgccttcttcgcccatgtgggtgacagccgcgcatacctcatccgcggtgacctcatccagcagatctccgaggaccactcgctggtcaacgagcagatcaaagcggggatgattaccccggaagaggcgaagcactcccgctacaagaacatcatcacccgctccgtcggcttcgaggaggaggtgcaggtggacgtcatggggctggtgtcagagcccggcgacgtctttctcctctgttcggacggcctcgcgaacatgatggaggaccgggagatccacgaaaccgtggtgaaggcgcggaccttcgaagaggtccccaagcgtctcatcgacttcgcgaacgaacgtggtggtgacgataacatcaccgtcatcgtcgtgcgagtggaagcctgacacacccagagtctgcacgtggcctgcagacctccctgcgggtctgttgaccttgacactcttcgaatgtgagtggtagctgccccaacgtttccagccgagtcgaaatgccggtgggcgacgaagcgggaggggtaggcggcggggggaggtgttgcgcgagagcaagcgacttagcttgctgcgccagtagtcccacgcaagcaggggagctgtcccgtggcgaaaaagtccttcacactgatggtgattccggaccatgacgctccggtcaagcggtacaccatccagcggtcctttctcactcaggtggggatgggactgatgctcgtggtgggactgggcgtgggtgcgagcgtgcactacttccaggtggccgcggacgcctccgagaaccgcatccttcgcgaagagaacctgacgctgcgctcgcagctcaagtcggtgcgtgagcgcatcgagcacatcggctccacgttggaccgggtggagcgcttcgaccagaagctgcgcgcggtgacgctgctgtccgatcc

SEQ ID NO: 684 - DNA, 4324 bp, Myxococcus xanthus
gtcccccggctacaacatgctgcggcgggtagcgctggggctggaaggcgccctggaccggctgctcgcgcggcgcgggctggcgctggcgtccgtgtacacctcgggtggcccggacgacttgaagcgaatctgcgagcagttggtggacatggacgaggccttccagggctggctccatgcgcacttccagctggtgcgccgcaccattggcgtggaccgcaccgtgaaagcgctggacggcctgcccacgcaggtgctcgcggggcggatgatgctgccgctgttccgccagctctgggacgtgcggctggagctgacgtccgggtggcagcgcgagggcggcatcgccccgggtgccaaccgggcccctccaggcggcggctgccccatggcgcacgcggccagaatgcaggtggaacagccatgaagggggaggccacggccctggcttccacccctcgcgcactgcttcacctgctgtacaacggcgcccgcgccgtggacgtcctggaggcctccctggacctggggctgctggacgccctggagccgggccccgtcaccctgggagagctggcgacgcggcaccggctggtgcccgtgcggctctacaagctgctcgactgtctggagagcctggggctggtgcggcgcgagcagcccaccgacgcgctggagtccgcgcgctaccaggccgtcccgggcctgcgcgccgctgcgcaggccgtgctgggcccgcagtccctggagaaggaccgggagcgctacgcctggcacgagttgcacgggcagcttccgcaggtgctgcgcggtgagcgctccatgccccccgccgccttcgactggcctccgcgcaccgccgagcaggtggcgggtttcgaggccagcatggccgcgggcctgccccccatcctggagacgttccgcgcccaccgcggccggctctgggagcgcggcggccgcgtgctcgatgtgggcgggggtgacggcacgctggccgcccatctggcgagcgaacacccgggccttcacgtggacgtgttcaacctgcccgccaccgagccactggtggcgcgcacccgcgagcgctttggactctcccccgagcgcctgggcttccagggcggagacttcctccgggaaccgctgcccggcggctacgacacgctctgcttcgtgcgggtgctgcatgactggcccgcggacacggcgcgcgcgctgctcgtggccgcgcgcgacgcgctcccacccggtggccgcgtcctcatctgcgaggagttccgcaccccggagcgcctggcggcccagttcttctggtcctacttcctcatgggcgtggacacctgcgtgagccgactgcgcgaggtggagcactacctgcgcgtcctggacgagacgggtttcaaggacgccgaagtcctgcccggccccttcgaactcatcctggcccaccggtaaaaacgataggacctcacaggtgggtcacctgattgtccgccaagtgtcaccggccccaccgcaccgcgccagggaagcgctggtagaatgagagcaccccgtgtccggtgaaaccctggcacggtttctgcaatcttccagtccgtagcgcgtgtagcacggcagcgacgcagtccgacaaagaggagggactccgcatgaagaagcagggttcacgcaggtcggatgaaggctcggagaaggcggtccgcgggctggtgacacagccgcaaggcacgggaggctggacgccgcccgccgcggacggagaggtccgcatccccgtggaggaaggggtggagctgaggggtctgctccaagtccctccgggcgccaccggcgtggtggtgatggtccggggccacggcagcagccgccgcggcgccacggaccaggaagtcgcccggctgctccagcacgaggggctggccaccctggcggtggacctgctgacggcggcggaagaggaggcctgccgcgagcgggacctgcgcttcaacctgggcctcttcggcggacgcctggcgggcgtggcgcgctggctgcggcgcgcgcctcgcaccagcgccctgcgcatcggctacttcggggcgtacacgggcgcggccgcggccctggccgccgcggcgatgcggccggaggcggtggacgcggtggtgtgccggggcggacgcctggcgcagccgggggcggcgctggcccgggtgcgcgcgcccaccctgctcatcgtcggcgcggaggacacgtccgcgcaggagccccaccgccgcacctacgccgcgctgacgacggagaagcgcctggaggtcatccccggcgccacgcaccgcttcgaggagcccggcacgctgacgcagatggtggacctggcgtgcatctggttcctccagcacctgggcgcgccgcgctgggattccctgcccgcgccgcgcgccgccgggagctgacgcaccggctttccacacggtgggccagggcagccagcagagctgccctggcccccagcggacgccctggcgtgggggggagaaggcgcgagcgcgcctgacgcccaggcacctcgacggtgccaccagtcgtggcgcgctcccagtggccagcggtctgacgcgcaagccctccgggctcagaggcttgccgggcgctgcacacccaactggcacccgaggaccgccaactgcgtgcggttctccgagcccaccttcttgtagatggcggtgatgtgcgccttcaccgtgcgctcggtgatgcccaggcatgcggcgatccgcaggttgtccgcgcccgcggcgatgtagcccagcacctcgcgctcacgaggcgtcagccggcccagctcgccccgcggcgacgcctccggccggggccacgccaaccccgcgggcagcaaccgcttgccacgcaccacccgctccaccgcctccaccacctccgcgcagcccacgttctgtttccacaggtagccggccgcgcccgcctggaggcattgctccaccacctccgcctcgcggtggcccgacagcaccagcggcttcaccgccgggaagaagtcatgcagacactggagcgccgacatcccgctggtggacgcctcccaccccggcagctccaggcgcaggtccaccagcgcgacatggggcagcgtctcgcgcacacgcgcgaagaacggcgcgggctccccgaagtccgccaccacgtccatgcccgcgccttccagcacagccaccagggcctcccggaagacctgctggtcctccaggatggccacccggatgcgttccgattccatggcccttccaccctcccctgtccgtcccctgcgattcaaccccgctaaggggattccctcatgtggggggcgacagggaatgacgtctggaggatacttaccccgtcaggaagcacccgcagtgccatccgcacgctgaagggggaagccatgccggagaccaagattcgcgtcctcatcgtggacgatgaccaggaccagctctccctcgtggagcgcaccctctccgccttcggcttcgacgtccgcacccaccgctcctccctgggcgtgtccaacctggtgcgcaccacccagccggacctggtgctgctggacgtgaacatccccgcgctcagcggagacaaggtgctcacgctcgcgcgcggtcaggcccccaagggcacgaagttcatcctctactccgcgtcggacgaatcccagttgcgcgccctggcgcgcgcctcgggcgcggacggctacatctgcaagagcgtgcagggcgaggagctggcccagcggctggaagcgctccacctcaagcccgcggcttcggaagccgtgcaggccgcgcgttagcgcggcgccggcctcacgcgggcaggtccgtcacttccaggaagaccgcgcggaagtccccccgcgcgccgatgagcctcaggttctgcgccagcccaccggtggagcggaagaacatcatcgcctccggtggcggcctgattttcaggaagcgcggcgcgttgcgcgagaagtggtggcgcatgtcgcggttgatttcgcagaccgcgtagtcgtagtccggcaggcgcatgggccgcccggcgatgcgcagcacctcggtgatgaggtcctcggcctcgtcgtccggaagctccacggtgaagcccacctcccggctcaggctcaggatgtccaacggctccatgcgcatcgtctgccggagcatgcgctggttgacgtccacgaagcgcggggagaagcgcttgatggagccgaagtccatcaagcccagccgcccgtccggcatcgccatgaagttgtccaggtgcgggtccg

SEQ ID NO: 685 - DNA, 4289 bp, Myxococcus xanthus
  unsure (1)..(4289): unsure at all n locations
ctggcccgagcggcccgcaacatcgccctggcgcacgcgccgcagaagccgcaatgggtggaggtcgaaaccgagcccggtgtgctcgtgggccggcggccggatccgctgggccgcgtgggggtgtatgcaccgggaggccgcgcggtgtaccccagcagcgtactgatgggggtggtgcccgcgaaggtagcgggcgtgggcgaggtcatcgtgtgctcgccgccggggcccgatggattgccacaccccagcgtgctggcggcggcatctctggcgggcgcggaccgagtcttctcgctgggcggcgctggcgcggtggcggccatggcccatggcacggaaagcgtgccgcgcgtggaccgcatcgtggggccgggcaatgcctatgtggccgaggccaagctgcaggtggtgggcgcggtggcgattgaagcacccgcgggccccagtgaaatcctggtcgtggccgacgacacggcgaaccctgccgcggtggcgcgggagatgctggctcaggcggagcatgacccagaggcggcttgtgtcacgctggcgctgggggacgcgctggcggacgccatcgccgcggaggtggagcggcaggccgagcgcgcgaagcggtgggagatcgtcacgtcggccctgggctctcgcggcgcggtgctgacggtggcgtccctggaggaagcctggcccttcgtggcggactttgctccggagcatctgctcatcgccaccgcgtcgccgcgggaggacctggggcaggtgcgcaacgcgggcaccgtcttcctgggtgagcgctcgtcggtggcctacggcgattacatgaccggctccaaccacgtgttgcccacggcggggttggcgcgggcgtactcgggactcaacctgctcgacttctaccggtggaccacctaccagcgcgtcgcgcccacggcggcggcgtctcttgcggaggacgtggggcggctggccgacagtgaaggtctcttcgcgcacgcggacgccgcgcgcgcctgggggcggccatgattcccaggcgggcttcgtatcgggacattccgctgtacgcgccttcgacgcggccgtgccgggtggacctgagtgacaacaccaacctctttggcgttccgccctccgtggagcgggttcttgccaccaccgtgtcccgcgtaccgcgttatccgcggggttatgccccggacctgcgccgggcgctggctgcgtccattggagcggcgcccgacgagataacgacgggctgtggctcggatgatgtcatcgactcggcgctgcgcgccttcttggagcccggggacacgctggcctatcaggacccgaccttcgtcatggtgccgttgttcgccaaggtgaacggactcgagggcgtgccggtgccgttgaagccggacttcgatgtggatgcggacgcactgctcggcacgggggcgaaggtcatcttcctgtgctcgcccaacaaccccacaggcaccgcgctgtcgcgggcggcggtggagcgtgttgtcgaggacgcacctggcatcgtcatcatcgatgaggcctatgcggacttcgcgccggggaaggacttcctcgacctggcgcgacggcggtcgaatgtcctggtgacgcgcaccttctccaaggccttcgggctggcggggctgagagtcgggtggggcgtcggagcgcccgaactggtggcggagctcgagaaggctcgcggaccctacaagctcaccagtgtcgcggaggccgtggccgtctcggtgctgaagggtgacgcggactgggtgcgagcccgtgcggaggaagccgtcgcctgtcgcgagcggctgcgcggcgagttggtgtcgttgggtctgacgcctctgccatcggaagccaacttcctgatggtgccgctgccgggcgcgttggcggtcgcggagcggatgcgagagcgggacgtgaatgtgcgggcgttccaggcgctgacgggcgtgggcgacgcgctccgaatcggtgtggggccctggcccttgatggaggcggcgctggcggcgctgcgggaggcgctgcgatgagagtcaccttgttcgactacggcgcgggaaacctccactcgctggccaaggcgctggccacggtgccgggcgctgaggtgcgcgtccaggaggaccccttgcgtgcgctggacaccgacgtgctggtgctgccgggggtgggcgcattcggtgcggcggtggcgcggctcgagccggggcgcgaagccatgcgcgcggcactggagcagggcctgccgtgcctgggcatctgcctgggcatgcagttgctcttcgaaggcagtgacgaaggcgagggcgccggcctcggttacttcgcgggccgggtgaaacggctggcggcgaagcgagtgcccgagattggctggaaccaggttgaggacgaacgcacgctggcgggtgcgcggctggacaccgtgtactacgcgcacagcttcgtctgccgcgccgcggatgcttcggtggtgacggggtggacgacgcacgaggcggaccgcttcccgtcgncggtgcgcaggggaagggtggtgggtgtgcagttccacccggagaagtcctccacggcgggcgtgcgcttcgtgcaggccttcctgcgggaggtggcgccgtgattgcgattccagccatcgatctgcgcgagggcgcgtgtgtccaactcgtgggcggctcgtacgcggcggagaaggtccgggtggaggaaccgctggaggcattgaagcagtggcgccgtcacggcttccgcgcgttccatgtcgtggacctggacgcggcgctgggcaagggctccaacgcggacgccatcttccaactgaccgcctacgagcgagggctcaccttctccgtgggcggcggcgtgcgcgattccgaccgggtggagaccgtcctgtcaggcggagccgagttcgtggtggtgggaactcgcgccatcgaagacgccggctggctggcggacatcgccaaccgcttccccggccgggtggtggtggccgcggacgtgaaggggcgagaggtggtgacgcgaggctggacggcgggaagccatcgggacatccgggaggtgctggcggccttcgagcccttgccgctggggggcctgctcgtgacggcggtccacaaggagggccagttgtcgggagtggacctgccgttgatgcgggaggtggcgagcaccagccggcaccgtctgtacgcgtcgggtggcgtgacgacgatggaggacctgcgggccctcgcggcggcgggcgcatacggggccgtcattggcatggcgctgtacaccggaaggctggatgcgagcgcagtcgctcgggagttcgcgggatgaccactgtcattcgggagacgaaggagacgcaggtccgggtggagctggcgccgggcaagggcgtcacgaacgtggacacggggttgaagttcttcgaccacatgctggccaccttcgcgcgctacgcggggctggacctctcgctgcatgcgcggggggacctcacgcaccatgtgatggaggacgtggccatcacgctgggcacggcggtgcagcaggtgattccagccacggccgcgcgtttcgccgagcgcaccattcccatggacgacgcgctggtgcaggcctgtctggatgcaggggggcgcttttattaccagggcccgttgaagaaccggctctacgagcactggatgcgctcgttcagcgagcacgcccgggtgacgttgcacctgcgggtgctgcgcggaaaggacagccaccacgcgacagaggcgtccttcaaggcgctggggctggcgctgcgggatgccatggtggactccggctcggtgttcagcatgaagggctccgtgtccctggaggtgaagtgatgctcacgcggcggctcgtcgtctgtctggacgtgaagggcggacgcgtggtgaagggcgtccagttcgagggacttcgcgacgtgggtgacccggtggaattggcccggcgctacgaagcggagggggcggatgagctgacgttcctcgacatctccgccagcgccgaggagcgggacaccttgtgggagctggtgcggcgcaccgccgagcagctcttcattcccctggctgtcggcggcggggtgcgcacggtcgatgacgtgggccgggcgctgcgtgcgggcgcggacaaggtgagcatcaactccgcggcggtggccaacccggcgctgctcaccgcgtgcgcggagcgcttcggtgcgcagtgcgtggtggccagcc

SEQ ID NO: 686 - DNA, 3638 bp, Myxococcus xanthus
ctctaaagtctggggccgactgccggggcgggcccttcggacgtgaacggacaggacgacgcgtgcaagaacttctcaccaacctcatcggcaactctcagggcgtcttcgcctatgccacggtgttcggcatcctggtggcctgcggactgggtgtccctctgccggaagacatctccctcatcgtcgggggcttcctggcccacaagggggccgccaacctatcggtcatgatggtggtcggcttcgcgggcatcatcgttggcgacagcctcatctacctcgccggccgccggctgggtgggcggctggggcgtgaaggcggcggtggcttcttcgcccgcatcgtcacacccgagaaacgcgcgaaggtggaaggcctcttcgtcaagcacggccagaagatcgtctgcatcgcccgcttcatgccgggcgtgcgcgccgtgacgtacttcaccgcgggctccgtgggcatgtcctactggcgcttcatcttctgggacggcctggccgcgctgctgtccgcgcccgtgttcatctggctcggcttccacttcggtggcgagctggacacgatgatctccaagttcaaggaagggcagttcgccgtgatgggcgtgctggccgtggccgccatcggctacttcgtgtggcgccgccggcaggccgcgcagcgcgcccaggccgccgccatcgtggagcccgtggcggttcccgcgctggtccacgagtccgtggccgcgccgctgcgtccccaggtgtccagcacgggcgacgccctgttcgtcgcggcgccggagcaggccgccgccgacagctcacacgagctgcagaagtcgtaggcctttgaacccagggcgccggggacgacagcttccccggtgccttccgtggttgccgggcttccgggatcagggtcaggattgagggatagcctcaacgtcgaccttcatctgagcccgcgaatgcccaaaatccttcttcgtgcctgtgccgtggtcctgctcgcagccaccagcaccgcgcaggcgcaagccgtcccaccggccccctccgaggccgaggactcctccacgcccgccaaccccgtgccggtggacgccccacctgatgcgcaagcggcgccacccgaagccgaaccgggcgaggtgccggccagcgctgtcactgaagacgttccagcggtgagccccgaggtgccgcccgttccgccgaatggtggcgccttcgcgaaggacaacgcgctcgtccccgagggaacgccgttcctgccgctgcacatcgaagaccccgcacgggcccgtgccctggccgaggagacggagcgcagcgcgccggccctggtcgtcagcggcggcatcagcctgggcgcgtatcaggcggggttcctctccacgctggtccggttctggagcgtcgcgcagcgagaaggcgcacaggcagacctgggcaacccggcgccgcgagtgtggacgggcgcctcggcgggggcggtgaacgcgctgctcgggggactggcctcgtgtgacacggcgttcgcccagcccacgtggtcttcagagcagagcctcttctggaccgtgtggatcgaccagctcgacctggggcggttgctcccgctaagagcggaatgagccaccttaggggacgcacctcttcagcgagccccacatgcaggacaccctgcagctcatcctgaaaaaggcccacacgacccacttcaaggaggactggaccttcgcctacggcatcaccgtgacgaacctgcgcgggcgcgaagttcccttcggcgagggcggacccgacgcccagttcaagctgaagcgcgtgacggagaagctggtcgtccaagtgatgacgcagggcgaagggaagctcaccgcccggctgccattcatggagggcgcggcgagcgcgtcgttcccccacatcggggtgaagccgaaggagctcgcatactacccggcgctgggcgcccaaccaacgggcgacggcggacacgaggtgtccctgtcgaacctgctgctcacgccgcaggcctccggggcctttccgctcgcgttcccgcctgtccccgtcgaggtctccttcttcaaccagacgcaatgggggcccctggagtccctcaagctcattgacggcggcgtgctcaacaacaaccccgtggacctggcggtgcggctcggctcgcggtgggtggagcgcagcacctcgcgagagacgacgctcaatcgcgagcgcttccccgtcgtctacctggaccaggacgcggtcgcctgggactgggcatcaccgcccgaacggccggatcgctcccgcagccccttggacgaagcctacttccagcacctgggcaacgtgctgaacgccgcgcgcgacagcgccgtgctcaacacgctggagcacgacatcaatctgtcgggccgcatccagattcctcgccgcacgtccgtgctcccgtcggagttccagttcgcgatgatgggcttcttcgaccggcgcttccgcgagcacgacttctaccgtggcatgcaggacgccatccgcttcctgtcgacccagctcacctcgacgcgcgccgtcgacctgctggtgcctcgcgccggcaaggagcgcctgagggatcgtgagctccgcgtgctgaacgtcctgggcatcgactcggccggcttccgctgcgtcgtgggcaatgactgcacgacgacgccgcagttggggcggctgcgtcaggccaccaatgccctgacgcagaaggcggaagcgggacagctccggaagggacaggtcgacgaccttctcaccgtgctgggcgacgtgggctaccagtacagcgaaggcgtcatggaggggattgaagccacggggacccgagaggacctcatcccggtccgccaacgcgtgggcaccgccttccacagcctcgtcacgcagcagcggggcaacctcaagattccgctccgtcccgcgggcgccgcgctcctggacgagtggctgacgtattcgaaaccgcaccatgtctggacgctcagcgccatgcgccagcgcggtgtgggtgtgggcgtggagcttccgttcctggcgtccgagcagggacgcgaggactacgcctacagccgcaatgagtggcgcttcggcgccgtgctgtccgggctgggtgtgcgggacatggaccagctcgtgcccaacgacacccgcatccgttgggcctcgctgggcctctacatcgactgtgtctccgacatggacggcttctccggcgcgattccgttcctcgacctggggccgtacgtccggtggcgcgccggactgggcgtttccgcgggctacctcagcaagcccaatgaatgggcgctgacggtcccggaggcccgcctgggcgtggacctggcggagatggtgggcgtgcgcctcacgatgccggtctacctcctcaagaagacggagggagagcggcggctcatccgagggacgcccaagtacttcaaggagctaggcctgggcgtcgagttcctcctcacgcggtggtgaccttcagcgcgctccggagccggtccgccagctcgcggacccccggggcgcgcagcacgctgtagtggtcgccggacacggcgtgctgctccagtccggttcccacgagc

SEQ ID NO: 687 - DNA, 5054 bp, Myxococcus xanthus
ctctccgacgctcgttcatgtagaccgtacgcctgcgcgacggctaggcccgtggagcgggagagctggtgcaccaccacaccctgcgacttctgcagctagcactccgacggcgtcgcggagacgaagatggcctggggcaccagctcctcgaactcaccgagcttgagcgggcggttgtccagcgcgctgggcaggcggaagccgaagcccaccagcgtctccttgcgcgcgcggtcgccgcggtacatggcgccaatctgcggcaccgtctggtggctctcatcgagcatcaccagcaggttgcgtgggaagtagtcgatgaggcacggcggcggctctcccgccgcgcggccggagaagtgccgggagtagttctcgatgccactgcagtagccgacctgctcaatcatctccaggtcgaacatggcgcgctgctccagccgctgagcctcgagcagcttgccctcgcgcttgaatgtctgcagttgttcggacagctcgtcgcgaatggtctggatcgcgcgccgacgcacgtcctcctcggccacgtagtggctggcggggaagatgacgattttctccagcgcgcccaacgtcacgccgcgcagcgggtcgaactcggtgacgcgctccacctcgtcgccaaagaagctgacgcgcacggcccgctcctcctcgtacgcgggaaacacctcgacggtgtctccgcgcgcgcggaaggtgccgcggtggaagtccaggtcgttgcgcttgtactgggcctccaccagcttgcgcatgaaggtgtcgcgccccatctcctcgcccaccgccgcgcgcaccgccaactccacgtagctgcgggccgcgcccaggccgtagatgcaggacacgctggcgacgatgatgacgtcgtcccgcgtgcgcagcgaatgggtggccgagtggcgcatccgttcgatgttgtcgttgatggacgagtccttctcgatgaaggtgtccgtcgacggaacgtaggcctcgggctggtagtagtcgtagtacgagacgaagtactcgacggcgttgtgcggaaagagcgccttgaattcgccgtagagctgcgcggccagcgtcttgttatgggccatcaccagcgtgggccgctgcacgttggcgatgatgttcgccatcgtgaacgtcttgcctgacccggtgacgcccaggagggtttggtagcggtcaccccgcagaaggccctgcgtgagttcgccaatggccctcggctggtcgcctccgggactgtgttcgctgacgagctggaagtccgacatagccgcgagacttaacaccgcgcgggagggaaggccggatgttcgtcaccgcgctacttcgaagtgtcctgtcgcttcagcgcttccagggattgcagccgggcagcctcgaactcatcccccttgttccagcgcggcagctccggttgccgggcaacgtgggcccccagcaggaagaacaggcggatgtcctccaccgcgccggaaaagtcccaatccggacgcagctcgtccgacggctggtggtagtgcttcgactcccagacttcccgctgctgcttgccccagccctccggcttgccgatgaagtccatcccactgccgaagtacgcggcgggaatgccccgcttggcgaagttgaactggtccgaccggtagaagaagccgcggtccgacagctggtccgccttcaccacccggccctgcgtcttcgccagggcgaccagtgtggcgtccaggttggatttgcccaggccaatgacggtgaggtcgcgggtgcggccatggatgttggcgccgtcgatgttgatgttggcggcgacccggccgtggggcacgggcgggtgctcggccaggtactgcgagcccagcagcccctgctcctcggcggccacggcggcgaagaggatggagcggcgcggcgccttgggaagggccttgaacgccttggcgatgttgagcatcgccgacacaccggacgcgttgtcgagcgcgccgttgtagatggtgtcctcgcccggcttgccgccttccttgcggcccaggtggtcatggtgcgcggtgtagagcaccacctcttgggacagcttcgggtcacttccgggcagcagcgccaacacgttggcggtgggactgcggcgcaccgtgttggtgaggcgcgacgacaccgtcaccccgagtggcacgggctggaagtcgcgcttctgcgcggcggcccacagcgcgcccaggtccttgcccgccagttgcaacacccggcgcgtggcctgctcggtcgtccaggccttcacctggaggcggggcccctccgccgcgggcaactcgaactgctcacccgtccacgacgtctgcaccacctgccacgggtagcccgcgctcggcgtggtgtggatgatgatggcgcccgccgcgcccatcttcgcggcctgctcgtacttgtaatcccagcggccgtaccagagccgcgtcttccccgcgaagagctgcgggtcatcctccgggtcgctgttgaggatgagcagcgtcttgccgcgcaggtccatccccttgaaatcgtcccacttgtactcgggggcctggatgccgtagcccacgaagacgagctcggacgccgccagcttcgactcgggggactgcacgccggacacggcgatgaagtccgtgtggaagtccaggtgcaccgcgccctggggcgcctggaacgacaattccttggggctgctggtgacgcccaccaggtcaaaaggctgcaggtacgagccgtccgtgcccaacggctgcaacccgagcgcctcgaactgcgaagcgatgtacgcctgcgcgagcgcgtcccctcgtgtgccgggaccacggccctccagcaggtcattcgcgaggaagcgcacgtgcgcacgcagcacctccggagcgatgacaccggacgcggacttctccgcgggcgtcgtcaactgcacgcgctgcgcgagcgccggagcggagcagagggcgagaagcaggggcagcgagcgcatcatggtgtcccgagccctaacatgaagcccgggacacccgaagcactgcatcagccctggagcggcgccaccttccacgtcgtgccagcgggcgtgtccatgatttccacgcccttctccttcagctcgcttcgcacccggtctgcggcggcgaagtctttcgccgcgcgggcagcggtgcgctcgcccagcaggcgctccacctccgccacgtcgatgccccgctcgcgcacagcgcgctcgcggcggcgcagcagccacgcatcgggcgcgtcctcgaagaggcccaggacgctggacaccctgcgcacatcctcacgcagcgcgtgcagtgtgcggcccaccagggccttgtccttcacgggcggcttgtcggtcagctcgttcatcatcccgaagagccccgacagcgagcccagaccgcccgcggtattgaagtcgtcgtccatggcggactcgaactcggtgaagaagcgctgcgggtcgccatgcaggggccccttgccgaagtccttccccgagattcgctcgtccaccttgcggagcgtctcgtagaagtactccatgcgcgtctccgcatccgccagcgccttgtcggagaacgacagcgggtgacggtagtgcgtggcgaggaagaagaagcgcagcgcttccgggtccaccttggtcagcgcgtcgcgcaggcgcaccacgttgcccagcgacttggacatcttcgcgccttccaggtccaggaagccgcagtgcatccaataccgggcgaacgtcaccccgttggcggactcgctctgagcgatttcgttctcgtggtgggggaagatgaggtccagcgcgccgccgtggatgtcgaacgtctcacccaggtacttcgcgctcatggcggagcactcgatgtgccagcccggacggccggggccccaggggctctcccatgcgggctctcccggcttggccgccttccacagggcgaagtcgagcggctcgcgcttctgctcacccggctgcacgcgctcgcccacgcacagctcgtccaggttgcgcttggacagcttcgcgtagtcctcgtcgctgctcacggagaagtacacgtcgccctgggaggcgtacgcgtggcccttgtccacgagcttctggatgatggcgatgatttcggggaggtggtcgctcacccgcggcgagaagtccggctccagcaggtggagcgcccgggtgtcctcccggaaaatctccacgtagcgcgccgccagctccacgggggcctcccccgtctccgcggccgccttgatgatcttgtcgtccacgtccgtgaagttgcggacgtaccggaccttcaggccccggtgacggaggtagcggaccaccacgtcgaaggaggtgaaggtgcgggcattcccgatatggatgtagctgtagacggtaggaccacagacgtagacccccacctcgccaggaatggcgggctgcagcagctccttctgcatggtcatcgtgttgaagagccgaatggcgggcggggtcacgtgcggcaatcctctcgggtccataggcgtgggtgtgtcccgcactctagagtcttgggtcgcggacaggccagtattcgcaaggggttcgtcgccgcccccaatctgggagaatgggcatcatggctccaccgaacccaaagcggccccctcggccgccccgcccgcccggtacgcaggcgccccaggattcagacgtggagctgcccttcgatgacgacgaggtggatccgctccaggctgacgacccacgtccccagcgggtcccccagtttcccgccggctcccgccgcagccggcgccagggccctggagggcgcgccaacagcgaccgcgagctcgcctcccgcttcgacaccgcgaatgagtactcggaccccgggtacgcgcctgccttcctgtacgtcgagcgaggccccggcgccgggcagttggtgcccgtcaaacaaggggcgctggtcatcgggcggtcctcctcgtccgacctccacctgcagcacgcgtccatc

SEQ ID NO: 688 - DNA, 4487 bp, Myxococcus xanthus
gggaggtctagccgcgcctgctgcacctgctggtggaggaggcctacgacccgcgctacggagcccgccccctcaagcgcgcactggagaagcgcctcacgttgcccctggcccaccacctggtgcggcggagcgcggacgacctggcgcgcgtggagctgctacgggacggcaacgacatgcgcgtgtcggtggaggtgctggtcaacgcgcccgcgtgggcgcccgagcggccggcctctgcgtggagcctgaccgaggtttcccgcctgctcgaggagacccgctcgcggctggaggcgttgatgacggagggggtgcccgaggcgggagaactggcggagcgactgcaccggctggcactcgaggccacggacattcgcgactacgagttggtcccgcgcgacttcctggacgcggagtcgcctgcgtccaccgtgaagcagatgctgacgtcgcactcgagtcacgtgggccacctgggcctgcggcagcgccctgtgtatgaggagcgcccactgcacgtctcgaacgaagaacagctccgccgcgcacagccccgggtgttggcccttcgcgacgagaccgcctgggtcgaacatcagctcacgcacctggcgagggggacggacgtcgtgacggtgttggtggaggggctcggcgacgcgacgccatccgcggtgtggaccgtggcccactccctccccagcgcgctcggggagtcggcgatgtacctggaagccgtccatgccgacgggcgcaccgagtggctccggtccggagacgagcggtccgaggacctggtgcttcggcgtgtcgccgtgcggatgtcggccatcggcctgcgcgaggtgctggcgccccttcgaggctatgcgctggtggacctcgtctatggcgatgggccacgccaggtcctggtccggctggagcacctgtccgaagacgtcgggagtctggaagacgtgccgcgcgtgatggccgcatgggatgaggcagtcgtccgcgaacgcgatgcccggaggagcggcgccgcgtcagtgggcgcggccagccacgtcatcctgcgtggccgcgaaggtgtcacgactgggcggccccacgactcgaccgaactcacgcacgtcgcgagcggacgccgcccccgggaggcgctcgcatgggccgcgagggtgctccgggaacccagccagggacacgactgacatggaaaagaacgtccacctcttcgtgcgcacctatcccgggctgggcgtggcggcgcacgtcctcacccacccgcacctggcggccttcgcgccgacgctgcacgccgcgaggctcgacatcgctgcggtggtggggcggctcctcaagcgaggagagctctgggacgaggagacccactggagcgatttgcgccagcggaagacgacgctgacggtgcgcgcgctcgaacacgggaagatgctgtccgtccccctgcgcctcaccgtgctcacgcacggggtgaaggcccgcaccgcacgcaagggagcaccagcgcgccagtccctacgcgtgtgggtgccccgcgtggacgtcaagggcacgctgcacgatgcggcggacctggagcccttcgtcgaggagatggtccgccacgagctctatctcgcgtcgctcgaccggctgcactctctggcctacgtgggcgaggagcaggtagagacgctgtcggtgccggtccgcttccgggacacgccgcgtgcccgtgcgctcgatgccgcgaagccgcagcggcgccaggcgccaccaccggggctcgcggaagccagccggtgtctcaatgaggaagcacgcgcgggtttgctggagcgcgcctgggaacgggacctggaggtgtcccggctcgcggaggccgtcacctcgcgcacccgtgccagcgtgctcctggtaggcccgtcgtccgtgggcaagacggccctggttcatgaactcgtgcaacgcgcggaggcggccaccacgggttcgccgcttcacgggttggaggtcttcagctcctccggaggccgcatcatggcgggcatgcgctacctggggcagtggcaggagcgcgtgaagcacatggtggaggccctgcgtgttcgccaggccgtgctgcacctcgacagcctgtcggagctgctgtccctgggtagcggcgacacggggctggatgtggcgcgtcagttgctccccgcattggaaagtggcgaggtctcactcgtcctggaggcaacaccggaggacgtggcccgcgcggagcggacccacgcagcgttcctgcaatcgctccggcacatcgccgtggcgcccctttcggcccaggccgcacgcaacgcgcttcagcaggcctcgcatcgggtgggccgcgctcgcaaggtgcgcttcacgcccgacgcgctggaccgcgctggcgaactcacggagcgcttcggctcgggcccttcgcccggaggcgcggtgtccctgctgcgcgccgccagcacggagcccggcgcggccggagaagtgaacgccgcttcggtgacgcgcgccttctgcactcggacggggtacccgctcgaactggtggactccgccatccggttggacccggatgccctgctccgccgcttccgcgagcgcgtggtgggccaggacgaggccaccctcctcctgcgcaatctggtcgtcacgctgaaaacaggcctggcggacccctcgcgtccgctgggcgccttcctgctgctgggtcccaccggcgtgggcaagacggagtcggcgctcgcgctggcggagtacctgtttggcgacgtggcccggctggcgcgcttcgacatggcggagtacgccgcgccaggcagcgccacccggctggtgggagaagcgggaggccaacaaggcagcctggcgcggcgcgtccgcgagcagcccttcggcgtggtgctgctggacgaaatcgagaaagcggacgcgggcgtccatgacctgctgttgcaggtgctcggcgaaggccggctcacggatgccaccggccgcaccgtcagcttccgcaacaccgtggtgctgctcaccagcaacctgggcgcggacagcgcggggcgctcgctgggtttcggggagcgcggccccctggagcgggcggcgcactacctgggggccgcggcggccttcttccggccggagttgctgaaccggttggaccgggtggtgccctaccgcgcgctcacggaggacgtcattcaatcactcgcccggcgcacgttggaggcggccctctctcgcgaggggctcagtcgccggggcgtgaaggtgaccttcgacgaggacgtggtgaagcacctggcgcgcaccggcttcgacgcacgctatggggccaggcctctcaagcgcgccgtggagcaacaggtggtcgcgcccctggcgcggtggttggcggctcaggccaccagcgctccgccccaggtggtgctccgcgtggaagctgaggggcggattgcgttgagcggcctcgaatgacctccgaggccgcccaggccagcgatggacgccgtgcggcgcgaactagcccttgaagttctgggccacgaagtcccagttcaccaggtgcgtcaggaacgtctcgatgaacttcggacgcgcgttccggaagtcgatgtaatacgcgtgctcccacacgtcgatggtcagcagggccttctggccgtgcttcatcggcaggtccgcgttgcccgtcttggtgaccttgagcttgccgccctccagcaccagccaggcccagcccgagccgaactgcgtggccgcggccgtggagaactcctccttgaacttctcgaaggagccgaagtcacggtcgatggccgccgcgagctcacccgtcggcttgccgccgccagcgggcttcatgcactgccagaagaaggtgtggttccacacctgcgcggcgttgttgaacacgccaccgtcgctgctgaggatgacctcctccagcgacttgttcgcctccggcttgccgtccaggagcttgttcaggttgttgacgtaggcggcgtggtgcttgtcgtggtggaactcgagcgtctccgcgctcatgtgcggcgcgagggcgtccttcttgtaaggcagatcaggcaacgtgaacgacatggtcgtttcctttcggtgtgagaggtcaggcgccatcgctatcagacggcggcagagaggtcacggttcgatagccccgcgcccaataaagaaggggctcctgcggacgtccctcatgaagacgtgtgacgcggccgacaatcagcgtgtggtcaccgtgacggtgcaggccatggacctggcatgacaaccccaccaggctgtcccgcacgaaggcgtccgcgtcgaagagctgcgcatccagctcacccttcgcgcactgcacggagatggaacgttgtgcggcggacaggatgctgagcgtgaagacgccggaagcttccacccgcttcaaggtgcggggacggccttcgacaacg

SEQ ID NO: 689 - DNA, 4808 bp, Myxococcus xanthus
atgggtgagtacatctactacttcggctgggctgatgccgccgcccgcctcgaagtcgagtactacccgaagctcgtggtgagcgggccgctgtcccccgccaccgtcccccgcttcctcatcgccccgggcgaggacgtccccgcgctgcgccgggccctgcttgccgccgccgccgggagcgcccaggaggcgggctgctcctccgttcacgtcctgtatcccacgggggacgaggcggacttcctggaggccgaggggctcgcccggcgcatcacccttcagttccactggaagaacccgggctacggcagctacgacgactacctggcgcgctttgactccaagcgccgcaaccagctcaagcgcgagcgcggggccgcggccacccagggcatctccctgcgtacggtgcgcggcgaggggctctcccaggcgcacgcccggcgtgcctacggcttctacacctccacctgcgagcgtcacgcctgggggcagattcagctcacccccgacttcttcgcgcgggtctttcgcacgatgccgggctcggtggagttggtggaggcggtgcgcggccagcaggtcatcgccggcgccttcaacctggccaccccggagcgcctctatggccgctactggggcgccttcgaggagcaccccttcctccacttccacgtctgcctgtaccactccgtggaggactgcatccggaccggccgcaaggtgttcgagcccggcgctgggggtgaacacaaggtgtctcggggcttcgagcccaccgccgtacacagcgcccacctcatcttcgacaagacactggacggcgcggtacggggcttcctccgccgggagcacgcacggctggcgcccgccgtggaggaggccgagcgcatctgcgggctgaaaccctggcccctggccgcctccccgggcacccaaggggccaccggcacctgaacgccccccggactgtcagcctgaagaggcctctccgcgacttgaagttgtgaaaccggggtgagcctctagagtgtcatcgccatgaaagccccggagacggacgaagacttcatccagtggtacgaggactgctgggcggaccgcgacgaagtcgagtatccgaagatgttcggcgccattgacgaaggcgtcttcacgctcgaccagacagatgccatccaagcgtggatggagagtgagctggcccaggtccaggaagcggaccccaactggggtcccatgggcgtgcgcgtctccccgcccagcgagagctacccctactggacctatgtcaccagcggactgtccaaccccttcaccgtggcgcccggcgaggacatccccgacggcgcgcccagcgggctgggctacgagatggtcatccactcgcccgaagaggcgaagtggccggtgttccggctgctggacatgatggcctacaacctcgtgtccctgcgcgccttcgccatgggccaccgctacccggtggaaggctccctggacggtggcgagtccaagctgagcggcttcgtgttcgtccgggacccgtcccggcccgaccacttcgtgctccccagcggcaaggtgcaactgctcaccctggtgggcgccacccgcaacgagatggccttcgcccgctccaacggcatggacaagctgatggccaagctggtggcagcaggctccggctacatcacccagcccgaccgggaagaagtgaagttgtagtcacaccgcttccgagtcgcgcgccggccgcccttctcagggaccggcgcgcggcggggcgtcctccaccagcgcgtgcaggacgcccagctcgaacggcttttcgatgcgcggcaccggcaccgactggaggaaggtccgtgctcgctcggagaagcctccgcccgtcatgaagacgaagcgcgcgagcagctccggctgacgcgaggacagcgcgtcgtacacgtccatccccgtcaggtcccccatcatcaagtcacagaagatgcggtcgaagtccgcgtcgcgcgccagcgtgtccaacgcctcgcgcccgctgtggaccaccaccacctcgtgacgcacgccgaggatgcggcccagcaccgaggcgagcagcggctcgtcatccaccaccagcacccgcttccgtccgggaaggtccgtgtcctccgccacccgcacggctggcgcgtccgcgtcggtggtgggcagccgcacctggaagacactgcccaggcccggcgcgctcgatgccgacagctcgcctcccatgcctcgcaccaggcccaggctggtggacaggccgagtccagcgccctcccccaggggacgggtggtgaagaagggctcgaaggcgcgctccaggacctcgggcgccatgccgtggccgttgtccgccacctccaccaccaccgtcgcgccgtccctccaggtggagagcgtcacctggtagcgcgccacgtccccttccgggatggcctgcgcggcgttgacgagcagttggaggaacacctgccccagccgcgtctcgtgcgccatcaccgtgggcaccgggcccaggcgcttctcgacgcgggcccggtggcgcaggtgcggcatcgccatggagaggccgaactccagcgccgcgtgcacgtccacgggcgacagttgcggctcctccgctcgagcgaagatctgcaaatcacggacggtggtgcggatgcgctcggcgccttccttcgcctcgcgcagggcctccatcgcctcgcccagcgcgcgggccaatgattcacgcaccgcgccctgcgttgcgaggggctcgagctgctccagcgcgaactgcaggttccccacgacgtaggagagcgggttgttgatttcgtgccccacgcccgccgcgagctgtcccgccatggccagcttctccgactgcaccagtcgctcacgcgcggccatgagttcgcgggtgcgctcgtggaccagggcctcggcttccaggcggcccgagtgctcgcgcgacagaagcacgtcccgctccgcctccgcctgcttcctggcggtgacgtcccgcccgaaaatggacacgttgccgttggcgccccaggcgtgcacctcatgccagcgtccaggcgtggcgcgccattcgaagatggtgtggcccgcgccgctcgcgacccggcgcagctcccgctccatccgcgtgcccagcaactccgggcacgcctgccacagaatctgccggaagagctgctcctgcgaacgcccgctgagggccgcggcctcgtggttcacgaaggtgattcgccagtccgcatccaacgtgaagaacgcgtcgggtgtggcctccagcatgctccgcacccagtccagggtttcgcggacgctctcctccaaccgcagggcgctggtgatgtcacgcaggcgcagcaggacaccgtcccggagcggcaccgccgttccctgaagccacacgtccccttcctggaagctgtccgcagccggccggcccgcctccaccacgttccggagcaggtccacccgggaggccagacccgagcccggcatcagctcgcgcagccgccggcctctcagcaactccggagcggcgtgccccagtgcgcgcgcacccgcgggattcgcccaggcccactggaagtcgacgagcgctcccgccgcgtcccgcacggcgtgcaacaccatgcagccctcaggctggtgccgctccgcttcctcgagcgccaccagcagcacatccatgtcgggcgccggagccgcctggaatcggtcgttcagaatggctccatgtcgacacgaatacgtggccgtcacaagtacacgcggcaaacatgtatcagtatcagttcccatgtgtctgtcggccaaccgccgcttgacctggctcgcgcgcgcaggggacgcccgggcggctaggctcctcggccgcccatgacgcccaccctcatcaccgccgtccacttcgagccgctgcacctcccgctcaccgagcccttcgccatcgccaccggcgcgcagtacgccgcggagaacgtcctggtgcgactcaccctggcggacggctccgagggcctgggcgaggccgcccccttccccgccgtcagtggagaaacacaggccagtacgctggccgccctggaacaggtgcgcgcggggctggtgggacgagacgctcgcgcgtggcggcccgcctccgaggcgctgggggattcactcgcgctggcgccctccgcccggtgcgccgtggagacggcgctgctcgatgcgctggctcggcactacggcgttccgttgtacgtgatgctgggcggcgcgcagtccgcgctggacatcgacatgacggtcaccgcgggagacgtggcccatgcgcgaaaatccgcgcaggcaatcctggcgcggggcatcaccacgctgaaggtgaaggtcggggcgctgccgcccgtcgaggacgcggcacgactggtggccattcatgaagtcgcgccccaggcccggctcttcgcggatgccaacggtggctatgacgtggccgaggcgctcgccttcttgaaagaactggcgcgcgcggacgtccccctggccctcttcgaacaacccgtgcccgcgcatgatgtggccggtatggcggagctcacgcgccgctcgcgcgtgccggtgtgcgcggatgagtcggcgcgctcggcgaaggacgtgctgcgactcatccgggaaggcgccgcgcacgccatcaacatcaagacgatgaagtgcggcgtcgtcgaggcactgacgatgtggagcctcgctcgcgcagcgggcctggagctcatggtgggcgg

SEQ ID NO: 690 - DNA, 5972 bp, Myxococcus xanthus
gacaggccaggacgtgttcctcgaagccgcggcgacgctgacgcgcctgtaccccgccctgcccgtgcgtttctacctggtgggcgcgccgctgtatcagacgcccggttcgcagttctccgaggatgaactgcgccggctcatcgcctcacgcggcctggcggagcgcgtgggcctggtgcccttccagccccacccggcctgcgtgtaccgggccctggacgtcttcgttcacgccagcacccgccgggagcccttgggcctcaccatcgcggaggcgctcgcctgcgggcggcccgccatcgtctccaacgcgagcggtgcggcggaggcactcacgaatggcacggacgcgctgctgatacctccgggcaatgtgcacgcgttggtccaggcgctgcgaacgctgttggaggatgcagccctgcgagcccggctgggcacggccgcgcgactcaccgcggaggcgagcttctcgcgcgaacgctacgcgagcgaggtgctcaccctttaccgcacgctggtgcggagcagtccccccatttgaaagtagtggagccctcatgccttgaagcagtcacgccggctcatcaccctctcccactcctatgtcgtcggccttatccggtgcctcgccaacgagatgatgcgcgtgggcgcgggcgcatgggatgtcaccacggtggcaccccgcttcttccacggcgacctgagcccgctcgccctgcaactcgaagcggacgagcccgccaggacggaaggcgtgcgcgccttcttcagtcgctcgctccacaccttcctttacggtccggaggtgcatgctcacctcgctcgcggcgcggacctggtgcacgtgtgggaagagccctatgtgctggccggcctggagctggcattgctcacaccgcgtcacgtcccgctcgtcttcagcaccgcgcagaacctgtccaagcgttacccgccgcccttcgcccaggcggagcgcttcgtcgtccagcgcgcttccggctgggtggcctggggtgaaaccgtgagggacaacctcctcacccgtcccggctatgcggagcgtcccgcgcgcgccattcccatgggcgtggacgcggacctgttccaaccggatcgcgccgcgggcgagtccttgcggcgcgagctcgggtgggagacatcaggcccacccgtggtggggtttctcggccgcttcgtcccggagaagggcgtgcccctgctgatggatgcgctcgacgcgctcgacactccgtggcgcgcgctcttcgtgggcggaggcccgatggaaggtgcgttgcgtgactgggcggcccggcacacccactcggtgcgagtcctcaccggcgtgccccacgcaggcgtgccacgtgcgctcaacgccatggacatgctgtgcgcccccagtcagacgacgcgccaatggcgggagcagttcggccgcatgttggcggagggcttcgcgtgtggcgtgcccgtgctcggcagtgactcgggcgaagtcccgcgcaccatgggcgacgcgggcatcgtgctgccggaggcgtctgtgtccgcctggacgcaggcgatcgccaacctgttggagagtccccagcgcagagaagaactggccacacggggccgagagcgcgccgtcacccgcttctcgtggccggtggtggcgaaggcacacctggacttcttcaccgaagtcctggagcagcgcggctgacgaaacaggcgcctcagccctctcgctccaccgtgtccacgatggcctcggccatggtgtcccatgtctgcgcccggagcgtctccgacagcgcggccacatgaggcgcccaggccgcggcgtgctggcgccaatcttccaggcgccgcaccaacgcgtccacgtcatccggcgcgtccagcagcaggcccgacagcgcctccgggtagcgctccgccacgcccgccgagcggctcaccaacgcaggcagcccggtacacagcgcctcgtggacgttcagcccatatgcgtcataccgcgtgggcgacaccagcacgtccgccgccgacagcaagcgcgccacgtcgtcacggaagccgaggaattggatgcgctcacccacgcctctgtccgcggcttcgcgctcccacgcataccgaagacgcgccggagcccacgaccttgaggtccacgccccaatccgcacgtgcacacagccgcagccacgcctggaagagggtgtcgaagcccttgcggcggtcgcccaacgcgcccacgaagagcgccacgggccgagactccggccaccccagggacgcgcggacctcacggcgcgcctcggctgttaccgggcgaaagcgctccgcatctccaccgagatagatgacgcgcacccgggacgcaggaacgcccgtggcagccaccacatcatcccgcgtgcgctccgagttggcgatgatgacgcgcgcgcgccgcagggcctgccgctccgaacgcacgtagtaccggtggctcacgcggcccttgagttggcgcagcacgccgccgctgggctcggaggtataggcgccgtggacgtagtggacccagttggcggacgccaccgggcagttgccaccattggccaccacgcggcctccctcggcgcgggtacgcagcgcccaggcccggcccaccgcgctcagcagcggttcgccgagcagatacgcattggcgggcttgggcactcgcacgaagcgcaccttgggatggcgcaggaggacctccgccacgcggtgtgccaccaaccggacggggtacccctgcttcgccagccagagcgccagcgccaggttggcccggtccatgcctccggtgtccacgaagtcaccggcgatgagggtgtacggtcttcgcatgggccagggcgccgaagagcgccgcgttgagcaaccagaactccatgcccgtctggctcatgaagaacggatagctgaaggtgagcgcgaaggcgcccaggttgtacgcgaagaggacgctgccccacagccagaactcgtcctgcggaccgtcacggctgcgcgcgacctgaaaggcccacagcaacgacatcagcacgcccagcgggtagaacagcacgcccaggatgccgccgtcgtagacccaggcggtccactggatttccgcccacaacggcgggcgctcgcggtcgctgttgtcgccgaagtaggcattcgtcatgccgtagcggcccaggcccgcgcccagcggatactcaggcagcacgtccgcgaaggtccccgtcaggaagtagccgcggttgcggtggtacacctcgtcggggctggccgcgaagagcgtggaccagcgactcatcaccgcgtcgccgcccaccgccacggcccaaccgaaggtggccacccccgcggtgcccatcaccgccagcagggccaggaaccgtcccacgcggccactcaccaggagcaccgccgccagggccaccagacacaccaccagcatgacggcggtggcgcgcacctgcgacaggtagataccgaagagccccaccagaatgccgcccacgctcaacacgcgcgtcagcccgcgacgggatgacagcaggaacccgccgcccagcagcaccgcatagaagccgccagtggacgcgccgcccggaatgtccgtcaggcccatgggccggaacacgcgcacgccgtccgaggtctcgaacttgaggctgctcacataaccttcgccctggccctgcaccgcggctgacagcgcgggctggaagcgtccggggaagtagacctgcagcacgcccacgcccgcgctggccgtgttgaagaagaagagcagcgcgagcgtgcgacggaacgtcttcgggtcgatggccagccgggtcacccacagcagtggcgcggcgatggcaagctggatgcccaactgcgccagcgccgccaacggggcaccggtgccaggattgaagagctggagcgcggtgatgcccagcgcggccaggatgaagggaagcgccgggtgcttcagactccgtccccgcaccagcgccagcagcagcagactgacgccgaaggccagcacgcgcaccgccacgcggagcggcgcgatggcttccaccagcagcgcgagctgacagcagatgagcagacagacgaagagcggcaccaggcggctcgacgccagcaggccgccgcccatgcgcgcaccgcgagcgacgggcgcggtgggcgaggccccctccggaaccgcctccagcgcggcccccggtgcgcggcgcacgaaccggcgattcagcacgccggggccctgaagctggggcgccctcacaccggcacctcctgctcggacagcgcgcgcagcgcctcctccatgccgcgaaggaagcctcccgcatcgcacagcgccgcggcacgcgcgggccccgccgcgcccagccgggcacgcgtctgggggtcctcgatgagccgtcccagggccagggccagtgactccggctccgggcggacaaacaccccgcaggaggcatccacgatttccagcgcgccccccatcggcgtggtcaccacgggcagacccgcctggagcgcctccacgaagacgagaccgaacgcctccggcctcgagttgggctggcagtggatgtccgcggcgcgcagcagccgcggcacgtccgagcgttgccccaggagtcgcagccgcccctcgatccccaggtgcttcgcctgcgcccgcagcccctcctgataggcttcctcgtccggacgctgagcgccgccagcgaaccagacgcaccagcccggcaccgctcgcagccggcccagcgcctccagcaacaagcgctggcccttcccctcctgcatccggctggcgtggaagatgacggcgtccccttcggaggcccccagctccgtgcgcaggcgcgcgcgctcggacgcccccagcgccggcggtggcatgggcagcggacagtgcgtcacacgccaaggcacctggggatagacggacaccagcgtgcccgcggcgaagcggctgttggtcagcaccaggtcgggcggcgtgacacgcgcccaccgctccagccaatgctggcccgtcagtgcgtcatgctggaagaaggccaggggaacgccagccgtgcgcaccacgggcccgaacagcgcctgaggccagatggcgtggcagatgacgacgtcgtagcgcccgccgcgcagcagctcgcgcaggacgctccgcgcgcgccacacggaccaggaaccggcctgtcttcgcgggccccagcacatgcacctccacgcccgcgtcgcgcagctcccgagccagccggccctcgaagcagagcgcgaaggcatgtgacagcgacgggcgaaggttccgctcgcgcgccatcgtgtgcagcagcgtctcgatgccaccgtagaggttgccgctggagatgtgcagcacgcgaaggggatggctcatacgctccccgtcaagcgcagcagcgccacgtcgggcgccatcaccggcgcgggccgccccagcgcctccgagtacagggacaggctgcgccaggccatgacgtcatgccggaactccgccacggcccgctcccgagcctcgcgccccagcctctgcgccaacccgggctcctccaggagtcgccgcgccgccgccgccagggcctccgcgtcgccgaccggcaccgtcagccccgtctgctcatgcagactcacccacgcgacgcccgagtgcggaatcgccgtgttcagcacgggcagaccgctggccatggcctccacctgcgacagcccatacgcctcgctgcgggcattgccacagaaccagagcgcgggggccccatgcagcgcaccgaccagcgaggcccgaggcagatagcccgcccacgtcacccgggcccgggacgccagcgcgcgcgcccggggtcaaaccttcgcctacggcggcccctgccccaccaccaccagccggccccggaacccggcggcaaggg

SEQ ID NO: 691 - DNA, 5074 bp, Myxococcus xanthus
cagcttccgcgccgcgaggaagagctgcttggcgcgcgccacgcccaccagccgcgcggcacgggccagcccctccggggagtagacgatgcccagcttcgctgggggcatgaggaagacggcgttgggcgtgccaatgcggaagtcgcacgaggccgccaggtcgaagccggcgcccaccgccgcgccctccaccagcgccacactgggcgcgggatgggactccagcttcaacaggcactccaccagcaagtcatccggcagccgtccgcccgcgcccggcgggcccaggtgcgtcaagtcatagccggaacagaaagccccgcccgcgccgcgcaccagcaaggcgcgcacatgcggggcgggctccagcgccgcgtccagccgcgccagaaggccgtcatcgagcgcgttgcggcgagccgggttggacagcgtcaacacccggaccccgtcgtcgcggtcctcgacgttcagcgaagcacctgtcgcgacgacgggctccactgctagccgagcaccacgaggacatcgccctcgttgaccgactgcgcctccttcacccgaatctccttcaccgtcccgccatcctctgcctccacgggcatctccatcttcatggattcgaggatgacgagcgtgtcgcccgcgttgacctgctggccgacctgaacctcaatcttccacaccgtgccggtgatgtgcgccgctacgtccgccatgaatccgtgcctcctcaggggtggttggggctggagcgggccccgctacgccggcttggcgtggtgctccaggaagttcgtgtccagctcgccggcctggaaggccgcatcctgcacgatgcgcaggtggagcgggatgttcgtcttgatgccttcgatgcggaacgactggagcgccgtcacggagcgctcaatcgcctgcgcccgcgtctcaccggtgacgatgagcttggcaatcatcgggtcgtagttcggcgtgacggtgttgccctcgccgtagcccgcgtccagccggacgccctcgcccgtgggcggctggaacaccttcagcggcccgggagacgggaagaacttcaccgggtcctcggcgtagatgcggaactccagcgccgccccgcgccgcttcacgtcctcctgcttcaccgtgaggcgctcgcccgcggcgatgcgcagctgccagccgatgaggtccagccccgtggtcagctccgtcaccgggtgctccacctggaggcgggcgttcatctcgatgaagtagacctcaccgtccgagtagaggaactccaccgtgccggcgttggcgtaaccaaaggccttcgccgcggccaccgcggccgtgaagagcttctgcgccagctccgggttgcgcccgtccgcgaacagcacggagggggcttcctccaccaccttctggtggcgccgctggatggaacattcccgctccagacagtggatgaggtggccgtgctggtcccccagaatctggacctcgatgtgccggggcgccgggaagtagcgctccacgtacacgccttccttgccgaaggcggccttcgcccggtccgtgcactggcggtagaccttctccatctccgcggcgttcctggccaccgccatgccaatgccgccgccgccgctggccgccttgacgagcaccgggtagccgatgcgctcggcctccgccagcgcgctggccacgtcgggcaccacgccctcgctgccgggcaccacggggacccccgcggcggacaccaactttcgggcctggctcttgtccttcatccgcgccatggcctccggcggcggtcccacgaagatgagccccgcgtccgcgcaggcctgggcgaactcgccgttctccgacaggaagccgtagcccgggtggatggcctgcgcacccgtctgcttcgcggcttccaggatggcggcggtattgaggtagctgtccttggccggcgcggggccgatgcgcaccgcctcgtcggcctccttcacgaagggcagctcagcgtccgcgtccgaatagacggcgaccgtcttgagccccatgccccgggccaccacgccgatgcggcgggcaatctctccccggttggcgatgagcagcttctggaacatggcgaaacccctggggtgcgggtgcgaaagggcggcgaacctaaccctcgctccctcccaagacaagggtgcgaacggacgtgcaacaggtccctacagtccagtaaatttgcgggtctacgaggcggtgtcgtaccttgttccccgtgacgccccccacctcctcaagccctggcggcgtggtcaatctgcaccacgcgcggcgcgccaagcgcctggacctctaccgtggccggcacacggaccgcgtgcgcttcgtgcgcaccacgctcgagacgttgacgcagagcggcaccctcttcaccgaggagggcacgcgccgcggcctctccctgctgaaggcgctccagttgctgcagcgggcccacgcgcgcctggaggaagtgtccggcgacggcgtgctgcccgcggcccggctcccggagcgcgtggacgcgctctattcggaagtcgacggcctcttcgcccgcgcggacaccctgtccgcacgcgacgaagccagcgtggcccagcttcccgctcgctgagccccgcgtctcccctgccccttacggcagttccgtctggccctgccgccgcaggaaggtggggatgtcgaactggtcctcgtccagcggcagcggcgcgtccttcaccaccgcggtgcgggcgctcaccgacttggcgctctccacggtcaggggccgcgagccgctgcccttcgtgggcaccaggctggcgacttcctcgcgcgcgttcgcgagcacggacggcgccggacgcgacagcggcacctgcaccaccggcgccaccgtgcggaccttgggcgcgtcgcggtgcacgaagcccgtggcgatgatggtgatcttcacctcatccgagatgttctcgtcgatgagcgagccgaagatgatttccgcctcgctgtcggcggcgtcgtgcaccagcgtcagggcctcgttgacctcctgcagggtcatgtcgcggccaccggtgatgttgatgagcaggcccgtggcgccgtcgatggtgacgtcctccagcagcgggctggcgatggcctgctgcatggcaatcagcgcgcgcttgtcaccggtcgagttgcccgtgcccatgagcgcgatgcccttgtcgctcatgatggtcttcacgtcggcgaagtcgacgttgatgtaaccgtggtactggatgaggtcgctgatgccctgcacggcgttcagcaggacctcgtccgcgcgcttgaaggtctccagcagcggcatcggctcgttggagagcgacagcaggcgctggttcggaatggtgatgagcgtgtccaccgcggccttgagctccacgatgccctgctcggcctgcttgcggcgcttgttgccctcgaagaggaagggcttggtgacgacgcccaccgtgaggcaacccaggctcttggcgatgtccgcgatgatgggcgcggcgcccgtgccggtgccgccgcccatgccggcggtgacgaacaccatgtcggcgccctcgagcaccgcggcaatctggtcacgcgactccagggcggcctcgcggcccatctccgggttggcgcccgcgcccaggcccttcgtcagcgtctggcccagctgaagccgggtgggcgccttgctcgcggcgagcgcctggacatcggtgttggcggcgatgaagtccacccggtccagcttggacaggatcatcgtattgacggcgttgcagccggccccacccgccccgacgacccgaatcttggcggcctgcttgttctgatcgaactggtccatggtggtcctctcgcccggagtcgcacgatgcagcgcgcgtgctcccaacccccacaatcatcagcaagtcccacgctttggcaagtattccgctacgagcctgtagcgggatgctgcgcgtctgagtcctgacgcgcacttacgccaatgcatggacgtgcaggcgtgcgacgcggtgggtgaacttcgccccttgactcgcgatacacggcactgcttggcgggtggggcgcagcatgccccaaaaaacgacgggtggccccgaaatctctttcggagccaccctcgctgaaatcacccggtgtgtttcaccagggaatcagagccagtgggtcagcgcgcctcgcgttccacttccaccttccccacgcgaaggatggtgaaccccacgcggcggttgttctcacggcccttcgccgtcttgttggtgtccaccggcttcgtctcgccgtaacccaccgcctccatgcggccctcggcgatgccctccttcaccaggaaggcgcgcacgttgttcgcgcggcgctgcgacaggtccaggttcttcgcgtcattgccctggtcgtccgtgtggccctcgatgcggaccagttccacctgcgggttggcccgcagcaccgcggccacctgcttcagcagcgggtgcgaacgggccaggatgacgtcctttccagtggcgaagtagaccttctccaggatgacgatgcgctcgccatcgacgagcaccttcaccttgcccttgtcggggcaaccgtcctcgtcctggaagccattgatggtctccggctcgttcgggcacttgtcctcggcgtcggggatgccgtcccggtcgttatccgggtccgggcagccgtcctcgtcctggaagccgtccttgtcctcagggtcgttggggcagcgatcatccggatccatgatgccgtcgccatccgtgtccaccggcggcggaggcggcgccacatccgggcagccatccgtgtcctcgaagccgttgaccgtctcgggctcgttcgggcacgtgtccgccgtgtcggggatgccgtccgcgtcgttgtccgggtccgggcagccgtcctcatcctggaaaccgtccttgtcctcgggctccgtcgggcaggcgtcgtcgatgtccaggatgccgtcgccgtccgtgtccaccggcgcgaccggttcttagagcacgcgaaa

SEQ ID NO: 692 - DNA, 4825 bp, Myxococcus xanthus
ccatccgccgcccggtggaagaagcgagcctcatggcgggggcggagatttcccacgtctacacgggcatcgccggaggccacatcaagggcttcaattcccagggcatcgtcgccgtcaaggacaaggaggtccgcgaggcggacatcgcccgggtcattgacgcggccaaggccgtggcgattccgctggaccgggaggtcatccatgtcctcccgcaggagttcatcatcgacgaccagggcggcatcaaggagcccctgggcatggcgggcgtccggctggaggccaaggtccatatcgtcaccggcgcggtgtccagcgcgcagaacatcgtcaagtgcgccaaccgcaccgggctcaatgtctccgacatcgtcctccagccgctggccagcgcggaggcggtgctgggcgaggacgagaaggagctgggcgtgtgcctcgtcgacatcggcggcggcaccacggacatcgccatcttctccggcggctccatcgtccacacggcggtgattgcgctgggcggcaacaacctcaccagcgacatcgccattggcctgcgcacccccgcgcacgaggccgagcgcatcaagcagaagtacggctgcgcgctgtcgtcgctcatcaacaaggacgacaccattgaagtgcccagcgttgggggccgtcatccccgcgtgctcgggcggcagattctctgcgaaatactggagccgcgcgtggaggagatcttccagctcgtgcaccgcgaaatccagaagtgcggctacgaggacctgctggcctcgggcgtggtgattacgggtggctctacgctgctggccggcatgccggagctggccgaggaagtgctgggcctgcccgtccgccgcggcatgccgcgcggcattggcggtctggtggatgtggtgaagagccccatgtacgccaccggcgtgggcctggttgtctacggcgcccgccacctggaccggcgcatgttccgcatccgcgaggagaacgtgtacaagaaggtgaagggccgcatgcgcgagtggctcgaggaaatcttctgacgcgccgggccgagcgccaaccgcgttgccaaagggctctccgaaaggggggcccttttttgttggccgtgggccacaccccgcgtcccggttgacgcgtcagcgtcctggtttgacgcgtcagccgacctggtgggttgccccccgaagtgcccgagccggtccagtttccggaatctggatccgtggttcggatggggcacgggataccccgtgaggcggacgctgaaatcctcggaatctccagggtcgtagattggacagaggctggctctcggattgctatgtgcggcatttgccgctggagccacaccccccagcgaccccaggtttatgaatcgaaagaccttttacgtccccctgtttagtcgggccttccgaggacgcctcggcttggccgtcgcacccctggtgctgctgtgcgcggccctgctgggtcctgtggcgaaggccgcggcggacagcttcggcctggggaacgggagcagcggcgcgctgaccgtcggtgtcgccggcactgtcatcaacacctacacgcgtgtgacggccgcagtgccagcggggcagagcttcgtggcggtggacacgactgccgaattcacggcggaggacctggtgatggtgttccaggccacgggccttgaggatgccccttctgggaatcaagcacccatcgtcctgacggggggcttggtgggacgctgggagctggcgcggattggcagcgtcgatgttgaaaacgcgcagctccatttcacgcagcctctcactggcgccttcgcggccaccagcacgcaggtgattcgggtgcccgagtacgccagcgtgacggtgaacgccgcgggcagcatcacggcgcagccctggaatgggacgacgggcggcgtggtggccttcctgtcgcagggcgcggtgaacaacgcgggggccattcatgccgatggccgtgggttccgcggagggttcgcctggaatggttcgggagacggctgcgacggcctggatgaggcgtgggggccggataatctgtggctgggcgggacgtcgaagggcgaaggcttggtgcctggccgttttgggggggaggaactccctcctgatgggagaacgggcccgacgacgggccggggcaacgccgccaacgccggtggcggcggcgtttgccacaactcgggtggcggtggtggcagtaacgtgggcatgggcggcatcggagggcggacgtgggtgggtgaagcgcccccgtattcccgcgaggtgggtggtctcggcggggccccgctgatcttcgatgcggtttcctatgcggtgttcggcggcggtggcggtgcgggccatggcaacaacgacgcggctggcggggggagcgcgggtggcggtttggtgttcatccgcggggcctcgctctcgggggccggtcgcgtgtcggcggacgggttcgcgggtggtaacgccatcgggctagccaatgacgctgcgggcggcgccggcgctggcggcaccgtgtatgtgcgcgtcaccggagccctgtcttgctcggccaatgcagtgtcggcccgtggtggtgatggtggcagcaccacgcacgatcagcacggaacaggcggtggcggtggtcgtgcgctgattcagggcgtgacggtcgggtgcatcccggtcgtcacgggcggctttgcgggcacgcagccgacagccaacgcgccgggcgggctcacgtatggcgccgctcctggcaaccccggtatcgtcaccatcctcccgggtgccttcccggcgagtgtggcggcccccgtggtggtgacgcctgccaacggctccaccacgggctttcgtccggtcatcagcggtactgcccccgcgagctccacggtgatcatcttcgtggatggcgtcgaagtggcccgcgtgacggcggacccctcggggaacttcagcttcacgccgaccgcggatctgtccgtcggtgcgcacacggtgaatgcctacgccctgttccagggcgtctcgtccgtgctgagcaacaccaatagcttcaccgtggtctccgacaccacgcctccggataccaccatcgtgagtggaccgccggcggtgtcgaactccaccagcgcgacgttcgacttcgcctcgaacgagggcccggtgacgtacgagtgctcgctgaacggcgcgcctttcgcggcctgcacggccccgcagacgttcacgggtttcagcgagggcgagcacacgctggcggtgcgtgcggtggatgcagcgggcaacatggacccgacgcccgcgacgtatgcgtggacggtggacacgacggcgccggacacgacgattgtcagcggcccttcggggacgacgacgtcccccaacgccacgttcgatttcagctcgaatgagagcccggtgacgtaccagtgctcgctggacggcgcgcccttcgtggcctgcaccgacccgcagacgttcacgggcctggcggacggtgcgcacaccctggcggtgcgcgcggtggacgcggcgggcaatgaggacccgacgcccgcgacccggacgtggacggtggatgccaccgccccggacaccaccatcgtgagcggcccagcggcggtgacgaacgccaccagcgcgacgttcgacttcgcctcgaacgagagcccggtgacgtaccagtgctcgctggacggcgcgcctttcgcggcctgcacggatccgcagtcgtacacggccctgaccgagggcgagcacacgctggcggtgcgtgcggtggatgcagcgggcaacatggacccgacgcccgcgcagtacgcgtggacggtggacctcacgtccccggcactgccgaccatcgactcgcccgcggaccaggaggaggtcgccaccacgacgccgacgctgacgggaacgggtgagccgggcagcgacatctacctggaagtgggcggcgccacctacggccccgtcctggtcgatgaggacggcaactggaccttcaccgtgccggatccgctcgtcgagggtccgcacaccgtgtccatcaccagcgtcgacccggcgggcaactccgcgggcccggtgacgagcacgttcatcgtcgacctctcggcgcctgacacgttcatcgactccggcccgacgctgctgacgcgggactcgtccgccaccttcgaccttcgctcggaaggcggaggcgtggcctatgagtgcagcctggatgggggcgtctatgtggcttgcgccgaccccgcgaccttcacgggtctggcggatggggaccacctgctcctggtgcgcgcggtggacgcggcgggcaacgtggacccgacgcccgcgcagtacgcgtggacggtggacacgacggcacccgacacgctcgtcgtgagcggcccggcgacgccaacctcgtcgaattcggcctcgttcgagttcgcggcctccgagccgggctcctcctatgagtgcagcctggacggcgcggcctatgtgtcgtgcgaggagacggtgacgttcgacggcttcgcggaaggggagcacacgctcctggtgcgcgcggtagacgcggccggcaacgtggacccgacgcctgccgagcacacctggacggtggatttgacgccgccggtggcgccgctcatcaccacgcccgcgaacggcgcggtgctggatgacggggtggtgaccatcaccggcacagccgacggcgctgagtccgtgacgctggtgctggatggcgtgccctacggccccatcccggtcgatgccggtggcaactggac

SEQ ID NO: 693 - DNA, 5764 bp, Myxococcus xanthus
ctctcaggtgtgctgttcggcctccagctccttgtgcacgtcgaacggcatgatgaggcggatgacgtagaagcccgacacgaacaccgccaatccgatgagcgagtagatgatgctcgccagcacaccctgaacgctgaccaccacgccaagtaacaacatcacttccctcccatgtagccgccagtccacagcaggacgccgcccggcccacgccgaacgttgcccggtaccttgtcccgctcttccttcgtgaagggggaccagcccgaaatcgtcaatgccgcgtagcccagcagcaccagtcctccaaaccacttcatgacgcgcctccgtcacgtttgacgactcaaacctagacgttgctctccgcccagcgccgcgtctcgaagctgtgcgagcgatacaacgccaccaccggccccaccaccatcaaccccagcgcgaagcagaaccagctcgagttgggcgtgtcgtggatgagcttcaccctgtacgtcatgggccgcggccgcctcgggttcgcctcgaagctcgccgtcgtgcgcagcgcgtactttccggcgggcaccggcgacaggtaggtgctggtggacatgttgctttcggtccactcgccgtcgccgtcgttgccacggtagtagctcagctcttcgtagaagaggaccacgtcgttcgtgtcctggttcaccaggtcgccctggatgcccagccactcgttgaagggcgtgccgctgatctccacgcgcatgttgccgcgcttgggcaattcgaagggctcgctgaagtgcatggccgcgggcgtgcctggcgtggcatccggcggtaccaccaccgccttctccaggacgaccgtcttcgcggcggtcaaggacagcacggccgacagcacgaacaacgccagtatccagaggccagtccagacgaagacggagcgcaggcccgactggtgcgggttcggctggctgggggcaatgccctcccgttgaggcatcggctccttcaagccgaaggcctccttcaccacctcgggctccaggtactcgccgtgggtgtacgacacctcgtcgtccgtggcgtccacgttcaccgagtacggcacggagacgtactccgacgcctgggcccgctcgcccactctcaccgtccagtagaactcccccaacaccttgtccgtgaccgcggtgacgtgctggaagcacttgtagcggcggtgctcatagaaggcggcgacgtcgggcgacagcgacacgtcacccgcgggcagcggcttcaggaacacccagtggccgttggagttcatcagccagacgaagccgcgcctcgcgttgtagaggagaaactcctcccacgggtagcgcacgccctccacggtgcacgagcgctccaggtagccgatgcagatccactccgcgccatccagcttccccttggttcccagggggatgatgagcggccggctcggcttctccagcatgcgcaggaaggacagcttgccctggcgagcgtccagcagcgcgccgcagtaggggcacgccacgcgcagcgtcttgtccggcgcgcgcagtgacaggttgccgttgcactgcgtgcagcgcgcctgctgcagctccaccttgcgcacgcggggccggagctgcccggccgggatgcccagctgctccagcttgagcgcctcgccaacgaagacctcgggcgagtgcccacgcgtgccgaagtcgagcgtgaggaaggcgcccttgggccccgtggcgtccacgtaccaggcgtcctgcgtggggtccacgtcgctggggagctgacccgcggcggccaccacgcggccatggccacgctcctcgatgacccacgcgcggtcgcgcaggtgcagccgctctcccgggtgcaggtcctccagcaccacgccctcttcgggccccatgtcgaacatcaggtggaaggtgccctcggactcgctgagccacccggtgcggccgtccgcgaactccacgtaccactcgtcccacggtcccgcgccgtggtccttctgcaggtggccgacgatggtgtacgccgccttgcggtagcgcccctccgcgcggagctgcaacggcgaatcggtggggacgatgctgccaatcttcccgtgggactcgaagtccaggcccttgcgagccaccaccgtctggcagtagccgcacaccacgacctgcgccgagccggcggtgaactccaccatcgcgccgcacgatggacacttcccctgcgtcacgccgtcacccctcgcttcagctcacgcaccacgcacgccgtcgcgcccagatggcgcgccagcagcgcctcgaagtccggacgatggcgctcgcggcagcagtacacgttgagcgcggcgaacccgtgctccggaaacgtgtggatacccaggtggctttcggccagcagcgtcagcccggtgatgccaccgggctccgggaacacgtgccactgcggctggcccacgaccttcaggtccagcacgacgatgagctcctcgaagagcgccgccagtgccgccgcgtccttgaggctgccaggcacgcagccgctggcgtcaaccagccattcctgtccggtggtcagcttcgaaatcctcccgtcctcgggcgtcttatcacgggccctccctcgcgtctggcttcatgtcaccccctggagcacacagcgcctcattggcgcccgcctcggacttcccagtacgctgccctccaagatgacgccgtcgcagaccgatgccccacacgcgccgtccacccccgccgcggccccgagcgccatcacccggctcgctcgcacgctgcgcggactgcctcccgccgagcgctggtggggccctggctgcgcgggcatggccggctggctgaagcgggcggcgcagtccctcccccccgaggacctcacgccccgcttccatgcgctgctcgcgcgcgtccgccaggggctgccggtgctgccgcaagaggcccagcgccaccagtacgtgctggtgcgcggcatgctgggagacgagctgcccggctacctgctggacaacgtgcagcggctggagcgccggggactgagcgtgcgcgaggccgcggtggacaccgaagggctgctcgcgaacaacgtggcggtgctccgcgaggtgctgcgcgacgcggagtacttcggccgcagcgtggtgatggtgggacacagcaagggcggcgtggagtgcaccgccacgctggcgctctacccggagctgcgccacgtggtgcgcgcggtggtgacgctccaggcgccgtatggcggctcatccatcgcgcacgacctggccaccacgccccagctccgacggctcatcgacttcgccttcccgctgctgttccacggcgtgtcccgctccgtggaggagctgtcctatccccagcggcaggccttcatccagcagcacccctaccccgccgacatccccaccgtgtcgctggccacctcgcggctgtcgcgcacgtccacgctgtacccgctccagcgctacctgcacgagcgctacgggtaccagtcggacggcatggtgacggcggtggacgcggaggtgcccggcgcgcgcgtggtgcggctgcacgacatggaccacgcggaggccgcgctgcgcggcctgccaggcctggtccgctaccacccgggcgacctcaccgaggtgatggtcgccctggccttggaagcgcgctgaggctcacgccgcggcgggcgtcagcgtcaccttcttcatcacgtggtcgatggtggagaagcgcagcgccatttcgtacaggcggcgagccagcgcctcgtcctccttcaccgccacgcccagctcctgccggttgacgcccgtgaggttcgcgaggtcctccagcatggcctccgtcgccgcgcggtccggctggatgccgtcgcgttcggcgatggctcgcaggaccagcgccagcgtgatgcggtacgccgcatccatgcgggtcagcggatcctgcagccacccctccagcgcttcctgaagctcgtcgggctggaaatccttgcgctggaggatgggccgctcggcctccgcccagcgctggcgaatctcctcatccaccagcgcggcggacagctccaccggcgtgcggtccacgagcacgtccatgacgcgctcctgggtcaaccggtcgacgtcggcgagccgcgcctgggccagttcgtcccccagcttgcgcatgacgtccgtgatggagcccatgcccagccgtgacagcaactccggcgagtcatcttccagcaacttcagctctcgcgccgccttcacgctcacgaggaagcgggccggctgcccccgcagcgcctccacgggataggtgtccggcagcgtcagctcgatgccgaccgactggcccaccttcgcccccgccagtgattcgaagaagccgggcagccccgggtccgccgcgacgcgcacccaccagttctcccggacagagaagggcatcagccggttgttggcgaagcccagcacgtccacgagcgcgtcgtcctcgagcgccacatcctcgcccggctgacgctcgcggacgtctgcgtgctggcgacggagcgcatcgaagcggtccacgagttcctgctccgtcaatggcgcaggcgccacctgggccaccgacaccccctccagggaaggcgcctccaccgtgggaagctccaccggctcggtgctgtcgagctgcagcgccgccggcatcttcttcatgatgccgagcgcatgaagctcagccagcgaacgggcattcttacgaccgccctgcgaatcgtcatgggtcgtcatggtctctcgctccgtccccctcggatagcacaacgctccggaaggaccgaagccccccggagcgttgagattgacgacgcggcgcttcctagaagaaggagccgatgaagccggacacggtggagacggccgcacccacctggctcacgaccgggatgttggtggcagcggcgatggaccccagcgccgtcactccagcggtaatcttctttccagccgaagcgttcgggtccgtgatggtgttcacgaccgccacggtgtccgccgcggcgatggcgacgttgaggcccggggtgaagcggcccgcggcacgcgccaccgcggtgccaccgccctgcaccgcggcgcgcgcggcggtgccagcggtgcgggcggcgccctcgagtccgcgctcggcgacctcggcggccgcgcggcgcacgacctgacgcgacgcaccttccagcgcggtgttggcggcggtggtggccacccggttggcggcggcacgcgaggcatccggggccgcggcggtgaaggcggtgcgagccgcgtcggtggcagcgcggtagttgctgacattgcccgcgaggctcaggccatcccgcgccgccatcagccccgtggagagcgtgcccgaggcggtgcccaccgcctcacggacgttcgcttcggtcgggttgcgaagcgcatcgcgcacgtcacggaacgtctcgacggctccggtgggaagctgcgccacgttggccgcgaggctgacggcaccggcgccgcgcgcgaggcgggtgttcgccccttcgacgacggggccattgccacccggcaggttgacggggccgaagcggcggggcccgaaggcgtcacgcacctgcgtggcgaccgcggcatccgagacagagcggagcccagtggcggcctgcgtcacgcggttgtgcgcgtcctcgaaccggtcggactgcccgggacgggcct

SEQ ID NO: 694 - DNA, 5656 bp, Myxococcus xanthus
gctctacagatggcgtcagtcatggaagcaggatgcgcgaagcctccgccggccgtcgagcgggatggcgcagacagccgtcccgcgtgacgtgactatcgtccctggggccgcccgttgcccgctgcatggtgcatgggcgcgttcatttcctgtcgggggcggcgccggtccggcgtctccttcggaaactcgacgaaggtgcacagctcgcacagccggctgtagatgcgctcgcccacgcgctctcgcaggagctccgcctctcgggccgcgctgcgcgagtcgtcggtggtgcggtagcccgacggcgccgcgcttcgcatggcgcgcctctccggctccagggagtagttcgtcgcgaacagcgtggtgcggcccgcgttgtagcggcgggcaatcagctcatcgagggtctccatctcaaaggggcttccgcggcccttgcccagctcgtcgatggccagcacctccacctccgacaggggtccgatgatttcgccgccgctcttgccctcctgaaagccacgccggatggtcgcgtagaggagggagatttcgacgtagcgcccacgcacgcccagctccagcgccaggtgcgccagcgtcgccgccaggaggtgggtcttcccggtacctacaggcccgctgatgatgtagcccttagacgacccgccttggacgtattgataggcgaactgcatcgccacactccggcccctgtcttgtgcctcctcataggagcggtagttctcaaagttcgcatgcgctgctgaggcaggcagccccagcgcatcgaagcgagcaatgcgcgttcgcagcttggtgcatgtgcacgtctccatcacctcatagcgccgggggcccatcttctggctgaactcgccctcgcgctcgaccagcacgtgcccgcgccccccgcacaccgagcagtgctcggagcacgcgcagatgcgcgcctgggcctggtccccgcggcgctcgatgacataggtccgcccgccgcacacaccacacgcctcgccattcgcctttggagccatctcacgcaccgccataccagagcctctcctcggccgtcagtccactgaacgggcagtcaggcgtcccgcccacctacatctccttcacgcccagccgccggcgcaccgtcgccagcacccggaagcgccgggacaccttgcgggcgcgcggcgacatcacctgttgttccgcggacgccgccagggcctcacgccacacggcgcaccggtccaggaagggcagggcgcgcagcaccagcaggaacgccagcgcttcctgggcatccatggccgccggctcttccgggacatgcgccaggacggtgatgcgcaggttgcgcacacggtgcgacagcgcttcgttccgccccgccaggtcctcgagcgccgcgcacagccgcgcgtgccgcgtctcttcccaggaacgggcccgcttgcgcttggggctggaggagggttcctcacccgcgcccgccgccagctcccggtacttcttgatctccgactccacctgccgtcggcacgcgcgcagcgagcgcagcaccggctctccgggccgcgcgtcccagagggccttctccgccgagcgggagatgccgcgcgccaccacctcgaagggaacgccttcccgggcccaggtcgtcaaaagctcggtgtccagcgcggagagcatcagccccgcaccacgcacagcgaggaagtagtcctgcaccagctcttcgaagctggcgctttcggggaggagactcatgatccgacgcgtactccagtgcagggaggccggacaaccgaccgtccgttcccccatacctggcaggtccgacatggcaactccagcgcgccgattttcacagcgaatctggaagattttgaaccgacgctccccgaggaaagcaggcggccagtcagtgttgacccgccgcgcggaaaccgcgcatagtgagggtccccgaatggaaattcccgaagattcccggacacttgcctaccaagcaagcaactggggacgccggtgcccctctcctaggaagaccatgcgccgttcgcttctcgtctgcctcgtcctcctggccacggcctccgccgcccaggagaagaaagccccgcgcgatgccgatctcggccggaagtccgccaccgcggtggacaagtccctggctggcgacatcacccgtgaaaagaagaaagaagaggtcgcccccgcgctccagtacgaccagttccggctgggcgtcgagctgcaggtggcctccaagcggcgcgagcagatccagtcgctgaagaagatcatctccctgtcgccggatccgaaggaggcccccagcctcctgttccgcctgggcgagttctactgggaggagtccaagttcttcttcttcgaggccaaccggaaggatgacgacctcatccaggccatgaaccgcaacgacgccgcgggccagcagcgggccaaggcggagaaggcggagttcagcgcgaagcagaaggagtacggcaagctcgcggtggagcagtacacgaagatcgtccaggagtacccgaacttcgagcgcaccgacgaggtgctcttcttcctcggccagtacctcatggaggatggccaggaccgcaaggcgctggtggccttcaagcgcctggtggagaagcacccgcagtcgaagttcatcccggacgcctacttcgccttcggcgagtactacttcaacaactccaaggggaagcgcccggagctggagaaggcgctggtggcgtacaagaaggccgccgagttccccgagagccaggtgtacgccttcgccctctacaagcagggctggtgccactacaacatgggcgacttcgagtcggccaaggacaagttcaagacggtggtgctctacggtgaactcgccggcgccaacgctctggagaaggacggcggcaagggcggcggccgaagctcgctgctgcgcgaggcgcgcaccgactacgtgcgggcgttcgcgcaccacggtgacgtggcgcaggcccgggcggagttcggcaaggtggccaccaacccggaagaccgcttcacgatgctgaagcagttggccaacctgtactacggcgatggcaaggaccgcgaggcggccatcacctacaacggcctcatcaaggagaagccgctgtcccccgaggcgcctggtttccagggccgcatcgtcgactgcatcctccgcatgggcaacaaggagcgcaccgtggtccaggtgcgccggctcgtgaagatcatgaaggaggtcgagggctccggagtcatcaaggaggacaaggacaagaagctgctggcggaggcgaaggagctgtccgagcgcacgctgtccaacctcgccgtcacctggcacaacgagggcaagaagacgcgcaacgaggagacgttccgctacgcggacgcggtgtacagcgactacctcacgctcttcccggagaaccccaaggcgtacgacctgcgcttcttctgggccgaactgctgaacgacagcctgcagaacttcgacaaggccgccgccaactacacgctcgtcgtgctccaggacgccaaggtgctggaggccaaggacgacaagggcaagccgaagccgggcaagccgggcaagtggctgcagaacgccgcctacaacgcggtgctggcctacgacgaggtcgtcaaggcgggcgaggcgcggggcgagggcaagagcgaggcggtgggctcggacatcaccaagaaggccaccatccccacgctgaagaaggcgctgctcgacgcgtgtgagcgctacctcaagtacgtgcccaagggtgagaagcgggtggagatcgccttcaaggcggccaacatctactaccgccacaaccacttcgacgaggcggtgctgcgcttcagcgagatcgcgctcggctaccccgagtacaagttcgagaacggcgagcgcgcggcggagatctccgccaacctcatcctcgactcgtaccacctgctgcaggactacgcgaaggtgaacgagtgggcgcggcgcttctacgccaatgacaagctggcggtgggcaagttccgcgacgacctggcgaagctcatcgagcagtcgtccttcaagctcgtcagccagctggaggagaagaaggagttcgagaaggccgccgaggcgtacctcgccttcgtgaaggacttcccgcagacggagatcgccgacctggcgctctacaacgcgtccgtcgactactacaaggcgaagcgcctggataaggccatcgaggtgcgcaagcgcctgttcgccgagtacccgcgctccaagcacgtgccggactccatctacgcgaacgcggaggcgctggaggccattggcgacttcgaggacgcggcggcaacgtacgaggcctacgtgcgcggctacgagcgcagcctgggtgacaagggcaacgccaaggcgcgtggtggcggcaagaagaagcggggcgcggtggacgacaacaagcccgcggtggtgcagaagtgggacgagtccaaggcgcaggtggcgctcttcaacgccgccacctaccgagagggcctgggccaggtgaaggcggcgctgcgcaaccgcgagcactacctgacgctgtggccgcgcgcgaaggacgccgacgaaatccgcctctccatcatcgacctgacggccaagagcggcgccgcgttcaaggccatcaagatgctggaggagtacgagcgcgacaacatgcgctcccccagccggttcctggccgccgagggccgcatcgtcgacctgtacaagaagatgggcaagacgcgcgacgtggcccgcatgcagaagcgcatcttcgagcacttcgaccagctgccccgccgcgtgcagggctcgctggagaagccggcgctcgccacggccgcgcaggcgcagttcctgtcggtggacctggactggaacgagtaccggcgcctgaagctgtactggggtgctccgccgtcgccggaccgcttcaaggcgagcatccaggacaagagccgcgcgctccaggtggtggagaagaagtacgtgcagacggtgacgctgggcgcgcccgagcccgccatctgcgcgctgcaccgcattggcctggcgtatgaccacttcgccgaccgcctcatcaacgcgcccatgccgcgcggcctggatgaggagtcggagcaggcgctgcgcgacgagttcgccaaccaggcgcaaccgctcaaggacaaggcgaccgaggcgttctccgccacggtggccaagagccgcgagctggacgtctacaacgattgcgccgcggagagcctgaagctgctgcgcaccacgtaccagccggaccgctaccccgacatgcccgatgagaaggtggcgctgaagggccgcgtgcagctcatcggcggcgacctgctggccaacatccaggacgtgccgccgccggcgcccaaggcggcggacgcgcagcaggcccgggcggagacgctgcaggaggacctgacggacctcaccgcgcagctgcgctcgcagaccgagactcaggtggacgcccgcccggcggccaccaccaacggcgccactcccgcgaagcatggcgggaatgacgaggagccggaggactttcctctatgaaccggaccacccgcaccatgc

SEQ ID NO: 695 - DNA, 4195 bp, Myxococcus xanthus
aaggtactccttcgccgtcagcccggggaacaccgcgtactccagcggcacgtcatacgcgtgcaccagcgttagctccgagccgggcgtcatcagcgtgggaacgaagctcgccgcgcgcttggacgtttcgtcggcgtccacggccacgacgggccgtaggtagggcccaggagcccgccggttggcgatgagcacgggcaggtctccgccgcggatgacgttctccgccgtggagcccaggaacatgttgcgcagcggcttgtcgccatgccggcccaggacgatgagctccgcgccaaaggcccgggcccggcgcaggatggcctcgacgggcttgccgcgagcgatgtgcgtgtcgaccgtggcggaactgccctcggcacgcagcatgttgcgcagccgctcggcgacccgctccaactcgcgcgcggtggcctggagcgctcgggagcccacctccgcgggcatgcggctggggaggacgtgtgtcaccagcaccttcgcgccgtccgcgagtggcaggtgtccagccctgcccaccgcgtgggtgctcgcctccgagaaatcagtggcgacgagcactctgcgaagtcgcctcgggaccgcctgctttcgtggtttcacacacgagagtctaggaggcccagacgcagcaggcacggcaaacccgcctgaatgtcatcaggcggatgtgccgtgcccggatgaatcaggcgctcgcggcgccggccacggccggagtctcaccctctggcggcacgtggttctccgcggcgtccgcggcggcgatgcgctcatccagatccgccgtcagccgtgcgaaggcctccttgccaatggtggcggactggtaggccttgagcagcgccgccttctccacgatgagcacgcggcgaaccgcttcctggtgctcctcctcgtggaagcgcatcgactgctgcttcagcgccgtcagctccttctccgcgacgacttccttctcctggtagtccttctccaactgcgtcaccacatcccccggaatctcccgggcgcggcgcatgctctccagcgcggcctgcgctgcgtggatggcgcccaggcggccgcgggccagctcgtactgctcctggaacgcgtccttgaggccggtgatgcgcagcttgcgcagcagcggcgccatggtgaggccctggaagatgatggagaggaccaccacgccgaacgtcatgttcaccagcagctcgcggtgcgggaagtccgtgggaagaccgagcaccagcaccatggagatggcgccacgcaggccgctccaggtgagcaccgcgctccaggtccacggcatcttctccttggtgaagcggagcagcgcggacacgccgtagacgaccacggcgcgggccaccatcaccgccacataggcggcgaggatgggcttccacgaggccagcagcgaggagagctgcacctccaggccgatgaggaggaacaccacggagttgagcgcgaacgccaggtactcccagaagctctccaccgcgatgcgggtggcggggctcatgccctcgtgcgtggcccagttgccgcacagcatgccggccaccaccgacgcgatgacgcccgagtagtggaagtgctcggcgagcacgaacgagccgtacgccgcgatgaccgtgagggtgatttccaccatggcgtcgtctacgcgcttgatgacctgcgcgacggcgaagcccaccgcgctgcccatcagcacgcccatgccgaagaccttgatgaagtcgaacagggcgccgcccaccgtgaactggccacccgtggcgaccgcgacgatgagcgtgaagagcacgacggcggaaccgtcgttcagcaggctctctccctccaccaggatgagcagccgcttgggcgcgcccagcgacttgaagagcgccaccacggcgatggggtccgtggacacgatgacggacgcgaacaccagcgcggacagcatcccgaagccatggacgaagtccaacccatccaccacgcgcgtgaggatgaaggccgtgagccccgcggaggccaggagccctggaatggccagggcgtggatggccatcttgttcttccagaacttgcggaactcgacgtggaaggccgcttcgaagagcagacctgggaggatgatggcgaagagcagctccttcgtgaggtgcggcggctcgaacgccttgaacgtacccaacagcaggcccgcgacgaccagggcaaccgtataggggattttgaagtaccgcgcggcgatggccacggcggtcgcgatggcgaaaatcagtacgaaggccaactcgaaatgcattcgtccttacctgtttagactcaaagcgcgggacgatagcgcagttgcgctggacagagacgcactcgatgttgttcttgcttgtacggagggcatcgcaaattgccagggcgaggtggaatgcaaggcatcacctctcgcctggctgctcttgccttcccgcgtggggcttccccagctttgagccatgtccaagcaccctcgctccaagggaggacggctgagcgcgggcctcaagctcatcgggccgctctgcatctccgtcggcttgctcgtggggctgcggctgctggggccgcaatacctggatcagcagacgctgtcgggctggctgaggcccctgggcgcgctggcgcccttggccttcatcctgctcctcgcggtgcgcccggtgacgctgctgcccgggcagctcttcacggcggtgggcggcatcctcttcggcatggccgcgggcacggtctacgcgctcgtcgggacgctgctggcctcgggcctcatccacttgctggcgcgcaggctgggccgcaagcccatgcggcggctggccggggacaagcacccggtgttcgagcgcgcggcgcgcgagcatggcttccagctcggcttcctggcctgcatcaattcagtgattccggcggatgtgatgctggcgacggcgtccgcgtcaggcgcccgctacgtcccgctggcgctgggcgcggtggtgggcaccctccccgggacgctgctgacggcgctcttcggtagctcgctgggacaggggaagacgtggatgacggctgtgtccgccaccggcatggtggtgagcctgctgctggggctcgtcctgggacgcaagctgatgcgggagttgctcgcgaaggaggcggccgttgcgagcggagggcctgggcgtgtgcacccaggccctggggacgtgcggcctacgggtagcaggcggcctggcgcagcgccgtgtcttccggcagccccagcgcgacgttgaagttctgcaccgcctggccggccatgcccttcaccaggttgtcgagcgccgccatgacggccaccgagcggcccttggtggccaccgcgatgtcgcagaagttgctgccggccaccgcagcgatgcgcggcgtaccctcgacgatgcgcacgaacttcgagccctcgtagtagcggcggtacttctccatcagcgacgccgtcaccaccgcgccgccgtgctccggccactcgaactgcacggtggcgaagatgccgcgcaccatgggcgccgagtgcgggacgaaggccaaccggtgccgctgcgcgccgtgggcgaccagcatgacctccacctcggcctcgtgctggtgctccagcggcttgtacgcgcggaagtcttgcgcacgcgtcgggtggtgcgtgccctcaccgggcagcgagccggagccggacgagcccgtgacgccggacaccgcgagcagccccaagcccggcgtggaggcgatgggcaggagcgccaactgcaccgccgtggcgaagcagcccgggttggcgatgcgcttcgccgtcttcaccgcgtcgcgcttccactcggtgaggccgtaggtgaaggtgcccagcagctccggggacgggtggggccggccgtacgcgcccgcgtagcggcccgggtggtccagccggaagtcggaggacaggtccaccagcagcaggcgctcggcgatgccgacctccgcccactgcttctccaggcccgcgaactgcttggccaggtcgccgtggcccagcgcgctgaagacgacgggctgctcgcagtccgccagccacttccagtcgggctcgccctcgaagcggccctccaccagtccgcgcaagtgcgggtgcaccttgtggatgggctcg

SEQ ID NO: 696 - DNA, 4039 bp, Myxococcus xanthus
cagctccacgtgccgggccgtcatgtcgggcggcaccttgttgcgcttcttgcggcgcgcggccttcagcttgcgctcgcacagggccagctcgcgctgcgccttggtgcggtcctggatgtccggcgcgctgcgcacgtaggcgcggtaggcggcgcaggccccggggacgtccttcgcccccatgcgcgcgcgggccaggcccaggtaggcgggcagcagggacgggttggcgcgcgtggcctggagcaacacctccgccgcgtccttgtgcttgcgcttgttgtagaggcgggtgccctcggccagcagcgcatcgccacggccgacggagggccccaccaggggctcggccagggacaggccacacgtcagcagcacacaggcccacgtcaggcgccgcaggtcagaacgcatagcccagccctccgcgaatgttgctcgttccggcaatcttcttcagcagcgtgaagctgtgctggtacgcgacggaggcgtacaggccctcgtacacgaagatgcgcgcggtggcctgtccggacgcgtgcaggtccagcgcgtagaggccgtccttgaagatggccgcgtcacccgcgcgttccttcaccagcagccctcggccctccagtcccacctggatggcgaaggacacgggcccgagcacgtagcgcagttgcggctggagcgcgcgcagcgacaccgcctgcacccgcgtgtccagcgacgacacgccgtccggccccacgccgcccacgccaggcggtacgtcgatgcccagcgtccatgtgtcgccggtggaggcgtaggtggcgcccaccagcatgacgccgaagaactgcccatagcggccgtactcgacgcccacgccgcgcaggttgcgcgagcccggcgcgcgcacgtcccgagtgcgcaggctctccagctcctccgaggtgctcagcggctgggacgccagcgacgtgcccgtgaggcgctgcatctcgaacgaggcctccaggtagctttgccgcgccatggtggcttccttgcggcggcgcatggccagcttgaaggactgcatggaggtgggcgtcagcgcgtgctccagcgtgtaggtcccgccgggcgcgatctccgccgtcacctcgtggggctcgtagccgtccaacgtcagcgacaccctgcgcgtgcccggctggatgccctggtccaccgcggtggtccccaccggctggccgtccacgcgaatctccgcgccctccggctgcgccttcaccaccagccgcgcgggcaccttctccagcgtggcgtccagcttgacctgctggcgcgagctcatcacgcgcgtctcttccttcggaaggtgcgaagccagttcgaagcggaaggtgtgctcacccggcagcacctccgtggtgaagggcgtggagcccaccttcacgccgtcgatgaagacggtggcccccgcgggcgtcgtctccgccaccaccgtggcattgagcgacaggaacttcaccagcacgccggccagggccttctcgaacgccgggttcgccgtctccgcctgaccccgggcgcccgtgccgggccggacgctgacggcgcggaagcggtagccggcgtcgtcctggcccacctgcaccagcaccacgcgctccagacccagtgattccaggtacgcctccagcggctcccggcagcgcgcctcgccggacacgcagcgcaggtcgccgccctggcccttcaggtgcatggccagggcgccccggccgatgagctgctccgcctgcacgtcttgcggtatcagcgcggcaatcccttcctcggtgcgttgcagcaacgcgtcctgtcctgggtacagggcctggacgagccacagcgtgtgcgaaggggtgggtgcctgggtgtccgggggcattccgggtgcggcgccggcgctcagcgccaggctgacactcaggagacaggagacgaacatggcgtcctcgggggagggggccgcggcggaaccgaccggcggcccccgtccaaggtgtacgccaatgaacgctctcctgcctaggggggaggtccgagaacggagggatttccgggaagctgccttccagcgccttcctgctcgcctgccttccggccgcatgcagggaagctgggggctggaggtcgcctggggtgtggggaatgcgcatcgttcccccggtcgcagcacctccgaggaggcggaatggttctccctggcaagggaatgggctggaagacgttctttctggcgctgaaggacgagtggacgcgcgacgaggtgggggacgtcgctggcgcgctcaccttccggatgattctggcgctgttcccattcctgctgttcctggtgtcgctggcgggtctcctcatcgagcccgcccaggcccaggtgctcatccaggaactggcgcgggtggcgccccgggaagtgacgtccatcctgagcgagcgcatcgaggcgctggcgaacagccggccggtggggctgctgacggtgggcggtgtcggtgccgtctgggcggcctccgcgggcgtggtggcgctgatgacggcgctcaacaaggtctacggtgtgacggagtcgcgtcccatctggaagctgcgcggcatcgcgctgctggtgacactgggcggagcggcggtggccatcctcgcggcgttcgcggtcatcgtcacgcccgtcatcgctggcaagcttcccggcgggttgggcaccgtgctcatgtggctgcggctcccggtagcgggcctgctgatgatgtttctgtgggcggtgctgtactacgtgctgccggacgtgaatcagaagttccgtttcatcaccccgggctcggtggtgggcgtgctcatctgggtgttcgcgtcgtggggcttctcccagtatgtggccaacttcggcaagtacgacgtcaactacggcgccatcggcggtgtcatcgtcatgctgctgtggatgtggatctccgcgcaggtcatcctgctgggcgcggaaatcaacgccatcctcgagcaccgttccccggacggaaaggcgccgggccagaaggtcccggagcagggcaaggcgctgaccgccaccaagacggaactggaggcgggaggtgcgtcgcttccgggcgctccgggcttccagcccgtggtggacccggtgacgggccggcccctggatgacccaccgtccgctccacccaggctgcgtgacacgccgctcgcggcggccttcaagtggaccgtgggcatgggcctggggttgttcctgctgcgcaagtcggactcccggtagaccgtccttcgcttcccagtgccgccggggcgttcgcgcgtgacgacgggtggcttttgactcgcggcgccactccggtgtgaagggttgtcatcgcagggggggcttgccgaacgcctacccccagtgcgagcgtgcgcgcgttgttggctggacgacagtggctgccgtcatccactgaccgcccccctcggacaatcccccgcaccctgagtgccccggcgcatggacgacgtacgccctggagttccgatgtctcagaccccctcctggcccctgcgctgcggcgcggtgcttctcacggctcaactcgtccttgcgtgtggtggcggggagccgaagcctccacctcccaccgacctcacgccgcccacgacacgcgccacgcccgcgggaggcgacttcaccaccgccgtggtggtgacgctggcttgtgacgacggcggcggcagtggctgcgcggccacgtactacacgctggatggctccacgcccggcacgggctccacgcagtatcgcgagcccttcacactggggagcaccaccacggtgcgcttctactccgtggacgcggcaggcaacgcggaggcgccggggaccgcgacattgaccctggtgggtgcggcggacacggagccgcccagcacggtggccaaccccgcgagcggcgcgttcagcagtccccggagcgtggcgctgacgtgtgacgacggcgcgggcagcggctgcgcggccacgctctacactttagagcac

SEQ ID NO: 697 - DNA, 4084 bp, Myxococcus xanthus
gagcgcaggatgagccccacatctccttgcgccgccggggccgctgcacccccgcctcgtgcagcacgttctccaccagcaccaccgcgccatccaccaggatgccgaagtcgatggcgcccatggagatgaggttcgcgggcaggcccaccatcttcaggccgatgaaggccgtcagcagcgccaggggaatgacggacgcgacgatgagcgagcagcgcaggctgcgcaagaacagccatgccaccgccaccaccagcagcgcgccgtgcagcaggttgtggtgcaccgtggacagcgtgtgccccaccaggtcgttccggtcatagaaggcctcgatgcgcatgcccctgggcagcacccgcgagttcagctcctccaccttggcgtgcacgccctccagcaccgtgctggggttctctccccggcgcagcaggacgacgccttcggtgacgtccatgtccaggttgtggctcaccgagccgcgacgcggcgtgtgagacgccaccacccgcgccacgtcgcccaccgtcaccggcgtgccgtcctcgctcttgaggacgatgctctgcacgtcctgcgcgccgcgcaggtagccgacaccgcggatgagcaactcctggtcgccctggcgcaagaagccgccgcccacgttgcggttggagcgctccagcgcctcggtgacgtccgccagcgtcagctcgtgcgcgagcagccgcgacgggtccacctggacgtggaactccttgaggaagccgcccaggctgagcacgtccgccacgccgggcacctggcgcaggtgccgcgcgatgttccactccatctccgagcgcgtctcggtgagggtgtgccggtcgctcagcacgcggaactggtagattttgcccagcggcgtggcctcgggcgccagccgcacgtccgcgccgtccggcatgtccgcgttggacatgcgctccccgacgatggtgcgagccttgaacgggtccacgccgtcatcgaaggtgaggaagatgagcgacagcccgaagaggctctcgctgcgcatctgcaccatgcccggcgtgccgttgagcacacgctccaggggcaccgtcacctgccgctcgatttcctcgggcgccagcccaggcatctgcgcgatgacattcacttggaggttggtgacatccggaaacgcctccacgggcgtttcgagataggccttcacaccgaagaggccgatgcccagcgtcagcaacaggacgggcaggcggcttcggacacagaacgcgatgagtgttcgcagcatgggtaggtgtcctcgccgcgcctagaggagctggtccgccgcgccatccagcagcagcgcgccccgggtgacgaccgggtcccccggtgacaggcccgcgatgacctgcacccgtccctccaccggctgcgccacgacgacgggccgccgctcgaaggtgcccgcgtcctgctgcacgtacaccaccgagtccttgccgttgcgcagcagcaccgcctccaccggcagcgtcaggctggcgtccggcgagtcgatgcgcacgcgcccgaacatgccgggccgcaggctctgctcctgcgtgtccagggtgatgcgcaccggcgccgtccgcgagccgctcgccaccaccgcgcccaccgagtccaccttcccctccagcggcgcgtgcaccgacggcatcgtcacccttacccgcgcgccctcacgcaccagcggcaggtcgcgctcgaacacgtccgccatcacccacagcgccgaagggtcccccacctccaccagcacgtccccgcccggctgcacggcgatgccctccgccgcgctccggcccagcaccgtgcccgccatcggcgcgcgcagcaccacggtggtgccgctgcccgtgcccacgaagcccacggacgcctgcgcccgcgccagctccgcccgcgcctccgccagccgcgtctccgcggacaggcgctcacgctccgtcgtgacgccctgctcgaacatgcgcgcctcgcgctcgaaggcggactgggcctcgcgcagcgccgccgtcgcggtggccaccgccgtgcgcgacgccgcggcctccgggcagtccagcgtcaccagcgcgtcgcccggcttcaccgtgtcgcccgtgcgcacgtggacgctcaccacccggcccgccaggggcgccaccagccgcgacagcgccccgtcccggaaggccacgcgcgcgggggcctggagcgccgcgctgctggcgtccgcctttaccggagtgacggtgatgaaggcccgcgaggcctcggcgagctgcaccacgccttccttcaggggggcgggcgcggcgcgctcagcggaagcggagggggtgcccgcgcccgagcaggcggcggagaaggcccagaggccaaggagcagggtcctgttcatgccccagcccctgggcaagtcccggtccatcgcgcctgatgttcaacccacgagaatcattgaggacggcgatgctcagcgagcaggcggaactggtgcttattgaaccacctgtgcactttcgccacagtgcccggcgtgcgcatctccacgaagctgggcctgggcctgacactgacgagcgccgtcatcctgggcgcttacggctacagccaactccagaaggaggagcacgacctgcggacggccaccgagcaggcagcgcggctgttggccacggcgctccaggtggccatggagaacgcgctgcgggacgggcaggcggcggacgtgaacgaaatcctcgagtcgttggaccaccgggacccgaccgtggacgtcttcgtcttcgacgcccaggccgtgccggtggtgcgctccccgggcagttcgcagacgctgcacctggtggaggatgcctcccggcgggtgctgaagacgcaccactccctcacccacttcgcgggccccgagaagctgtcgcacctgctcatcgtcctgcccctgcacagcgacgacagcaccgtcgtggtgggggcgctcgccgtggtgaagccgctggacgggctgcgacaggacctggagtccaccagccgcgccaccgtgctgtcggtgctgacgctcatcactggcatctccctggtgggctggctgctgctgatgctctacctccaacgtcccctggagcgcgtggtgggcgcgatgcgcgcggtgcgcggcggcgacttcacggccaccgtgacgcccggcagtgacgacgaggtgggcgaggtcgtccacgccttcaacggcatggtgaaggagctgggcgaggcgcggcagcggctgtcggccgaggccgagtcacggttggcactggaggcgggcctgcggcgcgtggacaagctggccgccgtgggacagttgtccgcggggctggcacacgaaatcggctcccccctgctcatcctcaatggacgggcccaggccctggccgcgcgcgccgacctgcccgacgacgtgcggcgcaacgcgcgcatcctggtggagcagtcggagcgcatcgagcgcatcgtccgccagctcctggacctggcccgccgcaaaccgtcgaagctggagtccctggacgcgctcgcctccgtgcgcgcggtggtggagctgctggagttcgacgcgcgcaagcgcgacgtccggttgacattccattccgaggagccgctccctcgcgtgctggcgaacggagacgggctgcagcaggtggcgctcaacctgctcaccaacgcgctgcgcgccacgccccgaggcggcgaggtgcgggtgacgctggcgccgtccaccttccagcccgcccccggcctgcgcgagcgccatggcgtgcgcctgtccgtggaggacaccggcgtgggcatggatgacgcggcgctggagcgcttcttcgagcccttcttcaccacctggagcgcccacggcggcacgggcctgggcctgccggtggtgaaggccattgtcgcggagcacggcggcgccgtgacggtgacgtcacgcccgggacagggcacgcacttcatcgtgcacattccttccgagaaggaagaaggaacgggggcggtatgagcactcccagaaagcgcctgctcatcctggatgatg

SEQ ID NO: 698 - DNA, 4057 bp, Myxococcus xanthus
  unsure (1)..(4057): unsure at all n locations
agcagcaaccacgcggtcgaaaccccggcgaacagcagcccgaagaagcgcatgctgacgcgcagctcgacatagtgggtcaacatgcccatgacgatgcccgcgggagggacgaccgcgaacaggatgttgtgaaggcccaacagccgcccctggaggtcctggggacacgtgagctggatgaacatcagtgtcagcccggccagggtggcgatgccgaaggagctgatggccagcatgaccgcggcccccagcggcgaggtcgaataggagaggcccacctgcgccagtcccaccaccaagggggcgcacacgagccgcatgccggcccacctgggcgcggtcaccgccagccctggccccatcagcaggaccgtccgccgccggtcgtagcgatccgccacctgccccgcccaggccatgctcaccagcaccggaatgctggcgatgctgattaatgacgcgacctgcgccgccgaatccgcgagccgggccaccagccaaccgcccgcaatctccatcatccatcggccggcgacggagatgttctcgaagaaccagaacagccagaagggctggctcacgaagccggcgggcggccccccgggcagggctgccaatgccagggccgggtctccccggccgagggcctccccggcatgggcgggggcgtcaggagaactcacaggcaccgctggacactttgacggtcatgacaagcccttgcattgacaaccattacaccacccgcttcaatgacaaaacaaacactccaccccacctagagctacgacaatagaagccaccctgacctgaatcgcaagacaccccagaccgcccaggaatttcctctcaagaattcaacccacacagaattctccacggcaccccatgtccaatcccatcatcgaagcgctcgacgcggccatgattcccttccgtcgaacccatgcgggtgaggcgctcgcgcgtgtggaagaaaccctgctcatcaacacggggcgacagcccctcccaccgctgccggcgctgcaacgcccgtcattgttctacttcccgggtctgggcacgcgcggctggtactcggcctccgagtacccctcgctcgactccctggcccgcctcctgaaagaagccacgccgatgctgcgcgaggaattcctgacgcgcgcgcaccagggcgaactgctggcctacgaagagcagatgccgggccgcttccccaccctcgaccggcaggactgggggtcgctctatctgctcaaggagggcatgcggaacgagacgaattgcgaggcctgcccccgcagcgcggccttgatggagacgctctaccctcagttcagcccgagcggcgccttcttcttctccgtgatcggcccgggaacgaagattccgccgcaccacgacacgatgaacctgaagctcacgtgccacctgccgctcatcgttccgcccgactgccggatccgggtagacggtgagacgcgcgaatgggtggagggcgagtccctgttcttcgacgacaccttcctgcacgaggtgtggaacaacagcgaccggcctcgggtctgcctgctgctcgacatctggcaccccggcctcaccgccatcgagcgagaggccatcaccgcgctcggccgggtgatggggcagttcatcaaccagggatacacccctccctggtcgacgaatggccgaatcttcgagcactgaggcctggccggaagccccgccctcagcccgccacgtccagcatccacacgtggccgtccgggtccttgaacgtccccgagtacccccagggctgcttccccggtggggccgggacctccgcccccgcctcccgcgcccgggcaatgagcgcgtccacctgggcctccgtctccagcgacaggcccaggatgcactcggagacgcccggctccgccacccggttgccgcccgccacccagccgaacccgcccgtggggatgagcatcaggctgacgcccgcgttgagccggaagtggacgggctcgggcatcgcgtcgccctccgtcccggccatgagggcgaagccgagcccctgccggtagaaccgaaaggccctcgccaggtctcgcgtcgggagactcacgatgacatggggaccgcccggttcacgggccttcaacgaatcatgcgctgccacgacgacctccagggaaggggttcctgaggatgagacgtccctcgcggcccgaaatcatcgccccccctggagaaagggccggggcacactcgccaccccggcccgggtacggactactggcagtcgctcagcgggaagacgtagtcacggcgcggcgtctggccgggatcctggttgatggccgcgacactcagctcgctgtagttcaccgtcgtgctgctgccgatgaccatctgcgtcttctgcacgcgcgtggtggacagcaccaccttgccaatggtgccgctcggctcgatgcggtagcagttcatgatgcgcgggtccaccgtggaccggcggcactggttgtactgccccagaatctcgcgcttcgtgtacgtgcagcgacaatcccaggggtcgtactcctcggagacgtacgcggcctcgaagccggtcgccgtctggacgacctccaggtgcgtgccgccctggaactcgtcacagcgcagcaccacgtcgcccacagcgccctgcttcacttccgccgtctcggcaatcacctcggcctcggccgccgggtcctgcggctgggcaccgttgcaacccacgcccatgagggcgctcatcagaatcatcgcggagaaacgaatgggggaacgcattccagctcctgaagaaaagtccgggtcatcccagacctctcacatgggagcttttcccgtgatgaagcgcaatacacttctccgtaacagcgcctcattcacactgcgcgtcccagccgtcaggacatccggagcgccgtccacagcgacagggcgccgaagatgaagaagaggctggcggcggcccaccgcacccaactcatctgcacccgcccggcgagccggtcccccaggaacacagccaggccgtccgacagcatcatcccggccgtggtgcccagcgtcaccgtgatgggcgcctgataacgcgcggccacggccatggtggccaactgcgtcttgtcccccatctccgcgaggaagaagagcaccaccgtggtgaggaaagcgccgaagcgcggcggcttgcctccgtcttcatccagcgtgtccggcttgagcgtccacaaaccgaagccgatgaagagcaccgccaggagcagcgccatccacttcgccggcacgtgcgcggacacccaactgcccacgctggacgccagcgcgtgattggcgacggtggcgacgaagatgcccgccagcacatgccacggcttgcgaaaccgcgtggccagggagaacgcgagcaactgcgtcttgtcccccatctcactggcggccaccaacacaaacgaacccatgagcgcttccaacatgacgactccctcgcaacaacagggccggggttcagattcgtgggagacgccagggcagcacgcgcacacgacggacctcggccaggaagaaacgacaatccctgtccgaaggtctcgttcgtctcgcgaacatcacgaggtgggggcccgggccgtttccagccagtgtgtcgagcttcccgccgccagcgccgctggcgtgaactactcccctaaggcaagtcgcggagtagcagcgcggtaccgcgctgtcaacgcgagctgcggcacggctcgagcccctggcccccggcgcattttttgacgacgtgcccgtccgcccgcctaatgccgcggacaggcaggtagcggcctgtagcagccacgcccggaggaagtccgatgcaggatggaagcgccagtcccctgagccccgaggctccgtcgtccccggcggccacggaagtgtctgtcgacgtccgaggcccggacgccgacatcgtctccacccacgtcctggtccccgaggagcaggtccagaagctgcgcgagctggcncggcggacccg

SEQ ID NO: 699 - DNA, 5207 bp, Myxococcus xanthus
agctccccctccccggaagaggacctgtccgcgctgtccttggaggcgcagggagatgaggtacgccgccgcatcatcgcggaggccaacttcgagttcgacctctccgccgggccgctgctgcgagtcggcatcctgcggctcgatgcgcagcacgcactggtgctgttgaccctgcaccactccgtaacggaccagtggtccctgggcgtgttcctccaggagttgatggcgctctacaaagccttcgaggagggccagccttcgcccctgccggagttggaactccagtacccggactacgcgcggtggcagcgcgagcagttcgaaacgcgggaactggccggtcagctcgattactggcgacgacagctcacgccgcagccttccgcgctggtcgttccgtcggaccatccccgaccggcgctgaagacgtatcgcggcgggtggcaccacttccggctcgagccagagctggcacggaagctcaagcaactggcgcagaaggaaggcgccacgctcttcatggtgctgatggcggcctaccagacgctgctgcaccgctacagcggccagcaggacttcgcggtgggctcgcctgtcgccaaccgccgggcccccgagctcgaaccgctcatcggattcttcgtcaacatgctggtgatgcgtgcggatgcctcgggggacccgacgttccgctcattcctgcaccgggtgcggcaggtctgcctggatgcctactcacaccaggacgtgcccttcgacaagcttgtggaggagctgcaaccgccccgcgaccccagccgcaatccgttcttcgaggccgtcttcgtcctccagaacgtgcctcagccggccctgcggattccgggcctgctcgcgcgttacgtggagttggatctgggcgtgtcccagttcgacctgctgatggagctgcgcgaggaccggccggaccggttcatcggccgcatcgagtactgcgcggacctgttcgacgcgaagaccgtcgaacggatggatcgccactacgtgcgcctgctggagagcgtggttgagaacgccgaccagcgactctccgagctgcccctactgcgcaccgaggagcgtcaacagctcctggtcgactggaacgcgaagtccacggcgtttccacgtgagacgccgattcactcgctcttctccgagcaggcggctcgcgcgccagacgccgtggcgcttgtcagtggtgagaccctcgtcacctatgcggagttggagcgtcgtgcgaatcaactcgcgcatcacctgcgcacgtacggcgtttcccgaggcacccgcgtgggcctgtgcctggagcgctctccggacatggtggtgggacttctcgccatcctcaaggccggcggcgcctacgtgcccatcgatcaccactaccccgctgagcgcatctccttgctgcttcaggaggccggcatcggcgtgctcgtcacgacaaagccactggcggaagggctccctgcatccaacagcaagcatgtgtgtgtagacacagacgcggacgtcatcaccgccttgccgcatgacgcgcctctgcccgcgaccgtgggcggtgatgatctcgcctacgtcatgttcacctccggcagcaccggccggcccaagggcgtctgcattcctcaccgcgcagtctctcgcctcgtcctcgccaaccccttcatccacttcggccctgacgaagtcttcctccaactcgcccccgtcgccttcgacgcttccaccctggaactctggggcgccctgcttcacggtgcacgcctcgtcctcgctccgcctcacacgccttctttggacgaactcgccgcactgctgactcaccaccgcgtctccaccctctggctcaccgctgccctcttcgagcagatggtgcttcaccagggcaacgccttggccggtgtccggcaggtgctcgctggcggtgacgtgttgcctcctcttcgcgtccgtcagcacctggagcgcattcccctcggcgccgtcctcgtcaacggctacggccccaccgagaacaccaccttctccgccacccactcccttcgcgcgggggaggccttcggcacctccgtccccattggcaggcccctggggcactccacggcctacgtcctcgactcgcgcatggagcccgtccccgtcggcgtccctggcgaactcttcgtcggtggcgacggcctcgcctggggctacctaagccgcccggagttgacggctgagaagttcctccctcaccccttctcctccgccccgggcgctcgcctctaccgcaccggcgaccgcgtccgttggagggcggacggctcgctggagttcctcggccgctccgacttccaggtgaaggtgcgcggcttccgcatcgagctgggcgaaatcgaatccgtcctccagcaggctccaggcgtccaggaggctgtcgtcctcgctcgtgaggacgccccaggcgacaagcgtctcgtggcttacttcgtgcccaccgccgcagcgcggtcggaagaacaggccgcgaatgctgtgggcggcatccgcacattcctcaaggcgcggctgcccgaatacatgctgcccgcggtgttcatgccgctggaggtcctgccgctgtcccccaacggcaaggtggaccgcaaggcgctgcccgccccgtacgcggacctgaatcggacaggaacgccgttcgaagcaccgcggaacgcctccgagcagacccttgccgatatctgggccgaggtcctgggcctccgtcaggtcggcatcgacgacagcttcttcgagttgggtggcgactccatccgcagcatccaggtcatcgcgaagctgcgggaacaaggcctggaactgcccacgctggagttgctccagcacccgaccatccgcgaactcaccggtgtcatcaaagccacgagcgtggcccccgcgggccagatcgcgcccttcagcctcgtgtccgaggcagaccgtcagcggctgcccgaggacgtggaagacgcctacccgctggccgcgctccagtcaggcatgttgttcgagagcgcgctggatgcctcagccggcatctaccacgacatgttcagcttccatgtggagatggcgctgaacgaaccgctgctgcaacaagccttccgggagctgttcgcgcgtcacgccatcttgcgcacgtcgttccacttggacggccacgaagagcccctccagctcgtccaccgtgaagtggaaccgccgctgaagttcgaagacctccagcacctggaggccccccagcaaacggcctacttgcaggtgtcggcggagaaggaacgcgtccagccgttcacctggaaccaggcgccgctgatgcggctctgcgtgcatcgccggtcggaaaccaccgtccagctgaccatcgtcttccaccacgccatcctcgatggctggagcgccgcgacccttctctcggaactcttcggccgctacctcgaattgctggagggcactgaaacccctgccgcgccgtccccggccgccacctaccggcagttcgtggccttggagcgtgaaacccagaactcccatgagagcgagcggttctggctgcggcgcatggatggagtggacgcagcaagtccgcgcccgctccggtcccgggacgacgagcgcgtcctacacacccacgacgtgcgcatccccgggcctctccagcaggccttgctacgcgtggctcacgaggcgggtgtgtccctcaagacggtgctgctggccgtgcatctgcgcgtccgcggcttcgtcgaaggcagcacctccgtcgtcaccggcatcgtcaccaacggccgccccgaagtcgtcgatggtgagcggatgattggcctgttcctcaacagcgtccccttcccggtgacgctgcctggaggcacatggctggagctcattcagcaggtcgcgaagcatgagcaggagttgatgccgcaccgccgctaccccatggcgcggctccagcagaagcgcggcggtcagcctctgttcgacacgctcttcaacttcatccactttcacgtcgcgggggggctgtcccaacagaaggggctgcgcttcgtggacgagatgctgggcgccgcctggatggaactcccgctgggcgtcaccttcacccaggatcccgacacctcgtcgctatcggtctccatcgccaccacgggcactcggcacgaagcggagcggacgcgggagttggggcagtactacctgcgcgcactggaagccgtggccgcgggaccaagtggccgctacgagcaggcagcgctgctcccaccggtcgaccgcgacacgctgctggaggcgtggaatgccacgcgccgggaggccgcctgggaaggctgcttgcacgagcggttcgaggaccgtgcggccctttctcccgatgctctcgccgtgctggacgatgagcactcgctcacctatgccgaactcaaccgtcgggccaaccagctcgcctgggccctgcgtacccgaggcgtagggcccgaggtccgagtgggcctctgcatggagcgcgcggtcgacatggtcgtaggcgtcctcgccatcctcaaggcaggcggcgcctacgtccccatggatccggcctatcccgcccagcgcctggcctacatggtgagtgactcgaatgtcagctgcatgctcacgcagcagcgagtcgcggacaagattgccgggcacaaggtggaggtcctctgtgtggatgacgcagggctcgtgaacggttcacgggacgcgtccaacccgccgcgactcagcagaccccagcacctcgcctacgtcatctatacgtcgggtagcaccggcatgcccaagggcgtcatggtgcagcacgcctcggtgatgaacctgcgcgcggcgctggcagccaccgcctacgcaggtgtgggcaagcccctccgcgtcagcctcaatgcgtcgctgtcctttgacgcgtccgtgcagcaactggtgcagctcgcggacggacatgcgctgtgcgtggtgtcacaagcgacacgagaggacacccgcctgatgctcgcgtggttggagcggaattccgtggaacgtcctggactgcgctccctcacaactgcggctgcttctggacgagggtctggccgcacacagccctttgcgcgtactggccggcggcgaggcactagacgaggcgctctgggcccggc

SEQ ID NO: 700 - DNA, 4561 bp, Myxococcus xanthus
tgtgctctcagagggccgtttggagctgacaccactggtgagcctctcggtcaacgaccccttatattctaagggggggctgtatgtccggggcgcctactacctgggggacacgctggctgtgtgcgaccgggtctcgctgatgcaagtggtgccgtcggactacgggcgacaccgcaagcggaccttcaacaggaagatctactactcggtgccccagtgggacgggatgggcgacgcggagtggagacccatataccgaaaggtggcgttcctcaactccatcctccacttcgacggctacctgctagcgggcgcgggcgtggtgaatacggagacctcggcgctgccggggcgaggcctcaacccggccgctgacttgggcctgggcatgcgcttcgtggctcaggactacatcgccgtcaacgtggccctcatcaacacctcttatgtggatcagcccctgggtagcagcaagggcgccatccagaacgtcatgacgctcaacgcaggcatctcgctgttcctgccgttcaagtcgacggggagggactcggaatgaagcgtttcttccgtgtgctcctcgccctctgtctgacggcgcccgtgctgggcttcgcccagaccaccgaagaggcggaagccggcgacgtgtcggaggtcgacaaggaccggctcgggcccttgcgcgagcgcgtccggccggtctccggccacgtcttcctcaagaagggccgcttcgagttcagcccgtccgcgacgctgtcgctgcgcgacgcgttctacagcaagtacatcttcggcggcacgctgacgtaccaccccatggagacgttgggcgtcagcctgcgcgtgggctacgccatcaacacggtggccggcgcggcgcagaagtgcacgttcggggacggcggcgagggctccacgcgcggctgcgtgccgcccacgctcgacgagctggacgggaacgcgccggggcagatcaagctgctgggcggcgcggacgtccagtgggcgcccatctacggcaaggtgtcgctgctggctgagaccttcgtccacttcgacctgtacggcatcgcgggcgcctcggtggttcagtaccgcggccccggtgactcgctgggcgcggaggcgcagaactacctcacgccgggtgccaacctgggcgttggtgcgcgcttcttcctcaaccggtggatcacgctgcgcacggagctgcgtgacctcatctacgtggagaagggcaccgaggtctctggcaactacctgcgcaaccagctcctgttcgagctgggtgtctccttcttcttcgggtccgagtcatgatgcgctccttccggctcatccgcgtcgccgtcctcgggctgtcgctcgcgtggacggcccccacctacgcgcagaacttcgagggcctggacctctccggccagtccaagaagaagaagcgcaccactcccaagaagaagcccacccgcaagagccgcgccgacaaggcgaagcccgcgccggcgcaggatgacgacgcggacgacgatgccgccgctgcttcctccagcgaggcgcccacgagcgtgtctcccgcggagacggcacccgcggcggccccttccacgcccgcgcccaccccggcttcgcctcccgcgaacaccgggagcatgggcatgggcctggacctgacgcaggaggcgcccaagccggccgcgcccaccatgtccttcgacgcggtggacgtctccggcaagacggcggaccgccagcgcctggacgtggccgtcagcctcttcaagaacgacgagtacgaaaaggcctccatggcggcgcacgagctgctggaggatccgaagctggcgggcctgcacaccgaggcgcgctacgtgctggccaagtcgctctaccgcatgggcatgtaccactcgtccctgggcgagttctccaagatcctctccctgggcccgtccaccaagttcttcaagacgagcctggagtggctcttcttcatcagccgcaagacgaagaacgagacggtcatcctcgacgagattgcccgtcacgcgaaccaggagttccccgagaagtaccgcaacgagttccgctacctgctggcgcgctaccacttcgtgcgtggccgcgcgctggaccaggtggggcagcccgaggaagccgacaagagcttctcggaagtgaagcggctggcgctgaccattccgcgcaccgacccgttcttccctcgcgccaagtacctggagggcctgtccttcttccgtaacggcagccgtcagaaggacgcggcggccaagcgcgccaacggggagatgctggccgccatcgaggcgatgaaggaagtcgtccgcctcacgcgtccggcgccgggcaagacggcggaccaggcgaagctggacaagtcgctgcgtgagctggccttcatgcagctggcccgcacgcactacggcatgcagcagaaccgcttcgcgctcttctacctgggcaaggtcgagcgcggaaacacccagtggctggaggccctcttcgagtccagctgggccaactaccgcgtgggccagtacgagcaggcgctgggcagcctcatcaccctgtcgtcgcccttcttccgcgaggagtacttcccggaggcgctcatcctgaaggcggtcatctactacgagaactgccgctaccgggagtccaacatcatcctccaggacttcgagcgcacctacctgcccgtgcacgaccagttggaggcgctggtgaagaagaacatggaggccagcgagtactactcggtgctgtccgacgtgcagaagaagaacaaggacggcctggagaagaacgagacggacatcatcctggagcgcatcctccggctggccctgacggaccaggacctgcgcaagacgaacgactccatcctcgagctggaggcggagatggatgccttcgcgaaccgggcggacaccttcaagtactccgagctgagcaagtccctgctggaggggctcaaggtgcagcgcacggcgctcatctccaaggccggcatcatggccaagggcaagctggagacggagctggtggcgctcaaacagctcctggccaacggcctgcgcatcaagttcgagacgaccaccaaggagaaggagttcctggaggagcagctcaaggcgggcggccgcacggccatcgtcaagaagtacaagtactccgtcgccgtgcaggacgaccagctctactggccgtacgagggcgagtactggcgtgacgagctgggcacctaccagtacacgatgaccaagggctgcatcgagcgcgacaccgcgaaccggaaagtccagtccgccgaggcgatgtaaagcccttcggacccgggacttctcccccattcgagccgccggggcgctatcttcgcgctccggcggtttttcttttttcagcaaaggggcaactggtggtgcggcgggcggcgtcactccgtgtcgtcttcggaatcgtggcgctggacctcatcgggttcggcatcctgattccccagttgggggtgtacggcgtgcggttcggtgcctcgcccttcacggtggggttgctcatctccgtcttctcgctgatgcagctggtgtcggccccgatactgggccggctcagcgaccggtacggccgccggccggtgctgctggtgagccaggtgggctcgctgctggcgtacctactgttcgccttcgcgcagtctctgccgctgctcttcctggcgcgtgtcatcgacggcatctccggtggcaacatctccaccgcacaggccgtggtggcggacatcaccacgccgaaggacagggcgcggggtatgggagtcattggcgcggccttcgggctgggcttcgtgctgggaccggcgctgggcggcttcctgggcgcctggggtggcaacctcgccatcggtctgttcgcggcggggctggtggccatcaacctgacgggcacgtacttctacctgccggagacgcgggtggaggggcgcccgggggaagggcacgcgcgcacgctgaagggcgccacgctggccatgagcctgcccgtggtggggcgctgcctggtgctgatgctggtgttcaccaccgccttcgcgcagatggaaggcaccttctccgtctacctgctgacgcgcttcctgtcgtccgggccggtgccgctccaggaaggcgggctgttcctccgggcggcggtgacggacctggacgtgctgcgcgaggccagcctgcgctccggttggctcttcgcggcgattggggtgatttccgcgggggtgcagggcggcctggttcgccggctgacgggtgggcccgggagcgcgccagggcgcgaggcgctgctggccacggtgggcttcggactgacggcggcggggctggccctgttgcccgtagcgccggattatgcgtggctgttcccggtgatggggttgttggcggtggggtcggcgctggtgacaccgtgtctgtccgccctggtatctctgcatgccccgccggagcggctgggggcggtgctgggggcgtaccaggccttcggc

SEQ ID NO: 701 - DNA, 5515 bp, Myxococcus xanthus
aggaacggatgtggtgattcgtggccacgggttcgccatgggcgcgacggtgagcatcggggggacggccgcgacccacgtcaatcgcgtgtccgacaccgagcttcgcgcgaggacggcggcgcatggcgcgggcctcgtcgatgtcgtggtgacgaaccccaacacaccggcgatgacgctcgccaacgggttcacctacgccaccgtgacgagcattctccccgccgaaggccccgtcgctggcaacaccgtggtggtgatacgcggggacgccttcgcggacaccaccacggttgcgttcggagggacgcccgcggccgccgtcgcattccaatccgcgcaggagctccacgcgacaaccgccgcgggaatcgcgggcccggttgacgtggtggtgacgcgggcggtgggtggcgcggagcaggtcacccacgggttcgcgtttcgcgccgcgcccaccatcgcgagcgtggctccgccggccggccccgccgcgggagggacctccatcacgctcacggggaccggcttcgtcgacggcgcgaccgtcaccctcaacggcgtcaacgcgacccacgtccgggtgctgtcgccgacgacgctcaccgcgacgaccgcggcccagctccatggcacggtcaatgtgatggtgaccgtccacggcgtgcccagcgggacgctcgtcaacggcttcacctaccgtcaactgcccacgctcgccgccattacccccgcgcaaggagcgctcgaaggtggcagggcggtcgacatcaccggggcccggttcctggacggaatccaggtgcgcattggcggagtggactgcacggatgtcgccgtggtcaacgcgggtcttctccgggcgcgcgtacccgcgcacgtcgccggggcgtgtgacgtccaggtccagaacccgggcgaaccgctcagcctgcccttggcgaatgcgttcacctacgtggatgtccccactgagacgggagacaacgacgtcgtcttcctcatggacggagaggagtacttcgaggagttccgcctcaacctcgaagccgtgcgacaggcgccgcgacatgcgctcacgtacgttcgcctcgcgttctggatgattgaagcgtcagttaccatgggcgaccgggcccacttccgggtgcccaatcacaccctcctctcctatatcgaccgggtcatccgcgcggggcacgacttcgacatcatcgtctggcgcccggcgaaggtggaacgggtgagcgagggcaagggcgtcgccgaagtgaatgaggctttcgcgcaggccgtggcggaaatcgaccgcgccgcggccgccgcgggcccgggggtgggacgcgtccgcgtcttcctggagacctacgaaggggaaatcggggcctcgaaccaccagaagattgccatcttctccgtcgcggggcagcgaacggtgctcctcggaggcatcaacctttctccctcctacttcgcgcccaacgatcattcgaacaatcagacctggcacgacgccgccatccgtcttcgcggccccgcgacggatgacgttgaagccgagtggatgcgccggtggcggcgaacctcccaaatcgaggagcggtggatctggaacagctttggaggaggcggagacatcctggcgcgaggattcgcattcaacgcgagtcagacggttcgacgggaagccattcagattcaggagaaccggacgcttcaggccccccaggccgccaacatcaacgtgagcatcgccttgacgcgctcagagggaaagacgcgctatcgcaagctgcgcgacctgctcctggcgcgcatcgcggcggcggatcagtacatctacctggagaactaccacttcgcggatccagagattgttcgagccatctacacgcgccacgaagtccgccgacaggccggccaggagttgcgcgtcatcgtcatgatgcccacgggtggcggtgcccccggctatatgacgcgtcgctcgtggctccagattgtcctgcgactccgcagaccgaatgggacccactactgcagccgcgtctactacatggtgaacggcgtcgagcagcacatcgaccgggtcgactgtgtcacgtggaccgtggtggacacgtaccaggcgaacaacccgacggcctcgagctggttggaggccgacaccctcacgttccggagaaatggaggtgggggcatcgacaccgtggtcaagctcgaagacatctcgcgcgtggattgcgcgctccatatctacacgtgcatgaacgtcaccgccagggcgcgtatctacacgcactcgaaggtggcgatcatcgacaaccgttggctcatcgtgggctccgccaactggtcgtatcgcagcatgcaatacgacggggagatctccgcgttcatcgacaaccccgcgcttgcccagaacacgctccagcggctcctcggccactacgacacagccaccccgctcaccgtgaacaacatcgaggccgaggcctgcaccaacctggcgggggtattgggcacgaatctcgtgaggcaagccgccatcatcaatcactacgtcgtccttccactcgggcacaccacccaacccaacttcgggcttccacgcgtcaggcccggcctgatggaggtccccaactacacctggtattgagacaactcaccggccgcccagcttctccagcatcttcaccgcgttggcgttcttggggtcgagttccagcgatttcttgtagcgcatgacggcgtcatccttgcggcccgcctcggcgtaggcctccccgaggctgtcgtgggcgttggcatcctcgggatagaacgccgcgttggcctcgaacaccttcacggcgtccgcgagcttcttctggcgcaagaacccatagccaatctcgttgaggattcccggggacaactgggcgtcagtcgcctgcccctgcttgcggtccttgaaccaggccagggcggagtccacgccctggagcctgaccagcaggtccaccgtcgtggaggggctgtccggccgggcctcctccatgcccttccagccatactccgccaccgcgctggcgagcagcctgtcaaagaggcgcgagccgtcgtccgagttcgtcatcacggcgattccgctccctgaatccgccagggccatgaggaaggcgcggtagcccgcgttggcgccgccgtgcccgaaccaggccttgccctcctcgcgcgcgaagccaatgccgaagttcgaggactgagcggtgagcatctgcctcgccatcgccggggagacaatccgccgggacttgccgttccgggccttggagacctccagggcgatgcgcgccaggtcggaaggcgtggtccacagccccgcgggggccatctccgggtaggtgtgccaccgtccctccacgctcgtgccacctgaacgagtccccacggcggcgcgggcttccagcgccttggggagcggctgctcgaaggtgctgtccttgaggcccaacggggcgaagaccgcatccttcatgatgcgcgggaagggctgctggagctggtcgacgagcatctgctggacgacgaccgtgccaccaccgctgtagcgcgtccgcgtccccggcacggtgtcgaccctcacggcgccgctgttcgccggagcggcgccgtccagaatctgctgcgtcgtcggcacggccgctccctccgcgtaacccgcgaagccgtgcaccgtcgtgcccgcgttgtgcgcgagcaaccggcggagggtgaccttctgctccttcgtgaagtcgttctccggcaccttccaggagatgagcgtgtcgttgatgtccgcgtcgagcgaccacttgcgcttctccgcgtggcgcatggccgcgagcgccgtgacgggcttgctgatggaggccgcctggaagagcgtgtcgatggcgacgggctcgctgccgccggactgcttcacgccataggtcttcgcccagacgagcgcgcccttgtcgaagacggcgatgctcagcccaggcaccgagtacagctccatccattgctggagcgtcaggtgccggggggcctcgcctggaagcacgatgggagcgagccccgcctccacccgcgcgatgcgtgcggcctcagagggccgcgcgagccactccgtagtgggacgtcgcggggcggcggcggtgagcagcacgagggcggcgaagctggacaacgccgtcgcgacgatacgggcaggacgcaatggggacatggcgtgagcgctacgaaggagttcgcagttgattgtgcccgcgcggacgatttctgggtcgttccggaccaggcggccacggcacgctgcgtgtgcgcgaggctactgcttctggaactccggcgagcccagcaacaacccggcgatgagcgagacgtccacggggcgtgtctctcccacggcgctggcggcctcggcgcgcttcgacagcgcgtcgaggatggtcgctcgcgtctcctccgacggaggcgcgcccagcagcgcctggcccagcgagtccacccaggcgcgctcggtgggctcggttggcgtggccaacgccttcaacgccaccttcgtccccggcatccgcccggacaccagctccaggctgaagttgagccgggccaccagggagccgctgttcacccacggagctgccccttccggaaagcccgtgggcgctggggcccggaagagcggctcgcccatcttcgccagggacttcaccagccgggggcgcaccgtcacctccgcttcggtggcccgcagcgaggacaccacgaactcgaagggcgtcttcaccttcgcggcacgcgcctccggggcccagaactccggcgacaggaagagcgcgcggtacacggtgggcaggtccccgcccgagtcgaggaacaccttcgccacccgctccaccagcgccggcggcggcgtgtccgagacgaagcgccgcgccagcttgctcgcgacatggcgcgcggtggaggggtgtcgcgccagcaggtccaacacctgctccccatccgccacgctccgctgaccggggatgcgctgccccagcacccacttgtcgtccgggtcatgcgcccggcgacggaagtagaacgcaggctcctggcgcggcttgcggatgctccagcccgtgaaacagcgggccacctcgcgcacgtcctgctgcgtgtagcccccctccacgcccaacgtgtgcaactccagcagttcgcgcgcgtagttctcgttgaggccgggcttcggcgcttcgggctcgcgtgacacgcgctccggcatcccgtcacggacgctgcgccagttgtccaggtagaagagcatcgccggatggcgggccgtggcgcccagcagctcccggaagttgccgaagacatgcgggcggatggcatcgcgctcgtaggccgtcaccatccaccgcaccgcgcctttgtccgaggacacgttgaagtggttgaaccagaagtccaccagcacctcttcgagctggttgggactctccaccgc

SEQ ID NO: 702 - DNA, 6402 bp, Myxococcus xanthus
gccctgaatggccgggcgcaaggcgcgatccaggggaagcagcacgccttccaccagctcgatttgacggtcaagctcggcgggtgacggccccgcgagcgcggtgcgctgcaaggccacaacgggctcgttggagaacacgttcacagacggctccgccagcgcggtgatggcacgagagagctgctccatgtacgcaccgaagtcaggcgaaggcgccagtgccgccatccgcacggtgggcgcggactccgccggaggctccggcggacgctccgactgcgccgccacccgctccgtcagcgccttgagcaggtgcgccatgtgcttgaggtacggcgtcaggtccggccccgcggccacgggcgcggcgaccacgggcgccgggatggccttcgcggccttcacggactcgcggcccacctgggccacctccagcacggcctcgcgcagggactccaggcgaggcagcacctccaccacgggccccggctgctcgtcacgcgcctggctggcggagacgtggttggccgcctgcaccaccgcgtcccgcaccgcgcccagttgctcctcgatgccactgagctgaccggtgacgcgggccacggggtcgtcgtccttgccgcccatgcgcttcacgcgcgcgaagccctgcttgatgtcctcccagcgcttcgccttctccggcgtcaggcgcccgcgcatctccgccagcttgagcaggttctgctccgccgccgtcgtcagcgtctgggactcgccttggtagtggtcgtcgatgagccgctcgagttcgtcgtcggtcatcgcggagacaatcttctccgtcagcttgttcatgttgcggtagctgccctgcaacttgaacgcgggctcggagcggaagcgctcgtcctgcgccgccgaggcgatgtactgcaggttcaccttcagcagcaccgactgggcccggaacatgcgctggaacaccgcgatgatttcctggagctccgccgccgcgtagccgtgcttcagctcgcccgtctggacctcctcgccctgcgccatgcgaatgaggcggtgcgtgtccgccgggtcgcgcgtggccagcggcgccgtcaccgtgttcgacgtgagcgcgttctcgatgtagctgagcgcgaacaggtgctccttgccgtcgaggatgtcacccaggttgtaggtgtccgcgcggttggcgagcatgtccgggatgcggaagcgctcacccgtctccgtgtacgggttgccggccatgaccacgcagaacttcttgccgcgcaagtcataggtgcgcgtccggccgttccacacgccttccacgcggcgctggccgtcgcacagggagatgaacttctggagcagctccgggtccgtgtgctggatgtcgtcgaggtagagcatcacgttgttgcccatctcgaaggacaggttgatgcgctccacctcctgccgggacgtggcgttcggcgcctcggccgggtccagcgacttcacggagtgacccagcgccgggccgttcaccttcacgaaggtgagccccaggcggctggcgacgtactccatcagcgtcgtcttgccgtagcccgggggcgacatgagcagcagcatgcccatgcggtccgtgcgcttgccctcgcccgccgcgcccagctgcttcgccaggttggcgccaatgagcggcaggtacacctcgtcgatgagccggttgcgcacgaaggacgacagcaccttcggcgtcagctcctccaggcgcagcttgcggcgctcgcgctccagcaagtccctcagcagcgcacggtacgcctggtactggggcacccgcacctgccggaactcgcccaggcgcgccaggaactcgtccaggcgcagcggcagcttccggtcctggatgcgcgaatgattgcccagcagcgcggagacctcggtggccgtcagcgcgcccgccgtctcgcggtccagcttggagccggtgagcagcagcaccgccgtctccagcgccacatggacggaatcccccggacccccctcgcgctgcgcgaggtagccgtccagccacacccgggcgagatccagccgggcgcccaggtccttctccaggccgcgcaggtcgtcctcgaacgcggaccgcgtcccgtgccggtcgagctcatgcaggaacgcgtcccgcagcgccaccgcctcgccgctggtggtgaagcgcggacgctccgcgcccagctcctcgacgaggtaacggcccgcctgccgcggctcggccggtgagtgcgccaggccgttcgcagtgaggaacgtagcgatgcgctcgcccagtgcctcacccacctcggccatgctgccgccggacgcgaaggtggtgcgcagccgcgccaggctgcgcgcgcgccgctggaacacggtgcgggccgcctcgtccgcgtcgaaggcccagtacagcgccgcccaggcgcgcggcaccggcgcgaagcgcaacaggccggcgccctggtgcaggcccagcaacttctccaggatggagaccgcgtccgcgtcatggacgccgcgctcgtagccctcgtcgaagcggtcggccgcgtacgcgcgcaccttctccagcagcgtgccgctgatgagcgcctcgtgcagcgcatccagcgactggccacgcttgccatcctccgcgtccgccaagaggcagcccgcgaggtactcggcgcggtagacagccggtgactcggagaccaggtgctgctcccagaggtcgcggtacttcagcaactccgcatcatccaccttctgcgcgtagtccgtgccggtgagctggaggtacagctcaccgtcgcgcggaagcagcgtcaggtccagcggctgcgtgttgacgttgaagcggtacgtccccagcttgatgacgttgtcgccatccgcgaacaggtcctgccggtcccgtagggcgcgcagcgcgtcctgcttggcggacttcacgcgcgacatcacctcgtccgcgcggacgctgtcctgaagctccatcagctggtcggccagctggcgcagcttgaggatcatcgcgtcggaggcgtagtagccgttgagctcgtcgtccgtcttgaaggacttggcccggcgctgcacgccctggaggatgcgctccgcggccccgaagaggctctgcgcgcggcgctgccgctcgtccaacagtgactgcttgcgcgcgccaaaggcctccagcagctcctcgcgcttctgggtgatctgctccaggaactcgtcgaactcgccgaagcggccctccagctcctccaactgcacggtgaggcgggacatcgcctcgtcgcagcgctccgggctgtccgcctgcgacagcgagctttcgatgctctgccccagcagcttgaactgcgcgccgaactccgcgcgcttctcccggccggacagctccttgcgcttggccgcgaggctggcgcgcacgcggttgaggcggctgaacagctcggagatgccctccaggattcgcgcacgggccagcgggtcaccgacctggagaccggctacgacctcgaccaggacctacagggcgcgggccgtccgctccacttcctcacccagtggccccagctgcaccgacgtgtgcaccggctccagttgtgccagcagatggtccacacgcgaggccaggagaggcagctcctcaaccgtatggaggaactccacgcaggccgatctgacccggagggacccctccaccaccggggtctccaggacttccacgcgtcccaggtccatgtagcggatgtccttcaacgtaatcaggtgcccgcgctgcttgcgcaggtccgccagcgcctgcatgaaggcttccgcgtgcgtgaggttctccggctggacacgcagcagcagcgtctcctgctccacctccgcggccgccagcgactcggtggcgcgcttctgcatcgcgaccaccttctcgaactcatcaatgatgagctcggcggtgcgccgcagggtctccaccggttcctggaggcccgtctcctcatggcccagccagtagtacgcgtccagcgcgcgggtggccgaggacaccaggtcctcatacgtgcgccgggtgggcttctccgacttcgcgatccgctgaatcgtcagcgcgtcggagatgccgcgcaccagctccgcgttgcccaccttgcccaggtagcccggggccggcggcgtccccgccgcgtgctcggcggatacgaacggggtctgccacacctgcatcgggtggacgcgcgtgggctcatccgacgcggagcggaagatgacgagctgcccgtcggagaacaggctcatgccgtgcgcgaccagggggttctgcacctccttgcgcaccaggttgtacgggaagaggacgtagcagccgtccgtccgccggtggaagatgtagagcacgtcctcgccgttgggcgagcggatggcgcgcttgaactccatgccttccgacgccgcggcgccgtcgaagaccttgaagtcccctgtctggaggtaatagccgcccgggaagacgatgccctggtcctccggcagccgcacgcacgcctgccccatggcatcgatgcgcaccacgtgctgcgtgcgcgagttgaagacgaggtagcggtgcgtcttctcccggaacggcagcacccgcagcaggatgagcgtgcccacctgggcccaggcgaactcggcatcgtccagcgactggtccgggtcgtccacgggctcgctgtagatacccatgccggtggaggtgttgtcctccaccttgatggtgaggtcgcccttcaccgtctccacgaacacctggtccagcacgttgacgtgcgggtgctggccggtgacgtagttgtcccgcgtggccaccgtccactcgaagtcgtgcgacggcgggaagacgtggtcgcgctcgccctggttgtccaggtaggtggcgcggccctccaggtccaggctgaagcggaagaccttgatgtcgcgcagcgactggcccgtctggaagacggccagcaggcgcgagtccagcttgcgaatctgaaggagcttcgcgtccttgtagtacttgtagagctcgccgaagtccttcacgaagcgcgggtccgccaggaacccgccggcctcggaggtgggcgccgcggagaagtcgtacccgtcggccgtcttctcgaacttgtgcagggagaacacgtcggacaccgacgtctcccgcttcaggccgatgaagacgttgtagccgaagagcaggtacttgccgacgctggcgatatcgcacgggacgcagttgttctcggtgcgcacccgctcgttgccgatgaccgtcagctcggtcccaccgaagagcgccttgcgccgcccgttgaggtccgtcgccttcgcgcccagcacatccgcctgcgacaggagccgcgaacggatgacctcgtagctgccgccttccagcgccgcctcgcccgcgggcgccgcgcccttgccaccgtcagttgccatgagtgttcaccggaaatgcgaagacccccacccccgcaccctcccgagcggaggggcgccaccccggaggggaggccggagtgagggtcgtcttacggccgtgccaccgccgcctgttcacggcggtggcccattgggactgtcagccctgcttgtcgaccgtgcccggccgcgccacgtcttccaccagcgccttgaggccggccgaggtcgcggccacggggctggccgccatcttgtgcagcagcgcggccacggccaggttctgcgcgtcgttgctcagacccggcttggagagaatctccttcaggtcggccggcaggtccttctcgccgttgaggtagccgcccagcgccgtcttcagcgcctcgccgtggtccagcgcgccgtccaccgccgtgccgaacgacaccgccttgacgaagcgctcgaagaactggccgtcgccaccgacgatgttgaacttcgcgttggcgaacgccttggccagcacctcggcctgcgcgtgcgcgatgtccttcttcgcgcggatggcctccagctccacgtcgcgctccttgttgagcttgaggcggaactcctcgtgctcgcggccgacgccgtccatcagcttcatggacgcggccttctccgccagaccgcgggcctcggccagcagcttctcctggatggcagcggcctcggccagctgcttctcgcgcgtggcaatggcctccgcctcgccgcgcttctggatggcgctggcttccgcctccagcacgcgcgcctgagccaggcccttctcctgcgcacccgcggcctccgccagcagcttctcgcggacgatgttcgcctccgcgtggccctgcttctcgatggcgcccgcctcggcttccttcacgcggacgttgaccatgccgagcttctcctgcgcctgcgcgt

SEQ ID NO: 703 - DNA, 5467 bp, Myxococcus xanthus
gcatcgggcccaatggaaatgcccgactccgtcacggccatctgcccggcggccaaccgcgaactgcgcatacaggtccatccggcgcacttcgcgcttttcgatgaacgcctcgggctcgaagtccttcacctcgcccgcgatgcgcgtgtcgattttgccaacgtcaaagcgcgtgacctgggcaatacccgacttgccggcgatcaacgcctgccagttcttctcggttccggttcccagagccgaaacaagcccggttccggtgacgacgactcgacgttgtgacacggtcctctccggtggcgcctgggacaccggggacgccgcgcatcacgcggcgccgccccgcaccccggcacgccgtggtgctacctacttcttgtgggtgttgatgtagctgacggcgtcgttgacggtcttgatgttctccgcctcttcgtcgggaatctcgacctcgaactcctcttccatcgccatgacgagctccacgatgtcgaggctgtccgcgccgaggtcctcgatgaaggaggactccggcttgatctcatcctctccgacaccgagctggtcggcgatgatggacttgaccttggcctcaatggttgacgtcgacataagtgtagaaccctccaggaaccagatgtggcccggctggcttcccggaccatgtcgaaagcgggcgcggtatatcccacgcccggcggcaatccaaccgtgggttacatgtacattccgccgttgaccttcaggacctcgccggtgatgtaggacgcggcgtcccccgccaggaagagcacggcgccggcgacctcctccggattgcccaaccgacccagggggatgccctccagcatcttctggcgcatctcgtcattgatctgatgcgtcatgtccgtcccgatgaagccgggggacacggcgttgacgcggatgttccggctggacagctcgcgcgccacggacttggtcaggccgatgagccccgccttggacgccgagtaggccgcctgaccgccgttgcccatctcccccaccacggaggtgatgttgatgatggcgccgcccttctgcttcatcatgggccggctgacggcgcggatgagcgagaaggcgcccttgaggttggtgtccaactgcttgtcccagtcctcgtccttcacccgcatcaccaggccgtccaccgcgacgcccgcgttgttgacgagcacgtccagccggccgtggcccttgacgatgccgtccacggcgctggcgcaggcggcgctgtcggacacgtcgaagcggatggcctccgccttggcgccctccgcctggagcagggccaccgtctcctgggccgccgcctcgttgcccgcatagctgatgaccacggtggaggcccccgccttggcgaaggccaccgcgcacgcccggccgatgccgcgcgagccacccgtcacgagcacgaccttgtccttgaagccgctcatgctgccacccccagtgccgcgagcgccttgtccaggctcgcggagtcctcgacgttgaacagctcgatgtccttggtgatgcgcttgaccaggcccaccagcaccttgcccggccccagctcgatgatgcgggtgacgccttcggccttcagcgcctccacgcactcaatccagcgcaccggcgagctcacctgctccaggagcagcggcaccacccgcgacgcgtccgcgttgggacgggcctccacgttggtcaccaccggcacggacggcgcggacacctggatgccgcccagcacctccgccagccggggctgcaccggcgccatcagcgcgcagtggaagggggcggataccggcaggggcatcacgcgcttggcgccggcctccttgcacttcaccccggcgcgctccacggccgccgcgtcaccggcgatgaccgtctgctcgggcgagttgtagttcgccggcgacaccacctgcccctcggccgccgcgtcacagggtgccttcaccttctccggaaccaggcccagcaccgcggccatggcgcccacgcccgcgggcaccgcctcctgcatgaaggtgccgcgcgcgcgcaccacccggaccgcgtcgcccaggtccatggcgcccgccgccaccagcgccgagtactcgcccagcgagtgccccgccacgaaggacggcgccggtccccgcttcgcgaacaccgcgtgcgccgccagcgacaccgtgaggatggccggctgggtgttggccgtgagcttcagcgcctcgtccgggccctcgaaacagagggtggagagcttctcccccagggcggcatcaaccgcgtcgaacacggcccgggcctcggggaacttctcatacaggtccttgcccatccccacggcctggctgccttgcccggggaacacgaacgcgaccttcgacatgcggactctgcctcctcttcagcggccggggccgcaggctggacgccctgttgccgtacctgaccaggttgagccagcaatttccgcgaggcgccccgccaccagcccgaggcggcctgcacgctccgggcgaaggctctaatcggaaacgcccgcgtctgtcgctctttttcccttcggatgggtcggaagccacgccgccgcgcgcccaatgcaacgcgtcaactccgcctgcacgcccccctccgccatggccagcgccgcgcccagcgcgttgaagagggcccggggcgtggagcgcccatgcgcgacgatgcccaccccctggatgcccagcaggggcgccccgccgtactcggcgtagtccaccacccggcgaagcccggccagcgcgggctggagcagcatcgcccccaccttctccgccagcccgccgcgccgttcgatggcctgacgcagcatgccaatgacgcccatgcccacgccctcggatgtcttcaggacgacgtttccggtgaacccgtccgtcaccaccacctgcacctcgccggagaagaggtccttgccctccacgtaacccacgaagtccagatccgagcgccgcagcagcccactggcctcccgggtgagcggcgtccccttggaggactcctctccattggagagcacggccacccggggccgggccacgcccatgcgcgcgcgcacgtaggcctcccccatgacggcgaactgggccaggtgcgtcggcttgcagtccacgttggcgcccgcatccaggagcaggcaccggccgccgcccttcagcgcgggaaagagcgcggcgatggcgggacgctccacgcccggcagccgtcccagcgtgagcaggcccccggccatgacggcgccagagttgcccgctgagacgagcgcctccgcccggccgtcccgcaccagttcgaagcccacccggagggaggagtcccgcttgcggcggaaggcggtcgaggcgtgctcgtccatctccacgacttcagaggcgtggtggacctggaggttggacggaggccgcagcttgcccagcaggggcgccaccttcgcctcgtcccccaccaggagcacctcatggccggggtgggcccgcgcgaagagcaccccaccctccacgggggcggcgggcgcgtgatcgccgcccatggcatccagcaccagcctcatccccaccctctccttgcccgcccggcgtccggccggctgtcggtgtccgtatcccacccgccggggggcgggcggcgcgcagcacagcaggaaccctgcaggggggcaacgactggctgatacgccctggagcacggccggaagaatggcgaccgcgccatgggcgttgtcaccgggcaccgtccgagatagacggtgcccgggagataacgggccctcccgcgttgccgcattgactcgggggcttcgagccgctagggtccgccgccttccgaagccggacatggagtacgggagccttcgtgcgaccgccccagaccggtttcgagcagagagtgttgcgcagggagccggggaccccggcacagcgcgaaagacattggactcaaccggtccggaccggcgcgaacgctccgggtcggggtcgaatatagaggtgagccgtgggtgtccccaagaagcgtacttcgaagatgcgtcgcgaccgccgccgtgcggccaacaacaacctgcggagcgccgtgcaggtgaccaagtgcccgaactgcaaggagccggtgatgcctcaccgcgcctgcacgtcctgtggccagtacaagggccgtgaagtggtcgctcaggccgaggcctgacacacagtcacatacagcgcccttcccgggcgctgcgaaacacgacgggccgcgtctccatccagtggaggccgcggcccttgtcgtttcagggccccctctcacgaggtggccctgcactccaggctcacttcagttgttgagcttgatgttcttcagcggcgccagccgcgggtccacgggccgggtctcacaggtgcaggcgacctcgttgcggttcgcgccgcactgcgagcacaggcccttgcagtcgtcccggcacacggcgttcatcggcagggccagcaggagctgctcccggacgatggggtccaggttgatggtcttcccgtcgaagagctcctgatccacgtcgtccagttcgaaggagccgccagactcaccctggctgcgctccttcttctccatggccttctcgtcgtcatccttgaagtcgtcgccccgagccagggactccggcaccaggttgagcgtgaactccacggggaccttcatggccacgtcggcgaggcagcgcttacaggggctggtgacgtccaccgtgaagcgcccctccagcagcacgccgccgctcagcttgcgcagcgacgccttcaacgtcgccggggccgtggcccggaatccggtatcctcgccggaggcagcgcctcccagcgtctcaccgagcagctcgagattgacgggctcctcgagcttcagccctgcgtccttgatttgatcaacctttacgagcatttacgctacttccaggccaaaaggggcgcgcaacatagagggtggcccctccagcgtcaacacgccctcgtgcaacaccgccacgaagatgtcaccgctccgtcacccccgatgggccggccttcgtggattctctcgataacgttttgataggttcgaatcgatgcacgcacatggctggcggttgcgcgggtgggccctcatcctggtgctgggcctgggtgcccgaccgggctggagccggcccctcttccctgagcctgttctctcgcagctcggcccggccagcccggccatcaccgaggcccgcgagcagttcgaccagggcgaattcgaagacgcacgtcgcaccatcctggaaggcctggatgcgccggacctgacggatgatcagttggtggagatgtaccgcctgatgggcctcacggccctctacctgggggacgagccccaggcgcgcgacgcctgggagaagctgctccagacccgg

SEQ ID NO: 704 - DNA, 5121 bp, Myxococcus xanthus
acgacttccagtgtgctctaaagccttgcgcatcttcttggcgaggttgaagaagagcgcccggtccttggtggtgaccttcttgatgagccactcgcgcagcggctccttggacttgttggcggcgcccagcatcgagcccaccgtctccgaggagaacacgccggggcccttggcccagatgtccaggccggccgcgcggtacatctgctggcccaccggggccatgatgtagacggtgaggatgatggccaggccggtgatgacctgggtgggcggaatctgctgcgtgcccagcgccgagcggacgatggagagcaccaccgaaatcttcacgaagctggtcgccatcatcagcgcgaagggcaccaggcccatggccgcgagcgccaggatgaggatgagcgggcgcgaggcgaacgagtcgctgttgacagcctcgttgaccaccgagtcggggatggccgcgcccccgcgcttctgagcgagcgcggcgaagggatgaacggcgaccacggccgcgaacagccagggcgggacacgcgggagacgggagcgggcggaggaagggaggttcacgggcacggtcgtcaggagccggggggctgggaaggcgggccaccactgcggcgggagaggagcttctggaggaatgggctcagtggaactgcattcgtctgcgggcgctgcgcgcggatgcgctccaccgcctccacatccagcttcgacaacagttgcaagccgccctcgccgccgcccaacagcaggtattcgtccgcggccttcaccacgaagaggctgcggcgctggtccaggggcagccgctccaccacggagaccaggggctgacggcccgcggccgtcccctggagccccatcagcttgcgcagtcccacattcagcgtgaggtagatggacgcaaccaccacgcccagcacgagcagcgtgcgcaccagcgtccagcccaggctgtccgtttcctcggactccgacagggtgtccccgcccgcgccgctccgggccgacttcgcggactcgcgagcagacaactccgcgtccagggcccggtccgcttccaacaactcgacgtcggccttggggtccgccttctcagcggccggtgctggcgtcgcgggcgaagcaaccgcaggtgccggaggcggggcagactccgcggggggcaccaccggcttcacggtgggtgcggacgtggacggagcctgggccatggcggcgggcggcgcgaacaccagcgcggcaccaagcaacaggcgcatgagggggggacggaggactgccatggctgggcgcgaggctagtgcatcggccggaggaccgccacgggcccacgcccggccggccgctcctgctcgcctgccctgccccgactgggactcagctcgccagggtgatgatgcgcacgccgagctggccttccaactccaccagctcaccccgggccaccaccttgccgttgacggacagctccaccggctctcccggcccccggttcagctcgaggacctgaccggtgcgcagccccaccacctgctgcgcggtgacgggcacgcgcgccagctccaccgcaatctgcaggggcacgtctccgagcaggtcgcttccgtccggcttgctcacatcgtccaaggccgccccttccagttccggaggcacgtccagctccgggttcgtgaagtcctcttcttcatccccaggctccgcgctcgcctcgtccgcggagcccgggtggcccggctctccttgaacgaaatcggtgatgcgcgcctggtagcgcccgtcctcgccgacgaacacctccgcctcggcccaccccgccgtccccttccccacccgcagccgcgcggtgcccgcctcgcccttgtccgtgcgcgccgacaacgcgtccaccagcagcacgtccttcacccgcaggctcgccaggtcctggccggaaatctccgccgagccaatctccgcgcgaagccaactgcgcaccgccgacaggcggctcgcgaaggcctccaggtccgccttcccccgggcccgccgctgcgtgctctccaccgccggctctgccgcgtccagcaccgccgcgggcaccaccagccgcaccatgccgctgtgcggccccagcgtcgcttgcaggtggaccgccagcatggggccatcatcccccagccgcgcggagacctcgtccacgccccgcgccacgccgtccaaccgggggcgcggcaccgccgcctgcagccccggcaccagcagcttgagcccctcgaggacgacgtaggccatcacgccctcctcgatgtccgtcagcggccgcaggcccaccgtctcaccggcgccgcccagcagcaggtccaccgccacgtgcgccagcgcgagctccacctccagcaccgcccggccctggagcgccccgggcgcgagcaccgccaggaaggtcgggtcgcccaggaagcgccgcagctccgccatgggccgcacctggacggactccaccgtcaggcgcacctccgcgtcgaacaactccgtgagccgagccgccacggccaccgccgtgccgtccgcgggcgtcagccaccgcaagcgctccgcgagcagtccctgggcccgggagaccttctccaggttccggaaagcgaagggccgccagcgttgctcctggctggcgggtggctcctgggatgccggggactcctgcggaggcgcctggcgcgaaggccggagctggctcaggtccaccagcatcgtgcgctcgtggacgcccgatccttcgtcctcggattcgagactcatgccttcgcctcgaagcggacgtcttcaagccggagcccacggccactgagcgcggaccgcagtccctcgctggccccctcgagttgcttgagcacctcgcggttgctgccgctgaaggtggccgaaatcttcccgttccgggcgctgaccttgatggacagaccgctgagcacgtcgccccgcaggtcgatctggaactccgcgttgcccgcggcgttcgtgcccacgcggacgcggtcgacaatcttctgcgcaatctcggtggccagggcccgcaggcgctccgagcccgcggtgcccttgggcttggccacgggcaccggcgccatcagcgcggggttgaagcggaagccgggggcgatggactccgacccgccgtccttcttgtccttgccaccaccactgcccttgccgccgcccgcgtcggcatccgcccggatggcggcgccccgctcggagctgacctgccccagggaggactccgccttgcccaggtccttctcgcggctctcggaggtccgcttctcgtcggtgcgccgggcgtcccgggcgtccgacgcgcgcgagccgccgcgagcctccgcggcctggccctgcgcctgggcttgcggctgggccagttccttcatggcgggctgctgctcctgctgcacccgctcaccaaacgtcttgccctgctgggtggcccgcgcgagcacggcgcgcgccagaccgccctgttgctgctggggctgcgcgggcgccgggcccggcgacggaggcggctgctgggactgctgcatcagccgctggaaggcggaggccccctcctggcgcttcttggcctgcccctcggcgagcttcttctcctggaggaggcgctcggccaggcgcgctgcttcgcgatcgtcgtcaactcggctcatgacgtcattccagggggatggggagggcgcaggttactacttgcgctggcgcgccaggaacaaggcgttgccaatctcctcctggttcagttcctcacgctgctgtcgctcgtacttcacctgcttctgccagttctctcggtgcttctcgatggccttcagttccttcgccgcctcggccatctcccgccggcgctgctccaccagccgttcggccaccttgacggcctcccgctggcgctccacctccagcgccacctgcgcctcttcgtccttcaggcgctcctcgaagcggttcatcatgttcatgccgttgatgccggcccccttgaacatgacctccttcaggtaggcggccaccttcgccttgcgctcgcgcttgcgctgctccaggtcgtcgatgagacgctggagctccgccttctccttctccagcgccttgatggcggaggaaaaggcctgctccgcctcttccttggcccgggcgcgcatgtcctgcagggcctgcaaccggtacgggggcatgttggccccatcctaacccggaatccctgccgcgcacccctggccagcgccttactcgtcgaacagggcgatcagctgctccaccgtctcctcgaacccggagttggagtgggtgtcctgcttgaggaagtcgatgatggcgtcgtacttgtcgatggcctgatccgtgcggggatccgtcccgtactggtaggcccccaggaggatgaggtcgcgctgcttctcatacgtggagagcagctctcggagccgtcccgccgccttcttgtggtccttggagacgatgccgctcatcacacggctgaggctggcgagcacgtccatcgcgggccactggttgcgctcacccagggcacggttgaggatgaagtggccgtcgagaataccgcggacctcgtcggcgatgggctcttccatgtcaccgccggccacgaggcaggtgtagatggcggtgcacttgcccttctccgagttgcccgtgcgctccaggatgcgcggcagcatggagaacacgctcggcgggtagccttgacgggccgggggctcacccacggcgaggccaatctcacgctgggcacgtgccagacgcgtcaccgtatccagcatgaagagcacgttgccgccgcgctcgcggaagtactcggcgatggcggtggcgacataggccgcgcgcagacgcacgaggctgggctggtcggaggtggcgcacaccagcacggagcgcttcatgccctcctcgcccatggcgtcttcgatgaactcacggacttcgcggccacgctcgccgatgagcgccaccacacagaggtccgctttggtgttccgggcaatctgccccatcagcgtggacttgccgacgccggagccggcgaagaggccccgctgtagagca

SEQ ID NO: 705 - DNA, 4907 bp, Myxococcus xanthus
cgaaaccagttctggtgcaccgtcaaggtgagcgagtgcggccgcttcgccgtgctcgcgaagtgggactacgtccacgccaacgtcatcaccctgctgcgcctcgcggatgatgcgcgcatccctgtggcaacagccatgacctccctcaatcaggtgcaggtcatcggggagtccctgctcatccataccgacctcgacgcaccacgaggcaggctctgcaccgcgccgctgacggcgcccacccagtggcggacgctcatcccggaaagcgagcacacccttcagactgtcgcaggcgtcggcggccggctctacgccgtctattcacgcgcggcgtcgcaccacgtgcgcatccacgccgaggacggcacctggctgcgcgacctgaagctcccagccctgggcgccgtaaatcgcaacgaaggagagggaatcgtcagcggcgtcagtggcccatggcggggcgacgaggtgtgggtgaacttcatgtcgtacgtgcaggccccctctgtctatcgctacgactacgacgcagacctgctgacgccgtaccacgtccctgacgtcgggctcgatgcgtccgagtacgtgacggagcaggtctggtatccgtcgctcgacggcacccgggtctccatgttcctcgtccaccggaaggacctgccgcgcgacggacagtggcccgtgaggctgagtggctacggcggcttcaacatctccgtggagccgcgcttcacgtcgctccaagccgcctggctgaagtggggcggcgtgctggccttcgccaacgtccggggcggcggagagtacggccgcgcctggcacgaggcggccctcaagacacgccggcagaacgccttcgacgacttcatcgcggcggcgcgctggctcgtctcggagggctacacggtgcctgcccggctggcctcgcgaggaaacagcaatggtgggctgctggtcgccgtcaccgccatgcaggcccccgcgtcctttggtgccgtcttctgccgcgcgcccacgctcgacatgctgcgcttcccgagcttcggctacctgagctcggccaccgtcgaatacggctcacccgaggacccggttgagggtgcctacctcgcggggtactcgccctaccacaatgtcagagccgggctccgttacccccggatggccttcgtcgccgcgctgaacgaccggaccgccccaccccacgacccgctgaagatggtcgccagacttcaggcagaaggcacgcagggcgggccctttctcctgctcccgcttcgcgactccgggcatgggggcggcaccaccctgacggcgctcatcgagcaggacgtcgacgagctctgcttctactgtggggcgctcggcgtctcaccgggctgaggcacctgcgccgcagggcccggcccccagagcccccgaggccgctggagaattcggcgtccgacgacgtcaagcgccccaccaccccggggcttcttgattcaagaatcaacgcgcgttatgtcggaaatccccagattgacagccctcgggggaggtctggggattcggggcagccatgccatctgacgcatccaccgttagcgattctcgcgcccagtcccgggattggcgggcgcgcacccaacggagcgtggtccagctcgtgggatgcgtgggcgcctatgtcctgctcgcgggggccagctatgtcttcttcgcccaaagcctggtgggcggcgtggcgctggcggtgctcgcgggcgtcgtgctcgtccgggtcttcatcctccagcacgactgtgcccaccgctcgctgttccagcgtccggtgacgaatgaccgggtgggcgtggtgctgggcatgctgacgctggcgccgcacgcgtactggcgggccatgcacctggtccaccacagcaccagcggagacctcgaccggcgcggcgtgggcgacatcgtgacgatgacggcccaggagtacctggcgctcaaaccctcccagcgccttcgctaccggctgtaccggcaccccgcggtcctcctgggcgtggggcccatcttccagttcctgctgcgcttccgcatgccgggcatcgtcgccaaggagcgcaggcccgagcgccgctccatcctggtgacgaacctggcgctggtggccgtccacctcgcgttcctggcgctgggtgactggccccggtggctggtggtgcacctcatcatcacccaggtggccgcgggcctgggcatctggctcttcttcgtgcagcaccaggtggagcggccctactgggttccgcgggcgcagtggtccctcaagggctcggcgctccagggcagcagtcacctggtgcttccacgcgccttcgagtggctctttggcgccatcaacctgcaccacgtccatcacctgaagccccagattcccaactacctgctgcgcggctacatggagcagcacggcctggccgaagagggcgtgaagctgggtctgcgcgactcggtgcgcgccttccgcctcaaggtgtacgacgaggccaccggcaggatgacgggctttccccctgtccacgcgggccaggccaggacaccgctggcctccccgccctccatcgagccgacaggtcagctgggccgagtgctgaccttctccggcgaggaacgctgaaaatgcctgattacgtccatgtcctcctcggactcgtgctggggtacgtcatctcctcgtacgtcgagtccttcatgcacgagtacgtgtccgacgggcgtccgaagacggtgcgtttccgtcgccgcgctcccagggtgttccgcccgataatcaacaagcacttctcccaccacaccatccaccacgtgaggactttccggagcaaccacgtgacgcagttccggagcgaggaggagaagcagaagctcaccgaggagctgctccagcgaggcaagcacggccggaccatcatcaacggtgcctttgccacccggctgcacggagagggcgccttcgtcttcgtggccccgctggtcatcttcttcccggtgttctacttcacgctcaagcccatcgccttcctggccggctgcgtgacgctgctgctgccgcccttcatgagccacttcgtccacccgtacctgcacatgcccttcgaggaaggacagcgcacggcgccccggtggctggcgtggctgctgcggacccgctacatgcgcgccgtctatcgcaaccacttcctgcaccaccgctatggcggcgtgtccaacttcaatctggtgctgggggcggacatcgtgcggcggcgcacccgcgtgctgacggagaaggacctgagcgtcatggccgaggtgggcatgccgctgcccgaagaggccccgacgcggaccgtccatggctgagcatgcgaacgccttccacgtcccctggtggctgcgcttctcccacgtgcagaccgtggtcccccacctggaccggcgccgccacgacgtgctcaccgagcacatccgtcacgagctggcggacggtgacttcgtggacgtgtactggctgaaccggacgcggccagggcccttgctcatcctgctgcccggcatgcagggcacgcaggactccacctacgtccgcagcctgctgtcggagctgtccccgcgcggcctgcgcgcggcggtcttgtgccaccggggcggcgccgtgcccaaccggcgggcccccttctatcacgcgggattcaccgaccacctggcctggctggtgcgcttcgtccgtgagcaggagccccacacgccactctatggcgtgggcttctccctgggcggcagcatgctgattcgctacctggcggagacaggccacgccagccacctgtccgccgcggcggccgtgtccctgacgttctccctgggcagcacggcccggcgggcctgcgaaggcatcaaccagctctaccagctccgcgtgttgaactcgtacaagcgcgtcgcgcggctcaaggcccacctgccggagttcgcctcacgcgttgggacgctgaatgggatgcgcagcatccaggccttcgacgaggtcttcaccgcgccccttcacggcttcaaggacgcggaggactactacgagcggtgcagcagccagcaattcctgccgggcatcgaggtgcccttcctcgtcctcaacgccgaggacgacccgctcgtcgcccgggacacgctccccgacgcacgcgcgctgcgggagcacgtgcggctggagctgacgccgcatggcgggcacctgggtttcatgtatcagcgttcctccgggctgggttactacccgccggcccggctcatctcgttcttcctgcaggagccgtccgaagcacatgaatctctatctcaggatgttgtgggtcatgctctcctcgctctggaagccggagatgcgcgtggacgcgctgacgagcacgctggagcagcgcgtcctgcccaatgacctggacctgaacctgcacatgaacaacgggcggttcctcaccgtctgtgacttgagccgggtcgacctgttcatccggacgggcctgctggcgctcatgctcaagcagaagtgggcgcccatcatcgtgcgccacaccatggactacaaaaagccgcttcgcccgttccagaagtacacggtgtccatgtcgattacccgctgggacgagaagtacttctacgccacccaccagttcctctcgcgcgggaaggtggtggcggagggcgagtccaccgcggtgctgctcgggcgcgagggcgtcgtcccgccggagaaggtgattgagggcggtcacccgcccggcaaaaccggacggcggtggagaaccactgactgaatggcccgggcctgggcccgcgtcacgcccaggcctcttcggatagaccccaatttgcccttccctttgcgccccttt

SEQ ID NO: 706 - DNA, 4090 bp, Myxococcus xanthus
tgccctatcgctcccatccacggtcacgtcgagacgctcctcgcgctcgcgcgccaccgcgtcccactccgagtccagacacaccacggtggcgctgtcccgaggcaggcgttccgacaaccgagcctgcgtcagcagcaccggcgccgccgcatccgcgagcatgtactccagtcgctcgcggggatactccgggtcgagcggcacgtaggcgccccccgccttgagcacgccgaggagccccaccaccatctccagcgaacgctccacgcacagcgcaacccgcgtgtccggccccacgcctcgggcccgcaggtagcgcgcgagctgattcgcgcgccggtccagctcccgatacgtgagggtgtcgctctcgaagctcagcgccaccacatccggtgtgcggtccacccgcgcttcgatgagccgatgcaggacgctcactcctggccgagggcggtccgtgtcattccacgccaccaggacccggtgccgctccgccgaggtcatcaggggaagcgcgtgcacctgctgttccggctcacggacgcccgcctccaacaggacgcgcaggtgctccagcaggcgcgttgcggtatccggctcgaacaggtcggtgctcagctccaggttcgcggagaagccgtccgccgtgtccgtgatgatgagtcgcaggtcgaacttcgccgtgagactcggctgcggctggacgttcagccgcagccccggaatcaccaactccggcagcgggtcctcctgcatcacgagcatggcctggaacagcgggctgcggcccaggtcgcgctcgggctggagcgccttcaccagttcctcgaagggtgcgtcctggtgcgcgaatgcccccagcacagtctcccgcgcgcggccaatcaactccctgaaggacggcgtgcccgccagtgacacgcgcaggaccagcgtgttgacgaagcagccgatgagcccttccagctcggtccggtcacggccctccaccggcgttcccacgcacaggtcatcctgcccgccatgacgggacagcagcgcggagaagcccgccagcagcaccatgaagggcgtggcgccctcacgctgggccaacgttttcagcgcatgcgacaactccgggcccaggagcatgcttcggctcacgccacggctgctgcgcacggccggtcgaggccggtccgtgggcaggtccagcgcccgaggtgcccctcccaaccgggtccgccagtacgcgagttgcgcctccagcgcctcgccgcgaagccagtcgcgctgccacgccgcatagtccacgtactggagcggcagcggcgacaacggcgaaacctgcccctgggagaaggcccgatagagcgccgccacctcgagcacgagcacacccatggatgcgccatccgtcaccaggtggtgcagcaccaacaagagcacgtgctcacgcgcgctcacctggagcagcgtggctcgaagcggcggtcccgcgccgaggtcgaacgcccgcagcgactcctccgccaatcgcaacgatagggcctccgcctgatcagccccagacagcgcggtcaggtccacccggtccagagcaagccgggcctcgggatggatgcgccaggaaggcgtgccgccgtcatcgtggaaggtggcgcggaggacttcgtgccgccggaccacctctctcagagagcgctccagcaacgccacatcgagcgccccctccacacggacagccaccgcatcgttgtacgcggcgccaccgggctcgagctgctccaggaaccagagccgttgctgcgcgaaggacagcggcagcgcgccttcgtgagaccgggccaccaatggaggcaccccggacgcccccaggaggcgagcatcgatgcgcgcccccaaggccgcgggcgaggacgactcgaacaactcacgcaggggcaggtccaccccgaacgcctcacgaatccgggaggcggcgcgcgtggccagcagcgagtgcccgcccagcgcgaagaagtcgtcctccgcgcctacccgctccacgcccagcagcgaagcccacagctcggccaaacggcgttcagtgtccgtccgaggcgccacgtactcccgagcgacgtcacggacaccctccggcgcaggcaacgccttccggtccaccttcccgttgggcgtcagcgggagcgcatcgagtggcacgaacgccgaaggcaccatgtgctccggcagggagcgccgggagaaggccagcagcgcctccaccgaaagcgccgtgcccggcctggcgacgacgtacgcgacgaggcgagcgcctccagcagacgcctcccgcgccacgaccacggcctgcgccacgtcggagtgccgcgccagcacggactcgatttcaccaggctccacccggaagccacggaccttgagctggtggtccacgcggcccaggaactccaccgttccatccgctcgccatcgagcccggtcgcccgttcggtacatccgggcaccagcgttggaggacgccgggtccgggaggaatcgctcggcggtcagctccggccgcgcgtgatagccccgagcgacacccatgccaccaatgtagagctcaccgggcacacccacgggcaagggccgcagctccgcatccagcacgtacaacgacgtgttggcgatgggcgtaccaatgggcaccggtcccggcgaaccatccacggcgtgcgacgaagaccagatggtggtctccgtggggccgtacatgttgagcagcgctccgcccatggtgccccgcagccgttccgccagctccgcggatagcgcctcaccgccgacgagcaggcgctccagccccacgagcgccccggccgcaccgggctccaagagcagcgcctgggccagggagggcgtgcattgcagatgcgtgacgccgtgccggcgaagctgcgcgggcacggtgatttcctcctgcgactgaagccggaagtcccgctcgcagcgctgccgcacggcgtccagcgccggaaggctggcgagcacggcatccgtgtccacgccgaagtcgatgaggcacgcgacctcatccacgcccagcgcctcgatgcgcgccacctgctcccgacaggtgcgcggcgtcccgaagagccccgccccgtcgaagaagcgcccgaaggcccgtcccacgagcgcgtccaggtcctccggacgcaccgatgcgggatccaggtccacgcccagcgtccggcccaacccgcgcatcaggtccgcggagttgctcaggtagcgccgcagcggcgcttcgactgtctcacgcacgcgctccacgtcgtgccccacgaacgtgtggagcatcagcgtcacgtggccctcgccctcgtggcccgcctcgcgccaggcctcgcggtagagcgcgatgcgtgattccagctcctcccaccgctgtcccaagaggtgcgtcaggacgcccgcgcccagccggcccgcttcgcggaaggtgtccggattgccagcggcggtcagccacacagggagctcgcgctgcacggggctcggacggatgcggacatcgatgggcgtccccgcgccattggggaacgacagcgactcaccgcgccaaagccgccgcaacgtgtccaggtcccgccgcgcaagctcccggcgctccgcataccgctctggcgcgaggacgaagtcatccgcgtgccagcccggcgcaacggagatgccgacgcggcccttcgacaggttgtcgacgagcgaccactcctcggccacgcgcacggggtggtgcagaggcagcacgacgctgccggcgcggatggctacgcgctcggtgatggcggcgatggccgcgctcgtcacggatggattgggatagagcccaccaaacgcatgaaggtggcgctccggcgtccacaccgcctggaagccatgacggtccgcgaaccgcgcaccttccagcaacagccggtaacgctccgcgcctggagcaccctcgtccgccgcgaagtagaagaggctgaagcccagaggcttctggcgcgatcgggtcacccggcgcggcgcggcccccaaggccccctgctcgccctgcacggggaccttg

SEQ ID NO: 707 - DNA, 6363 bp, Myxococcus xanthus
  unsure (1)..(6363): unsure at all n locations
gcacggcggaccgcgcccgcagcgacctggactgggcggacctggtgctggtgtgcggcaccacgaagctgcaccacaaggtcagcggccactacacgcacggtgggccggcctacagccacaaggtggtgcacgtcgtgaagcggggcgtggccgcgctgttggaagaaggcatcacccacctggagcggacgcgctgagtgctggactcaggcgacgcgccaaagcgacgcttgagtccatgacgaccgagttcatcctgctccgtcacggagagacggagtggaactccctggggcgcctccagggacatcaggacagcaccttgagccaggtgggcctgcgccaggcagacgccctggccgcgcgcctggagcccgtccgattctcggcgctctattgcagcgacctggggcgggcgcaggaaacggcgcggcgcatcgccatccgcacgggccacaccgtccagtccgacacccgcctgcgcgaacggggcctgggcatcctggaaggcctcacccgggacgaggcacgccagaagcacccggacgtcttcgccgcgtacgccggtggcgcgccggactacatcgtccccggcggggagagcacgtcccaacggctgcgccacgcggtggagtgcctggaggaactgggcgcgcgccaccggggcgaacggctggtggtggtgacccacggaggcgtgctcagcctcctgttccgtcacagcctggggattccgcacgcggcgccgcgcaccttctctgtgctcaacgccgggtggaaccaattcgactaccacgaaggtgcgtggcggctggtgacgtggggtgacgtcacccatctgcgtgcctccagcctcgacgacacctgagcgcccgcgcggacgctcgtggagactacagctccacctgcggacgctgctcgtcgcggcgggacgcgcgcgtcgcggccggacgaacctccagctcggcgcgggcctcctcgatggcgtcgcacaccccgtcggcggcccgctggacctgctccagcgtgtgggacgccatcacctgcatgcggaagcgcgtctcgcgcaagcgaacggccgggtactccaccaggttggcgaagatgtcgcggtcgaacaccttcttcgaggccagccgcgccaccttcgcgtcgcccacctgcacggggacgacgttggacggctcgcccaggcacgtcacgccccgcgcctcgaaggctccgcgcagcgccaggatgttctcccgcgccttcgcgcgcagcgcgtcgccctcttccgagcggacgatgcgcagcgactccagcaccaccgccgcctgcatgggcagcagcgcgttggagaagatgtggggcccgcccatgatgcggatgaactggcgcaccgccggcgagcgcgtggccacgaagccgccattgctcgcgaacgtcttggagaaggcgcccaccaccaggtccaccttccccagcaggccctgcacgcccaggctgcccgtcccccggggccccatcgcgcccaggtcatgggccacgtccaccagcagcgtcgcgccgtactcacggcagatggactggagctcttcgatccgcggcacgtccgagtccatggagaacaggccctcggtgacgacgagcaccgcgttctgcgtgtcgcgggcgcgaatctcctgaagcttgcgccgcatggcgcggttgttgaggtgcggcacgcggctcacgttcgtcgtcgcggcggcggcgccctgctggaggcacgcgtgcgacagcgcgtcgagcaccacgtggtcatcgggacgcaccagcccagcgatgacgccgaagcccgcgccccagccggtggagaacaacgccacgtgcggcgtctgcaggtgctccgcgagcgccttctccagcatcagcgacggcgtcgtattgccccccagcatcgccgagcccgcgctgtgcaacccgtagtcctggatggcccgctgggccgcctccaccaccgccgggtgcgtggacagcgacaagtaatcctgcgaaccgaagttcagcccctggcgcaccgcccccgtctcactgcggacaccacactccgccttcggtgccgcctccaggcttcgcgagtacggccacaggcccgcctgccgccgcgactcctgccactcgaagaagggttccgtccgacccagcaggtcaggtcccgtcggctgcgcgtaatgggagatgaagtgggtgaagagcggcgagtcgagttgagctcggaaatccatgaagcacgtccagggggaaaggtcgcgctgtcaacgagaggcgcggcgctcggggaggggggggcgagcggcacatttaatgcctctgcatctttccagtgtcaaccggcctaccctgacggctccgttgtattcgtttgttccgattcaaccggatgtgctgcgtaggctgaaacaggcgcgagatacccagatagacacgcattgtccgggccaaaaacgacgaatcctggtttttcgccccagggcagaggcgggttttgacgcccccctgccctgaagtgcgagcaagtgtccatcagtcgtcgttctgcctcagcgcggccaggacgttgaggtcctccagggtggtggtgtccccggaggcctgattgcccgcggccacgtcgcgcagcagccggcgcatgatcttccccgagcgcgtcttcggcagcgcctccgcgaagcggatttcatccgggcgggcgatggcgccaatctcgcggcccacgtgggcggccagcgtcttcttcagcgcgtcggacggcgtgtggccctgcttcagggtgacgaaggccaccagcgcggtgcccttcaagtcgtccggacggcccaccacggcggcctccgcgacggtttcatgcgccaccagcgcgctctccacctccgcggtgcccagacggtggccggcgacgttgaccacgtcatccacgcggcccatcagccagatgtacccctccgcatccgtgcgcgcgccgtcgccggtgaagtacatgccgggcagctcgttgaagtacgtgcgcacgtagcggtccgggtcgccgtacaccgtgcgcaacatggagggccagggacgcgtgacgaagagcagtccgccctgccctcgcggaaccgtgttgccctcgcggtccagaatctccgcgtggatgccgggcagcggcagcgtggccgagccgggcttcgtcggcgtggcgcccgggagcggcgacaccatgatgcagcccgtctctgtctgccaccacgtgtccaccacggggcagcgccccccgccgatgacgtcgcggtaccacatccacgcctcggggttgatgggctcgcccacgctgcccaacagacgcagcgaggacaagtcgtgcttgcgcacgggctcctcgcccagccgcatgaaggcgcggatggcggtgggcgcggtgtagaggatggtggccttgtaccgctcgatgatgtcccagaagcggtccggccccggctgggtgggcgcgccttcgtagaggatggtggtgacgccgttcatcaacgggccgtagacgacgtaggagtggcccgtcacccagcccacgtcggcggtgcaccagtagacgtcgtcttcgcgcaggtcgaacacccagcgcgtggtgagcgacgtattcaccgcgtagccgcccgtggtgtgcagcacgcccttgggctttccagtggagcccgacgtgtagaggatgaacagcgggtgctcgctctccacccactccggttcacattccgcggactgcccgctcaccagcgtgtcccacgccaccagcttgggcccggacagcgccagcgtgctgcccgtgcggcggagcaccaccaccttctccatggtgggcatgtgcggcagcgccgcctccacgttcttcaggagcggcaccaccgcgcccttgcgccaaccgccgtccgcggtgagcagcaccttcgcgcccgcgtcgttcatgcgctcgtggagcgcctccgcggagaagccgccgaacaccaccgagtgcaccgcgccaatgcgagcgcacgccagcatggccaccgcggcctcgggcaccatgggcaggtagattcccacccggtcacccttccgaacgcccagcgacttgagcgcgttggccagcttgttcacctcggtggacagctcgccgtacgtgaggctgcggcggtcgccgggctccccctcgaagaggatggcgggcttgtccttgcgggtggccaggtgccggtccagacagttgtaggctaggttcgtcttgccctcgacgaaccaccgcgcgtgcggcggcttccagtcgagcaccgtctggaagggcgccttccagtacagctcctcgcgggcgcggtcgccccaatacttgtcagggtccttcgcggcttcgtcccagagctgctggtactgctccatgctccggatgtgcgcgcgccgggcgaacgcctctggcggcggaaagacgcgtgcttctgtcaggaccgagtgaatctcatgcttcgaagccgccatgcgttcctccagcgtggacaatgccaccctgttctaggaacacggagcgcgcggctcaaccctccgtgtcgcagcgcttcgattccttgacggcctcgtagcgcagccacatctcgcacacgcattcgtcggggcggcgcgtgtcgtaacggactcgcagcacgccattgaactgcgtttcgcactgcgtcgtaccgtcgatgtggatgttgatctggtccaacaggcactcctggccgttcacctcggcagcggccttgaccacgctcccgtcgatggagaagtggtctccatcctccaggaaatagcccacgaggtggctgtccaggaaaccgaagtccaggcggacgacgcgcccgctgatttgcagggtgccgtagagctggctgcggttggtctccagcaggccgcagtcgtcgcggaggacctcgacgggctcgaagacgtaatcacccggctcctggacgtggggcagacagcccaccaggcacgccaggagcaggccggagaggacgaggcgatggcgtctcggagtcgacacggcgcgcacaatactccacggcacgcatctaggaagtgcgagcgtgacggcagcaggtagactgggggtcatgcccgaataccgcaaccccaagcccaccgtggactgcatcatcgagctgcccggtgaacgcatcgtcctcatccggcgtgcgaatccgcctgtcggctgggcgctaccgggtggcttcgtggatgagggcgagccgctcgacgtcgccgccgtgcgcgaggtgcaggaagagacgggacttcacgtgaagctgtcggagcagttcttcacgtactcggacccccggcgggatccgcggcagcacaacatctccaccgtctacatcggctcggccgagggcgaaccgcagggcgccgacgacgcggccgaggcccgcgccttccgcgtggatgacctgccgaaggacttgtgcttcgaccacgacaccatcctgtccgactacgtcacgtacaagcggaccggacagcggcggaagctctaggaacggcgcgggaggatgcattacgcgctcgtcctgctcgccctgggaggcctgctgaccctccacgaattggggcacctcgtcgccgcgcggttgctcggcgtgcgggtgccccgcttcgtgtttggtttcggtccaccgctggtgtccttccgtctgtgggggacacagtacgtgctggcggcggtgccactgggcgccacggcgcacatgcaggggatgaacccgcaccgtgcggacgtcgacgaggccgcgggcttcgccgcgcgcgggccgctgctgcgcatcctcatcatcctggcggggccgctggccaactatgcgctcgcgttgggtgtcctgttcgcgctgtacacgtcgggcacgcacgtggtggtgccgctgaccgtggggacggtgcagccgggctcggaggcggcgcgcgcacaactgctgccgggggaccgcatcgtcaatgtcgcgggacagccgctgcggagctggtcggagttcgtggagaaggtgggcgcggcgccgggtgtcccgctggagttgggcgtggagcgcggcggcgatgcgcgctcggtggtggtgcggncccngncggatgagcgcggcacgggccgcatcggggtgagccagcagtacgtctacaaggcgcacggcgcgggtgaggcgctgagccattcgttcacgcacaccgtcaaggtggccgaagaaggcgtggcgctgttgaagcggatgatgcagcacggcctggagagcgcagacgcggcgagccccggagcgctggtgcgacaggagtccccggacgcgatgttgtccgggaaggatgccctgctgc

SEQ ID NO: 708 - DNA, 7186 bp, Myxococcus xanthus
ctctacagaaggcgaagctccgctccgggaaggagcgcgcttccagcagcgccttgagcagggcctcgtgcgtggacggcagccggccttcgcccagcgcgtacagcacccgcagcgcgcgccgcccatgaacgccggtgaaccagagggccagcgacaacgccacgcccaccagcagcaggaagggcccccaggtgccctcgggcaccgtgccggtaagctggcagtgcagcagcaccagcaccgtgcccatggaactgcccaacaacgcgggacgcgcggtccaccgcgccaggcccctcatgcccccgggcaccgtcatgcaccctcccctggatgcccgcgcaggaagcgctcgaagtccgccagtcccacgaggggccacagcgctcctcgcgccatcacgaagccctggaggctgccccccgacgcgcgcaccgtcaccggcggcgcgggcagcacccggtgcggctccgcgtcgatttccagcgcatccacgcccactgccccgcccgaggcggacaccagcacgcgggcggaaccctccgtctcatggaaggcccggcgcgcggaggccgccgcgtgcccggagggcgacgcgatggaggccacctcgtgcgcatggaaggcgagccggtggggaccggcatggcacaggagcattccccggacgtggcccggcggctccatgactcaggtcccctgactgaggtggtcgaagagcccttccgggtcgatgacggccacgtcccgggggccgctcttggcggggccgcgcaggtggacgtggacgcccgtggggcccaggggctccagcgtgcccgtcaccggggagacgccggccaccgtactggccgtgagggccagggtcccacgcggcaggcgaacgagcaccgcccttcgggaaccctgactgacgccgcccaccagcaggcccatgtccacgacggggatgacttcaccccgatgcgcgaacacgcccagcaggtgggctggagcgccgggcacccgcgtgagctcggggaaggtcacgacctccgccgcgctctccgcgggtaccgcataccagctactgccacaggcgaagacaagataggactgacgcgcttccggctcttggacggccatcacacgcgcagcctacctcagactagcgctggaactcgacgcggcggttctcggaccacgcgtcttcggacgaagcggagttcaccgggcgggtctcaccataacccaccgtgcccagctggctggccggcacgcccaggtccgtcaggtagcgcttgacggacgccgcgcggcggttggagagctggaggttgtactcctcggtgccgcgctcgtcggcatggcccgccagggtgacgcggcccggagcggtcttcatgcattgagccaggtcggacaggcgctgctgcgcgtccgcggacaggccggactcgttgaagcctaacgggacggggctccagtcgcagcgctccgcggaggccgtcacgcactggccagcctggcactcctggccctcgccgcagtcagagctggacgcgcaggtgttctcgggaacctggcaacggccggactcgcacttgccgccgccggggcactgggtgtcctgctggcactgggcctcggcgcacttgccggcctcgcagatgcggccgctgccacaagcgctgtccgtggtgcactcaggcggcttgggggcgcacttgttcgcctggcaggtgaaaccctcctggcagttggcgtcggtggcgcactcctggcactggccctggacgcaaacttcgcccttctccgcgcagtgctcgtcctcgttgcacttcggataggaaggggtgcagccgcccatgatggcgacggcgagggagagccccgccaaaagggaaatctgacgcattatttcctccagaattctgtagtcgaaaacgcgcccgcgcccgcggggtgtagtcgttggcgtgtagtctcactggagggggtgagtcaaaacatttgtcccgcgcaggacaccccaccccatcgccgaaacccttgaatctccaaatattttccgtgagattgtcacgattgacccgcgtgtggcgcgccccgtggcacgcctcggggaaagcccgccatgcccgcctctgtcctcatcgtcgatgacgagaagaacatcctcctcaccctgagccagtcgctccaactggcggggtatcagacgcacctggcaaacagcgggcaggtggccctggatgtcgtcagcgcccgtcccgtggacgcggtgctgatggacgtgaagatgccggacatggacggcctcacggccctggcgaagctgaccgagctgaagccggagctgcccgtcatcatgatgtccgggcacggcaccatcgacaccgcggtgaaggctacccagttgggggccagggatttcctggaaaagccaatcgcccgggagcggctgctggtggcgctgcgcaacgtgctcaagcaccaggcggccatggcggagctccaggagctgcgggcgcagttgggccgctacgacatggtcggcagtggaccggccatgcagcgcatcttctcgctcatccagcgaacggcgccgtccgagggccgcgtgctgattacgggtgagaacggcacgggcaaggagctcatcgcgcgggcgctgcaccagcactcgaagcgcaaggggcagcccttcgtgaagctcaactgcgccgcggtgccgcacgagctcatcgagagcgagctgttcggccacgagaagggcgccttcaccggcgcggtgagcgtgcggcgaggcaagttcgagctggcccacgagggcacgctcttcctggacgagattggcgacatgccgcaggcgatgcaggccaagctgctgcgcgtgttgcaggaaggcgagttggagcgcgtgggcggcgcggagacgcacaaggtggacgtgcgcgtcgtcgcggcgacgaacaagaacctggaggcggagattgccgccgggcgcttccgcgaggacctctactaccgcatcaacgtggtgcagattcattcgcctccgctgcgtgagcggcgcgaagatttgccggacctcatcaagacgttcctcgacgaggcctgcgccaagaatggacgccggccgttgacgctgtcccccgacgcgctggcggtgatgagcgcctacgactatcccggcaacgtgcgcgagctgcgcaacctcgtggagcggctggccatcctgtgtgaaggccccatcgtcacccggacggatgcgctggagctgttgccccggggccggaacgtgccgccgcccgcaccggtggagacacccgcgagccccctaccccctccttctcccgaggcggccgtggtcctggcgtccagtacgcccgcgcccgccatcgccgccccggtggcgaccgagcctcccgcgcccgtgggcttccggcctcgcgcggaccggacgttccgcgagcaggtggaagacgccgagcgggaaatcatccagcacgtgctttcccatacacacgacaacgtgacggaagccgcgcgattgctcgacctggaacgcggtcacttctacaaaaaaatgaaggccctgggcttgcgccgcggcagctccgagtcgtaacgctgcggattcattgtccctccatggtggctgcgcgtgtgtggcgagtactaccgagtcccgtgtgctcgccgcgtgctcaactgagagaaccgaaacggatgagcttcggggagcgaggttgttgagttcgtgaggaggtgcacttctcatggcttggcagcctcgccggccttccgccgagcagcagcaggagcgcgtcgcgcgtgaattgagggtgtccgaggccgcgataagcaagtgggccgcgcggctgcgttcgggcggactgcgtgcgctgcgtgcacgccgacacccggggcaaccttcgcgattgacgcccacgcaatggcaacaggtggccacgattctgcgcgcaggcacactcgtagcgggctttcccaccgagcgctggatgctgcggcgtgtcgcgcaggtcatcatggtgcgcggctacgcggtgggcacctacaacctgacgctgacgtacagattcccgtaggtccgacttccacggcgggtggcccactccctggggccgcccgtcgtgcccggggtccggtcgtcgggtcagccccggcgatttagtcagtgagccaggcggtgtttggagcgtttgggtatccaggcgccagcgctgatgctggcaatattctgccatgcagtgaatccaacgtagggcgcaggcgcggtgtagcatcgagctgggatcaggtcgcaggtcgccaggttgccggcatcaatgccggcggacaggctcctcacggctcctgcccaatagcgcggcgggaatgagatgaacggcagttgaatcctgctcaggtccgcaagaccgacagaactggctgggtttcgataaaggcagagctttgcccctgtatagttcgtgcctgagaagagccatagcgtgttgccattgttgcagtcgataatcaggcttggaatctgggatgccgtccggccttcgagggcggcgatacgctgggcctcccgtgctctggcctgggcctgtagttccgctcgggtgacataggaggtgtgctgctcgagcgtcccgtcgtcgttcacccaggcaacggtctgagggatgagctcctcgtcgctcgtctgcggtgcctcggcgccacaccccagtgacagaccaaccgcacagatcaacatccacgcacatgaggacttcatgttggctctcctgtctatgctgacatgaatggacgggcagggaacggacagaccaagcagattttcttggaatccggaagctcttacaagtcctgtatttagatgcactccgctggggtgatgactttcttcaggcccagaggctgcccgagagcctctgcctgccactcgtctgggccctcggcgggggactcgcatgacgcagcgaccgaatttggggtaggcacacctgtcacggcccctccgcagtgcttgcggcccccgtcccggtcgcgcgcagcgtcacggccccccatcacaaacgcttgtcatcgtaccaggcattcatcccatcgacggcccggtccacatcagcaatcgtgttgtagatgtgagggcacaggcggaacgtcttgtcgtccccggagcccgcgatgtggtagcgcgggtcttcgtagagccagtcgtacagcgtcttctcccggtgctcctttggcgcctcgacgcgcaccacgccccaactgcgcgccgggtcgctcggcgtgacgagcttccaccggctccccgtctgctggagccgtgacatgaggtgctgggcgagttgggcgatccgctcgtaaggtctgcgcggttgcagcgccgtccacatcttctgggtgaggtctagcgcgatgatgttcacgtcgtcgcgctgcccgatgagctcgaacctcagcgcgttctccggcagctcccggtacggcacgatgacgatgcggtagtcgtacccgaagatgctcggcatgaagttccgggccttctccttgcgcatgaagaggatgcccgtctccttgggccccaggaaccacttgtgggcgctggagacgaggctgtggcagtacgcgttcgccaggtcaagcgggcgcgcgccccacgccatcgtgccatcgatgtggacatggcagtttggccggttcgtcttcacgtgggcccagatggcgcgcatcaccgactcgggcatgcggaagccattgctgttggccgttctcagtgtacgtcacgaagcgcgtgcgctcggtgattcgattgatgaaggccgtcgcgatgtccgcctccggggcgtttgtcgggaaggacacctcctccaccttgaagggcgtcgggccgccgggccactcggctcgcattttccaggcctcgcggttggtgggatggttctccgcccacatcaccactgtgtcattcccgtccgcgctccagccccggaagccgcagttgatggcgttgttcgcctccgtggcattacgcacgatggcgaggtcggtcgggtcgctcaggcccaggccgaaggccagactcttgcgcgtccgctccaactggagcacccgctcgccctgcacggtgcgcatctgttgcgagacgttgaggttgtattcgaggcgcagctcgttgagcgactcgatgagcgccgtgggctccgggcagaggttggcggcgttcatcggcgtgacgcgctcggagggcgcgaccgtcgcgaagccaaactcctgctggaaatccgtccagaacgcctcgtcggtcttctttgatggggcacggaccgcctcaaagaagcggttcagcttgtcagtcagcgcgcgtcctcgctccttggaaaggagccccacgtcggacagtgacgtgatgaggggacggcaatcgacggactcggccgcgctggcggccccgtcggagtcgggggctttgaacatggggcgctccggaaggagtgggtcagccaccgtgcacctggttccgactccgggacatccccccgcagggcaccgcgcagtcggggaccggacacatgccggtccccctcccgagtcttggtcctcacaccggagcgtcgtaggcccgcccgtcgaaggacggatgcgcacatcgaagtgaagtaattcctcacggtcgaagcggcgccccttcggacgcaaagaaggcccgaagcctcggcgtctccgccgcgctccgggccttgttggccgcagcgggatcagctcagggtcgcgatgccctcacccagcagatccgcctcgcggccacggcgcgacggatagcggtcaccgaagtcctccaggttggccttcgcgtcgtcccaccgctgctccgtcacctgcgcgaagaagttgggcgtggccgtcttcagcgagccgtactggaagcccacggaggcaatcaccgtctgcatctcccgcggcagctccgcgaacttcggccggctgccaccgtccgcggcgttcaggcgctcgacctcggtgttgtactccttgaccacgttgtccagcgcctcacccttcacggcccggtccagctccttgacctcttccgccgtcaggttcagcgggttctccgccaggaagtccgcggcgtcctggccctgcttgcccaggtaggggctccaggcttcgtctt

SEQ ID NO: 709 - DNA, 4183 bp, Myxococcus xanthus
tgctctaagggacttccacgctgcgcaaagcctccagcgccaggtccacgtggcccacggagtgggaagcggacaggcaaaaccccaggcggttggtgccctcgtaaacggtgggcggacggatggccttcaccagcacgcccgcctcgcgcagacggcgcgcggcgtccagcgcccgctcgggctcgccgaggatgagggggaacacggcgctgcgaggctcggcgcgcacgcccaagccgcgcaggccgtccgcgaagcgacggatgttgcgccacagccgctcgcgcaggtccgggtcgccctccacggcgtccacggcggcctcggcggcggcgcacaggtgcgcgggcagcgcggtggagaagacgaagggccgcgcgcgggataccagcaggtccgccacctcgcgtgaggtcgccacgtacgcgcccatgacgcccagcgccttgctcagcgtgcccatgcgcaggtccacctcgctttccaaccccagctcatcgcagaggcccgctccacgtgcgcctagcacgccggtggcatgcgcttcgtccaccatcagcgcggcgccgtgggcccggcacgcggcgacgatgtcgcgcagcggggccacgtctccgtccatggagaagacggtgtccgtcaccaccagcttgcggcgcgcgggcgtctccgccagggcgcgcgtgagcgcctccacgtccgcgtgcggatagacgcagacgcgggcgcgtgacagccggcagccatccacgagcgaggcgtggttgagggcatcggagaagacggcgtcctccgaccccaccagcgcggggatgatgccggtgttggcggcgtagccgctgttgaacaggcgcacggcctccgcgcgctcgaaggcggccagccgcgtttccaaccggtgatgcgcggcggtgtcgcccaccaccaaccggctggcaccggtgcccacgccgtagcgctccacggcggccagcgccgcggcacgcacggtgggtgacgcggccagccccaggtagtcattggacgagaagttgacgagcgtctcgccccccacgcgcaccacgggcccctggggagagtccaggggctccaggtagcggcgcaggccgcgctcggacagggcctccaggtcctcccgggcccacgccgccgcgacggcttcatcactcacggtgggctcagccttcctgacgcggctccagggggcggattcccgccttctccagcagggccatgtcctgggtgtactcggggttgccggtggtgagcagcttctcgccgaagaagagtgagttggcgcccgccatcatgcacagcagttgcgcctcttcgttcatctgctgccggcccgcggacaggcgcaccatggactggggcatcaggatgcgcgcggtggcgatggtgcgcaccatgtccaccgtctccacgcgctgctgctcctgcagcggcgtgccctccacggccaccagcgcgttgatgggcaccgactccgggtggtgctcctggttggccagggtgcgcagcaggttgcagcggtcatccaccgactcgcccatgccaatgatgccgccgcagcacacggagatgccggcgtcgcgcacgcggttgagcgtgcgcaggcggtcttcataggtgcgggtggagatgatgtcgccgtagtgctcgggcgacgtgtccaggttgtggttgtacgcggacaggccggcctcgcgcaggcgcttcgcctggctctcggagagcatgcccagggtggcacacgcctccatgcccagcgcgcgcacgccgcgcaccatctccagcacgctgtcgaactgcggaccgtccttcacctcgcgccacgcggcgcccatgcagaagcgggtggctccggcggcgcgggccttggacgcggcatccagcacgtccggcacggccatcagcttctccgccttgacgcccgtcttgtagcgagccgcctgcgggcagtacgagcagtcctccgggcagccgcccgtcttgatggacagcagcgaacagagctggaccttgttgtccacgaacacggcccggtggaccgtctgggccttgtgcaccaggtccagcagcgggagttcgtagagggccctcacctccgacagcgaccagtcatggcgcacgtccacgcccgccggtggcggcgcggcgacgtgggcgtgaccagagaactcgctctcgctggagacagtggcggtatcgggcatgggctcctctacggacggatgagggcccgaacgtgcgtggaccccggaaagttgtcaacgcccgcgagcaggttggttgacgactctccagggtccatctcccctcaagagggactcagcgcgtcaactgacgcgcggccctagacgtggacgcggcggcccctgcctgccaggcccaccaggaacaacaccaggagtgcgcccaggacggagaacaggagccctgtcgggtgcaggtcgaagacgcggccatcactgcggaagagcgaagcgacgaaaccgcccacgaaggagccggcgatccccagcagcgtggtggcgaggagccccatcgactggttgcccggcatgagcgcgcgggcaatgagacccgcgagaaggccaatgaccagaaacgcgataatccccatgactacctcccttgcttgtttagcgacgcagggtgcgacgcccacctgggagcaaacctgggttgcccctcccgttcgtacaacttggcgcggggggcttgacatggtgcctgcccgctctgcggtcgtgcctgcccgtaaggtcgcaaaaacgtcagggttccgcgctattcacccaacccatggcgaaggcgaagacgcactacacctgtcaggcgtgtggatacaaaacggcgaagtggctcggaaagtgtccggactgtggcgcgtggagttccctgctggaggagacggacccgaaggcggatgaacgacgtccggcctggggtgcctcgggcggttcggcgcggcccatgctgctcaaggaagtgagcggcgagacggagacgcgccggcgcacgggcatcgccgaattcgaccgcgtgctgggcggcggcgtggtgagtggctccatcgtgctgctgggtggcgacccgggcatcggcaagtccacactgctgctggcggcgttggacaggttggcgcgccacggaccggtgctctacgtctccggtgaagagagcctgcgacagacgaagatgcgcgccgagcggctccgggtggagggagaggccatccacctgttcgcagagacggacgcggagcgggtgctgacggcgacggaggcgttgaagccccaggcgctggtggtggactccatccagaccatgtacctgccggagctgggcaacgcgcccggcagcatcacccaggtgcgcgaggtggcgggccggctgatggcctacgcgaagcgcacgggggtgcccacgttcctggtaggccacgtgacgaaggaaggttccatcgcgggcccgcgcgtgttggagcacatggtggacacggtcctctacttcgagggtgagcggggccacccgttccgaatcctgcgcgcgcacaagaaccgcttcggctccacgaacgagattggcgtcttcgagatgaagggcgcggggctggtggaggtgtccgacccctccgccctcttcctgtcggagcggccggtgggcaagtctggcagcgtggtgacgagcacgctgaacggtacgcgcccactgctggtggaggtgcaagcgctggtggcgcccacgggctacggcaccgcgcggcgcacggcgattggcgtggacggcaaccgcgtggcgctgctggcggcggtgctggagaagaaggaagagattccgctggtgggctgtgacttgttcgtcaacgtggcgggcggcatgcagctcaccgagcccgcgtgtgacctcgcggtgtgcgcggcgctggtgagcagcctccagaatcgtccgttggatccgaagacgctggtgctcggagaagtgggcctcgcgggagaggtgcgagcggtgggtcaggtggagccccgactggcggaggccgcgaagatgggcttccagcgcgtggtgatgcccgcgggcagcgcgcggcgcctggaggatgcaggcccgaagatgaagatcgtcggcgtggagacgctcggcgacgcgctcgtcgcgatgttcgactgag

SEQ ID NO: 710 - DNA, 5234 bp, Myxococcus xanthus
ccgccccagctcttcaggctgaacagctcgagggccaggtgggcggtggccggggccacgcgagggatgtctcgcgtgcgcatgcgcgtggccagcagggactggtgcgcgtcccgcatggtggtgtccgtcagcagcacgcgtttctgggccagcacacagtccgccagtccgcgcgggcccttctccgccaggatgtgcgcggtgccccgaggcaccgggccagaaggcgtcttcggcagccgcggctccaggaactgcgtgggcttgagccgctggtccttcttgatggtggggtgcccgttgacgatgacgtcgcccaggtactggagcagcttggtggccctgtccctgcggggctccaactggaacagcaccggcgtctcgtcgatgaagcgcgtgtacgtctctccctgctggaaggcggggtgggcgagcacgttctccaggaagggcaggttcgtcttcacgccgcggatgcggaactcgcgcagcgcgcgctggcccttcatcaccgcgccctggaacgtgggcgcgtaggcgatgaccttcaccagcatggagtcgtagtagggggagatgacggcgttggtgtagccgttggagccgtccagccggatgccgaagcccgtggccgcgcgccaggcggtgatgacgcccgcgtcgggcatgaactggttggcagggtcctcggtggtgacgcgcagttgcaccgcgtagccccggggcaccacgtcctcctgccgggagatgcccacctccggcgcgtccagccggaagccctccgcgatgcgaagctggctctgcaccaggtccacgcccgtcacctgctcggtgacggtgtgctccacctggaggcgggcattgcactcgatgaagtagaaggcgtcacccgccaccaggaactcggcggtgccagcgctggtgtagccggccttgcgcgccagccgcaccgccgcgtcgcagatggcctccttcaccgccggggccagattgggcgcgggggcaatctcaatgaccttctgatggcgccgctgcacggagcagtcccgttcgtgcaggtggacgatgttgccgtgcaaatctcccagtagctgtacctcgatgtggcgcacgtgctccaggaagcgctccaggaacaccgacgacgaaccgaaggcgctcttcgcctccgaacgcgcggaggccagcgcatcctccagcgccttcgcctcgcgcaccacgcgcatgcctcggccgccgccgccatgggccgccttcaccaggatggggccaccctgcttcgcgaagaaggcacgggcctgctccagcacgtgcgcgtcgtcgccctccagggtgatgccgggaaccaccgggacgccgcacgcgtcggccaggtgcttggcggcgaccttgtcgcccatggtgcggaccacgtccgagcgcgggccgatgaagcggatgccacgccgctcacacgcctccgcgaaggcggcgttctccgacaggaagccgtagccggggtggatggcgtccacgcccgccttcacggccacgtcgaggatttcgtcgatgcccaggtaggcctccacgggccgcttgccccggcccacgaggtacgcctcgtcggccttgtggcggtgctcgtgggtgcggtcctcgtcgctgtagatggcgacggtgcggatgcccaactcgttgcacgcgcggaagacgcgaatggcaatctcaccgcggttggcgcagaggaccttctggatgggacgcagcgacacatgttccatgtgcgcgctgtatgcatcccgtcggccccggagcaacggctgccggggcgaacgtccgattcaaagcgcggcgccccgtgagcgccgcgccgtgcgtcaggtgccggactgggagggctgggcggccggctgcgggccgttcgccgtctcttcgtaatccaggtcccggtggaacgtctcttccagccgggtgagggccagcagcgccaggccgaagcagatgctaccgacgatgagcgccgcggtggacaccgacatctcgcccttcaggtaggcgaagccgctggccgcgagcgccgccgagccacgcacgaagttggggacggtggtggccacggtgccgcggatgttggtgccgaactgctcggcggccatggtcaccagcacggcccagtagcccacggtgatgccaatcaggaagctcagcccgtacaccatggtgctggtgaggcccggggtgaggccgtagacgagcatcagcacgaagcccgcggtgaggttcatcgccaccgcgcgcttgcggctcttgagccactggctgaagacgcccgccagcaagtcacccagcgtcaggccgatggagccatagaggatggcgttgccggccgtcacggtgccctggacgttgaggccggccgtcagctcgggcgcgaaggtgaagaggatgcccgtggtgaagtagatgggcacgccgatgaggatgcagcagatgtacttgatgaaccggccgccggtgaggagcagcagcgggttggcgcgcgcggggtccatcttcttgctgaacagctccgactccgacaccttgaagcgcgcgaagagcagcgcgaggcccatgaagccgccggtgaggtaggccgtcttccagtgcatgtgctggcccaggaaggccgcggcgacgatgccgagcatgcccagcgtggcgacgatggtggtccccaggccgcgcttctccttgggcagggactccgccaccagggtaatggccgcgcccagctcacccgcgagccccacgcctccgaggaagcggagaacggcgtagctggtgacgtcccaggcgaaggcgttggccaggttcgcgaaggagtagagcaggatggagccgaacatcaccgacaggcgtccgcgcttgtcggcgagcacgccccacagcaggccgcccaccatcatgcccaccatctgcgcgttgtagatgagcaggccgctctggaggatgtcggccgggtcggtgacgccgatgtccttgagcgatgcgacacgcaccacgccgaacagcgtgatgtcgaagaggtcgacgaagtagccgagcccggccaccagcacggtcaggttgaggaccgagcggagctctctcaggaatttcatacgcccgattaacggactttggcgcgcgaggagcaagcgccccgcgcaggggcatgcatgacgcactgcatgaacctgaattcaccttcaggccatggcctgggcgagcgcctgctcgatctgggacaggccgtagggcttgggcaggattacggcgctgtcgagcggccccttggcaccgatgtccacgttggcgccgtggccggacgcgatgatgacgcgaaggccgggcacgtcctggacggcctggtgggccagctcgatgccggacttgccaggcaggctcacgtcggtgaacaggaggtcgaactcctgtgtgcgcaagaggggcgtggcttcttccgcgcaggcgacggccgtcactgtgtggcccatcgtctccagcagttcgcagacggggaggaggatgttctcgtcgtcctccaccaggaggatgcgcagcccggtctgcttcacgcgagcgggtgccggcgtggtggcgcctcgggtcggctggggggcctcgcgctgggcgatgcgttgctgccgggcggccaggagctggcggatcttccgcgccaggtcctcgcggcggtagggcttgctcagcagttggacacccggatccagccggccgccgtggacaatggcgttctccgtgtagccggacgtgaagagcacctccaggtccggggagagggccttggcctgccgagccagttcggggctgcggaccgggccgggcatcaccacgtcggtgaagagcaggtcgatggggatgccgctctggatgaccgcgagcgcgctctgcccgtcagaggccttgagcacgcggtagcccagctccgtcagcatctccaccgcggtggcgcgcacctccgcgtcgtcctcgacgacgagcagcgtctcggtgccgccttcgacctgttcggggatgacctcggcgcgtggcatctccgcctggagcgaacgcgggaggtagatcttgatggtcgtcccgtggccgacctcgctgtagatcttgacgtggccacccgtctgcttgacgaagccatacaccatgctgagccccaggcccgtgccgtggccttcaggcttggtggtgaagaacggctcgaaggcgcgctccagcacctcgggcggcatgccgcagccggtgtcggagatcgccagcaacacgtgctggcccggcacgacgtccgggtggaactgggcgtagtggtcatccagcatggcgttgccggcctcgacggtcagcttgccttcgctcgccatggcgtcgcgcgcgttgatggccaggttgagaatgacgttttcgagctggttcggatcggcgaacgtgctccaaagcccgccgccgatgatggtctccagcgccacgtcctcgccgagcgcgcgccgcagcaagtcgtccatgtcgcggaccatgcggcccaggttgatgaccgtgggattgagcggctgccgccgggcgaaggccagcaactgggacgcgagccgggcgccgcgctccaccgcgcccaccgccgtggtcagccggcgctgcgcctgggcgttgtcgcccacatccaggaacaggagctgcaggtttccgctgatgacctggagcaggttgttgaagtcgtgcgccacgccgccggtgagcttgcccactgcttccatcttctgggcctgccggagggcggcctctgcttgacgccgttcggcctcgctctcctccaatgcgcgggtgcgctcccggacgagctcctccagatggtccttgtactggcgcagttcgtcctgggcgcgcttctgctccgtgatgtcgtggccctggacgaagatgccggagatggacccgtccggctcgatgatgggctgatacacgaggtcgacgtagctctccgccagcgtgtcatcgggggtttgctgaagggagactttcatgccccggccgacgaaggtctgccccgtggtgaagacacggtccagcagctcgaaatacccctggccatccaattcgggcagggcgtcccggatgtgcttgccgaggatgtcccggtgtccgacgagctgcatgtaggccgtgttcgccagctcgaagacatggccctggccgcgaaagaagcacatgaagcccggcgcctg

SEQ ID NO: 711 - DNA, 5781 bp, Myxococcus xanthus
gtgtgctgtcaggacgggccgtgcccgtgggcgatacctgggcgtgcggcacgccgccgaccatgatggtggggccctgcggaatcggagaggccgaggccgaggcctgcacccccgtgccgggcgccgaggtcggacgcaccggtccctgaccaggacggccggcgccctgatacgagcccggtccctggtaggacggacgtccacccggaccgccgggacgaccacccgggccgcccggaccaccgggacgaccacccgggccgcccggaccaccgggacgaccacccgggccgcccggaccaccgggacgaccacccgggccacccggaccaccggggcgaccaccaccgggcccaccacgctgctggtagccaggcgcggggccccgggagacgacggtcgcggacgaagaagtgctcgaaggcgtccggactgccggcggtaccggtgagcgtggggggggttggggcaaggtggtgctctcctgaacagagggacgaggctgcgcggcggcgggagccggcacggcagcgcggggagcctccaccggggcctgaggggcctcggcggcgggcgggggtgaagccacctcggcggcggcaggggccttggtggcctcggcgacctgcgcggggggcgtagacgtgacagcagccggagccgtgggctccgtggcggcggcgaccggggcctcgacgcgctggggctccggggcgctcggcgcctcgacgggcgcacggggcgcctcgacgggcggaggtgcctgcactggctcctcggcggcgaacgtggcgggctcgggcgccgacggcggctcataggcgggctcggcggcctgtgaagcctcggccccgctgtccgcggtcgcaccggcgggcggacccaccttgcggcgcacgacgaagcccttcgccgtcacgggcggcgtggcctgcttcggcttgcgcttgtccagaatcttctggacggcagcggtcgcctggtcgtcatcgagagacgacgagtggctcttgacgtcgtaaccgaggctcgacagctcggtgacgacctccttgttgtcgagctcaatcccgtggctcttgagttccttggcgatttcgtggacgcgcttcttcgacatattgcccttgatggccttctgctccgccgactccggggcgcagcaccctagtccaaacccgaaaatgtgtgcgagtggtggctaacacccactcccccccgcacccctccgctcaccgtccccctgctcccatgcctgtccgagctgcgacgggtcaacctggcccgcctttccgcgaaaggccctaccaaacgccttccgcttcagcgctgccgtcagacaaccggcaccgcacaggtaggcgccccgtcctggcagccgccttttcctgtccacctcgatggcgcctccgggccctatcacgaaccgggtcagttccgcctgttgtcgccgcgacccgcatccgacgcacgtccggaccggacctgaccccgcattctgaacttccggcctgggccggccagccgggcgccgcacgtcccctccctcgcttagcttacggcgccttggtggcttctgcgccaccctcaagtgccaccgtcatggcgccgcgctcggcattcagctccgcgcgcagcttggcttcctccaccagatagttttccgccgcgctcttcagctggcgggccttcttgatacccacacccggaacatcgcccagcttcgccaggtccttctcgttggcgatgtcctccaccgagcggtaccccgcgaggatgagctgctcgatggtcttctcaccgacgccacgcacgcgcgccatgcgctcgggctggctgagctcgtccggatgccgccgagcctccgcgatgcgggcctgctctctttcataatccatgcgcgacagttccgcctgatcctcgaccatccgggtccgggcggcttcctgcatggaggggatgcgggccgggtcgatgccgggcagctgcgccagcaactccgcgttggcctcggcgatgtcccgggcctgacggaagccgtgcgcgtagagcgtctccaccagcatctcgttgacgccgggcagcgagcccagcgagcggttggcgaactcgcgcagctcccggacccggctctcgctgttgatgtcgagcttccagccggtcagctgggctgccaagcggacgttctgaccgcgacggccaatggccaggctgagctggtcgtccgggacgatgagctccatggcgtggttggcctcgtcgatgatgacgcggctgacctccgccggggccagcgccgagcacacgaagcgggccggatcctcgtcgaaggggacgatgtcgatcttctcgccgcgcagctcctgcaccaccgcctgaacacggctgcccttcataccgacgcaggcgcccacggggtccacgtccgagtcccggctggacacggcaatcttcgcccggccgcccggctcacgcgccgccgcctcgatgacgacgatgccttcggcgatttccggcacctccatctcgaacagcttggtgagcaggttgacggacgcgcggctgaggacaatctgggggcccttggactcacggagcacgtccagcacgtaggcctggacgcggtcgccgggacggtaggtctcacgcgggacctgctcgcgcaccggcagcacggcctcggcgcggcccaggtccacgatgatgttgccgcgctcgaaccggcgggcgatgccggtgacgatttcgttcttccggtcgcggtactcgttgaagacgttctcccgctccgcgtcgcgcgtgcgctgcaggatgacctgcttggccgtctgcgcggcgatgcggccgaagccgcgacggaaggtcttcaggcggaggatgtcaccgtactggtcgtcctgggccttggcctcggcggcgtcctcgtcccggtagaagatctggaacacgagctcgtcgcccggctccacttccatgcccttcttgtgggcctcgaccagggagatctgattcaccgcctggaccggatcgacaatctcctcgaccacggtgatggcctggaacagctccacgacgcccttgtccgggtcgtacttcgcctcgagctcgcggtcctggccaaagtgcttcttggccgcggtcttcatcgcgtcttcgagcgtggcaatcagcacagcccggtcgatgcccttgtccttggcgacctggtccaggacgaggttgaggttgacactcgggttggcttgctgcgtgggcatggtcttctcctaaaagggtccacgggcgccctcgcgcggaggggcaccctgtatgtcgacgtctagaactggaactccaggttcgccttggcgatgtccttgaagaggatgtggaaggttccggccccttccacctccaccgagatgccgtcgcctgccacctcggtcagcgtgccggtgaagttcttgcgcgggggctctcccaccgggccgaacgtcttcaccttcacctgctgtcccttcacccgctcgaagtgcgtcggcttcctcagcggacggtccaccccggggctggaaacctccaggttgtactcgtgggggatgaagtcctccacgtcgagcgacggatccaccgcgcgcgacacctgggtgcactcgtccagccctacgcggccacccggcttgtcgatgaacaaccggagcacccagccctcgcgctcccggaggaattccaggtccacgagctccaggccttcacccgcgacaatgggctcgagcagggccaaggcccgctcctccaccgtctgcttgaggttcttctccgacataagcgggaaaccagtctccaaaaacacgaaaagcgggcacgcggcccacttttcgaagtgcttcatcgaaaaatgtcggggcgtccgtagcacacgcccccgtcggggtgtaaaggaaggacacgccctcctactccgggcgaaacccgcccggcagggcgaggaattcccaggggttccgaggccccatgggggttataacgcgcccatgcacctcatcgccgccgcgcagatggtgtccaccgccgacaaggcccacaacctggaagccgcgacccggctcgtccggcgcgccgtcgcactgggtgcccggctggtgggcctccccgagaacttctcctggatggggccagagcccgagcggcaggacgccgccgaggggctcgacggtccgacgctgtcccagatggccagcctggcccgggagctgaaggtgacgctgctggccggcagcgtgctggagacgggcgcgccgggtgggcgcctctacaacaccagcgtcctcttcggccccggcggcgagcggctggccgtgtaccggaaaatccacctcttcgacgtcgaggtgggagatggtgcgacctatcaggagtccgcggcggtggcgccggggacggaggtggtctccgcggagacggaggtcggccggctggggctatccgtctgctacgacctgcgattccccgaactgtaccggcggctgtcccgcgaaggcgccacgctgctggcggtcccggcggccttcaccctcatgacgggcaaggaccactgggaagtgctcctgcgggcccgcgccatcgagaaccaggcgtacgtgctggcgcccgctcagggaggacggcactccgccaaccgcgtcacctatggccacgccctggtggtggacccgtggggcctggtgactgcgcgggcctccgagggagaggggctcgcgctggcgccggtggacccggagctgcaagcgcgcatccgacgcaacctcccctgcctggagcaccgccgtttgaactagcgtgcgtgtacccaggcccgccccccctcgggtccaccttcgatagacttcgggtcccccggaactcctctcgtgaacggacgacgctggtctcccatgttgcttgcgctcgcgctttcggccctccccgccggctgcaccgccgatgagcgtccgtccgcgcccgacgcggcaacgcctcccacagtggccacgcaccgcgcacacctgcgagccatgaagggcggcgtccaaatcaagcgcgccacggccgacgagtggagccccgcccgggaaggccagccgctctacgagaatgacaaggtccgcaccgaggcgggcgccggcaccgacatcgtcttcgccgccaacggcagcacggtgcacctcaccggggactcgctcatcagcatcgcggagacgcgcacccgccccggccagcagcgcacggacctcaccgtgttgcggggccgcatcgacgcggagctggagaagcccgccacccagtccctgtccgtcaccacgccgtccgccaccatccaggcgggaagggagattgtcttccaatgaaggcggcgctcctcctcctcacatggctgggcacgacgcccccgggcaccgtggtggtgggccccaacgaatccctgcgccaggtggcccagcgcaccctgggcgacgcgcgcgccgcggaggaactgcgcgcactcaacggactttcctcggacgacgtggcggcggggacccggctgaaggtgcccggccacgagcgcgtgctggcgcacaaggccctggagacggcgcgcacgctggtggccagatctaagcatgcgagcgtccccccaccggcctcctgccggcttaaggtcacgaagtcccatgtccacgaggcgcaatacatgcagtgttcctcgtaggccaacgtcgtgtggaagctggaggggacagagcgctcgctgcagtcctccgagttcttcgtgttaat

SEQ ID NO: 712 - DNA, 3465 bp, Myxococcus xanthus
gcaccagtggggtgccccagtccggcggtccgcaagacgaactggcacatgccgtgaccacctccggcgacgcggtctatacggcgggctacaccagtgggcagctcggcgcggagccctcggcggggggacaggacgcctacgtttcgaagtacgacgcctcgggcgcgctgctgtggacgcggcaactgggaacatccgcgaatgaccgtgcgctcgcggtgtccgcggatgaatccggcaacgtctacgtcgcgggctacacgtggggcagcttcagcttctacgagaacgccggcggcacggacttgttcgtggcgaagtacgacgcgaagggggccttccagtgggtccggcagttcggcaccgccacggatgactacgccacgggcatcgccgccacgcggctggcgtcgcatgacgtggtcttcgtcagtggctactcactggggcgcttcgatggctcggcgccgcaaggcaactacgacgtggtggtggccaagttcgacacgggcggcaatccctactggctgcgccagttcggctccgcgcgcagtgacgtggcgctgggcgtggccgtgagccccaacgaggacgtctatgtcacgggctacacctacggcagcttcgacggcgtgacgaacccgggcaacacggtggacctgttcctggcgaagtacagcgtcctgggcgagccgcagtggattcgccagctcggctcctcgcatgacgagttcggcaccggcgtcgcggtggcggacgacggcggcgtctacgtgtcgggctacacgtcgggcgcgctggaggggagcacccgcctgggctcctatgacgccgtgctggtgaagtacgacacccaaggcaactggcattggacgcggcagattggcacggcgaccaccgactacgcgcagtccgtggcggtgggcaaggagggccgtgtctacctggcgggattcacctccggcgccatgggcggcgaaccgttgctcgggagcaccgacatgttcctggccacctacgacagccgcggcacgtggctggatttccggcaggtgggctccacgtcggcggaccgtggccagggcgtggccaccgcggaggacggctccgtctatctggtgggctacaccttggggcagacgtccagcttccccagcgcggggggctacgacgcggtgctgtaccgcttcctggatggcgccgcgttgccggatgagccgggtccatgggggccccgaggggactccaagggcctctgagccattcgccgtccagcacgggacatcgtcgcgcggggacatcagccaccgcgcgccgccgcgctacgcttccgccatgagccagcagggcgacggcgcggcgacggcccgctacaaacaagcggccgccgaatgggcggtggacggcttcctccagccgggcatggtggtgggcctgggcacgggcagcaccgcggccttcgccgtccagcggctgaccgcgctgcgcgcgcagggacggcttctggacatcgtgggcgtgcccacctcgcgcgccacggaggcgctggctcgctcgctgggcgtgcccgtgtcgacgttggacgcgcaccccgtgctggacgtcaccctcgacggcgcggacgaagtggcgccggacctgtcgctcatcaagggcggaggtggcgcgctgctgcgcgagaagatcgtcgcgcaagcaagccggcgcgtcgtcatcgtggtggacgcgggaaagctctcccccgtgctgggcacgcactggccggtgccggtggaggtgatgtccttcggttggcgctcccaggcgcggttcctcgaatcgcttggcgcgcgcgtcaccgtccggcagggcgctggcggcgagcccttcctcacggaccagggcaacctcgtgctcgactgcgccttcggccccatcgacgcgcccgcggcgctggccgcgagcctgggcgcgcgcgcgggaatcatgggccacggcttgttcctgaacctcgccacggacctggtggtggcggggccggagggcgtggagcaccgcgcgcgctgatgtcaacgcggtgtgagcgcgcacccagagtcctctctcacccagaaggcaaacagtggcaacgtaggcgattgtatggccagtttattctgcaatccttgcattcactggcgtttgaagccaatcccagcgcaatcccgcagttcgcctggacgctcaggggcgctgaagcgccgcgctagaatcgtgacggaccgtgttggtgaagcggttagaatcgtccgccagccagcacttcagagggggccaatctgggggtggctggtccgagggtgccttgcgtatgcgactcttccgtttctctgtttccgcggccttgctgctgtcagcagcgtcgtgctcttccgacaaaaccccgccagggggggcgcctcctgaagtcgacgaggcttcggcgacgcgtgtgcggcgcatgacgcgtgcggagtacgacaacagcgtcaatgccatcttccccacgacggtgccgctggtgatgacgtacgccttcgcgccggaggacaccatcctcgggttctccacccatgaccggctgcaggtcacgtccttgctggcggaccagattgacgtggccgcgaacaacctcgcggagtacggcaaggtccaactgcgcgcggactggacatgcgcggcgggcgttccggattcggagtgcgcggagaagttcatccgcggcatcgcctcgcacgcctaccgccggcccgtcaccgacgaagaggtcgccgacttcctggtgctgtggcaggaatcgagcagggggacggacccaggcaccggggcccgcatggtgctccagggcatcttctcctcggcgtccttcctgtaccgcaccgagctgggcgcggagggtgccggcgccaatcaggtggtgcggatgacgccgaatgaagtcgccaccgcgctggccttcgccatcaccgccggccccgccgacgcggagctgatggccgcggccgaggcgggccaactcgactctccggacgagcgtgagaagcacgcccgccggctgctggccacgcccgcggcgcagcggcacctgtaccgcttcgtcgaggagtggctgggcatcaccggccaggccaacctcaccaagaacaaccaggtgttcccggtcttcagcgcggccttcaaggtctccagccaggcggagacgaaggccttcatcaaccacatcctgaaggagcgcaacggctccgtccgcgagttgctcaacgccgactacacctacgccgacgcgcgcatggcgtacttctacggcacccagccctccatgccggacggcacgctgggccggttgccgctgccggccgagcgcgcgggcattctcacccacgccagcgtgctggccacctacgcgctcttcgactccagctcgcccatccgccggggcaagttcatcatgcaccgcctgctgtg

SEQ ID NO: 713 - DNA, 6119 bp, Myxococcus xanthus
agagcgcgcgcgacccgagcccggtgcaggagcccacacgcccttcgacgcccgcgctctcggctgtctcggtcgagcgcggagcccgcgtgccggagctgaccggcacggagagcacggcgcgcgccgcgactggcggcggacgaccgtcgccggaagagcgcgtcttcgagcggcccacgggcagtctctcctcgcgagacgtcgccgtggccttcgtcatcgggaagcactccgtggcgcctgctccggagccggagccagccaagcggcccgcgacgactgtggcggaagccgcgacggctggcagctcggaggacgacctggggcccgacgcggacttcgaccgcgtgctctccggcccagggcccaacgccaccaagcaccacaagccgaccgtctatgttccgcccgacccgacggcgccgcgcgagtcgctcgacctggccaccgtcttcgcggtggtgcatgcccggcgttcggagctggcggcgtgtgcccgggagcagtccgcgccgccgcaggagggggaccgggcagtcctgcgcttgagcgtccttccgagcgggaaggtggagtccatcaccaccgagacgccgtggctgcgaggcacgtcgctcgtgcgttgcatgcagcagaagataggcgcctggacgtttcccaggcatcgaacgcagggagcgcccgtcgtcttccgatacgagttctgagccgccgcgaggagcgcccatgcctgcttacgtcctggtcgaggtctcggtgcacgacgcgcagacctacgagcggtacaagcagctcgcgcctccgtcgctcaaggcctacgggggccgctaccttgtcaagggtggccccacccaggccctggaaggcacctggcagcctccgcgcttcgtcctgctggagttccccagcgtggagctcgccagggcctggtgggcatccccggaatacgccgccgccaaggcgctccgccacgaaagcgcgcactccatcatgttgctggtggagggcgtgccggccacgacgcccgttaccgaagtaggggagtcgccggcctgagcggccgctggaaagccgaagcccggcgccagtccgcggtgtgtcgcgggccgggccgggctcgggtgtcttcagtgaagcgggaggactagttcacgccgacggcggtccagctctccttgaccttcgccacttcagcggagtccgcgccgtagaggtccgtcgccgcgttgatggtcgcggtgcgggcctgggcgaacgtggtgctcggcgtcatgtagtgagccagggcgcggtagtagatcttcaggcccttctccatgccgatggcgtccttcacttcgatgccggacgtgcggttggttccgccgttggtcagcaggtagaaggcgttgttcgcgatgccgctggagccgtgcacctcggtctgcttcgggtagttcttgtagttgtcgaccgagtagttgtccttcgtcggatcgtccatgtagcgcaggccgtcggtggggtcgccgttcttcggcgtccaggccgtctcgcccaccgtccagttgaacttcacgtcggggttcttctgggacgcgtaccactcgaggccagcgcccatgatgtcgctcatcgcctcgttcagaccaccggactcgccgcggtagatgaggccggcggtgcgctcggtgaggccgtgggcaatctcatggcccgcgatgtccagcgcggtgagcggaccggagttgcggccgtcgccgtcgccgtagctcatcttctcgccgtcccagtacgcgttcacgtagttgttgctgacgtggacgtaggacaccagcttctcacccgcgccgtcgatggagtcacggccgaggatgtccttcatgtagtcgtacatcatctggccgccgtagtgcgcgtccaccgcggccttgttgcgctccgggtccgtggcctcgccccagacgtcgttgttgtccttgatctgcgtctggccgctggcgcgctcgcggttcatcgcgtcgtaggtcgccacgcccttgccgcgcgtgccgtcctcgagcgtgtacgtgccgtccgcctgcttcttcgtttccagcgcgaccttgccgctgtacatggacgtgtcgtccgcgatcttctcgccgggaccgggctcgttgggctcaacggccttcggggtgatggtcaggccccagctgttcagcgtgcccgtgtcgcggcgcgcgttgtccttcaccgacagcgtccactcgcccttcgcggactcgcccgcgaagccgctcaggtcgaagctgcccttgatgtggtccgcgctgccacccttgcggttgtgcaccgtctccgacttgccggaggggctggtgagcgtgaccgacaggtcgcccttgaacgtgtggtcgatgtccaggtccagcttcagctggtccacggtgccgtcctgggtcacgttgatcttcgacgtgacggtggccaggtcggcgatctccgccttcggcgtggccgaggccttgatctcggaagccgtcgcggcagcgccgtgggcgtggtcggcgtggtccgcgccttcggcgtgggtgtggccatgcgcggcgccgtgctggcgggcgaagccgtcaatggtgttgaactgctcgaagagcttcccggtgttggcgtccaccaggtagttcatcttgcgcggattgtcggtgccatccacgttggtgacttccacccggtaggcggagtggtactcaccggagatgtccttgtagatgacgcgctcggagttcggctggcggtccggcttgccgtcgaacgccttcatcgcgatgtccagcgcctggctgtgcgacaccttgggcttctccttgcccaggccggccgggatctcagactggtcgccggtggtgctcttgaccttgccctcggcgtcgaggtgcgtgacgacctgctcgccgaagaccttcacgccctcgtgctggcggtccagacgcacgtgcgtcatgcccagcgagtcacgctccacgctcttcggcgtgtacgccgggaactgcacgccgccgatgatgccggggttgcggatggaggtctgggtggagggggccaggtgcgccagcgacgtctggatggcggtctgcgcctcgcggctttccagggagagccggcccacgggaggcggcagcggcttcagcgtcttctccgcgcgcgccaggtccgacgtcttggccgcggggccgaacccgtccttgatgacgttcggggcgatggtcgcgggcttcgcggccgtcttcgactgagcctcggaagcagcagtggagcgaatcgtgggcttcggaccttcggtgcggcgaatcgtcattgggggtctcgaactcagtgcaagggggttgaagagttatcgccgcagtgtggcgcggagtttcttgcgatattttcaacgcaataagccattctcgaaaggcaagtaaaaccctgtcgaggttccgttgaaatcaggttacggacgtgtaaacacgcccgttctttcacggggtgtgtgcgcgatgctgctgcacggagtggaggggcggcgaaattcggcagaaatcagccgaaaaaagaaacctcgagaaaccgcacatagaggttgcaagccgcgtgaaacaaggcggcgccgatgacggtgccggtgcgctcccgcatccacccgaagatcagcgctgggaagaacacggacagccgccacgcctggaagatggccaggtggcccagggcgaacagcagcgccgtcagccagaaggcggggcccagccggccccccaggaacttgcggccctggggccaggcgtcgcgcagccgcgtctggaggtagccccggtagaagaactcctccggcagcgcgacgacgaagagctggtcgatgaaccactcgccgaagcgcgggggcaggcggggctggaagcgggcctcgcccatcagcggagtgaggtgcttggccagcgccgggggcaggtgggggagcacctccacgaacgcggcgaaacccaggaagaagagggggcccaccaccgcggacagcagcaggaacaggcgcaggtcctcgcgccacgcgcgcagtgacaggccgtagtccccgtagtcctcgtcccgccagcgcatggggatgagcggcaggtagaggaagcccactgtcgcgaccagcttggggatgctggtgccgcccaacaggaggaacgcggcgacgatggacaggaagcccacggcccacaatcccaccgcttcctgaacggcgttcggtcgccagggcgtcgtcacggcctgggtcatggcatgtccaccgacgccagctccaccttcacggcgctcagcggaagcacccggcagccgcgacggtgcttcttcaccaccaccgccaccagccgcccctccgcgtcgaagacggggctgcccgcgggcagggccagggggacatcatagaaggggggctgggccgcccgggctcgcgccggcacggggcgcgcgggctggcccttcttggcggggaggacgcccaccagccagcggccgtcaaggctgtcgccgtcccgaagcaccttcacgggcgccgccgggtacgcgccatccggagcggcgagcaccgccacctggaggtcctggctggccatcaccacgcgggcgggcagcgtcttaccgtcgtgctccaccatggcggcattcaggccggcgaagctggcccccactggagtgacggacgtgaggacctgtcccgcggaccccacgaagacaccgggccccgcgttccgaggacccttgacgtgcaccaccgagcgcccgtgtcggtccagcacccgttggaggtcggcgcgcgagggcttgtccgcctccgccgcggcggaggccaaggggaggaggcagaggaggagcagcggccgcaggcgggacatcggtggttgccgcagcctatcaccggcgctcgcgcagcgcggtgacaaaacggtccgtcgggagcgtgttgagcacgtccccctttcgggcccagccccggcgcgcggtagccaccgcgaaggccaggttcctcaggtcctccttctggtgcgcgtcgcagctcaccaccaggcggacgccccgcttcacagcctgccggacatattcggccttgatgtccaggcgcgcgggcttgccgttgacctccacggccacgccgcgttcggcggcccgctccaggacctcgtccatgcggacggggtagggttcccggctgttgatgagccggccggtggggtgccccagaatctggaggcaggggttgtccatcgcggccagcagccggcgcgtcatctggtcctcgtccatgccgtgccggacgtggatggagccgatgacgacctcgagctgctccaggacgctgtcggcgtagtcgagcgcgccggactccaggatgtcgacctcgatgcccttgagcagccgcacgccggagaccgccgcgttgatgcggtcgatctcctcccactggcgcttgaggtcatccaccttcaagccgcctgcgtagatggctgcctcgctgtgctcggtgacggtcaggtacttcagacccagcgcccgcgccgcgagcgccatctcctccaggctgttgcgcccgtcggaccaggtgctgtgcgcgtggaccgcaccctggacgtcctccagcgtgagcaggtcctggggaagctgtccctcgcgtgcggcctccacctcgccgttgtcctcccgcagctcggggggcacgtactgcatgtccagcagggcgtagagcccggactcgtccgtcacgggcaccttggtgccgtcgtcccggtggacgccccattcggaaatcttgaggccgcgttcctgccccaggttgcgcaggcggatgtggtgcgccttggagccggtgaagtggtgcagggcggtggcgaagtcctcgtcgggcagcacgcgcaggtccacctggaggtcgccggcctccaaccgcacggagcatttgctttcgcccttgcccagcaccgcggccacgccgggtgcgttcgccagggcatccagcaccggtcccgcctccggcgcggaggcgatgatgtccacgtccgccacggtctccgcctgtcggcgcacgctgccgcccaggcttggcgcgcaccacgcccgggcgcgggctt

SEQ ID NO: 714 - DNA, 5245 bp, Myxococcus xanthus
gtgctctaaagttgcccagctccagcagaccctgcagcagctgacccagcgcaacgtccttctggagacgcgcgtggaccccagcctgttgggtggtgtctccgcccaggtgggcagcatcctctacgacggcagcatccggacccagctcgaagagatgcgccgcgaattgaagcagcgctgaagtccgcccgctcgccgggcaaccaacgttccaggtcgtcttcatcaccccgcagtccagggctaaccggtatttccagcgggccctgacagcggtatactcgcaggtggtgcgggacagccccgcgccgcctggacgacctgaccatgtcgcagtccctactccaccggtattccgaaggtccgtccacgctggcggcgcccgaggaggctcggccctttctgggggccctcctgagcgcggcgggttgtggggtggccctgctggaccgggagctgcgtccggtgtgggtgaatgccacgctggcggcgctgtccggcctggagccgcgcgcgcacgtgggccgtcctctcgcggagctgtggccgcaggtggcgcaggcgctgtcaccgctgctggcccgggcactctccggagaggacgtcacggatacccctgtgcggggcgtgctggcccccgccgcgggtgagcggcacctgcgggtgggtctgtccccggcgctgcagggcggcgcgctggcgggggtggcattgtgggtgcgcgatgagacggagcgcttcctcgaggagcagcggctgcgcgcgcgggagtctcacatgcgcagcctggcggacgtggcctgcgacgggcacttcctgcatgacaacggcatcgtgatggacgccaaccgcgcgatgtcgcagctgctcggctacgcgtcaccctcagagatgatcggccggcacctggcggactacgtcgccccggagttccgctcgcaggtggggctggtgctcagccgcgggctggaggccccctacgaggtggtcgtcctccgccgggatggccagcggctgcccctggaggtgctggggcgctacgtgacgtgggaaggccggcaggtgcggttggtcgccgtctgggacatcagcagccgcaaggccgcggaggagctctccgcgaacaccgagcagttccggcaccagatgctgggcgccgtagacgcggagctgcgagcgcccctgcaatcactgcgggagggcacgcgctccctgcagcggctggacgggctggaggagccgcagcggaccctggtgagccaggtggcccggtccgcccggcgcatggagcggatgctccaggagttgatggacttcacccgcacgcggctggcgggcggactggcgctgcggccagagcccgccgtgctggacgcggtggtgacgcgcgtcgtggaggagcgccgccgtgagcatcccgggcgaaccctccacctggagacggaaggcgacctgcgcggacactgggatacccaccggctggcgcaactggccgacaacctcctgggcagcgtgctccatcaaggggccgaggattcgccggtcaccctgcgcgcggtgggcgcggtgggcggcgtcacgctgtgtgtgcagagtcccagactcacggtggcggcggaggagcgctcctccctcttcgagcccttccgcagggagcgcagcgccacgccagagggcctgggcctggggctctacatcgccaggcagatcgccgtggcccacggcgggaagctggcggtggagtcctgctccgggggcggcatgagtttcaccgcctggctgccccgcgaggggccggggcattgaaggcctccgcgcctggcgccgcctcaacggaggctgatgcaccagagtagccaggcacgattctggcccacccccttgagcgcctttgcgcagccgcctgtcccactcctgaacgggcgtcctctccgcccccgtggcgggtggcgcggaccgcattgcagcgggtgggtgtgcgtggtaaggggccccgacttcaaggtttcggcggcctgctccacgtcggccgcccctgcgcaaggacgcatacgctcatggaaatccgcgccgacgagatcagcagaatcatccgggagcagatcaaggactacgggaagaaggtcaccgtcgctgagacgggtaccgtgctgtccgtcggtgacggtatcgcgcgcatctacggcctcgagggcgcgctcgccggtgagctcgtggagttcgccaacggcgtgcagggcctcgtcctcaacctggaagaggacaacgtcggcgtcgccatcatgggtgacttccaggccatccgcgagggtgacacggtcaagcgcacccagcagattgcctccgtgccggtgggcaaggagctgctcggccgcgtggtggacccgctcggcaagccgctggacggcaagggccccatcgccgccaccgagacgcgccgcctggaagtgaaggcgcccggcatcgtgtcccgcaagagcgtgcacgagcccctgcagacgggcatcaaggcgctggacgcgctggtgccggtgggtcgtggtcagcgcgagctcatcatcggtgaccgtcagacgggcaagacggccgtcgccatcgacaccatcatcaaccagaagggcctgaacgtttactgcatctacgtggccatcggccagaagcagtcgacggtggcccaggtggtggagaagctgaaccgctacggcgccatggagtacaccacggtggtggcgtccaacgcctccgacccggcccccatgcagttcttcgcgccgtacgccggcgtggccatgggcgagtacttccgcgacaacaagatgcacgcgctcatcgtgtacgacgacctgtccaagcaggccgtggcgtaccgccagctgtcgctgctgctccgccgtccgccgggacgcgaggcctaccccggcgacgtgttctacgtgcacagccgcctgctggagcgcgccgccaagctgtccgacgaggagggcgccggttcgctcaccgcgctccccatcatcgagacgcaggccggtgacgtgtcggcgtacatcccgacgaacgtcatctccatcaccgacgggcagatcttcctcgagacggacctcttcttcgccggcgtccgcccggccatcaacgtgggcctctccgtgtcccgcgtcggttcggccgcgcagatcaaggccatgaagcaggtcgccggcaccatgaagctggagctcgcgcagtaccgcgagctggccgccttcgcccagttcggctccgacctcgacaaggccacccaggagacgctggcgcgcggcgcccgcatggtggagctgctcaagcagggccagtacgagcccatgcccgtcgagaagcaggtcatgcagatctacgccgccaccaaccgcgacgaccccaagaagcgcggctggattcgcgacatcccgacggccgacgtggtgcgctggatgcgtgagttcctggagttcgccgacggcaagcacccgaacgtcgccaaggacctggcgtcgaagcgtgagctgaccgccgacatcaagacggcgctgagcaaggccatcaccgagttcaacgaggtcttccagccgacgccgggcgccaaggtttaacgccctcgccggttgtgacccacgagccccgcgctcccttcaccgggaggcggggcttcgtgcttgcgggcccggccttcagcgaaggcggggcagcacgccgtgcaggctgcggtccacgccgccgcgcgcgcccagcagctccatggccttcagctcgtagggcagcacgttgtcgcgggccaccagttgcacgtgcgcgcccagcgcggcgggcagcgccaggtccagctcgtagatgtcaccggccaccagcgtctgttccggcgtggtgcccgtggacgcccagacgcgcttgagggcctcgaagtaccggccccggcgcaggtagacggggcggcgcagcacaccgtccagcgtctgcgtctccggtaccgcggtgaagcgggcatccggcgcgtccggcgggtccaggaggaacttgcgcgcatccccggacaccgtcagcttctcgcgccccttgggcgccaactggtccagcttcttctccaccaggtcggtgtgcgcgttggtcaccaccgtcaccggcaggcccgtggccaccagcgcctccagcacctccttcgcctccggcttgaaggcggtggccgagtgcgcgtaggcctcgcggtagagcttctgcaccacgtcggagcggcgggcctcgtcctggccctgcccgaagcgctgcatgaggcggtgggccgcgcaggtggccgtcaggtacgggtccgccgtggcgggcgccaccacccggccgcccaaatcccaacccagcgcgtccgcgcccgcgcgcaacgtggcgacctcctcctcccacgcggcctccaaatcctcgcccaacgccgccgccaggccctgccggaaatgccggaggaagggggcgctctccgccgccacgtccgtgaaggttccgtcgaagtccagcaccacgcacgcaatcgccatcagaccaccaactcccgaagatgaagaaaggggccggatgaggcctcacccatgggcctcgaatcaagcccgcccgcatcaacaggcggtcgggtagccaccgccctcgggagcatcaccccgaggacgttctccctgcaccccgggttatcatccagccacggaacggcccgacgtacaggcccaggccacacccgcagcctgtcgccacgtccgccagattgcccgcgcccacggcggcgagctgacggtggaagcgccccccgtgggccccggcgcgcgcttcgtgctgcgcctgcccatgccccaggtgccgcaggctcccacgtcctccccttgaagcctaccccgcccaggccgctaacctcacggacatggaagcgatgcagcgaaacgagtcggcgcccccgcgccgggcgtggctgccctggggcctgctggtgagcgcggtgctgctcgccacgacaggggcctgggcgggttcgcgctccatctccgccctggtggagcgcaacgacgcgctgacacgcgaggcggccgagtccgaggcccgcgtggccgagctccaggccctgcgcgaggccatgtcgcgccggctgcgcacgctggagcagcagcaccacgccgcctatgccgccgcggtgacggccaccgccgcgtgcaccacggcgctccagccgccgcccgcgccgggcaagcccttagagcac

SEQ ID NO: 715 - DNA, 7317 bp, Myxococcus xanthus
  unsure (1)..(7317): unsure at all n locations
ctaaagggcgccatcttcaacctgcccattggcgacaatgccagcggtgatgacccgctgtccgggctggcgggcctcttcggaggcggcgcgggcggcaaggacggcgcgtcctccggcggccctcagcccgcgggcctgggcggcatgggcggcgcggccatgggcatggcccagcccatgttcacgcagatggtggaacagatcacccagacggtccgcgaggtgcacctcaccgtctactggcaggaaggcacgcaggtggagagcatcgacctggtgacacacgtcgtgtcgctcgggccgggctcggaccgcaacggcggcgccgccgcggcccagggcggaggctccgacaaccagtgggtgacgcaggacgggcggcccgtggccaaccccatccccggccccaacggcgtcatgttggatccgacgacgcgccagcccctgcgccgcctctccgacgcgcagcaggacctgggcggccgccgggggaacatgggcggcggcagcccgctgggcaacccgatgatgccgggcggcttccgagggactcgatgatgcggcgtcacacgcgaggcttcacgttgatggaagtcatggtggccgtcgccatcaccgccctcatgggcacggtggtggccatggccttccagacgggcctgacggcgaaggagacggtggaggtggacgcggaccgctaccggcaggtccgcgtggccatgaaccgcatggcgcgtgagattggctccgcctacgtcagcgaccgctacgactccacccgcttccgggaccagaacgaccggcccagcaacttcgtgggggagcgtggcaagctgctgttcaccaccttctcgcaccagcgcctctacacggacgtgaaggagtccgaccaggccatcgtcgggtacttcgtggaggcgtcggaggaccgggaggcccgcggccggcaggacctcaagcggcgcgtcaacgcaaacatcgacgagcgcatggagcagggcggccacgtggacgtgctcttcgaaggcgtgaaggagctggagttcgcctactgggattcggagaagaaggagtgggatgacgagtgggacacgcggcggacggagcgcaagtccatcctgcccacccgggtgcgcgtgacgctgacggcggtggacgaaacgggcaaggaagcccgttacgtcacccaggcccgaatcatgctcaacacggagctgccgaggtactgagccatgcccctgcccttcttccagcagacgccccggcggcgacgcaagcccccgccccgcccggcgcggcgggagcggcgctcgcggggcgtggcgctcatcatcgccattgtctccatcgccctcctgacggtgattgccaccgacttcgcctacaacagccgggtggacctgcagctggcggccaaccagcgggacgaagtgcgcgcctactacatggcgcgctcgggcatcgcgctgtcgcggctgctgctgcgcttccagaagcaggtggaccagacgcccatccccaacccggcggccatcctggggcagttgggcatcggcggcacgccgcaggccgggcaggtgcagccctcctcgctcaacatccagctcttcaagatggcgcgtgtggactgccacatgctccgcgggctggtgaagagcgacggcgcgggtggagaagtctccgcgctggagcccaagcaggacgacaacttcaagctggatgaagaggacgcggacccggcggcgcgcgaggtcgcctcgcagatgaccatgcgctccttcggcggcttcgaaggctgcttcctggccaccatctccgacgaggaagagaagctcaacgtgcaccggctcatcgcgggcgcgggtgacgcgcggcccacggcgctgcggctcatggacatgatggcggacccgcgcttcgagttcctctgggagcgagacgacgccaacaaggtgcgcagcacgccccaggacgtcctcctggccctcaaggactgggcggacgacgaccggacaggctcggcgttcaacccggtggacccggtgaatccgctgccgggtgggttctcggatgaaggcgcggcctacagccgttatgagcccggctatcagcccaagaacgcgcgcttcgacagcgtggacgagctgtaccgggtccacggcgtcaacgaccagttcatggcggcgttccgggaccgcctcaccgtctatccggacatcaaccgccggcccaacatcaacaccgacgacccggtgatgatggggctggccatcatgtcggtggcggaccagacgcggccggacccgcggctgagggacccggtgttcctcaacgagctcatcgaacgcgtgcgcgccgcgcgcatgttcagcttcttcgggatgtccgtgcaggacttcgtcgcggtggtggaagccgcgggcatcctggtcgacccggccgtgaagtccaacgtcgcgggcaaccggctcgtgggcgacaagagtcagaccttcaccatcaaatctgtgggagaagcgggcagcgtgcagaagacgctgaccgccgtcatccggctcgacgacactctgggccggctcctgtactggagagaggaatagcatggcccgtatccttggcctggacctcggcagtcacgccgtgaagggcgtggtgctggaggcgaagacgaagacgcacaccacccatgggttcgccgaggtccggcgtgcccaggagggcgagcgtgccgacacgctgcgagccgcggtgcaggagctgctgggccagctcccgccgggcaacgtggaccagattgtcatcgccctgcccggccccgcgctcaccacgcactcgctgagcctgccgttctccgacgccaggcgcatcgaggcgacgctgcccttcgaggtcggcagccagcttcccttcgacatctccgacgtcgtctatgactaccaggtcgtgggcctgaaggacggcgaaggcaaggagaaggccagcgacctgctggtgggcgtggtgcgcaaggaagagctggcggagctgctggcgctgctgtccgagctgaaggtggacccgcgcatcgtcacgcacccgggcctgacctaccagaacctgttccagcagcacccgggcctcttccaaggaacgggtgaaggtggcgcggtggcggtggtagacatcggccacgagcgcacctccgtgtcggtgggcaagcccggtgagggcgtccagttcgcgcgcaccttctccggcggcggcaaggacttgagcaaggcgctggcgacggagttccagacgtcgctggcggaggcgcaccactggaaggagcagcacggcgcggtggccagcgcggcccagggcccggacgcggagcgcgcggcggcggccttcgtgcgcggcctgcagccgatgctgcgcgagctgcgccccactctcaaggccttcacggcccgcacccgtcagcaggtgggcgcggtggtgctgtgcggtggcaccgcgaagctgccgggtatcgccgagcaactctcccgggacttgaatctgccggtgcgggtgctggcgctgcccgcggacgcgaaggcgattcccgcggcggagcagcccgtggcggcccaggcgtattcgctgtccctgcgcggcaacgcggcgggcgtgcgcgcgccgcgcttcaacctgcgccggggcgagttcgccttcaagggcgacttcgactacatgaaggacaagctggggctcctggcgtccttcgcggccacgctcatcctgctgctcatcgcgttcggcgtggtgcgcaactccgtgctggcgcggcgcgaggcgcaggtggacgccgtgctgtgtgacaccacccagcgaatcctgggccggtgcgagaaggactacaaccgcgcgctcaacatgctcgcgggcgtggagagcccggcggcggcgctgccccggctgacggcggtcaacctcctggcggaggtgacggggcgcgttccggacgacatgccggtgaagttcacccgcatccagatcgacctgagccgcgtcatcctcgagggtgagacggactcctcgaagcagatcgacacgctgtccaacgccatcaagaaccacgtctgcttcaaggacgtccggcagggcaaggtggagaagacgcgggacggcagcaagatgtccttccgcctggacgtgcaggtgcaatgccctggtgagcagggaggagagagctgaccatggccaagcttcaggaagtcttcgcccccgtccagacgtggttcgagcggctcagcgaccgcgagcgccgcatggtgtccatcgccggcgcggcggtgctggtgttcgtcctgttcgccgtggtgatgacgttcaccaacagcgcgtccgggtaccgcaagcgcaccgaggacaatctgaccaagctgcaggaagtgaacacgctggccgccagcttccgcgaggcgcaggccaaccgtcagtcggtggagcagcagctcaggtccagcaacgtgcagctcatcagctacatcgaggacaaggcgacgctggccggcctccaggtgcccaacatgacgcccaagggcgaggtgggcatcggcgacgggaaaatcgtggagagcgccgtggagctgaccttcacggacgtggacctgcgcaagctgaccgacttcctgcagacggtggagagcggccccggcgtggtgaaggtgaagctgttgcgcatcgagccgcgtcccgcgtcggacacgctgacggcgtggaccactgtcgccacctaccggatgaagccctgacccatgtccactgactccaaagccgcccgctggaagattctcctcggctacgccgcgttcgcggtggtggccttcgtcgtgggcctgctcgtcaccttcccgtacgacgccatccgcaagcggctggtcagcgaagcggcccaggcggggctcgcggtgcgcatcggttcgctgcgccctggcctggcgggcatcaccgccaccaacgtgcgcgtgagcaagccgccccagccgctgagcgcggacacggtggcggccctcgcgcggggcgaaggcatgctgggcgccgcggagctgggcgagccgctggtgctggacagcgtggcgctgcgccccgccctcttcccgccgggcatcgcgctgcgcgccagcgtcatgggcggcacgctgagcgcctccgtgggcctgctgggtgacacgcgcgtcaaggtgacggcggacgggctccaggcctccggcggcaacctgccggccttcaccggcatggacctggacggcgagctgaacgcggccctgtcgctgacgatgcccaagagtggcgcgcaaccggacctgtcccaggccaacggtgagctgacgctggacacccggaacatggtcatcaagagcggcaaggtggccatccccatgggaggcggcacggcggtgcccatggacctgccgcaaatcgacctgggcgcgctcaccgggcgcatccagttcgtcaagggactgggcacggtggagtcgctgcgcctgaagagcaacgagctggaggcagtggccactggcacgctgaagctgggcaagcgcctggagtacagcgagcccggcatggatgtgaacatcaagctggacccggagttccagaagcggctgggcctggtgggcgcgggcgtcaccatcctcccgccggacaagacggaccccagcttccgcgccgcccggctcgccggcttcctcaaccggccgacgttcctcccgcggcgctgagcgcccgctcccccgcgccctcctccgggcgcggggttgaaagccgaacaccagggcgtgtaaagcgctctcaggcgctggactgctgagagggctgggatgccggagctggtgttctttcgtcgtggcgaggaggtgttgcgggtgggggtggaccgggcacggctggtgctcggacgcggcgagcagagcgacgtcgccatcccagaccccgaggtgagccgcctccaggtcgcgttgctgtgggacggcgagcgctgccgggtggaggatttgtccggcaagggcaccaccgtcgccggccagtccatcacccacggcgagctgccagacggcgcggacctggcgctgggccaatggcgcgcggtgttccgcatcagcggcggcagcgaaggcgcggacgtcaccaccgaggtgggccacacgacgtccgtccagtcccgcgacacgcaggccccgcgctggcagcccgcgcaggtgcgggtgaagcagggcctcaatgagtccgtgcaccgcttcacgggtgaaggcttcaccgcgggcaaggacgccggctgcgacctggtgctccaggaccgcttcgcctccagccggcacctgaaggtgacccggcgcgacaacaccttccacgtcgtggacctgcgctccaccaacgggacgtggatgggcccggtgcgcgtcttcgaggcggaagtcccgctgcccaccgtgctgcgcgtgggtgagacggagctggtgctggagcctgccgcgcccaccacgcgcaaggagcccacgtccttccacggcatcatcggcggcgacccgtcggtgcggcagctctcggagttgattgagcgggtggccccgtcctccgcggcggtgacgattctgggcgagtccggcaccggcaaggagctggtggcccgcgccatccacgcctgctcgcagcgggcgaaccggccgctggtgcccgtcaactgcgcggccatctccaaggagctcatcgagagcgagctcttcggccatgagaagggttccttcaccggcgccatgggcgcgcgcaagggcgccttcgaggaggccgacggaggcaccctcttcctggacgagattggcgagctgccgctgtacttgcagacctagctgctgcgcacgctggaagcgtgttaaatcaagtgtgtgagaaccagccgacggcaccaggtggacctgtgggtggtgcagnccaccaacagggtcttgctgccggcggcgcgcgaggcccccttccccgagagacctgtacatactggatttgtgtcatccccctgcacctacggccgctgcgcagcagtaaggcggacctgggctcactgtcaaagcaattcgtgcgcacctacgcccggagtggccagtccgtgagcttcacacccgcggccttggacagtctccagcgccacgcgtggccgggcaacatccgcgagctgcgcaacgtggtgcaccgcgcgctgcttttgcgcaaggggcccctcatagacgcgggggacatctccttcgaccagtagatgacccgcgagacgggcatcgccgtgccggagctgccgccggggctttagag

SEQ ID NO: 716 - DNA, 5504 bp, Myxococcus xanthus
acgtgtcgcgcatctccgcggggcggctctcgctggagttggaggagctcgagctggggtcgctcgtccgggacgtcgtcacccggtatgaaccccaggccgcgcgcaccggctcccccttgcagttggaggcgggagacttcgacatcgtgggccggtgggaccggctgcgtctggagcaggtcatcaccaacctggtggacaacgccgtgaagtacggcaacggcaggcccatccacgtgcgcctggagccgcatgacggcggagcgcggctgacggtgcgggacgagggcatcggcatcgagccccagcatctgccccgcctcttcggccgcttcgaacgcgccgtgtccgagcgcaactacgggggcctgggcctgggcctgtacatcacccgcacgctggtggaggccatgggcggccgggtccacgtggagagcaggctggggcgaggctccaccttcaccgtggagctgcccagccacctgggcgcggagcaggcccgtcaagccccctgactgtcgtttccaggctcgaaggtcatgcgaagccgggagtctccagttagaggggcgtcaccacgaggaaggagcgagggacatggagactcggaagctgggaaggcagggccccaccgtttcggcgctgggcctgggctgcatggggatgtccgacttctacgcgggcagggatgacgcggagtcggaggccacgctgctgcacgcgctggagcggggcatcaccttcttcgacaccgccgacatgtacgggtcgggcgccaacgagacgttggtgggccgggtgctcaagccgcaccgggcgaacatcgtgctgccaacgaagttcggcatcgtccgcgacccccaggacccgcagaagcgcggcatcaacgggcggccggagtacgtgaggcaagcttgcgaggccagcctgcgccggctgggcgtggatgtcatcgacctgtactacctgcaccggctggacgtgcagacgcccatcgaggacacggtgggcgccatggcggagctggtgcgcgagggcaaggtgcgcttcctcggcctgtcggaggtggacgcggacacgctgcgccgggcctcgaaggtgcatcccatcaccgcgctccagagcgagtactccctgtggagccgtgagccggaagacggcgtgctccaggcgtgccgcgagctgggcgtgggcttcgttccctacagcccgctgggacgcggcttcctcacggggcaaatcaagcgcttcgaggacctggcgcaggacgactaccgccgcttctcgcctcgcttccagggggagaacttcacgcgcaacctggagctcgtcggccacatcgagcggctggcgaaggagaagggatgcactccggcgcagctcgcgctcgcgtgggtgctggcacaggggaaggacctggtgcccatccccggcaccaagcgccgcaagtacctggacgagaacctcggcgcgctggaggtgacgctcacggaccaggacgtggccgccatcaacgccgtcgcgcctccgggcgtcgccgcgggtgggcgctatcctccgtccatgcagtcctcgctgcccaaggcgtcccagccgcgcggccagtgagatgaagcgaggctggggggtgccccttcagcttcgaatacgaggaagctgggcgtgcggctgccatgcgccgtcgccgcccaggcagtaacggcaggtggccaatggcgtctcccgttcgaggtagccgagcatctgacccagcaagtccggcgtgtcgagcggcacgccatcgacctcgcccagcgcgggcatctccgggtacgtgcccccgagcaccgtcgccacgtgcggtggacgcgtgcaggcgtagaagcggtccgcgtggaccaggtgacagcggaccttcaaccaacaacgcgcgtggatgcctcgcacggcgtcttcggagtcgtgcggcgccgccggcgtgagttgctggaaggcgtcgattcgcttcaccgtgaggaagacgcagtgctgctcgcagcgctcggtgatgcgggcgatggagcgctccggcagcggcgcggaggtgtagacggacagggtcatccgatccaggcgctcgtagaccgcatcgggggcgctctgcgcgaggaagccgttggtggtgacggacacctgcggggagatgcccgaggcgcgcacggcgtccagcaccgctggcaggtcggggtggaggaagggctcgccgccagtgagcttgaagacgttgggccggagggctcgggccagttggcgcaagtccttgcccagggcagcggggtccacggaccaggcaggcaggtgcggcgacaacgggcagcactgcacgcagcgcaggttgcagtgcgtggcgacatgcgtctccagggaccaggtgaggatgcgtccgtcttggagctcgtagcgcacggcgggactatacgaggttgcccggggcccctggcgcttgtcacagtacccgcgtgtctcacgcttccggcggaatgctcgccaccctgccccactaccagtcattggcgcgcctggcgccgtctgtgtggcggctgaatcccccggggctggcaccggaggccgtcgctgcattcctgcgccacgcgctgcctcccgacgaaagcgttttccagggcgtgcgccgggttccgggcgcattgcctcgcgtgcgtcggagcgaggggactccggagacacgtgaggatgaagacaggctggcggaacggctcgtggccgcgctggcggacagcgtgggcaaacacctggcggcgggcgcggtggacgtgagcctgagcggcggcgtggacagcgccgctttgtgcgccctggccgcgcggcaggcgcccgggcgcgtgcgcgcctggaccatggatgtccacttcgcggatgccacggagcgacggaatgcccggacggtggcgaacacagccggagtcgagttggtcgacgtgtccgtttcggacgcggtgctgccagagctgttcgagcccgccgtcctgagccaggagacggccatcctcaacgcccgcgccgtggccagccatgccttctacgcggaggcccgaaggcagggcgcctccacgttgctgagcggcgcgggcgcggatgaggtgctcatgggcaacccggcggcgttcgcgggtgcggcggcccgtgtgacggaggaccggcgcctcgtgcataaggtgctgcacccagggcctgtggacaacttgggggtggatctgcgggtacttcgccttccctgggacgcggagctggcttccggtgacgaggatcaccccgaagaggtccgctacgcggcctgggtgctgtgggagctggtgctgcctcccgagctccggggtgcgagcgcacatggcgtgaacgtgtgcacgccctacctggacgcggacttcgctgacgtggcgctgggactcccattgggcgtgctcgcgcggcacggggccggcaagtggctcttccggcatgcggtgcgcacgctggtaccggatgaggtccggttggcccggaagacaccgcgctatgcgcacaccgcgctctccagccccgttcgtgcgcgttggctggagctgtaccgggaatggctcacaccggcccggctggcgccgttggagtgcatcgacgcgggcgcgacccgggcgctactggagcgctacgcacgtctggccgccgacgctcccgaggcgagtgccatggaccggctgttgatgcggttgtgctccctcgccatgctccacgcccacgccagcgcccgccccccatgtcccgaatcctgattgccacctcccccgagaagggccacctcaaccccatggccggtgtcgcgcagtggatgcgccgcatgggccaccacgtgggctggctgtgcatccccgagcccgcgccgcagctcgaacggctgggcgtggaggtgctgacgttgccccacgccgaggcgcccgtgcccgccatcgagacgggaggcgaggcgctcgcgcggttggtgctcgatgaagcggcgctggggcaatggattcgcggcctgctgattgacgccgtgccctcgctgctggcgccggtgcgagaggccgtcgagcgcttccgtccggatgtcatggccctggacggcatgcagtacgccgccgtgctggccgcccatgcgttgcgaatcccctgggcgggcgtgtcctccgcgctgtcattgctggagccgcccatcgattacggcctgcgccgcaacgtgcgcgcgctggccgatgagcgacaggctctgttttcccgccacggcttcgatgcccgcttccgcaactgtgagtgcctgtcaccggacctcaacgtcatcttcgccaccgaggccttcctgggctccgacgcaggactgcctcccgccacacacctggtcgggccgtcacagcctccggaggcgcgcggtgacgaggtggacttcccgtgggagcggctgggctccaagcccgtggtgtacgtgtctttcggcagccagatttcgtggcaacccgatttgtttcagacgatgaccgaggccgccgcgcccctgggcgtcaccgtggtgctcagcgcgggtgagttggctgatacagattttgttcacagccttcccggggacgtggtcgccgtgccatacacacctcagcgacaactgttatcacgagtctccgtgctcgtgtctcacggcggcgccaactccgtcatggaggcgctgaccgaaggcgttccgatgctgctcctgcctgtctgcaacgaccagcccatccaggcgcacttcctggcgaagtcgggcgcggggctcgtgcgggcgccgcgctcgctctccgtggaggactgccgcgaagcgctgcgacaactgctggagccgggcacggtgctgcgacagcgggtggccggcatcgccgcgtcctaccaggcgcgtgacggcgcgaaggacgccgctgaacgcatcctccgactcgtggcgtgagtgattgcatgcgtgattgggacgtgtggcgtctggtgctaccgggtgtgtcgccgctggaggtgtggaacctgcccgtgatgggtcgcgagctgtgggagttgctcggggcgcctcgcgtggatgcggaccgtcgcgcgggggttcccgagccggcgctcgcgggccgactgggcccggcgctcgcggtggcgctgtccacgctggtgaagcggcacgcggtggatgccgtgtggctcagtggcggattggtgtgcctggagggcttcggtgccatgctctcgagtgtgtccaccgcgctcccctgccctgtgtacgtggcggagcatccactcttcgctccggccctggcgggactgcgcctgctggcgccgctcgcgcccgcgcatccggtggcgctcgacgtggggcagacgggcatcaagtgcgtgagccccacagcggccccgcgcatcttcgagcgcgacgccgcgctgttgccccggtacttcatcggcatggcgcggcctccggacaggcgacatgtgaaggcggcggg

SEQ ID NO: 717 - DNA, 5464 bp, Myxococcus xanthus
gtgctctacagcgattcccgtttcaacccggccggacaatgccaccgcaccaggtggggtgtccggcggtgggacacaggcacgcttgggagggctcgcggagatgccttgccggcttgccttgaaccggcctgtccgcggccccagcttcctggcggaacaaccccgtctgttggaggcgctcgaaatgaaacgaatccaggcactggccatcgcgggcgcgttgtgcggaggcacggcgctggccaaggacaagcccgacatgcgcgggctcaccgtcaccgtgggcggtggcgtggagggctacagcggtgggctggccccccgaatcgatccgggcgcggcgtacggcgccacggccacgctcaaaccgtccaccgtgctgggcatcgagctgggctacaccggcgccatcaacaagctcgaccggcgcggcctggaggacctggctcgaaacccggacatcgtccgcaacggaggccaggccgtggccaccatcggcctgacggcgacccccgtgcagccgtacctcctcggcggcctcggcatgaactggtacaacgtccgccgcggcgcggaagcgctgggctaccgcgacgacaccgctggcgccgtaccgctgggcgcggggctgcgcttctacaccggctccttcaccgcggacgtgcgggccaactacaacctcctcttcaaccaggagctcgtccccacgctgccgcccgcagagaaccaacccgtgaaagacgtcacgttcgcgggaggctccagctacaacgccacgctgaacgtcggcgccacgttctgagcgcatcggcatgaccgggcccggagccctccgggcccgcgtcacctcaagccctcgtggatgaacttgaggacggagatgaactgccggtccatcaccagcaacatgaccagtggcgccagcgccgcccccaccacggccagcagggccatcttgtcccagggcaacaggcgcatcctccgctccagcgtgaaggccgtgccgatgtccgccagcgaggacatctccggcgcgcccagcagctccggctccggtccgccccggaaccacttgtgttcgaactgccgcgagtgcttggccgcgaccttcgagaagtcctcgtcaccgatccgcttcgcccgcacgagctggggcacgaagaagctcatcggcgcgaacaccagcaccaccgcgccggccgcgatgaccaccagcggaatcacgtaggccgcggggttggccgacaggtccttgggctccacccgggacgtgtatgccgccaccaccacggccagggagaacaccacgggcgaaaaacaggcctggcagacaggcaggaacccgagcccgcccatcatgtccggatgtgtcggaaccagggtcaacggcagacgtgacacacgcagcaggaaggcgctccacacgacgccacgccatagccaccggagcgccaggaaacggaacaggggttggctcacggcgaggttccaccaccccgccatggagaacccatcgccgctgagggtccacgaccgggtggcgtcggccggggtgatgaacgtgagggcatacgccaggatgagcagcagcgcctccacgatatagctgtcccgccagtgcatggcgcgccgggcatccgcttcgaacgtccggaggccgtccgtcgcccccaggttcgaattgaggaactggcggaccgcgaaagccaggcggccgtcgatgtagggctccgcggcgaggagcacgggcagcgccaccagcaactgcgcatggacctggagttccatgaacagggagcccacggtcggcccacccgaaggcagcgtgaagatcagcaagggcagccagccgatcgccgagaaggccagcgcccgcaacacggggtcataacgcttgcgcggaccccgccggagccggcgctcggtctcgaagagcagcccgcccttcaccagggagaattcggcaatcgtcgagtgcgggtccatgagggcgccgtctccacggtggggctgcgtccaggaacccacaagcgccccccggccgggcgacgaccggcaggagcaggcgcggacacgaggcctacccctgagggccggattgttccgtgccgcgtggccccccacgtttgctaccggggcacggcgcgcccctccgttctcgcagggaaggaggcacgcacatgagcatcgacgtcatcgacgaagtcccggcccagggcggccggcccctcgaggacggcgcggggcaggaagcccgctcgctgccgggcatggtctacatccccggtgggacgttctggatgggctcggaccatcactatccggaggagcggccgacgcaccaggtgacggtgacggacttctggatggacagccaactggtgacgaacgcggacttcgcgcgcttcgtggaggccaccggctacgtcaccgtggccgagcgccccttgaaccccgacgactttcccggcgcgaatccagcgctgctcgtcccgggctcgctcgtcttcaagaagacgctcgctcgcgtggacctgcgcgacctgacgcagtggtggttctatacggcgggcgcctgctggaagtaccccgaaggcgcgggcagcacctggcaggggcgcgaacaatacccggtggttcacgtctgcttcgaggacgcgctcgcctatgcgctctgggcgggcaagacgctgcccaccgaggcggaatgggagtacgccgcgcgcggaggcctggaccggaaggtctacgtctggggcgacgagttcgcgccgggtggcaagctgatggccaacacctggcagggggagttcccctggcagaacctgaacacggatggcttcgagggcacgtccccggtgggcaacttcccaccgaacgcctacggcctcttcgacatggccggcaacgtgtgggagtggacctcggactggtaccaggagcggcacgaggggaatggcggaaagccctgctgcatccccgtcaatccacggggaccggccacgtcggatcgcagcctggacccgtgcctgccgaaggtgaagattccccggcgcgtcctcaagggcggcagccacctgtgcgcgccgaactactgcctgcgctaccgcccggcggcgcgctcaccgcaggccgtggacagcggcacgtcgcacatcgggttccgctgcgtcgtccgcccctgagccgcaagctggcatttccagagaaggtcttgcgacgttgtcgcggcgcttccactcgccgcgactccatccctatcgtgtcacccgcctccaacgacacagggacccatgaagcagaaaatcacaggcttccacctcgaccgggaagaccactgggtggctgacctcaagtgtggccaccggcagcacatgcgccatgacccgccctggatggtgcgcccctgggtcctctccgaggacgggaggcgcagccgcctcggtgttgagctcgattgcaagcgttgtgacgaagcagggcacgcggtcgccgaggcggttcgcgaagcgctgcggacggtggccctgcgggcctatgacgacggcggcctgagcgggctctgcgccgagggccgatgggagcttgccctggacgcgctcggtgcggccgacctgcgccctgtcatccggcgcgcgctcgcccctgagcgcggggagggagccctcgtgagtgcccggatgattctccgtcccctcctccctgacgacgcccgcgccattcagcgcctggcgggtgaccgcgaggtggcggcgaacgcggcgggaatcccacatccgttcgaggacggcatggcggaagcctggattgcctcgctggatgcacgttcgcatgtcttcgcgctcggccattccgagtctggcgagttcatgggcctggccgggctggtggaggccgacgaggagcgccctcgcacggccgagctctcatactggctcggccgcgcgtactggggacagggctttgggacggaggcagcccagaccctggtccgctacggcttcgaaacgctcgggctggaatccctccatgccagttgtttctcccgcaaccccggctcccggcgtgtgctggagaaggccggctttcgccacgcgggccaccaggcgcgcgcgctccgccatctggggcaggacgaggacctcgagcgcttcatccaggagcggagccgctcgcgcccgtgagcggattgcccctggtgggcagcatgtgcccccagggtgccccacccgcgctcaatccgccgccgcgtccagctccgcgacgacacggcggacctgactcgcgcgccctttctcggtacgcgctgtcatcaccttgaggatgagcccgtaccgccgcgtcttgccaagcgcctcgaacgcccgcgcggcacgcgggctcgcagacagcgccaccgtcaggtcctccggcaccgtggcgttcttgtgggaagcgtaggccgcggcccagcgtccatcggccttggcggcctcgacctcggcgagccccgagggccgcatcctgcccgcgcgtagcagcgcctcgaccttcctcacattcacacaggaccagcggctgcgcggccggcgcgggacgtacttctgcagatagaagcgcgcatcgagcgacctccgttgccccgaaatccatccaaagcagagccccacgtcgaccgcctcgtcatcggtgagcgacgggatgtccgtccccttcttcgcgagcttcaaccagacgccagaaggagcatcggcatgcgcatggagccaggcctcgaactccgccgcaccccggaacgcaatcaccggcgcatccatgccgcgcccccacgcccctcctgcctaacgctggccacgggcacctcccaggacgtccaggtagtgacggttgaacatgacgcccagcacgttcccgaatgggtcgatgaccgacgccgtgacgaagccggggccacgctcggtgacgccctcgaggagctgggcccccagtgagagcaactgatcgagcgtggcggcgatgtcgtcgacatgccagtaggcgaccgtaccgccccgagccgtggcgagccccggcggagcaaatcgccggtcgatgatacccagctcatgctggtagtcgccgatgcggaactcgacatacccgagaccacgtccggcggcctcgctgctgaagtaaggctccacgccgagctgctccgcgtaccagcgcgtcgccgcccgaaggtcatccgcccagaggttgaaggtgcacaatccgcgcaaggtgttcatggggctctctcgtgtcctggccgcgcccgttcgcgaccccatgaccatggccccagaacatgacagaatgagtcacgtttgaagcgtgagcccgtcaccgaccgcctggaccgtgtcctgggcctcctcgcctcccggccgtcctggacagccccggagctggcggaggagctccgcgtctgcgtgcgtaccgttcgacgggatttgtcccg

SEQ ID NO: 718 - DNA, 6330 bp, Myxococcus xanthus
cacgcggctgtcgcgcaccaccgagcccgcgccatcggtccgcgtcaccaacatccgccggcccgagcccatcgcgccgccggaacctccgccctacgcggaggaagaggacgcgcgctactaccccgaagagaactcccccgaaggctgtgcctccggcgagtgcctccccgaagtcgccgccgcgccgccgcctgcgtccgagctcgtcatccagcacgagtccgagccagagccagagccgcccccgccgccccccgtcacccgctctcgggacaaccccaacctgcccctcatcgagcgttggcgggccgccgtggagacggtgaaggcctcccatcccaggcagggcgcggcgctctccaacgggcgattgatgtcgatgaagaacggcgaaatcgtcctcggcttcctgcccgtggccggcttccaccgcatggccgtcaactccaccgcgggcaaggccgccgtggacaaggccctggccgagcacttcggccgcccggtgaagctcaccatccaggatgcgtctccggacgacccccggctgggccccagtctggccgatcaggacgcacagacgcgcgccgcccacgagaagaacacggacagcaaggtccgcagccaccccgccgtccgagcggtgctcaagttcctgggaggcgaaatcgaacacatccaggtctacgagcccgagcgccccggggccgtgccagcggacgacacctccgacgacagcgcctgacaaccgcctcgcgcaacggtagggtggcgccccattccacgccggggcggggccatgtccgtggcgcccgctcccacgagtaccgaggaagcatatgcctggcgtcgacctgaactacttcatccggcaggcgaacaagctgacggagaagattgaagaacggaagcagcagctggcggaagagagcgtggaggccaaggccggtgacggccgggtcaccgtcgtcgccaacggcatccaggagatccgcagcatcaagatcgacaaggaagccatcgaccccaacgacacgtcgatgctcgaggacctcatcaccgccgcggtgaacgccgccctggcgagcagccgtcagcacatgcagcgcgagctcgcgaaaatctccggcggcgtcaagatccccggcattacctgataccggatgacccccgatccgctgaatcgactcgtcgcccagctcgcgaagctgccgggcatcggcgagaagaccgcgcagcgcctcgcgttccacatcctgcgggcgccgggtgagtatgccgcggagctgtcgcaggccattcgcgaggtgaaggagaaggtgcacctgtgcgtgcgctgcttctccctcaccgacgcggagacctgcaacttctgccgggatgctcggcgcgacgagcgcgtgctgtgcgtcgtggagacgttcgcagacctgatggcgctggagcgcacccgtgagttcaagggccgctaccacgtcctgcacggcgttctgtctcccctggagggcgtgggccccgaccagctccgcatccgcgagctgctggagcgcctcaacgacagccgggtggaggaactcatcctcgccaccaacccggacgtcgagggcgaagccaccgccctctacctgacccgcctgctcaagcccatgggcctgcgtgtcacccgcatcgcccaggggctgcccatgggcggcgacctggagttcgccgaccaggccacgctcgccaaggcactctccgcccgccgcgacctctaggccactcgcggtggcggcgcgagcttcctcgcgccgctactgcgtcacccgccacgagaaaggcatcaccaccgtgacctcctggtcccggtgaggagggaagcgcaggcgctccgcctgggcttccaggcagcggcccacgcccgacgaagccagcggtccccgcgtccccgcccgccccttgcctgacgagacgatggtgagttgcacttgcacttcgcctgggctcgacggcaggtccgccttgtagcgctcgaagcacgtggtgatgcgcgcccgtccacgcgagacgacacgctgcacgtcgtcgatgcccagcgtcacccgcttctgcgacgaggccttcttcgaccgcacaggtgccgcgtccgccccttcttcatccgcctccgcctcgacatcggacgcagcgccagcaagtccggcttcgtccgtctccgtcacgccagcagcatccacggagagctgcgccgaatccgtctcgcccacatcgccacccgccccattggccacggcgtccgtcagagaaccggcctgagcggcggcacccacgggtgccacggcctccatcggcgcgccgacctgagcggcagcagcctccggtgccacggcctccacgacgggcaccgtggccggcaccagcgacaccgaagcgggcgtcgtcatccactgccgatatccaacgatgcccgccgccgccagcatcaggccacccgccaatcccaccgccagcgtacgccagcgtcggcctccggccgtgggggcggactccggcgacgttgacccacgtgaggccgcgccatgggcaggcacgcctggcgaggaaggccgcatggacatgccggggcgctgggcggacgtggcatcgccctcccgagcaagcacgccatacaggttcgtcccgtgcggctccgcccccggcgcctgcccctgcgcccctgccgcggcgcctccgtacgtcgcggtgagcgtggccagcgtgggaatgcgtgagcgctcggtgaagcgctcctcaccaaagtgccccttcaagaaggcgccgagcggcatcgcgcccgaaccactgagatgctccgagaggaacgtctccagcgcgtccgcgaacgcctccgcggtggggtagcggtcctccggcttgaaggccatggccttcaggaggatggcctccagttcctcgggcaagtccggccgcagctcgcgcggcggcttgagctcgccctgcagcagcgcgttgagcaccgccaggtcgttctcccgggagaagggccgcacatgggtgagcgcctcgtacaggctcacgcccagcgcgaagatgtccgcgcggcggtccacctccttgccgcgcgcctgctccggcgccatgtacatgtacttgcccttcaccacgccagtgcgcgtgttgacgagccgcgactcggccttggcgatgccgaagtccagcaccttcacctgcccctggtacgtcaggtacaggttcgacggagagatgtcgcggtggacgacgttcagcggctgcccggcctcgttggtgaactcgtgcgcgaagtgcaggccgcgcgccgcgtcgatgaggacgcggagcacgacggggagcggcacgtagtggcgcttgcgtccggccagccgcaacgtcgtggagaagtcctcgcccgcgaggtactccatgcagatgtagtaacagccctccgcgaagcccagctcctgaatctgcacgatgttcggatgggccagcttcgccgccagccgcgcctcgtcccggaacatctccacgaagtcggggttgttcgtcaggtgcggcagcatccgcttgatgacgacgttgcgctcgaagccgtccgcgcccagcaacttggcgaggaagatttccgccatgccgccttcggccagctttcgcacgagcacgtacgggccataaggctgaagcaggggcacaaggcccgcttccgtcacaggcagggtcgtctgggggggggacatcctcacggccctcgctgtttcagagtgcgcaccgtatggaccgccggggcaccaggacgcgtcatcttaaacaccaatacgggcggcgagcccaccggctccacccaggtgttgaaccggtgtttgccatccagcgccaccgggcgtccattgatggacaggcgggcgtccacaggtgcgacaccggccgcgcgcaccttcgcgcccgcggcctgcccgttgcgcggtgtggacaccatgagcaccggcaccgagttgtcgtagaccagttccagcttgttcatccgtccccccttgagctgtgcacccgtggcggaaagcggcgtgacggaccagaggtagttgccctcgctcagcgcaccggcgtccagcgcggcgcgagcctccgtcacggtgcgttcggccaccggcgtatccaatgcccccgcgcggtacaccgccacacggtagcgcgccgcggaggtctccgaggcataggtgaaggtcaccgccgggggcttgtcctggtagaagatggtcgtcttctccggcccctcgggcaccacgttgcgcacccgcgccagcgagcgcaccgcgcgctccggcgcgaacgacgcgcttcccgacacctgcgtcccatccttgcggcgcacccgccagtggagcttgccgcgcaccggcgcgggcacgttgatgaaggggcggtacaccgtgcctgacagcaccggccgcgtgaaggccgcgtcctccgcgacctccaccagggcctcgccctccccttcccaggtgatggccacatcccgcagccctggatggaacacctccgcgccgtcgacgacgcccagggccagtggcgcgggcgcgagcggctcgacgcgtggcgcctgcgcggaggatgcctccaccgtggcgcgctcacccgcacgcagcgcctgccgggcatctccgcgaaccagcgtcacctgtccggtcagcgcatccaccagatagcccgcggccgtgcggcgcaccgccagccgcgcttcaccgccgccctccacctgcagccccggcagcaccagccggctggtacgccctcgcgcgagctgcaggttcagccagcccctcaacaagtcgaagcgagcctcgtccgtggcgccgccctgctccgctgacgtcagcaccagctccgcgtccgagcccagtgacgccaccgtggccgagccctccagtgccagcaccgcggagcctccgcgccgggtgcgcacgctgccccccggagataacacctcgccctgcttcgccaccggacgccagttcgacgcccccttggcccgcacctccgcgcgccccgccgccagccgtaccgtcaccggaatcggcgccagctccaggacacgcgccccgcgggccaccagctccgtccggccggacgtcgcctccaccgcgtcgccttcggacgcgcgcagcgtcttgccatcgcggcccacgaactcgattgcgcccagccgcacctcgacgcggcccgcgtcctcagccacctgcacgcgcacctcgctgggttcatccgcccccacgcgcgtgaggccgaagggcgtgcggatggtcagtgccaccttcgagccctggcccgtgcgcgccgcaccagcgggcacgcgcgacaacaggatgccgcgctccacttgaagcacgatgcctcccgaatccgagcccagcgcgaagcgcgcgtccggtcccacctccacggaacggccatccgggaaacgcaccgtggccgccccacccgcggccgtctccaccgcgtcgcccccgtacaagggcccctcttcggcgggcgcccgcttgccacctcgctccaggcgcacgtcgccgctcaagccctccaggcggcccagcacttcgccagcgcccgcgtcgaccaccgccgagggcccgggaggcggcgccacggcgtcatcatcacaccccgcgacgaggagcagcaggaccaggaaccaacaacgcggggcactcaccgtttccccctcgggaagaggtcgacattgaggatggtccgctccccctcgcgcagggtgatgaccttcgtctgggacagatgccctcgcgcggagatggtgatgcggtaggtgccaccccgcacctggacattgaaagcccccttcgcatccgtgcgcgcgcgcacccgggccttcgtgacgaggagggtcgccgccaacggcttgccccctcgcacactgcgaacctgtcccaccagcgtggcccgagtccccttcttttccggcgccagtggcaccgacagcgtggactcctgcccggcgatgaccaccgcggcttcatccgcggactggaagccggaagacgccaccgcgacagccacgggccccggagccaggtccttcaccaccacctgccctgccaggtccgtgcgcacctgtgccgtgcccaccgacacgcgaatgtccggcaacggcgcgcccgtccgcgcatccaccaccgtcacccgcagcgcgcccgtcggtggcggcagtggcgcggctcgaacctccagctccgcgcgcatgccctcctccacggtggcagtcgcctccgcggacgcgtatccctccgccgtcacctgcgcggacaccggtccgggcgg

SEQ ID NO: 719 - DNA, 4991 bp, Myxococcus xanthus
  unsure (1)..(4991): unsure at all n locations
gtgcgcacatgaatgtcctcttcatctcctcggaggtggccccgttctccaagacggggggcctgggggacgtggccggggccctccccgccgcgcttgcctcgctgggccatgacgtcaaggtcatcaccccgcgctaccgcgacctgcgaggcgcggagcggctggagcccacaggccagtccctgctactgcgcttccccttcggcgagctgtcgggccccatcctctccgcccgcgtgtcggagcggctggaggtgctcttcctggagaacgcgttcctcttcggcaaccgccacggcctctacggagacgcggggggcgccttcgccgacaatcaccggcgcttcgcctatctcagcgtgggcgcgctccaggcggcgcagcggctgcgcttcatcccggacatcatccacgccaacgactggcagacggggctggtgccggtggcgctgcggcgcggcttccagacggggccgctggcgcacgcgaagagcgtcttcaccatccacaacctggcctaccaggggcagttccccaaggacgtgatgggggacctggcgctgccctgggacttgttcaccgcccatgacgggctggagttccacgacacggtgaacttcctgaaggcggggctcgtcttctccgacgcgctcaccaccgtgtcccccacctacgcacgggaaatccagacgccggagcagggctacgggctggacggcctgctgcgccaccgcgcgcaccggctccacggcatcctcaacggcgtggacacgcacgagtggaacccggaggacgacgccttcctcccggcccgctacggactgaaggacctgtccggcaaggccgtgtgcaagcgcgagctactggcccgcttcgggctggaggacggccccgcgccggtgttcggcttcgtcagccggctggcgtggcagaagggcatggacctgctgctggaggccctgccggccgcgctccacgcggacatccgcgtcgtcggcgtgggcagtggcgaagggcctctggaggaagggctgctcgcgttgcagtcccgttacccgaagcaggtgggcgtgcacatcggcttcgaccccgggctctcccacctggtggaggcgggggcggacttcttcctcatgcccagtcgctacgagccgtgcggcctgaaccagatgtattcgctgcgctacggcacggtgcccatcgtccgggccaccggcgggttggtggacacggtggagggagggctggacggaaacggcatcctcttcgaggccttccacaagtccgccctgctggcggccatccgccgcgccctggccctctatgcggacccgtcgcgcctggatgagttccgccgccggggcatggagaaggacttctcctggggggcatccggccgtcgctacgaagcgctcttccacgacctggtggcggaatagtgggtgcggacggaaattcgcagtaatgttgtgccgtggcggatgctccggacctgggtggttacgaggtggtcggccggttggcggtgggcggcatggcggaggtgtaccaggcgcgagcccgggtcaccacgcagcgctcaccgggtgaaccggacgaaattgtcatcaagcggctgcacccgtcgtttcgcagcgacactgcctacgtcaaggccttcgtcgacgaggcgaagctgacggtccgcctgcgccatccgaacatcgtccgcacctaccgcctgttcaaggcggggccggactacctgatggtgcaggagctcgtgagcggccggacgctgggctacatgcaggagctgctggtgaaggccggtgcggccatgccgcccgagtccgcctgctacatcgcctggtgtctgctcaaggcgctggactacatccaccgggccaaggtgggggagaacggcgccaccatcgtccaccgtgacgtgaatccggccaacctgctgctgggcatcaacggcgacgtgaagctcaccgacttcggcgtggcggaggtggaggggctgatgcgcggcgactccggcgcgctgcgcggcacgctgccctacatgagcccggagcaggtgctgggcctgccggtggacgcgcgcacggacctgtacgcggtgggcatcatcctctgggagctgtggtccggccgccgcctcttcgtcggcgagcacgaggcggagctgatgcacaaggtgcgcgacgcacgggtgccgctgctgacgtcctctccggagctgccggactacgcggtgcaggtggcgcgcaaggcgctgttcgcggaccgggcgcggcgcttccagacggcggcggagttcatcaaggcgctggagtccctgtcccggcgcgcgggctggccgctgacggtggaggcgctccagccgctgctggggggctgagatgcgctcacgccgcgccgtcatcctggggctgctgggaggcgggctcgccgtgtccgggtgtctgggctcggtgcccttccggccgcgggcctatgaagacgcggtgcgcgtggtgggcttccaggtggacttccggcaggacggcaccggcgtcctggacctggacctggcggtgacgaaccccgcttcagacgcggccacgctggccgcggtggacttcacgttgcgggtggacgggcgccgcgtggcggtgggcacccagcaggtggcggcgcccctggcggcggatgggagtgccccgctgcgcgtgctcttcccgctggccagcgcgcgcgccacgggcgggccggagcccgtgccccggcgggtgcaggtggagggcggggtggtgctgcgcttcggcggcaccgagcggcgcgcgcccttcaggtccgaacgcgtgctcccgctggcctgggtgccgccgctggacggggactgaggccgccgccgctcacgcgtggggtcggcgccacccatgtggtgtcatggtagttgtccgttgccggcggccagtgtgacgtgccagcgtgctggccatgtcgcttttccgacaatgtgtgtttcccatctccttggcggtgctgggctccaccagcgtgctggccgcggagaagtcgcctccccctgagcctccggctccttcgcgcaaggtcgacccaacgaaggcgcagacggaggcgtggctgcgcgagcacatcgaggcgtggaacgactcggaggtgcacgtcacggtgaaggactgccgcatcatggtgttggacaagccccgtgagcggacggagatcgtcgacctgcgcggcttgctgctgcccatcgaggtcatccggctcaacggcggaaacgatgcgacgctccggcttcgtgtgaaggagaagcacaccgggacgtactccatgttccgcaagtgcagcgcggagaaccgctactgcgcggagcccaccggcaagttccagagcctgccctatgtggacctctccgtgacgtcggtgcgggacttcgtccccgggcggcagacggacgtcgacaagagcctgcggctggagcgggcgctcgaacactactcgcggctttgtggggcgatggaagatgcgcgcaaccggctcttctaggttcggggccgcggggctggcggcgttgctcttctcccaggcgggttgcagcacgacgtccgagtacgtgcgcggcgagcgcctgcgagaggcgtccctgggagagacccaccgcgacacgctggagagcgtcgtggatgcgtcctacgtgggccgcgtcgcggtgaagcgcaccacctgcaccgagatttccaccgagttcagcaagaagcgcatcgacacgacgaccagcccgcccatgggctcgttgctcggcgggctcgcgatgctcggaggtggcggcgtcttgatggcgatgtccgacggctcgtccgatgacgacgtcgacatcaccatgacgctcggcgtggtgctggcgctcgcctccatctacccgttggtgacggcgctcaccgacgaggacgtcagccaggaggaggtcgtcaccggcgaggtcgaagaggagcgctcccagcgctgtgatgagcggaccttctcgctcaagggcccgctgcactggagcgtctccctgggcgccgcgcggcgcaccgggcgcaccggagaggacggcgccgtgtcgctggggcagccgctcaacgagctggtggagcaggccatcaccgacgaggccagcgtccgccggctcgtcgccgggcggggcattgccttccggttggagctcgagcgcgccccaccggcggacttccggctcgattccaaggcgcttccggatgcctacttccggcgcttcgcggaccgctacgggcagcagctcggaggcagcgagcgcgcccgcttcgagaactgcgagctgattggcaagtccgcgcgagagacgctggagtgctactggtcccagtagtgggggaggggccggccccggagcggggccggtgccgctccgggcctcagctcttcgcggaggcctgttcctcgcggccgtgctcgcgccccagcccgtcgcgggactccgcggccttgccgtccttggtgaggccagacttcacgcgcgacatccgcacgcggtcgatgcgggggccttccttggacgccacgacgaactgccagccgctgtaggcgaagcgctcgcccacgtcgggcaggtggcccgccatggaggagaggaagccgcccagcgtgtcgaagtcgccttcgggcagggggaagccgaacgtctgcgtgaaggcgtccacctccagcgcggcgtccaccaggaagctgccgtccgccagcttctccacctgcttctcctccacctcgaactcgtcgccgatgtcgccgacgatttcgcggaggatgtcctccagcgtcaccacacccatgaagccgccgtactcgtcgacgacgatggccatgtggatcttctgcttctgcatgtcccggagcangtcgccaatgggcttcatccacggtacgaagtgcgccgggcggatgatgtcctgcangacgatgagctccgggtgctg

SEQ ID NO: 720 - DNA, 4631 bp, Myxococcus xanthus
cggcaccacgtcggcgggcgtggtggtgctgggcatcgtcggcatccaggtggcgcgcaacgccgccgtccacggctggttcggcggcggcgaggtccagacggacgacttcgagatgggcgaaatcaccatccgcgtggcccaggcccgggtggatgacgaggagctcttcgagtaccccggacatggcgcgcgccgtccgggctcgggcgagccgggggtgaagcccgccaccggcagcagcggtccgggcaaggtggccatggcctccaccacccgggcgccggcggaccggaagccccgccccgggggcagcgtgaccacggacccggatggcatggagacgacgcagcagttcgaccagtccgccatcaaccaggtggtggccagcaacaagtccacgctcttccgctgcttcaaggaagaggcggagcgcacgccaggcatctacgccaaggtccccatggagttcgtcatcgggaacaatggccgggtcagcaagctgtgggtggacaaccatcagttcaagaagggtccactctacgagtgcctgctgtcggagatgcagaagtggccgttccgcgcctacgaaggcgagcaggcgacggtgggcctgtcgttcaccatcggcaagcgggggtagggtcactttcttgccggcaccccgggcatgcccgataccgtgggcatgtccgccgcatctgttgctgagaccgaaattgcgaagaaggcgctgagcgtcccgccgggaaccttccgtcacaccgtgctgacggccgccaagcgcttcaagtccacctgggccgagctggggaagctcctggtccaggtccgggacgaggccaagttcgaggagtggggctacccctccttcgagacctattgcctcaaggaactgcacatcaagaagcagaccgccttgaagctcacccgctcgttcagcttcctgaccaagcacgagcccgaggaggagctcaccgcacaggagttcccccagcgcgcacccgcattcgaggtcatcgaagtcctcgcggacgcggaggagcggggccagttgtcgcccactgaatacaagtccctgcgcgacagcatctggagcccggagaagaacccggccgagctgaagaaggagttcgccgagcgcttcccccgtcccccgccggagccgcctccggagagcgcccaggtgcggaaactggcgcagatggcccgcaagctcgcgagcgagctgtctgggagccgtcggattccgaacgccgtcgccgagcgggcagccgccctggcggaagatctcgaggacatcgcctcgggcgtgacggacgcctgagccgctgttactgaacgctgacccgttggccggggctgtacgctcggcaacgggcctgtaccgccgggcttcctgcccgaaggggagggccctatagtggttcagggccgcgtggaaggtgggcctgacggctgttcgagacgtgggcaggccgtgcgggtaggggagcggtggacggcgaaggaggctccgggtgtccggagccggcgaactcggaggcggcagtgaagaaggagcaccacgtcaacctgtcttgttcgttctgcggcaagtcgcagcgcgaggtccgcaagctcatcgcgggcccgacggtctacatctgcgacgaatgcatcaagctgtgtaacgacatcatcgcggacgagaacgagcgcgaggagggcaagccccaggtcagcttgcagacgccggcggagatcaaggcgttcctcgacgactacgtcatcggacaggaccaggcgaagaaggtcctcgcggtggcggtgtacaaccactacaagcgcatctatcaaaagaagccgaactcccggccgcgtccaggcgtgaagggccccaccggcgaggaagtggagctgagcaagagcaacatcctgctcatcggtcccacgggaagtggcaagacgctgctggcccagtcgctggcgcgcttcctcaacgtgcccttcaccatcgccgacgccaccagcctcaccgaggccggctacgtgggcgaggacgtggagaacatcatccagaacctcctccacaacgccgactacgacgtggagaaggcctcgcgcggcatcgtctacatcgacgagatcgacaagatcgcccgcaagggtgacatgcccagcgccacccgcgacgtgggcggcgagggtgtgcagcaggccctgctgaagatcatcgaaggcacccgggccaacgtcacgccgcgcggcgggaagaagtacaaccagcaggagtacgtccaggtcgacacgacgaacatcctgttcatctgcggcggcgccttccacggcatcgacggcgtcatcaagcgccgcgtgggcgagaagggcctcggctttggcgcgaagatcacccaccgcgaggagcgcagcgtgggtgagctgctggcgctgaccgagccggaagacctcatgcgcttcggcatgattccggagttcatcggccgcctgccgatgatcgccacgctgaacgatctgaaggaagaggacctggtcatcatcctctcccagccgaagaacgcgctggtgaagcagtaccagaagctcttcgagttcgagaaggtgaagctgaccttcaccaaggaggcgctgcgcgccatcgcccgcgaggcgatgcgccgccactccggagcgcgcggtcttcgcgccatcctggaggatgccatgctggagatcatgtacgacgtgccgttccgcgagggcgtcaaggagtgcaagatcaccgagcaggtcatcaccaggcacgaggcgccccagctcgtcatggagaaggagaagaagacggcctagcggcggtctcccttctccgggtgtcccaaggccctgctttcctcacggaaggcggggccttcgttttcagggcgcgggcagcgtgacgatgaactcggccccggcgccgggcgcgctctccacgcggaggtcgccctggtgctcctggacgatgtcgtggcacagcgagagccccagccccgtgcccacgcccgcgggcttggtggtgaagaaggggtggaagagcttctcgcggaggtcctcggggatgcccggcccgttgtctcggatgcgcagctccaccttgcttccgacgcggcgggtgctcaggtgcacctggggcatgaagcccgcgccggcctgctgttgatgttgcgccgcggcgtagaacgcgttgtcgaggatgttggtgagcatccggctgatgtcgctggccaccagctccacgacgcccacggtggggtctaacgtggtctccaccttcacgctggccccgccgggacggctgcgcaggccctgcaccgccagattcatactgtcgcgcaccagcaggttgaggtccgacttggagcgggtgccctccgacttgcgcgagtgccggagcatcgtcttgatgatgtccgaggcacgtgtgccgtggctgtggatgcgctgggcgttctgcttcaagtcctggagcgtctccagcacgtcctcgcgggcctcgctgtcgagccggtccgccaggcccttcagcgtctcctccaactcgccggccagccgtgaggacaggttcgagaagttgttcacgaagttgagcggattctggagctcatgggcgatgcccgcggtgagcgcgcccagggacgcgagcttctcctgcgccacgagctggcgctgcatctcctgaagccgggtgagcgtctccgccagctcggcgttcttgtgctggatttcggcggtgcgctcctccacgcggcgctccagcgtgcggctgtactcctccaggctggcgtagaggtcggcgttctccagggagatggccgcctggaacgacagcaggcgcagcacctccagccgctccggggtgaaggcgccccgcgtggcgtcgttctccaggtagagcacacccgtgagcgagccctgcttcaagagcgggctgcacagcagggacttgggctgggcgctgcggacgtaggggtcctcggagaacggctcttccgctgaggcgtcgtggaggagcactgtctctccggtgcgcaccacgtagtggatgatggaggtcggcagcgacgcggaggactccatggggatgggcgcctcgagcaccacgccatcgccgtccacggagccttccgccgcgatgaccaggccctctgtccgtttcagcagcagcaggccccggcgcgcgcccgcgttctcgatgaccagcgtcatcagcttgcgcagcagcttgcccaggacgatttcgccggacagcgcgcgcgccgtcttgatgacggacgccaggtccagcgcggccagtgacgcttcggtgggggcatccgtgcgcgtgggcgtgggggcggacggcaagagccgggggtgctcccgctccagccgagccacgacggcgcgggccccccagcgcaggtaggcggcgcgggcttcctccaggtaggtgcgggccacgcgctcgcgggcttgcgtcaggtggaaccgtgccgcggcctcgcaggccacgccttcgtcgagcgacaggccgtactggcgcgccagccggatggcccggtcataggcatccgcggccgagtccccctgaccgtccaggagggcccgctccgcgtccagcagctccgggcggg

SEQ ID NO: 721 - DNA, 4387 bp, Myxococcus xanthus
  unsure (1)..(4387): unsure at all n locations
cgtcgtgggcggcgtggccaacgcgacgcagaacgtcgtcgagggtgccaaggacaaggccggtgacgtcgtgggcggcgtggccaacgtcacgcagaacgtcgtcgaaggaaccaaggaccgggtgcaggacgcggcgggcaacgtgcgcaacgccgccggcgacgtgttcgaggcaggccgcaccgcgacccagcgcaccctgagcgccaccggcaccgcggccgccgtcaccgcgaatggcctgggcaatgtcctcaaggatgcggcggagcgggcgggcccggtgctcgacaaggcgaccgacatcgccgcggacggcctggacgtggcgggccgggccatccaggacgcgcccacgctcaaccccctgcagggcatcaccaacgacatcatcggcggggcgctccagggcaccgcggacgtggtgcgcgacccggtggacacggcccgggccattggcgacgcggtcaacctcaaccggcaggtggaccagctcaagccgggtgagagcacctccatcagcctctacgccgaggccaacggcgccacgctggccggcaaggtgaagggcaccctgggcgtcagccgcagtgaggaagagggcggcggctacacggtgtccgtcaccggcgaggtgggcgcgggcgtcgcggccaagctgggcgccaagggcgcggcggacgcgggcgcggaggccttcggcaccgccggggccacggtggagttcaagttcgacacggccgaggaggccaagaacgccacccgcatcatcgcggcctccaccgccaccgcgggcgccgccgcgagcaaccccgtgctgggcgccggcgtgaatcacgtccttggggatccgctgtcggacctggcgggcctgacgaagaacatgagcgccgtggagttcaagctgggcgccgaggccagcgtcaacgccgagctgggcatgaagggcctgccggaggccatcagcgcgggcgccggcgcgagtgccggaatcaaccagagcaccacggcccgcatcgagatggagggcggcaagccccagaagctgaccctcaagcagagcctcgaaatcaacggcaacgccagcgcgtccgcgggcgtgggcatccccaccggtggcggggactccgtgtcgctgcccaccaacgcgtccgcgggggtgtccggttcgctcggggtggagctggagcagagcgtggagctgcccgagggcttcaacccgaccgacttcatcaaggacccgaagggcaccgctcgcgagattggcgccagcgtgcgtgacacccatgaggccaagctgacgctgaccgactcgcgtcaggccaacgcgtccgcgctgggcctgggcggcgcgacgggccgcgaggtgaaggcggaaatcagcggcaacatcaacgacatcgccaccagcggcgccttcggcagcatcgcccggggcgacgtgggccaggcgctggaccagctcaaggacaaggtcgaaatcaaggccaccgtccaggacaagcacaaggtcaccggcgactttggcgtgggcgttcacgcgggcgtgggcggcggcgaggtgggcctgtccaccgagcgcacctacgtgggcgaggagcaggacctcaacgcggcgcagctcgccgagctgtacctcacgcagcgctggtcggccggcatcccgggctgagccggcgctgtcaggggcccgcccgccctgggcgggctcctgggcgtgtgggcccgtgtcgtccggttgggattccctctggggacaggcacaccgtccgccatggcacagccgaggcaggcggccagcaccgaccccagggggtgggagtgccccttctgcgggacagccttagctttccgaggtgctttcaagattcctcgtctatgggtgcgtgggctgggtgctcgaggtgatgttcaccggcacgggggctgcgctgaagaaggaccggaacgccacggcgcgcacctacctgtggatgcaccccatctacggaggcacggcgctggcgctggaagaggtctccgcccggctcaagcccctgccccggccgctgcgagccctggtctacacggggctcatcttcggcgcggagtacggcacgggctggttgctcaagcgcctgctcggccgctgcccgtgggactacgcgccgcacaggtggagcgtacacggcctcatccggttggattacgccccggcctggtaccttaccgccctgctgttcgagcccgtgcgtgacacgctgctccacgtcaccagcgaggccctgcggcagacgccggagtaccgcgacgccgaggcccgggggacgctgccgcccacggcgctccccgaggagaagccgctggaggcggggctggcggcggcgcgcttcgagtcagcgcaggccgagcccgcgcccatcccctgaaagccggaagcgccgcgcctgcgtctgctggccgactgccccccaggcggatgtgaacgccactaccggcttttcttcctccgtgctgcgtcgcgtagtaccttggcccgcgcctgcccccgctatgacggggaaattccgccgaccccccgaaagttcccgcccccgtatgtttgactggcttcacaccctcttctcgcgtgacctcgccatcgacctcggcacggcgaacacgctcatctacatccgcggccagggcatcgtctccaacgagccctcggtggtggccgtccagcaggacgcgcgcgggggcaagaaggtcctcgcggtgggcaaggaagccaaggaaatgctcgggcgcaccccgggtaacatcgtggccatccgcccgatgaaggacggcgtcatcgcggacttcgaaatcacggccgcgatgctgcgctacttcatccagagcgcgcacaaccgcaagacgctcgtcaatccgcgcatcatcatcggcatcccctccggcatcaccgaggtggagcgccgcgcggtgcgcgaggcggcggccaacgcgggcgcccgcgaggtctacctcatcgagcagcccatggcggcggccattggcgcgggccttccggtgacggagcccagcggcaacatgatagtggacatcggcggtggcacgtccgacgtcgcggtcatcagcctcgccggcatcgtgttcgccaagagcgtgcgcatcggcggcgacaagctggacgaggccatcatccagtacgtcaagcgcaagtacaacctgctcatcggtgagcgcacggcggagctcatcaagatgggcatcggcaccgcgtacccgacggacgaggtcatgaccatggagatcaagggtcgcgacctggtggccggcgtgccgcgcacgctcacggtgtccagcgacgaagtgcgtgacgcgctggcggagcccgtcaacggcatcgtcgaggcggtgaagctgacgctggagcgcactccccccgagctcgccggcgacatcgccgaccgcggcatcgtcctggccggtggcggcgcgctcctgaagaacctggacacgctgctgcgcgaggagacgggcctgcccgtgttcctcgccgaggacccgctctccgccgtcgtgattggcgcgggcaaggcgctggagtcgctcgacatcctccggcaggtctgccagccgggctgagcctccgggcttcggctccacggcgccacctctcacgaggctggcgccgtttcgcttttcagggcgctgtttgacaggtccgcgcgcgagtggttcagggacggcggtgcttcgcatacaggccgtcccgccactcgagcaggtccgggaagcgggaggcgagctccgcgtcactccacaccgctcgcgtgccggggcccagggggaggtagctgtcgtccaccggccgcacgaactggagcatcagcgcggccgcgatgtccgcgaagctgaagcgcgccagcaggtagggccggccgcccagtgactcacgcaggcgctccagcgtggggatgaccttctcctggacggccgcgccgatgtccgtgggcgcctggtgtttgcgggccacgaagcgcgcgcccagcctcgcggacggggccagcagagaccggagtcccatgggcaggaaggcggggaggctctccgcctgcgcctgccgattctccaacaacgccgccaccaccttggcgcgcgccgcggagtgcacctgctcactgtcatcgtcccagcgctgaatcaccgggaggtccgttgcggggaagagcggctccccctgtcccagctcctccgcgcgccgcgcgatgacgaacgagccgggaaaggcctcgccctcgtcgatgagcagcggcacggcgggccgcacaccacgcggcgtacgccagcgcaacaacggcttgccgatgaacggcaggtgttcncggaacgacatggcgtgcatggaagtacccag

SEQ ID NO: 722 - DNA, 5787 bp, Myxococcus xanthus
  unsure (1)..(5787): unsure at all n locations
gtgctctaaaggagctcacgggccaccggcccgaagatacgcgtaccaatgggctccatgtccttgttgatgaggaccgcggagttgccgtcgaacttgatgtagctgccgtccggacgacccacctcgcgcttggtgcgaacgatgacggccttggccacgtcacccttcttcaccttcgagttgggaagcgcctcgcgcaccgagacgacaatcacgtcgccgatggacgcatacttgcgcttcgaaccaccgagcaccttgatgcagaacaccttcttcgcgcccgagttgtccgccacgtcgagcacgctcgtcatctgaatcatctgggaatctcctgtcgccggtgaccatcccgcgccgcctcacggccgcgcggaagggacatgcgtgctagacgttcttgctcttctccagcacctcgaccacgcgccaacgcttgtccttcgaagcgggcttggtctcggcgatccggacccgatcaccctcgttgatggtgatcttcttggggtagtcgtggtcctccacgtgcgccttgtacttctcgcgcaggctcatgatcttcccgtacttcgggtgcggagcccggcgctggacggtgacgaccaccgtcttctgcatcttgttgaaagtgacaatccccacgcgcgtcttgggacggccacgggtggaagtctcggaagcctgcntctcggtcgcttcagccatgttctctctcactgtgtctcatgcacccgggcattggcgcccggatggccgcacgcgctcctctatcagctgagcgcgcttggagtcgtgggtgttcagcccttaagccttcgtcttctgggtcagcacggtcagaacccgcgccaggtcccgtaggtgctgggtgcgctcggccgggttgtccagcaaaccggtccgccgcttcagctggtcctggaacagcctctcgcgcaggtcggccgcgcgctgcttcaggtcgtccgccgacagttccttcaattgcttcggagtcgccatttcactctccatgcgagcggaagctgtccaggggaccagctcccgccgctcggtgccttagaggctcaggtccgcccgcttcacaatcttcgtgagcaccggcagcttcgcctgcgccagcttcagcgccccggtggccacttccggcgtcataccctccatctcgtagaggatgcgggcgggcttcaccaccgcgacgtagtactccacgccacccttaccggtacccatacgggtctcaacgggcttcttggtgatgggcttatccgggaagatacggatccagatcttgccgccacgcttcacgtgacgcgtcatcgcgatacgagccgcctcgatctgccgggaggtgatccaccccggctggaggctcatcaggccgtactcaccgtaggtcatgtcgctaccccggtgggcactgccaggcatgcggcccttgtgcatcttgcggtacttcgtacgagcaggctgaagcatcgtcgctgtccttcgccgccctgccccgggcgccccttttgggagcgcccggcgcgggtgggctgattaccggttggagggcatgggggcctggccacccttgcccgggaggacctcgcccttgcagacccagaccttgcagccgatcttgccgtaggtcgtcttcgcctcggcgaaaccgtagtcaatgtccgcgcgcagggtgtgcaggggcacgcgaccctcgcggtaccactcgtagcgcgccatctccgcgccaccgaggcggcccgagcaggccacgcggatgcccttggcaccgaacttcatcgccgtctgcagggccttcttcatggcccggcggaacgcgatgcggcgctcgagctgcgtggcgatgttctccgccaccaactgcgcgtcggtctcagccttgcggacctcgacgatgttgaggaagacctcgttcttcgtgaactgctggaggtccttcttcaccgtctcaatgcccgcgccgcgcttgccgatgacgatgcccggccgcgcagtgtggacgttgaccttgaccttgttggccgcgcgctcgatttccaccttcgacacgcccgcgtggttcagcgacttcttcacgaactcgcggatgcggatgtcctcgtggagccactgcgcgtagttcttgtgctcgaaccacttggagtcccaggtcttgatgacaccaagccggaacccgatcggatgaactttctgtcccaacgtgattctccttgaagcgtccgggcagggcccgacgggtcctacttcttcgcctcggcgagcaccacgtggacgtgggccgtcttcttcttgatgggggtggcccgtcccatggcgcgcggcatgaaccgacgctgggtgggaccctggtccacggagatggtcttcacgtagagcgtgtccacgtcgacctggcccttggacttgtcagtcgcgttggccacggcgctcttgatgagcttctccaccggcttggccgcggcgcgcttggtgaacttcaggatgttgagggccgcctcaacaggcttgccccggatgagctccgcaacggtggaaatcttgcgggggctcatgcgcaggaaacgcagatgtgcagtcgactccatggtcttctcctcaggctctcaggcaatgcgccaggctacttgcccggggccttggcgaccttcttctccgccgagtgaccgccgaacgtacgcgtcggggcgaactcgccgagcttgtggccaaccatgttctccgtgacgaacaccgggatgaacttcttcccgttgtgcaccgcgaaggtgtgacccacgaactccggaagaatcgtggagcggcgggaccacgtctttacgacggccttcttgttcgtcttgatcatgtcctcgatcttcttcacgaggaagtcgtcgacgaacggacccttcttgatcgaacgagccatggaatcctcttactggctgcgcgcgccctggcggcggccggacacgatgaacttgtcagtgcgcttgttggtgcgcgtggtgagacccttggtcttcttgccccagggggacacagggtgcgggttaccctgaccggacttgccttcaccaccgccgtgcgggtggtcgaccgggttcatcgccagaccgcggacggtggggcgaatgcccagccagcggctcttacccgccttgccgatacggatgatttcatgctcgatgttgccgacctggcccacggtggcgcggcactcgatgaggaccttgcggacggtgccggagggcatacgcacctgcgcgtaacggtcctccttcgccatcagctgtccggacgtgccggcggagcggatgacctgggcgccacggcccggcttcagctccacgttgtggatgaccgtacccaccgggatgttctgcagcggcaggctgttgccaggccggatgtccgcgccttcgccggcgaacaccgtgtcacccacgctcagacccaccggagcgaggatgtagcgcttctcgccgtccgcgtagtgcagcagggcgatgttggcggtgcggttggggtcgtactcgacggccacgaccttcgcggggacgccatccttgtcccggcgcttgaagtcgatgacgcggtagcggcgcttgtggccgccgccctggtgccggcgggtgatgtgcccgtggacgttgcgaccaccggagcgcttgagcggctcggtgaggctcttctcgggcgagtccttggtgatgtccgcgaagtcggacaccgtcatcagacggcgggcggcgctagtcggcttgtacttcttgatgcccatggtgtgttcctcaggctggctcgacgccgtggcgtcaggccgcccctccctcgaagagttcgatcgagtcgccctgcttcagcgtcacaaccgccttcttgaagttgggccgcttgccgatgctacgacccacccgcttgatcttgccgcggacgatgttggtgttcacgccctcgacggtgaccttgaagagcgtctccaccgcacgggcgacgtcgtgcttcgtcgccttgcggtcgacgatgaacgagtactgacggaacttctcgcgggccttgtccagcttctcggtgatgagcgggcccttgatgacgtcgttcagattcatgacagcgccccctcgagggtcttcgcggccgcggacgtgaggacgaggtgcgagtgccggagaacggcctcgaggttcaggccctcgggcggcagcacgtcgaacttcgccaggttgcgcacgctgcggtgcaggttggtgttgcccttgtcgtcaatcaccagggcgttctggagcttcagacgcttggtgaggacctcgaaggcctgcttgctcttcggagcatccagggagaagccatccaggatgatgagcgtcttctcctgggcccgcagggacagcgcggacttcagggcgccgcggcgcaccttgcggggcgggcggtagaagtagtcgcgcgccttgggagccatcgccttaccgccgcccacccagtgggaagcgcggatggaaccctgacgagcgcggccggtgcccttctgcttccagggcttcttgccgccgccgctgaccagcgaggtgttcttcaccccgaccgtgccgcggcgccggttgatctgctgcatcttcgccacctcgtaaaacaggtgggcgttcggctcggtgccgaagacatcgtcggagagctcaatctccgacaccttcttcaaatccaggtcgacaacgtcaaacttcgccatggcactttcctcgcgggggtcggagtgaaaccactcgaacgcccacccgcttcctaggacttgatctcgacgtcaacgccagccgacagatccagcttcatcagcgcatccagcgtctgctgcgtgggctcgaggatatcgagcaggcgcttgtgcgtgcggatctcgaactgctcacggctcttcttgtccacgtgcggagaccgcagcaccgtgaacttgttgatgcgcgtgggaagggggatcggaccggccaccttcgcgcctgtgcgcttggccgtctcgacgatctcacccgcgctctggtccaggagcttcgagtcgtacgccttcagccggatgcggatcttctgtgtcgccattcgcaagaacctctttgaacggactctgcctctgccgcgggagggcgttacgaccgacgtcccctggatttcacagagccgtttcttcagaacgaaggggcgcggtgtgtaccatcccgccccagggtgtgcaacatgattcccaacggctccctgaaatttcccgaaattgggaacgcagggagccactgggggtttgcgctactcgacgatttccgccacgacgccggcacccaccgtgcggccaccctcgcggacagcgaagcgcagctccttctccatggccacgggggtgatgagctccacctcaatggcgatgttgtcgcccggcatcaccatttcgacgttctccggcagcttcaccgagcccgtcacgtccgtggtgcggaagtagaactgcgggcggtagcccttgaagaacggggtgtgacgaccgccctcttccttcgacagcacgtagatctgcgccttgaacttggtgtgcggggtgatgctgcccggcttggccagcacctggccgcgctccatgtcctcgcgcttcaggccgcgcaccagcgcgccgatgttgtcgcccgccatgccctggtccagcagcttgcggaacatctccacgcccgtgacgaccgtcttctgcgtcgggcgcagaccaacgacttccactttctcgccgaccttgatgataccgggctcgacgcgggc

SEQ ID NO: 723 - DNA, 5482 bp, Myxococcus xanthus
tgctctaagtggctgcgcaagaaggtgaagcgacgctggcgggccttcctgctgctcatggtgggcgtgccggcgctggtgctgatcaccctcccgttcatgtgcgcctcccgcttcgtcttcaccgccctgttcaccgcatggggcgcgtggtggtgggtggtcttcaccgccgccaagagcgcgcgggcctgggagccatccgcgggggccacgcggccgccctggttcctgcgggtgtggacggtgctcaccacgcgcgtgccgggctttcggtggggctcgctacagcggtacggcgcgtcctggggacggcgcacggaggaggtcttcgcccccatctccagcacggagcgccacccctgggtgttcgccgggctggcggtggtccgattcctgggttcatttcctccgatgaagttcttcgtccggccgctcatccccgtcgcctccgcgcacctgctggaggaggacgtgcccgcggccaggaaggcgctcgccgccggtgcgaacgcctcgccgcccgaagccgaggtaccccgccccgccgacgtgtggtgacgggagggacgtccccgcgccgctcggctcaggagtcgtcgcgcgagcggtcgtcgtttccatccggcgccggcccatccggcagcggcggcgccagggggcccagcggcgccgtcatctccagccgctcgcccgtctcgcgcgagtccggcaggtcgatgagcgcctggagctgcaggctcaccgcgcggaagaagcctgtcagcagctccggccggtccgcgagcaaatccaagaagtcacgccggtcgatgatgagcacccgcgtgtccaccgcggccaccatgtccgtgggacgcggtgcgccgtcgagcaggctcacctcgccgaaggcctgcttgccctggaagcgcagcacgtgctcgccgtcgtggaaggcatccacggcgccgtcgacgatgacgtagagcgcgtcgcccgggtcgccctgggcgtagatgcgctctcccgtgcggaacgacgcctcgcgggccacggcggcgatggcggcgatgtcatccacgtcgcactgggagaagacactcaccccttccagcgcgaacatccgctggactgtcctgtcgctcatgtcaccttcctgtgggagcacgtgcagcccgttcacccacgccacatggcgggcacatgcgcgcagcacgccgtcttcgctctggaccagcgccgccagccgccgccacaaccggcccggcgcgccgggtggaagctcgcggtggtgcgcctccacctgctccatcaccagttcccggtcctcttcgtcgaccaggttctccaacaactccagcgccaacgcgcgacggcgcaggtccggccccaccaggttgtagtggatgccgcgcatcacgtgtgacggatggagcagccccaggaggaagaaggacaattccaacgcctggtccatccggtcgcccaccgcgcgcgtgagcagcgagccatcccccaacgccgcgcgcaggtcgcggaaggcgcccaccaggttgcggtagacctcccgccgccggcccagggcctcgcgcacgcgctccacgtccacgggatgctcggggtgctcgtcgcgcaggcgcgacatctgcgcgccaatccggaagtgcagggacgcgtcgtcgcgcacgttggagaacagcagcgcgtccagcgccgccggtgttccgatgccgcgcagcacgcggggcagttgcagccgcatcgccagcggcgccatgtgcttgttgagctgctcctccaccaacggcgtcacctcgtcgcccagcgccaccagcgcctcgcgcgccgccttgcgctcctcccgccaggtgaggaacggcagcagccggggcgccagctccgcgtagccgcccctgcccaccgcgaccagggccacgtgccgcacggagccgtccgcgtcctccagatagcgcgccagcggctccgcgaagcgtgagttctggatgcgccccagcagccgcgccacctcgcggcgctcgggcaccggtgcgccctcgccgcgcgacaacatcgcccgcagcgcgtccagcgccacggcgctccccgtcgacttcaccagcgcgccaatggccgcgcagcgcaggcccacgtccgggtggttcagcagcgcgggcagcaggcgctccgcccgctccggtgacaaccgcgccagggcccacacggcctggtctcgaggccgacgtggcccttcctccaccaaccgctccagcaccggcgccagttcgtgcgcctccaactccagggccagggagacgccgcgctccagcacgcgctcgtgcgggtgacgcagcagcgcgggcaggtgcggacgcagcggcacctccgcctgctccatcatcgccaccgcgcgcagcacccgctccggagaaggggccgccagggcctcggccagcagccgctgctcctcctcgccctccagcgccacgtcctcttcttcgggcgctcccacctgctcgcccagcgcggccacgtacgcggacttcagccgcaccagcagcaggcccagcgccgcgcacatgcccaccaccgccaccgccatggtgacgccgttggccgcgcgtcccgcgccgatgagcaacagaccggccagcacgacgccgcccttgcgcagcagcccatccaccgtggcgcgcaggccctctcgctggtcgtccggcaccgcggtgtagagcaactggatgcccaccgggaggatggagtagctcaccgccgtctccaccaggcgcagcaagtgcaccggccacaagctgggggtgacgagcgccgcgcccgccagcggcgccaggaccagcggcaccatcgccacgtagcgcaagagccccagccgcttcagcaggcgctgcgccaccagcagttggaaggccacgcagaacaggccaatccagagctggagcgaaccgaagagcgccgtcagcgcgtcctcgctcagcgtgccctccaggcgcagccggaagaggtagtccacgaacgacgacagcaccgcgaacgcgatgcccagcgccgccagcacctgggcgtaggggctctccgccagatagcgcagccccaggaaggacgcggggcggccgcgcggcggcgtgggcggcaggcccttgtacaggtggtggaagatggcgcccgcggccagcaggcccacggcgccgctcaccacgatggccggcgtgcccagcttcaccgccaggccctgcaccagcagacctccggcgatgcctccgcccatggcgaagccgttgagcgcggtgaaggcccggcgcgcctcacgcgcgtcgaaggcggccgccatgcggccccagaagcggaaggacacgaacgtggagaaggtgtccgcgaagaggtacagcgccagcgcgggcatgcgctgccccgcggacagggccaccgccagcaccagcgccaccacgccgcccatgcccgtgagcaggcccggggactcgaagggcgagcccggcttggagcgcggcagcaccgtcatggccgccgtcatcaacgcacccagcaggtacaggtacggcagcgcctgggactcgaagcgcgacagcaccagggcgttggaagccgtcttcagctgcgtcacccctgcgatgagcgcgaactgaaaggctgccgccggccaaaggcggcggttccatgatgaggagtcggaggggagcacggtgcgagtgcgcggcagactaccccacgccctctcgccccaagaatagcgctgtcgtgcgaggtgccgcccgcctgctctccggacggcgggcaagtcacttcggacaccctcccccgccttccgccgccctcactgaaatcgttggagccgcgatgaatatgcctcgagccgcccgcacgtgcgccgccgcggctagactgtgtcggtgacgaccgccaccgacaccctgctggacggcacccacacggtgctcacccccgagtacgtggagttccgcttcacgctcgcgggtctgtactcgcgcttcctggcgtggctgctggacgccgtcatcgtcacgctgctcaccggcaccatcctgacgacgctcagcctggtgatgttcgccttcccgggcttcgccagcgcgctgtccatcgtcatctacttcctggtggactggggatacgcgataacgctggagacggtgtggagcggacgcaccgtgggcaagcgggtgatgtcgctgcgggtcatccaggagagcggcgtgcgcatcggcttctaccacgcggcgctgcgcaacctggcgcgtccggtggaccgggtgcccctgttctacctggtgggagggctcaccgcgctcgtgtccggctcccagcagcggctgggggacatgctggcgggaacgctggtggtgcgcgagcggcgcctgaaggtgccctccgccctgggcatgcccggcgacgaagggctgctggcggatccgctcttcgtgtcgcgcgtgaagcgcctgtccagcgaggagcgggaagtggtgctgacagcggccctgcgccgtgaggaactgcgcatggaggcgcggctccgcctgttcgcggcactgggagcaaggctgcaggacgcgctggccatggagaagccgccccacctctccgacgagaagtgggcgctgctggtggccgcggccctgctaccgccgaaggggcagcctagaagtacgccgcagcgccggcagacagcgtgagcgtgcgctgcgtcttctcgttgagcgcgatgtagaagttgtactgcgcgcgcgcgcccacgctcaccgagtccgacatgaagaagtcgatgccgacgttggggccaatgcccacgaagttgctgacgctgttcttgaagacgacgaggtagctcaggtccgagcccacataggggcggatggactcctccatcagcaggtaccggatgccgatggacggcgccaggcccaccacgcgcttctcgttgcggtccgtggtgtcgcgtgggaacgcaatcttcgacagggagaccacctcgaagccgttctcgatgtagaggctggcgtcgacgcccacgaagaacgcgtcatccaggccgttcgtccggttgaagtccatgtagcccagtgacaggcccaggctgcgattggcgaactgggcatgcgcggggctggccgacagcagggccagggtaaagccgagggtgcagagcagggtacgcatgggccgccactctaccggcgtaacccccggaaaacagcctggattcaagccactccgggcgttgcctgggcgcgggcgctctcctacactcgccccgccatgcgtgtccgccgacttgttgctgcgctgtccctggtctccgccctgcccttcgtcgcctgcgtccggaccccgccgccgcatgagcgggcgctcatcaacaacgagctatgcacgcaagagatggccaagggcgacctgacccgcgcggagacgttctgcgacctgggcctggagttctccccccagtgcgcgg

SEQ ID NO: 724 - DNA, 6599 bp, Myxococcus xanthus
cgtgctctaaagtggattacgcggtgcgtagcccgaagcagcagttcatcgtggtgacggaggcgggcatcatccaccagatgaagcgggccgcgccgaacaagacgttcattcccgcgccgccggacaacggctgcgcgtgcaatgagtgcccgtacatgcggctgaacacgctggagaagctctggcggtgcatgaaggagcgcacgcccgagctgaccatgcccgaggacctgcgcgagcgtgctcgcgcgccgctgcaacgcatgctggactggtctcagtagtccgcggatgaacggcagcagcggacatttgccaactcgcgtcttgcaccccgcgaaacacaatgcgatggagccaccgtggccttccgattcctcgcagtccccgcgcaccgactggtgaacttcccccagacgttgccggacgatgagcgcctcgagccggagctgcctccggtccatgaggcggtggagcgcgcgctcaccggcgctgaattccgagacatgcgagccaaggacaggctgcgcatcctgctacagggggaccgtcccccgtcgctgggcgcgcccgagacgggcttcggcccgtccgccatcttcgcgcatcccccccaggacctcccggcgctgctgcggctggcggacgagttggagaacctggcgcgccgcgaggcgggtgagcgcgccctggtgtggaagtgcggagattgtggcgcccggtacgcggtgccggtggccctggtgcgccaggtgtccatccgctgcgagcgctgcggcacgccggtggagctggcggccacgcgcagcctgggtgaggagtccctcatcgacccgttcctgggcgcggtgaatcacagccgccgggagctggccgccttcttccgcgaggccatggcccgcggctggccggtgctggtggccgaggacaagcgcgtgccacgcacgcagccctcggcctgacggagtccggcggaaaacgggttctcgcgccgcacggggagcggtagccttgccagccccatgcggcgcgcgctcgttcctctcctgcgatgtccccggtgccggcgtggcgccctccagccagaggtagacgccccggtgctcttcttcggcccgctgcgctgccaggcgtgcggcgccagccacccagtcgccgagggcgtcgccgacctggtggtggaccccgccgcgtccggcccgctgcagcggggcatggagcagcgctgggtggcgcgctcctacgagcgctacatgcgccccgtgctccagcgcgccctcacccgccagccgctggatggcgacagcgaattcgtcctctaccgcagcctcctgggcaaacccgaaggcaccgtgttggacgtgggctgcggcacggggctgctcgcgcggcggctggcgcatgagcccgacgcgccgcccgtggccgcgctcgacgtgtcccgcgccatgctggaagagggcctggcccaggtgcgcgaggccggcgtcgccgtggacttcctgcgcgccgaagccccctacctccccttccacgacggtgtgctgggcgcggtgttgatgagtgacgcgctgccctacgtcgcggacctgtcccggatgatgatggaggtccaccgcgtgctgcgtcccggaggccgctgggtggccagtacctacgcttcggtgggagcgcctcgggcgctgctccaccgcggcgtgggcctgcatccacgaggggaggccgaattgcgccgggaggccgcggcggcgggcttcgtgcgcttcgagcgcgtgtccctaccgtcgctgctggtggtgaaggcggagaagggctccgcccagacgcctagatgaagatgcccgcggacgcgtcgtagcgcgcctcgtcaaactgcaggttcgcgggctggccgcgcagcgcgtccatcacctggcgcttgggcttcttgcacttgctgcagtcgcacgagcccttcttgcacgtgcagtccgccttgctgccgcactggcacttggcggccatgagcgagtccagcacatccaacgggcgctccacgccgctggcggaaggctcgacagccttcggcgtggcctcggcggccttcgtttccggggccggacgccggtgggcctcgcaggcctccgccgcgcccggtgccaggagcaggccgctcgccatcagccctccggccacccacattccgatgcgcgtcatgttgctctcctcggggcactgcaggcgcccctgctcaaacggcgcctataccgcagcccttcccgactgccaaggccgacagccatacctttgtctacctggaaaacaggcgctggccgggttgcacggacggctcgccgtgcagggaggcgccgcgtacagtccgcgccgtccgtgacaccccgacactcccgcctcgtccatgccgccgcgctcgtcctgggggtgctccccctctgggtgtcgcgccacctgcccctggtggacctgccccagcacctgtacctcatctccgtcctgcaccggctggatgaccccaccacgctgtacccgcaactgttcgccgcgcgtcacgcgctgacgccgtacctgggctactactacctggtcagcggcctcaactggctgctgccgctggagatggccaaccgcgtcttcctctccgcctacgtggtgggcctgccgctcagcctcggattcctgctgcgcagcctgggccggcccacctggcccgccctgctggcgctgcccttcgcctacggcgacagcttcaactggggcttcatcaactactgcgccgcgctgccgctaacgctgctgtgctgcggcctcttcgtgcggacgctggaggacacgcctcgccgccggacgtggggcgtggggctggcggtgtgcctggtggcggtgctcctcttccacgtgcaggccttcgggttcctcgccttcggactgcccttgctgctgctcaccacgcgcgtgccggaggacgcggaagcgcgggggttcgtcgcgcggctgcgggctcgcgtgccccagctcgtggggctggtgcagcatgtcgagctgatacttggtcgatgtggtgttagccttcggcgagcccgcggacatccagcccggggtgccctggaaggcgtggggccccacgttctctccacagaacctggcgtggaagggcttcgaacagaaccgcgccgagttcttccaggtgctcgccaacaccttccgggatggctcggaccggtgggccctgtacgccgtgggcgcggtggcggtggcgggctgggtcgcggggctgctgcggccggagcgctccgccacccagggcatggtggcgcgctcgcggctgatggggctgggcctgctggccctggcgctctactttctgctgcccttcgacatccgcggctacgtctactacctcaacacgcgctacgcgcacctggccgccgcgctcctggtggccaccgtcccggcggccattcccgcgtggcggaggcccctgcgcgtcgccgccctggcgtgcgcggtggtgctggctttcgtcatggcgcgcggctaccgcgccttctctcgggaggcgcaggccgaatgggggccactggtggccgccaccgccccgcgccctcgtgtcatggggttgatgttcgaccccggctcccgggtggtgcgtcagcccgtcttcatccacagcgcggcggtgctggcccgggcgcgcggtggcgtgcccaacttcaccttcgcgtccacgccgcactccccgctgcgctacaccggcgaggagccccccaccttcccctccgagtggcggccgcagcagatggactacgagcggcagggcgtctggtacgaccacttcctcgtccgcggtgcgtcgccgtcgcgagtgttcggtccgcagctccaatccgagctggccgtggtggcggagccgggcaagagcgcgctggtgcgccggcgctgagtcctccgccgctcgcggcactgtgacctggtgggcgcaatacccgcgcggggcatgccccggggcgggtgccgtgcagtagaaggtccggtatgagttcctcctcttcggaccctcgctccctgctggacgccctgcgctccggcgcgccgctgcccgcctttcccgccgaagcggtggagtccgcccgcgccatggcgcgcgacgtgtcccaagccgccctcgcccgcgtggaggcccttccggagcctctggccctggccgtgcttgaggccgccgtgtcggacgggaacgccgtcctgccggaggccctggcatcctcgtcggtgaagcccctggccaaggccgcgaagaaggcgctgtaccagcttcgctcacggggcgtcgccgtggccgggcccgcgcgtgccgccccggccgagccgcccgccgctgcccccgaggccctcaacgcgctcgccagcgccgtcaccggtggcggcgagcgagcgctcgtgctggcacgggtgctgcgcggcgcgggcgtggaggtggtgcaaatgcagttgtcccacgagcgcggagtggtggcgctccagttgggcgacaggaatcgcgccacctggcggaagctggtgaaggacgggctggcccacggcggcatcgtggagctgccgcccgaagaagccgcggccctgctggccgaggccgccggcaccaacctgcgcacccgcacgcccttccccaaaggactggacgtggtgctgcgccactttggtgtccagccgcagcagtcgcccacggagctgcctccgcccgagcccgaggacatccgccgcgcgcaggaagccgacgtcctccacgacaccgtggagctggcttcgtggctgcctccggagctcgacatgcaggccctggtgcagaagatggacgaagtgatgcacagcccgctgtcgctgagcgacgtgcagcgccaggagcagctccaggcggcggtgctcggcgtggcccgggacttcttcacccccgaggtacgccagcgctacgcgctgcggctgtggcggatggcggactacttcgagcggagcagccgcccacgcgaggcggatatcgcccgggccgaagcccgccggctcttccatggggcccaggagcccttctcccgcttcgccgagcggctcttcgagaaggtgctggccctggtagccgccgccggggcgcgggccggtgcacggcccggcgcggacaccggccccgcggaggccgcgcctgcccccacgctggagcggcgcagccccggcgggctcatcatcccctgagcacaggggacccacacacggccactcaggccggcgtcacgcgggcacgcaggagcaggtccaggttctcccgctcccacgcgagggcacgggcgtagtcgtggaactgcttctcgtgctccatcaactcgggcgggtggatgcagcgccgcccgtcctcgcccttccgcgtccggtacacgtggtggagcatctcgtggaagacaatccactccacgaagtagcggggcaccaccggctggtccaacgccgggtggatgcggatgaccttcgagtccgcggagtaggagcccatcttgatgctcttgcgaggccccttcacccgcggcgccgggccgtaggtgatggccgcgtcgatgcggccttcgaagtagcgctcgttcagccgggcgtagatgcgctccaaatcgtggtgctgccccacgggctccagccggatgcgcttgcgcatctgcgccggagacaggcgccggatgtagacgcggttgcgctcgatgaacttgtccagcagcacgctggcgtccgggtcacccttgcgcacgaagctggcgagcgcctgcaccacgtcgtccggagcgaccaggaacatgtggtgcagccgaagccgccacatggcccgctggcgttggaacgtcagcatggtgtgcgtgttgtcgtgaatctccaacgccaccttcgcgcgcaggcgcgtgcgcagccggcgttcgagcacgcgacgccagaccttcaagagcctgttgggctcggggacgaggggaacctgccgggccacccggccggccgtgtaactccgcttcctgattacgtttttctgactcttcgggcgcgccataagggttccggattctacggacccgtctgacatgtgtaaacgcgctcgggaaggcgaaagccctggaattccaacggcttaaggccactcaagcccaccagggcccacttgtccgccgctggggcaggatgccgcatacgcttcaaacgcccgatgtcactggcgtcgcttcttgcatggaatctgcaggacgagcggcccctcgctcgccggctctatgaggtagggttttgtacccttcggcttccgacgccccgggcactggtagctcacccggatggggcccgcgggcagcgagaccagggtgttgatggggaggcgctcgcccccctcacgccggagcaccgtacgggcgggagcatcgaagcggacgctcacccgagagacttcggcggtggccgcgggcagcgcgtccgcgttggcctcaggagacgctggtgctcgcggctccggaggtttcgccggttcagtctgcgccgtcgcttccgggcgtccgtcgtcttgcgccgtggggggcgcgttcgtg

SEQ ID NO: 725 - DNA, 4429 bp, Myxococcus xanthus
tccacgttcgccagccgcgacaactgcaccatgtggaggatgggacgcgccgcgaccaggctctgcaccgccgccgcggggatgccgaagacagtctccaggttcgacgcgctctccgtgttcacggcgaggatggcgcggcgggcctccgccacgttgaaggccacgccgtgcagggtccccacgtgtccgtcgaccggcagctccacgcggcccgtgcccttggcgtacgcctgtagcgccgcgagcgcagcggggcccacgtacggcgccgcgtccacctgctcgatgctcacgaagcggcggtcatcccccgtgtgaagcacgccatccggcccctcgcggaagtcaatcagcgcctgcgccgcctgggagtccagcggcacctccaggtccagcacggtgtaggagatggagtagtcgttgaggaaggacagcacaccctccgcggcgggcgtaccggtggccagcgcctgggcctgcgttccgagcacgacggcctcgtgcgcggtgtccgtggacgtcggggctccacagctgatcaatgccgggagaaccgtggatagcgaaagaaacaagggaagtttgagtttcatgcgcaccatgtagcgcaagacttgcccggcgcacaggacgtcacccatgcgtgacgcaatccaaccgaagccgtggggaatacgcccacctccgtggcagtcttgcgcgccatgcgaatcccccacgcgctgtctctgggcgccgccgctctcctggcgctgtcggcacaagctgccgcccccggccgtccttcccccaccctgccttcgggctactggccagaggagaaggtggccgaagtcctcgccaagacgcaggaggtccgcctgtcgccggacctctcccgcctcacgctcgacgagcaggcggcggtgaaggacctgctggaggtgggcgccatcttccaggggctctacgagtcctcacgccaccaccaggcgctcccggctcacgcgaagctggaggcgctggacaagaagctgggcagccccaagcgcacgcaggacctgctcacgctgtaccgcctgtaccagggccccatcgccagcaccctgagcaacgcgcgggaggcgttcctcccggtggacgcgcaggtgtccgcgcgcaacgtgtacccggtggacgtcacgatggaccatgtggacccctccctggtccctaacccaggggagcgccagtccctgctgagcgagaagacggtggttcgccgcgccacggccgccaacctgcgccaggacgtgaaggtcctccagacgcacccggtgctggacacgctgcatccgggcctgcgccaggccctgcaagcgaaggcgaagcggcccgacgccaaggcgctctacgcggtgccctatgccgtggcctatgggccggagctggtgaaggcctacgggctggtgatgcgcgcggcgcagcggctggaggccagcgacgtggagctggcgcgctacctgcgctaccgcgcgcgcgacctgctcaccaacgactacgagagcggcgacgcggcctgggtgacgggccgcttccagaagctcaacgtgcagttgggcgcgtatgagacgtatgacgacgcgctcttcggcgtgaaggcgttccacagcctgtcggtgctgctgagcaacgaggcggccacgcaggaactgcgcaagcgcctgggcgggctccaggcggtggaggacgcgctgccctacgccgcgaagaagcgcgtgcgcgaggacatccccgtgggcgtctacgacgtcatcgccgacttcggccagtcgcgcggcaccaacaccgcgagcatcctccccaacgacgcgctcgcggcgcgccgctatggccgcaccatcctcctgcgggagaacatcatgcgaaaccctgacctcttcgcgtccgacgagcgcatctggcgcgccgcggtggtggacgcccacgcccgggagctggtctccgaaggcaacttccagcgcaccctctggcacgaggtgggccactacctggggccggaccgagaccagaaggggcgcacgctggacgacgcgctggaggactacgcgggcgccgtggaggagatgaaggcggacctggtgagcctcttctcgctgcatgacttccacaagaagggcgcgctcgacgccgccgggctgcgcgcggtgcaggcctccggcatccgccgcacgctccagaacgtgcgtccgcgcgaggaccagccctaccagcgcatgcagttggtgcagttcaactggttcctggagcacggcctgctccaggcggacccgcagacggcgcgcctgagcattcagtacgacaagtacccggcggtcgtgacctcgctgctggagaaggtgctcgcgctccagcacggcggcgacaaggccgccaccgcggccttcttccagcggtggagcgcctggacgccggagctgcacgagaagctggcggcccgcatccgggacgcgcagggcgcccgcttccggctggtccggtacgacgcgctgggcgactgagcgccccgcttccggcccccgcgaaatccgcgcggggccgtgtcagggttggcgcgcgcacgcgtcggaggtgccccccacacaccgccacccttgatgcgaggcttctggatgccaggctcccgacgtccgtctcacgcgcacgccatcctcttcggccggaatcccacccaggacgaccccttcgacgtggaggccgacgcggccgaagcgctcggggtcgacacctaccaggcagacctgggcgccctgctctccggcaatgccgaacaggcgctctccacccttccggagcgcggcaggctccggctcctctaccgcggctggatgttgacggaggaggagtacacggggctggacgaagccgtgtccgccctggggcaccggctgacgaccacgcccgagcaatacgcggcggcgctctacctgcccaactggtacccccggctctcccgctacaccgcccgcagcgtctggacggagggcatggacgcggcggaagcctggcacgcggcccaggcgctcggcccgcagccctggctggtgaaggaccacgtgaagtctgccaaggagcgttgggatgaagcctgcttcatccccgagggcacgacgcaggcgcgcttcgaacagatttgcgccaacctggtcgacgagcgcggagaccgcttcgagcggggcctcgtcgtccggaagttcctccccttcaagacgtacggccggacacccgcgggcccggcccacctcgagttccggctcttcttcggaggcggccggctcctcgccgccgagccgtaccacgagttcgacgtcgacgtgccggacttcaccggcttcgagcccctggcccggcgcatcgactcgcccttcatcaccctggacgtggccatgctccaggacggaggctgggcggtggtcgaggtgaacgacggcggcgtctccggactgccacccgggctggacccgcgcacgctcttcgaggccctgttcgccccccgctagcgcggcgtccagcgtgcgcgcgcagcccctgccctttgagcgggggcgtgtggcgcgccgagcggtgcgccgctgctttcaccctcccccggatgcgcacagtttcggacaggaccctatgaccgggaggaaggcatggcgcagccaggcaggcgtcgcatgtacctggggatggccggcacggccgtgatgctgttgggaggctgtgcctcccatcgctccagcgcgaaggtggacaagcaatgggtggcgcgcgtcccacccggcgagctgggaaacgtgcgcgaggcgcagctcacggaggaccatgcccgggagcagatcccccgcacccaggtggccagacaggacgccgaggcggagcgagaagtcgcccaacgcaacgaggacgccacgaagtcccgccacgaagcagctgaggcagcgctcgaggccgcgcaggcaacgggtgacgtcgcggccatcgagcgggcccagaatgccgcctgcacgacccagcacgccctcaccctggccgaggcggagacggcttggcgcgacgacgcggtgacgacgttgaagtcgctggaggtcatgcgccagcgggagctggacgtggccgacgcccagctcgaacaggcgaagtacgaagccgtcaacgccaacgcggacgtccgggcgaaagagttgtccccaggggacttctccagcgccgtcgccgacgcccggcgaaaggcggcggatcagcagcgccaggtggacgccaacctccagcgcgaacatcaggccaaggcgcgctggcaacagttgcaggaccagggctacggaggcagcggctcgcagcagccctgagacgcgccttcacctcgtagcgcctcacgtgacagcgcgggccggagcaccgtgcgtttagagcgcaaagggctagt

SEQ ID NO: 726 - DNA, 6269 bp, Myxococcus xanthus
ttttttttttccgatgacgccctgcccgttcccgtcgaggctccgcccgccgaggacgcgttcgccttcgacatctaatcctccagcggtgccgcccagggcctgccgccccaggcagacccctttgccctgccgcccccggaggcctacgcgcagtcggccgccccggtggacgacccgttcgccctgccgccgccagacatggcgtcccagacggacgccttcgcgccggacgcgtacgcgatgccgtccgcgcccgaggcctcgccctacgcgatgcctccgcccgccgcgggagcgccgtccttcgacttcgccgaactgcccgtccctgcgaacgccgatccgttcgcgctgccccctccgggagcggacttctccgacctgcccgcgcccgccgcgccccaggccctggagttcgcggacctgccggcccccgccgcaccggacctgtcgttcgacttcaacgagccgcccgcgcccggtgcggaccccttcgccgtcgacttcagcgccccaccggcccccgccctcgcggcggctcctttcgccgccgatttcggctccgcgccagcgccgggtgcggacccgttcgccatcgacttctcggagcccccggcccccgcgccagccgtcgccgtcaacccggccgtggacttcggtgacgtggacttcggcgcgccttcctcgcccggcatcccggactcgctcgagttcgaccccaccgcacggccggatgacgacctggaagcggacctctccgacccgctgccgccgccgcccaacgcgggccccgcggacggcctggagatgctgtccttcatcgacgacgccgcgggcaaggacggcggcgcccaggcgggcgccaaggtgcgccgtttccacgtccgccggcgctcgggcaaggtgttcggcccgttcgacgagggcgtcatcgtcaagatgctcgaggacgggcagctcctcgggaacgaggatgtgtcgctggactcggagacctggtccgccatcggcacggtgcccaccttcgccgccgccatccagcggctcatggaaggccccgccaagctggtgacgcccaccgcggcgcccgctgcggccgtcgtcgacgcgccccgcgtggacggcgccagcccgcaggccaacatgaagcggctggagcagctctatgaaggccgcatggccgcggtgtccgtggtggaccgcagcggcaacacggagaagtggaagaagcgcgtcccgctgatgattgccgcgggcgtcgccgtggtggtggcgggcatcggcgcgggcacggagttcggcacgcgctacggtgccttcggccgccgtgccctcttccccgcccgcctctccgacggctcggccgaggcgaagcaggtggcggacgcgaagcaggcgctgctcacggacaccttcgccagctacaagcaggcccgcgagctcagcgccaaggtgctcgctcagaaggagtacccggaggtgcgctcgctgtggtgccagtccgtctactacctccagcgccgctacgccgcgggcaatccgaacgagatgagccgctgccgtcaggacatggcggacatcgagttcctgggagagaaggacgtggacgtcatcaaggcgtccgcggcgatcgcgctcacctcccggcaggcggactcagtcatccccaccctgagcggcgcctacggccgcgaggatacccagggcgacgtggagctggccttcctgctggccgaggcctactcgcagaagcgcgacgagaagcgcgccctggacacgctgaacaaggtgctggcgaagaacccgaagtccgccaaggcccaccacgccgtgggcaacctgcaccaggccgccgaccgcgccgacgaagccgccgccgcctatgccgcggccctggaagcggacccgaagcacgtggcctccgcggtggaactggccgcggtggagctgctggtacgcaaggacgtggcgaagggcacggaggccgttgagcgggcgctggccgaggacgtccagtccgcgctgggccccgcggagctggcgcgcgcccgcggcctcaagggcgtggcgatgttccagaagcaccagccgaaggaggctgaggccgagctcaaggccgccctggaaatggacgcgaagtccaccttcctccggggccagctggcgcgggtgctgcgcgcccagcgcaacttcgagggcgctctgcccatctacaaggcgctggcgaccgaggagcccaacaacctggagttcgcggacggccacatcaccgcgctggtgatgaccgggaagatgcaggacgcgctggaggccgtgaagaaggccaacggcgtgttccccaacgaggcgcgcatcgcctacctctacggacgcatcgaggacgcgctcgacaacctctccgacacggagggccactacaagcgcgccatcgccgcggacgacaccctggtcgaggcccgcctctacctgggccgcttctacctggcccagcgccgcaacgcggaggcgcggcctcaactcgaggaggcggcgaagaaggcaccggagaacgcgggcgtgcgcgcgggcctcggcgagctggccctggcggagaacaacacgctgctggcccagcaggaattcgagcgctccgtgaagctcgaccccatcctggcggacgcccacctgggcctgtcccgcgtggccctgctgacggacgacctggagacggcgaaggcggaggccaaccgcgccctggagctggacccgcacctgttgaaggacggccggctgcagcgcgggctcgtgctgtggcgtctggggcagttggaagaagccgtggcggagctggagaaggccaaggcggaggacccgcgctccaccaccatcccgattacgctgggcgccgtgctgctggagcgaggcgatttgccgggcgcggagagcaacctgggcctcgcgctgagcaacgagccctccaaccacgaggcgctctattacctggcgctggtgaaggcgaggcggctggagttcacccaggcgctggacaacatgcgcaaggccgtggagcgggcccccaaccgccccgactaccactacgcctacggcgtcatcctgcgggacgcgaagaacctgccggacgccatgagcgcatggcgcaagacggtggagctggatggctcccacgcggacgcccacgaggcgctcggtcatgcgctgctggagggcggccagttcgacgaggccatcgcctcgttcgaggccagcctcaaggccgacccccgccgcacgcgggtgctgggctccatcggtgatgcgtacttcgccgccgcgcgctggaacgacgccatcaagcggtaccagtcggccctgaaggcggaccccaagctcacctacgtctattacaaggtggcccgcgccttcaccgagcaggcccagcacgccaaggccatcgactggtaccgcaaggccaccagcctcgattcggagaaccccatggcctactactacctgggcttcgcctataaggagcgcaacaagcgccgggaggccgtgcaggccttcaaggactacctctcccgcaagcctgacgcgaccgacaggaaggacatcgaggacgaaatctacgacctgcagaactgaggtcgtcgtccgccggacgtctccgcgcccggcgcctcccctcccccacggagtcagggcggaggggggtgcggcgtccggccttgagcaccccagacgtgaggaaccttgctggcctcaccgggggtgactacaaggcgtgctccatgctggacctccggaacgttgcgcagaacttcgatgcggtggtcgcccggctcaagacgcggggcggcaacctggatttgggccccttccagcggctcttcgccgagcgccgcgagctgtatgtctccgtggagtcgctggccgcgcgccgcaatgccgccaacgaggagatgaagcgcaaggcgaaggaggacccgaaggcgctcgacgcgctccgcggtgacctccgcgccgtctcccaggaaatcaaggagaaggaagcgcgcctcaaggacgtggaggaggagctcaaccgcatcctcctgctcatccccaacgtgccccatgagtccgtccccgagggcggcggcgccgaggacaacgtccaggtgagcatctggggacagaagcccgacctgctcttcgcccccaagcagcacttcgagctgggtgagaagctgggcatgctcgacttcgagcgcgccgccaaggtgtctggcagccgcttcaccttctacaagggcgcactggcccggctggagcgggcgctcgtcaccttcatgatcgacgtgcacaccagcaagggctacacggagctgctcccgccctacttggtgctgcgcgagacgatgatgggcaccggtcagctccccaagttcgaggacgacgccttcaagacgttgggcgagccggagcgcttcctcatccccaccgcggaagtgcccgtcaccaactaccacgcggacgaaatcctcgagggcgagtccctgcccatccgctactgcgccttcagccccagcttccgggccgaggcgggcgccgccggcaaggacacccgcggcctcatccgtcagcaccagttccacaaggtggagctggtgaagttcgcccaccaggagaagagcctggacgaactcgaggccatgacggacgacgcctgcgacatcctccgccgcctgggcatccaccaccgcgtcatgctcctgtgcaccggagacatgggcttcgccgcccggaagacgtacgacatcgaggtctggctccccggacagaacagctaccgggagatttcgtcctgctctgactgcggcgacttccaggcccgccgggcgaagattcgctaccgggcccagaggggggacaagccccagctcgcccacacgctcaacggcagcggcctggcggtaggccggacgaccatcgccatcctggagaactaccagcgcgaggacggaagcgtggccattccggaggcgttggtgccgtacatgggcggcttgaaggaactgaaaccgatttgagtctgaatccggcttgcaacgcgcgaagaatcaggtagaagggcggccccacggacgtcggtccgcggggtgccaagtcggccccggtggtatggaggcgtggccgagcggttgaaggcagcggtcttgaaaaccgcagagggtgcaagctctccgtaggttcgaatcctaccgcctccgagtttttgttcttgaatttgttggctctttgacagagaagagttggagagatggccgagaggctgaaggcacaggtttgctaaacctgcatactcgaaagggtatcgagggttcgaatccctctctctccgccacttgttgttgtagcagcgccggaagaaatgctcccttagctcagctggatagagcgtcggactacgaatccgaaggccggaggttcgaatcctccagggagcgccacttctttcgagcagttctccatgagtgacgaagctttcatgcagcaggcgctatcgctcgcgcgggaagcagcggaactcggagaggtccccgtaggtgcggtggcggtgctcaacggtgaagtcgttggcgctggattcaatcgccgcgaagtggaccgcaatccgctcgctcacgcagagatgttggcaatggacgccgcagcccggaagatcggtgcctggcggctctcgggcgtcaccctgtatgtgacacttgagccgtgtgccatgtgcgccggaggtctggtgcagtctcgcgtgacacgactcgttttcggtgccttcgatccgaaagcgggtgcggtgggttcgctgtacaacctggtcgaagagcctcgacacaatcaccggctccaagtcacgagtggtatcctggcggacgagagccgcctgcttttgaagacgtttttcgggcgcttgcgtgcgaagaaacgtgacaattgaatactggagagctggccgagtggtcgaaggcacctgactcgaaatcaggcataccggtaacggtatcgtaggttcgaatcctacgctctccgctccagatttttggagaggtggccgagcggttgaaggcgcacgcctggaacgcgtgtatatctgaaagggtatcgtgggttcgaatcccaccctctccgttgttgtttctgcagtacgtggttacattctttatggtcgggacaacgtgggggcgtgaaccccgccaggtccggaaggaagcaacggtagcgtacttccgcgtgtgtcccggccgtccttt

SEQ ID NO: 727 - DNA, 5040 bp, Myxococcus xanthus
tacgcctccagcctgctgctgggctgcgcggcgctgtacctgcgcgagcgccgcccctggcgcgtggagattgacgggcccctcaccagcgcgggatacctggagctgaccctcacgtggctgagccgcttcggcttcgacatcctgcgctccccgtcgagctacaccgtggccgggtacgcggcgcccccggccgtccccacgcttccgggggattggtcgtccctgggctacctgctgctggtggcgtggaagacgggcggcaccgtggtgcgcgcggacacaggcagtgcccacccggacgacgccattgtccggttgattgagcaggtgggcctgcgcgcggtgcccgcgggccctcccttcacgctcaaggtggagggccagctttcagggggccttcgcgcctccggcgaggaatgcccggacctgctccccacgctggccgccctcgcctgcgtgcttcccgcgccctccacgctcacggaggtgggtatcctccgcgtcaaggagagcgaccgtctcgagggcatccggacgctcgtgaaggcgttcggcggaaccacggagctccaaggagaacagctgctgatccagccaccccgcacgccacctgcgggcttcgagatgagcagcgagggggaccatcgtctcgcgatgaccgctgcgacactgtgtgtcctgtccggcacgccgctgacactcaccggtccagagtgcgtggaaaagagctttcctgggttctggcgccagttgtccagggtgggtgttcggataactgatgcaggatgagacccccagtgtccgtccagcagacttatcgttcttttttgttgaaagcactctcccccctgtgaaatctccgccccatggccaaggacacgctgacgatcaccgacaatcggaccgggaagacctacgaggtcccgatcgagaacggctgtattcgcaccaatgctctccgccagatcaaaacgggcgacgatgactttgggttgatgggctacgatccggcgttcctcaataccgccaactgcaagagcgccatcaccttcatcgacggagacaagggcatcctggagtaccggggctaccccatcgagcagctcgcggagaagtcgagcttcctcgaggtcgcctacctcctgctgaacggtgagcttccctccgagaaggagctgcagcagttcaaccacctcgtcacgcaccacacctacgtgcacgagaacgtgaagagcttcatggacgggttccgctacgacgcgcaccccatgtccatggtgagctccacggtggcggcgctgtccagcttctaccccgacgcgaagaacatcaaggacccgctgagccgccgcatccagatcacgcggctcatcgcgaagatgcccaccatcgccgcgttctcctaccggcacacgatgggcctgccgtacatctacccggacaacgacctgtcctacgtcgccaacttcctggcgatgatcaagcgcatcggcacgtcgacctacaaggtccacccggtgctcgagcgcgcgctcgacatcctcttcatcctgcacgcggaccacgagcagaactgctccaccacgtccgtgcgcacggtgggctcgtccgaggtggatccgtactcggcggtcagcgcgggcatcggcgccctctacggcccgctgcacggcggcgccaacgaggcggtgctccgcatgctccgcgacatcggccacgtctccaagatcccggagttcatcaagtcggtgaagagcggcgagggtgagaagaagctgatgggcttcggtcaccgcgtctacaagtcctacgatccgcgcgccaaggtcatcaagcgcgtggccgacgaggtcttcgaggtgacgggcaagaacccgctgctggagatcgccgtcgagctggagcgcatcgcgctcgaggacgagtacttcgtgaagcggaagctgtacccgaacgtcgacttctactcgggcctcatctacgaggcgatgggcttccaggtcgagatgttcccggtgctcttcgccatcccccgcacggtgggctggtgcgcgcagtgggaggagatggtgacggacaacgagcagaagattgcccgtccgcgccaggtgttcacgggcgccccgcgccgcgactacgtccccatggacaagcgcgccgtcaagtaggccgtgacccaaggcccgcgcgtctcgcgtgggcctgaagcacgaaggggcgaggaaccgcgaggttccccgcccctttcgctttcccgcggcgccggcacgctcagcccgtctgagaaccgccctgcggggactcgtcgtagagcgactccacgaggccggcgtacttctccgccaccacgttgcggcgcacgctcagcttcggcgtcagctcaccgccctccacggagaagtccttcggcagcaccgcgaagcgcttgatggtctcgaagcgggacagcttcggattcacgtcgcgctccacgcgctcctggaggaactggcgcagacgggcgtcctccgcgagccgagccgcgtcctccggccacccctgcgccttggccagggcccgcgccttctccacgtccaaggtcagcaaggccaccaggaagttgcggcgctcgcccagcaccaccgcatgccccacaccgggcagggccgtcagcagctcctcgatgttggagggagacgtcttcttcccgcccgaggtgacgatgatgtccttcttgcggccggtgatctggacgtagccgtccgcgtccagttggcccacgtcaccagagtgcagccacccgtccgccagcagctcggcggtggcctccgggttcttgtagtaccccatgcagacgttgccgccgcgcaccagcagctcgccgtcgtccgcgatgcgcagctccacccccatcattgcccggcccacggaccccagccgcgtgtgggactcggtgctcaccgtgccggggcccgtcacctccgtcatgccccacacctcgtggatgaccatgtcgatggaggcgaagaagtccagcacctcccggccgacaggcgccgccgccgtggcgaagaaggacacccgctccatgccgatgcgctccttcagcggggcaaacacgagccgcctggcgagcagatactgggcctccagcgtcatcgggacgctctggtggcgcatcacccgctcatgccgctccgaggccacccggcgcgcccaggccaccacccggcgcttcgagggcggctgcgaggccagcccctcctccgccttcgccttgaacttctcccacacgcgcggcacgccgaaaaagaacgaggggcgcacctcccgcaggctctgcggcatcgtgtccaccgacgccgcgaagtacacctgcaccccgttcagcaaggggctgtagagggagatgatctgctcggcgatgtgcgacagcggcagatacgacacgagcgaggacgcggcgggctggccgaacgtcaccgagtccgtgagctgcttcgccgtccacaccaggttgtggtggctgagcatcacccccttggggtggccggtggtgccggaggtgtagatgagcgtgcccatggcctccggcttcagggcgtggacgctgtcccagtagggcttctcgtcggcgccggtgcccagggccatgacgtccgcgtaacgcagcacgccctccgggagcaccgtgggcgcgtcgatgacgaccacgtggcgcagcttgggcaaccgctcgcgcagggccagggcggtgcgcaggtgcctctcgttctccaccaccaggagcgtggcctcgcagtgccccaggatgtactccagctgctccggggcgctggtggtgtagagaccgacagggacgccccccatggcgatggccgccagatcggcgacgtgccactcctcgcggttgaagctcaggatgcccaccggctggcccgcaccgacccccagcgcgtgcaaccccagggcgaagcgccgcacccgttgcgcatattcaaaccacgaggtgggcgcataggcgcccccacggcgcgtccacagggctgggcgctgctcctgttgcgcggcccggtcatggagcgcatgcaccaccgacttgggaaggtccatgccccgaacgctagcggaagcaaggccccctaccaatgtccccccgtctcggacgttgacagctggttggagtgctttgtatgccgcgcccgaccatgagcatcgacttcacctgccagaagtgcgaggcgagcttcgagctggacgctcaggacctcatcgaagggactgaaaaaatcgtctgcccgcattgcgacgccaaggcgcccgccaacctcacggaggacttcgtcgcagcgctcacggagatgcgcgcgcagattgccgcgctcgacaagcggttcgccgtgtccatgacgttggagtccgaagacctggaggacatgctcgacgacgacgacgaggaagacgacgaggacgaatcggaggacgacgacctcgatgaggacgaggacgaggacgtcgacgacgaggaggactacgacgaggacgaggacgacgacgaccgtcgttgagcctgtccgcctgccctccagcccggggagcaccccacgcagtcgggggtaaccgggcctggagcgcaaccctcccgacagatggccgggtgcgtagcttaaaggcgtgaaaacgcccaaccgcgccactttgttcgtcgcacctctctcggccgtgcttctggcgctcggagggctgctgatgtttcccgcgttcactccacccgtagcgctggcggccctgggaaaggctcagggtcagccctgcatcaccgaaggtgaagacgaccccaaggcctgctccgagctcgtcgagctcgaggtgcaggatgtcgtcccgctggaggaggcccaagaccacgccgtggtcctggccaccaaggacaagggcatcgcgctcccgcactacggggacgacgctctacccatatgcatcgccttcctgctggtggagcgccacccaccccagccggtcgcacaggacctcctgtacgacttggtgacacgacct

SEQ ID NO: 728 - DNA, 5618 bp, Myxococcus xanthus
tcaagtccatgcgggtggagggcgtagacgtcgccatctgtgacgcgtgcgtgccgcagggcacccagggcgtgctgggcgcgcccttctccgaacgggtggacgtggccttcgacgaagtcacgcaggaggccgtgctgtcgctgaagggcggcccgcccgagggcgcggtgacggtggacgcgctggtgctcgcgcggcgctcggagtttcccttcccggcctacgtgagcgacgtcaccgtggacgcgcgcggccagaggctgggggtggggctgtcggagcagaagccggagcgcgaccgcggcgtgtacgagcgcgagcgcaagggcgtggaggagccgcagggccccttcaacgcgggcgcgctggtggacgcgcagtccggtcaggtgctggcgaagtggccggtgcaccggggcgtggtggccaccgcggccatctccccggacgggcgctcgctggccagcggcggctgggacaagcgcgtgtacctgttcaccgaaggggacgtggacgcgcgcggcgagcaccgcttcgactggtccgtgcggcgcgtgcgcttcagcccggatgggcgctggctgggcgtggccgcgtggacgccccaggtggccagccgcgacggggacagcgacccggcggcggtgctgctggacgtgggctatgaatcgcccactgtgcaggggccgggcacggccggcgcgtccgtcgctccgtagtcctcactccaccgctcagaagttgaggtggatgtcacccgcgggcatgccgcgggcctggagcgtcgtcatcacgccccgcaccatctccttctgcccgcagaggaaggccaccgcggcctgcacgggttcttcagccaggtgggcctgcacatagccagtgaggccctgccagccgctggcgccgggctggctgacggtgcgcaccacacgcaccccgccggcttcccactcgtggagttcgtccgtgtaggcgaaggcgcccggtgttcgcgcgccgaagtagagcgtcacctggccgtaggcgccgcgctccaactggatgctggtgatgacggagcggatggcggagatgccggagccggtggcgaacaggagcacgtcctggccgcgggcgcgctccagggggaagccccgtccttctggccgtgacacgtcgacgtgggcgccccggggaaggtggatgagggcgtcgggcagcgggctgcccaccttgaggaggaactcccattgcgtccccgggcggccgggcggggaggcgatggcaaagagcccctgtcccacaccaggcaggcggaggtggacgtattggccgggccgctcatgggttccggccaggggcgtgccctggacgtccagcacgaggtcggtgaggccatctgcggcgggtgcactgtcagtgacggtggccgggtgccagtcgtgcatgtcggggttctaacctacgcgcccggcgcgtgctgcccctggtagcctgagggggtgaagagtctgctctggacaatcttgttcatgctgggcctggccggcgtggtgattccgctgacgtacctctacacggcgagcaagctgccgccgctggagagcgaattcgacgtggagaagcagctcaaacacagcatcgaaggcgagcggatgagcctccgggcggggcagtcccagcgcaacccgcgccccatcaccttcgtgcggccggatttctccaagctgcccaaggacctggtggccctctacatccgccacctggagtgcccccggtacttccagacgccacgagaggacgggcccgcgtgggcctggcgtctgttcctgggcgccaccgtaggtacgtcgccgccaggagatggggcgtgtgagcgcgtcctggccatgcgcatcgccgccgcgctgggcatcgagggcacgcgtgagcggtcggtggccgcacaccgcatccacaccttcatgcagaaggaccagctcatcgcgtacgacctgtccatcatctacttcgagcgcggcatcgtcggcgtggaggacgcggccctggcgctctttggccgtgagctgagcgagttgaagctggaggagctcgccgagctgcaactggccctgccgccgtactccgactactacggcatcaagatttgcaagaaccccacggtgctccggcaggaccgcaaccggctgctggaggacctggcggcgtggcggttggtgagcgaggaccgcgcgcgcaacgccatggcccagccgctggcctgcgcgcgctgagtcaggcgcgggtcagcgaatcatccccgccacgcccgttaccttcttgagcaggtcgatgcgggcgtgggcgctggtgtcggcccgcgcgtcgtcgcggtacttcgccagcaggttgcgcgcggcgttggccttgggggcatcaatcttcccgctcgtctccagtcggtccacccggcgctccagccggttgatgctctggaggatgtcctccagcgtgggggcggaggctttcagggggcggggcggcgcgactcgggtgtcctcggcgcgcggggccggcggcggacgttccacgctgtccggcggagccggcgcgacggcggcgacgaccaggggctgaagcggcacttcctccacgggggcctgctctgactcggggggaggcgaggggaccgccgcggcctgctccggcgccgcggcttgctgcggcgtgaccgcagcggtctgctccggcgccgcggcttgctgcggcatgatggacggcggcacgagcgcgggggccttcgcgccgcggatgacgaccgcggcggcgcccgcgagcagcagcagtgcgaagctcacggcacccagcagcggcaggtgcttgcgcagcggactgcggacgcccgcggcgcgcagctcctgcgaggtcagcggggtgttcagctccgggggcaccggcaccggcgtggtgggacggcgcgagtccgcttccgccaccgcggcggccttctcgaagccgggcgcgagcgcgctggggttggagcgcgtggaggcccgcagggtgcggcgcagcttgtggagctgctgccgcagcgcgtccgcggagttggggcgcgtctccgggtccttggtgagcatctgcaagatgaaggcatccagcgcgggcggcaaatcggagacgaactccgacgggcgaggcggccgcgcctccacgtgcttcatcagcaggtccaccggcgagctgcccacgaagggcaggcggccggtgacgatttcgaaggtgacgacacccagggcgtagaggtccgtcatcggccccacttcctggccgcgcgcctgctccggcgccatgtactccggcgtgcccaccaccatgtccgtgcgcgtctgcgcggtgcggccggtggggccctggcctcgcttggcgagcccgaagtccagcaccttcacgtagcgcgagccgtccggctgctgcaccaggaagatgttgctcggcttgaggtcgcggtgcaccacgcccgcgccatgcgcggcggccagcgcggccagcacctcgtcgagcagcgccagcgcctcctgcaccggaagccggttcttctccgtcagcaccgcgtcgagcgcctggccctccaggtactccatgacgatgtactgccggccgtccggcacctggccgaagccgaagatgtcgatgatgccccggtgacggatggcgttgacggcgcgggcctccgccagcagccgctccacctgctcggtggagtgggccagctccggacgcagcaccttcaccgccacgcgcttgccgatgagcggctggatgccctcgtacaccagccccatgccgcccacgccgatgcgcgagcgcagctcgtactcgcccagcttcaagccgatgagcgggtccctctgcacggccgcgggcgggggaggctctgaggcctgtaccaccacgttcggctcctcgcgcgggggcacgtcgaacgacgacagcaccaccgtcccatcgcgtgggcacacggtggtgtcggcaggtacggccaggccgcaggtatcgcagatcaactcggaagccatctcaaaccgggaagcagcgtagcaggaggacccgggtggggcgatgtgcttcagcccggagtgcctagccggcggtcaggcggagcacgcaagcgcccgccgggcaggcaccccaacgtcggacaacagacgctacgggttggcgctgacgcagttgaagtccggcagttgctcgcccgtgctcccgtcgagcccggggccggcgccgcccggaccgcccggaccgacctggaaggtgacgccgccatccgtgtagcggaccgtcgcgcccgggccacaccacacgcccaccgagggcccaccgccaccaccaccgcctccgccgcccgcgccgcccgcgccgccgggaccaccctcgccgccgggaccgccggtcgtccggtggatgatgatgcctccgtcgacgacgcctccgtcccgcacgacctggccgccgttgccgccgtgtccgccttcgcctccggggcctccggtaccgccttcgccaccctcgccacccgggcctccgccgagcgtgcgcagcacgctgccttcctccatggccgcctgggaaccgatgagcagcagggagatggacgcgccgccaccgccgccgccgggggcgacttcaccgccacagccgccggcgccgcccgcgccacttccgccgccgccagcgacaatcgtgttttcgagtttgcagattccgccagacccgccgccgccaccgccggagcccgccgtgccgccgccgccgggctcgccttgctgtccggcgacccaggtcccgtcgcgcagcacccccgtgcccgcgccgccgccgcccggagtcccgaggcctccttccgcgccgccctggcctcgctcgccggggtaggggttgcagacgcactcgaacctggagcacgcggcgtccggtgcctcgccgcccgcgccgcctgcgccgcccatttcgccgggcccacccgtgccgccatcccgtcctggattgccgccgctgctgccaatcacccccgcgccgcccgtgggctggatgccatccgggcaggtgatggggggggccgtcccgccctgtcccggatcggagtagccgctgaggccgtcccctccttcacctccgtccgggccgcccaggcccgcgtcccccgcctcgccgggggcgccctggccacccgcgcccgcggccagggtgacgtgacgcagacggaccccggaggagtccaccatgcgcacggcgatggagggctcaccggggccggccgcggtggcggcgctgatctgcacgtactccatcagcacaccggcgtcctggagtccctgcaccgtcaaccccagcgtgccggcgtcgaacatggccacgcggttcgcggcgcgacgccaaccgccactgcgtccggcatatccgccgtgcagcgagacggggacgtccagcaccaggtccgcctcgtcgtaggcgccgcccgcgaggaacaggtggcgcgggccgccatccagttcgcgcagcatcgccagcgcgcggcccacggtgcgcagcggcgcctgccgggtgcccacgcccgcgtcgtcatccccgtccatggggtcgatgaagagccccgcgcc

SEQ ID NO: 729 - DNA, 5165 bp, Myxococcus xanthus
cggagttggtcaccgtggcctggtccgccgccttggcgatgccgaagtccaccaccttcaccccgctctcgaacgtcaccaggatattctggggggacacgtcacggtggacgatgcccagcggccggcccgtcgtcgggtccgtgcgcttgtgcgcgtagtccaggccggcgcaggcctcgatgaggatgcggcacaccagcggcaccggcagcggctggcccatcagctccgactgcctccacagccggcgcaggtcgtcgccgtggatgtactccatggcgatgaagaaggagtcgtcctgggcgcccaggtcgaaaatctgcaccacgttggggtggttcagccgggcggcgatgcgcgcctcgtccaggaacatcttgacgaagtcgtcgttctccgcgaggtgcggaaggatccgcttgaccaccacccgcttgtcaggctccgcgccctgaggccgcgcaagatagatctgcgccatcccgcccgtggcgagacgactcaggagctgatacctgccataggtttcgatggacacggcgacctgaccggcccctggacaaccacccctttgagtggccccgagttccgggcgcgggatggacccgagcgtaagcgcaccgggaaggagggtcaaacccccaactgctccggaaacggcctttgtggctacctccgggcggcccgcacctcgcgagtctctcgcatcagggcctccagctcgtccaggtgccgcttcagcaccggcatcagcaccggcgccacgtccacccggtcgaacaggtccaggacccggtccaccttccgctcaatctcccccgcccgcgccgggctgattcgccgcagcagcaggtccgccccggcctccatcagcacccgggccacggcgtcccgggaagcaagcggctcctccctccgccgcccttctcccttgatgacgcgcagtcctggagcccgtccagaggggcgggccgcgctcgtcatcgttccttcaaagtcctgggagttcaccgggtgcctcctcggcagctgcaggtacgacctcagggtacacaccgcgaggtgacctccaattttctggtcatccgcacaggcggaagcagacctgtagcaccggggactgacaccactgtggagggccggatgtccggccctccgggtgcgttacatcgcgtcgcacgaacggcggtagttgatggagatgcgggtgcccgccggtggcacgacgtcgaacaccacgctgttggtggccgcgtcgtaggtccagccggacgtggacggcgtgccattcaccgtcaccgtcacggtgccgggctccggcaggtcgctcagcgggaagcgctcctgcgcggagaaggccttgtcacccaccgcctgcagcagcggccggtagtcttccgcgcttactctcaccacctcgcctcctgtgcgggaggtggcctgcgcgtagcgggtaccggcgccgcccgccgtcgcgcagccttcagccggcggagcgatggcgtagaaggtcgcgcgctgcggctggttctgccccttgagcagctgggcccagtccacgtaggtgtccaccgcgtcgggcgagtggtcgtcctcgtcgctgacgaacagcaccaccagcgcggcctcctcgcgcaggaagcccacgttgccgtcgttgggcagcggcgtacgcgggtcatccgcgctgttcaccagcggccgggacaacgcgcggcgcatcgcctcgaagccctgctccacctccgcgcaccggcccacctgcacgttctgctggagctgctgggccaggttcggcgtcgcgctcgtgaggatgcgcggcagcgagttgtccaccgggaagaagcggcccgcctcgcccccctccgcgccgcccgggcacgcgttggccgggtccgtcggcgtcaccggatggatgcccgtcgtcgtcaccgccacgttgacgctcacgccccggtccagcgcggtctgcacgaaggtcggaatggcctccaccagtcgtggatgctccaccgccatggaggcggtgttgtccaccaccagcagcacgtccaccttgctgacatcctgctggatgaagttgtccgtcttctccacgcgcatcgacgactcgcccaccagcggaaccatcagcggcgccggcaagtcgctggagcccacgtacagcggcgacaggttcatgcccgacaccaggccgaagtactccacgcccaccgtgaaggcctcgttgggcggcagcacgaagggaatggaggccggcaccgccgaaaacccgaactccgaatccgtggttcccggcccaatccacacgtcgttcaccgtcaccggcgcggcgcaggcattgaggaagttcacctccatgggctcggcggggcagtccggccgggcgacgccccaatccatgtagcggcgcgaggccaccaggcacaccgcctgcgtgttggccaccagcggcaccagcagcaccgggttggccggctgcatctgttcaatctgcacggtgccggtgaagtggccgcccgccacaggcgccctgaaggccacctggaagctgaaccagtcgccggggtacatgatgacgccgtggaggccgccgcccggcagcgtgaagacaccgccgccgtcatctcgcaggcggaggttcttcaccgggcacaagtcggtgccgcggttctccagcttgagtcccagcaccgcgccctggccgggcggaatggtgccgaagtccagggcctgcggcgtgagcgtgagctcgcagggcgcgtgcgcctccggcgtgccgcggaagtccatctgtaccatggtcgcggagaaggcgttggtcgtcatcaccagcgagccctccgctgtgcgcaactcggtgggctcgtagaagacctccaggttcacctcgccgccgggcggcagcgtcaccggcagcgccagcggcgtgtggttgaactgaggcgccccaccctgctgcggcagccagtccagcgtgttgatggtgagcccgccctcattggacgcgccgcagttcttcacgttgacgatgacgcgcaccttcgcgccgagcggctgcgtgccgaagtcgtagaacgacggggacacacacagctccggcgcgccgccgtagccgcgcagttgcacgggcgtcgtcggatggcggcggctctccacgtgatacagcgcggtgtcctgcgccgcgccctggtggtccgggctgtagcggaacgtgaaggtccgcacctcgcccggctggagcacgaaggggaagcccgcgttgttctgggtgaaggacgcgtcacggccctccagcgtcagctgcgtcaccgtcaccggctcggtgctgatgttgcggatgctcgactcgcgcaccgcgtcccggtccacgggcaccgcgccgaagtccaggacctccggttcggccaccactgcgcgctccagcgcctcggccgccacctgcaccgtcacgtccgcgcagccgcggcagggcgacaccgccagcgccacctgcttgcggcccacccgcaccgggtgaaacgtcaccatgagctcgcgaatctcaccgggcgccagcgtcaccggcgccacgctgaactcgtcgcggtccgcgcccaccagccgcggcgtcacatccacgggtaactccgtggggttctccagccgcagcggcagcgtcttcgtggcgtccgcttcgatgcggccgaagtccagccgacgcggcgacacgcgggccgaggcgtccacgccggtgcccgtcagggggatgcggagcaggggctcgatgcgcgtatccgagcgcaccaccaacaccgctggctgcgaaccttcggcgggcggcgcgaaacgcacgcgcagcgagcacgcgctcccgggttgcaagcggtgcggcccctcatgggtgaactcggcgcggtaggccccctcggggccctccacccagacctcgttcacgtcgacaggtgcgcggcccacgttgcgcagcgaaatctccgcttcgcgcgcatcgaagatggccacccgctcaaagtcgacgccacccggcgtcgccgtcagccgcccgtccgccagcgccgagcgctcgcgatccgcacaaccgaccagcaaccccaccaccgcgagggcgacccagcccaagcgcccagtcatggaccaccccttccccactaccgtcaaccttggccgccgcgcgccccacatggaggacggcggaaggaacggtggcgaagctaggcacccacttcagggtgagcaaccggccatgcgtggggaaccccgtgcccaggggtgggtgggtgtccgctatcaaatcttcggaatgcgcaatgtcttgctgatcatcgcacttccgctggccacatacatcagcgccaacgggtgaaggaccaacggtcccaggcgccactcaccaccccacaggtccggaccgatgcgccccgcccacgtcgccgcggccatcaccatcaccagcgccaggctggtgggaatgggggtgccctcgaagtacttcaccttccctgtctcgtccgacaggtccgccgacgtgacgttgaagcgcgccagccggctgatgccgcacgccacgaagtagaggagcgccgccacgtccagggagccgcgcatccccaccgcgaaggccagcgccgccggcgccatgccgaaggagatgacgtccgccagtgagtccaggtccgcgcccagcggcgacttcttgaagcgccagcgcgcgatgcgcccgtccatgacgtccatcaccaacgccaccggcatcaggccgaaggccacccacagccagcccacgtccccggaagccaggtactgcatggcggagaggatggcgcccgcgcccgcgaagccgttgcccagcgtcacgaagtcagcgagcacgaacgtgcgaatcatcgaaaagtgacggcgcgggcggcgggcacgggacggctcggtcggcatatgcgcgatttcctaccacacccctcccgctcggccggaagctcgttcttgccacactgcgttgtgcccggcggtgtgagaaatcattccagtttcagaaacattttgacggtgtgatcagccactccctacgctcgacgactgtcatgcaccccaaacttccctcgcccatccggcgcggtgtgctccggcgtacgcggagcacccgctggcagttctctgtagagcac

SEQ ID NO: 730 - DNA, 4845 bp, Myxococcus xanthus
ggtacttgcgcgactcgtggaggaccatgtcgtagccgtggccatggccgttggtgaagtccgcgccttggcccgtctcgaagtagagcccgtaaggccccgtgcgcccgtccgcgtagccgagcatcttctccacggagatgtcgaaggtcgcgttggcgctgtcgctgccagcgatgctctggaaccagacgcccgtggtgccgggctgccgccgctccacctccgcctgcacgtcgatatgggacagcacgcagtggggaagcacgtccgtcagtccgaaggtcaccagcacctcgagcagggcggactcgatggcggccacggactccggcgtggaggacaccgggttgcatcccagcaccacgtcacccaccgcgtatgagaaaccgtcgaacacctgccagcggatgtcgtccacgttgtcagtgggcgagttgggctggatgcgcgcccccatgtagccccgcgcgcccaccttgctgcctggtagtgggttgaacaccttgcttcccagcgcgatgagctccgcgtcactcatcagtttgacgacgcagccaatggtatcgctgcccagcccggggccgatggcatgaatggccgcctcgtcggactccagcaggaacttcctcaaccgtcccaacgtccagtccgccgtaagcgtcgccgcctgcgagtcctcggcctccaggctcagtgcgtgcaacgcatcctggtgcaaagggtgtcgccgcacgtcctccagccgcgtgtgccccaagagcctgcgcgcattcgcacgcgagttctcatccgcggcggcgacgcccacgagcgcgtcgccttccttgaaggtattggccgcgcccagcacctgcttgtagagcgtgtcgtcgaaggcgccccggagccgctggacgtagccgaagacgtcctcgcccgacttcacgtctgggatgtagacgccttccggcgtggggttggacgtcggttttctccggcagcccagaacggaggcggccgcgcctcccaccatcgcggtcagcactgcgcgtcggtgcagtaggaacctcgggtccaggtgcatggttctccctcactcaggacttgcatggcggaagggaacacccctcttcccgtcgcgcacaagcagggcccgggtggtgcagcgtgtcgctgtagggcacccaacggagggctccggccagggtctgatcacttccgcgaggttcggacagatggcgcccgtgcgggctgcgcgcgcatccctggacgggcgctgccgctgcgcctagggtccgcgcgcatccacttctctccccccgagtgagaacaccatggtctcggacatcttcaatccggcgcgctggaaggccgtcgagggcttcaagttcaaggacatcaccttccaccgcgcggtggaccagggcacggtccgcatcgcgttcaaccgcccggaggtccgcaacgccttccggccccgcaccgtggatgagctgtcccgcgcgctggaggccacgcgcttcatgacggacgtggggtgcgtgctcatcacgggcaacgggccgtcgcccaaggatggcggctgggccttctgctccggtggtgaccagcgcatccgcggcaaggacggctacaagtacaagggcgaggagggtgagtccgaccccgcgcgcctgggccggctccacatcctggaggttcagcggcagattcgtttcctgcccaaggccgtcatcgccgtggtgcccggctgggccgtgggcggtgggcacagccttcacgtcgtctgtgacatgaccatcgcaagcaaggagcacgcggtgttcaagcagacggacgcggacgtggcgtcgttcgacgcgggctacggttctgcgctgctggcgcggcagattggtcagaagcgggcgcgggagatcttcttcgtgggcgccaactactcggcggaggaggccttccagatgggcatggtcaacgccgtggtgccccatgcgcagttggaggagttcgcgctggagtgggcggcggagatcaacacgaagagccctacggccatcaagatgttgaagtacgcgttcaacctgcccgacgacggactggtgggccagcagctcttcgcgggcgaggccacccgcctggcctacggcaccgacgaggcgcaggaaggccgcgacgccttcgtccagaagcgcaagcgcgacttcaagcgcttcccctggtcgtactgaaaccgcggacgccgaggcggcgcggacgccctgggaatacccatccagggtgatggtcggtggaaggggcctcgtgttctaggcctcttccatgccgaagacgaaactctccgcgtccctcctcatcgtgctcgcgagcctggcgctgggctgctccagcggcgccacggccgctgccagccgtcgcgaagtctccacgcccgccacgacgtgtctcgacaccatctcgtgttgcctccagcgtcatccggcgcaacctgagttgtgcggtctctcggcctcggaagccgtcgtgtatctggcggaaatccaggccgtggcgaaggagcgcgaggcgaatcgggacgacggcgcgaaggcgggatggaagcggcgctgcgtggacacccatgcccggtgcaaggacgcggggcggggacgttgggtgggagactgctacgcctgtttcgtccgctgcgagcgcgagcgggaatggccctacgacagttgccaccggcgatagcgctgtcacaccggcgtcaggcgccgcccacgatgtccaggatgacggcgtaatgcacgcccgccgcggccacgacgagcaggtggaagatttcgtggtagccgaagacggtgggaatcgggtcgggccagcggcgcgcatagatgaccgcgcccacggcgtagagcactccgcccagcacgagccacgcgacgcgcccggagccaatcacctcgggtagccgcagcatcaccggcgtggccacggcgcccagcgcgacgtagagggcggagcgcagccctcgcgaggtgtgcacgcccaggagcgtgaggcccgcgcccgtcagcgcggcgatccacatcaaccagagtaggtacaggctggtgtcacccgtggtgtccagcgtggccatgggcgtgaatgagcccgcgatgaggatgtagatggccgcgtggtcgaagcgctggatgcgccggtacgcgtccatgccccaggtgaagcggtggtaggtggcgctcacgccgaacatcagcaccatgctgccaccgaacacgaggtcggccaggtactgggggccgcgcactggcatcagcgccagttggatgcacccgagcagcgccgccacgaaggccacggcgtgggagacacctcggagccggggcttgacgctctcgatgaggagcagggtgtcggtgccatctggggacgccatgagctgctcgtaatcatcgcaggtcaccctcgcgtcagcgcgcgggacatcccgtccagcttctgacgcccggggtgcccgagcgtccagcggcatacggccgcgggtgcgaaccggaagacaccgctgctggttcgcggccaggcagacgctccgcgtcagaacgttggtttcatcaccacggactccgccgagcgcgtcaccgggccatggaacacggcctcgatgttgttcccatccgggtccaggacgaacgcgccgtagtagccggggtggtgtggactctcgctgaagaagggcacgcccaacacgtccagcaccgcgcggtagaatcgcttgctggcatcgaggtcctggacgcgcagatggacgtgatcgaacagccggcccttgtggaactccatgtggctccttcacggtgatatggcgcacggacgtcgagcggtgcgcggggaggcgcgaggctgacatgaaacctcacatgctgaccttcttttgcgagttggaggcggagcctctgcgtgagctattcgccactcctggcgtcgtggaggacctggcggcgctggaggccggggtgagcctgggcctgctcgacctggggccggagcgggcccaggtggtccagcggctgaaccggatgggcattcccgtcacggcgtggctgctgctgcccaccgacgagggctactggttccatgcgggcaatgtggcgcaggccacggcgcgctacgaggccttccaggcatggacggccgagcaccacttgacgtgggagggcgtggggctggacatcgaaccggacatccgcgagctgcgacggtggatggagggtgggtggcggcagttgggcgaaatcctgcccaggctcgtgcaggggcaccgcgtccgggacgcgagggccgggtacgcgcggctgatggagcgcatccgcgcggacggctaccgggtggatgcctaccagttccccatcatcgtggacgagcgggagtcgcgctccacgctggtacagcggctggcgggagtgctcgacctgccggcggaccgtgaggtcctcatgctctacaccagcttcctgcggccccatggcccctccgtgctctggagctacgggcccggaagtcagtccctggcggtgggcatcacgggcgggggcgtggagctacccggcgccttcgccgcgaagcccctggattggacggagttctcgcgcgacctgcgtctggcggtgcgctggacgcatgacctccacgtcttcagcctggagggctgcgtccaacagggcttcctgaaccggctccgcaccttcgactgggatgcgcccgtcaccccgccagcgaccgcggcgcgccgcgtggacaccgtgcggcgcgcggcccggctgctgctccgcacgagcgcctgggtccttcgctgagggacggacgggtggacagcgtgga

SEQ ID NO: 731 - DNA, 5377 bp, Myxococcus xanthus
gcacttcgagcacgttctcactgggcacgcccaggcggaggtcgcccacccggaagcaaaagaactcctgctccggccgggcctgggcggccaaggcgcggtccggagccatccggagtgctcgctggaggggagtcgaggtcgtggtcaaggcgccaaagtatccggaggcgatgaatagcggtcaagaggacctgacgaccagcccgtctggtcgccgtttcgatggtccgcgctgcaccaaaggtgtagggttctaccgcgaagcccttgaggaggacgatgtcgcgcgtactggtcattgatgacagcccgatgctggtggagctcaccgtccggggcgctcaccgccgccggctaccaggcgagcggcgcgcaggaccttgccagcctcgagctgaagctcgccgaggggccgttttcgctcatcctcatggacgtcaacatgccggagatgttcggcgacgacgtcgtggagtacctccgccggcagaagaaggtcaccgcgaagctggtcctctattccgacatctccgaggcggagctggacggaaagacgaaggcgtcgggggcggacgggtacatcctgaagagcggtgggctcgaagccgtgctcggcggggtcatgggtctcattggcccccccgccctgagcatccccaccgccgtgcccgccccggctgcggcccccgcggcggcgcccaccccgccgccggctcccgcggcccctgcccccgcggcgacgggcggcctcaaacccgcgcccaccacgggcgggcgcaagccgcgcatcctcatcgtggatgacagcgagatgacggcccgcatcatcgaagcggaccttgtgaccaagggcttcgaggtccatgtcgcggacaccgccgacaaggccacgaagatcatcctcaagaagcagacgcgcccggacctggtgctgctggatgtgcgcatgcccaacgtgaacggcgagcagttctgccgcttcatcaagagcaacagcctcttcaagggcatcaaggtgctgctgtgctcgggtgagaacgtcgaggagttgcagcgcatctgccgcgaggcgggcgccgacggctacatccccaaggacgcggtgatgggcaacctggtggccaaggagctgatgcccaccggtaacgagtagtccccaggggccgcgtcgcggcccctcctggcgtgttgcccccgaggacgcgccacctgcctcccgaagacggagcgcccaccgggcctcccctccgacggaggaaggaacgccctcccccgcccccaggcactcgctaccggtgcccggccgcgttctcgcgctcgtccagcccgcgcgcgaagttgcccacgatgagccccgggcgcgccgccttcagccgctgaagcagcgtgcggatgcccaccggctcgcctcccgcgccgcgctcgcgcgccacttccaggtactgcagcgggtcgatgcacagtgagcgcgtctgaacctggtccacgcggtacttcttcaccagccgctccagtgcccgcacctcgccctcgcggtcggtgacgccggggaacagcagcaggttcagcgccaggtacgcgccgcgctcacgcgccagggcgatggaggcctccacgtcctcccagccgtacttcaccggcttgtagtaggcctcgtagaggtccttcaccgccgagttgagcgacacgcggatggcgtccagccccgcgtcgaagagggcctccaggccgcgcgtgaggctggcgttggtgttgatgttgatggagcccgcctgcgtgcgcgcccgcatgtagcggatggcctcggcaatctgcttccagcgcgtgagcggctcgccctcacagccctggccgaagctcaccatggtgcggcccggcgcgtgctccaggtggaagaggccaatctggcccatctcctctcccgtgggcccgtcatccatgcgctcgtgcgatgccggggggccgtccgccggctggtcggagatgcagcccacgcagcgcgcgttgcacatgacggacgcggggatggccccctcgtcacgcacgtagaaggtgttctgcgacgtgaagcacctgtagagcatcgcgcacgtcttgagttgcttcagcacccggttgtccgggaagcgcgccatgtgcttcgccaccaggtccttcatgtccggcgtggagaaccgctccgggtcccaatgggagcgacggtcggtatggatggcccacgccaccggcccctctcccacccaggccgcggcggtatacgcccactgcggcagcacggggccactgcccttcacctcgccggggaggaaggtgcgcgtgtagccggggggcagcaacgcgcccactgcgttggggacaaacgtcttcccccccaccttcatctcgcggacgagctccagctcccccgtctccggatgcaggcccaccgggaggcgccctggcaggtggacgagccgcccggtggacggcagcggaatgggcttgtcctgcggaggaacgagctcttcgccgctgcgcagcgtggcgagcaggtacggatgttccatcacccgtcccttggggtccgcgaataggagcttcggagcaaacgtcatgtcgctggtaactaacacgagcggcgcacgcttcatcacgcatcgcatccaacgcctcgcgtcatgtcttcaggggtgtttgacgccaatggcgctcatacggggctgtccgcccgcgccttgattcccccttgggccctcgttagggtccgcgcgcttttttacgtcccctctcggaggcagtcgtgatcgtcggagttcccaaggagatcaaaacccgcgagtaccgcgtcggcatggtgcctgctggcgccgccgccctcatcgccgcgggtcacacggtcctgatcgagacgaacgccggcgttggctccggcatccccgattcggagtaccagcgcgtcggcgcacagatcatctccaccgcggacgaggtctggaagcgctcggagatgatcatcaaggtcaaggagccgatcgcgcccgaatacgcgcgcatccagcccggccagatcatctatacgtacttccacctggccggtgtggacccggagctgaccaagacgctgctccagaagaaggccgcggccgtggcctatgaaacgctgcagccggacgacggcagcctgccgctgctcaagcccatgagcgaggtggccggaaagatggccatccaggtgggcgccaagtgcctggagcgggcccacggcggcaagggcatcctcctgggcggcgtgcccggcgtgcgccggggccgcgtcaccgtcatcggcggcggcgtggtgggcctgtgtgccgccaaggtggcggtgggcatgggcgccgaggtcaccatcatcgacgtcaacatggagcgcctcacctacctggatgacgtgttcctcggccgcgtcggcgtgctggcctccgactcggagagcatctcccgctccgtgcgcgaggccgacctcgtcgtgggcgcggtgctcatccccggtcgcaaggccccgaagctcgtctccgaggccctcatctcggagatgagcccgggctccgtggtggtcgacgtggcggtggaccagggtggctgcatcgagacgtgcaagcccaccacccacgacaaccccacgttcgaggtccacggcgtcgtccactactgcgtcgccaacatgcccggcgccgtgccgcagacgtccacctacgccctcaccaacgtcacccgcccctattcgctccggatcgccaacgtgggcctggcggcggccgtgaaggaggaccgcgccctcgcgcgtgcgatgaacacctacaacggccacgtcacctacgaggccgtcgcgaaagacatgggctacgcctacatgcccatcgcggacgcgctcgccggcaagtaagcccggtaagcaggcaaacgatgcagtccctggcggggaggttcggatggcgacatccggcctccccgctcgttatctctgctagggaatatgtttccctggccggcgtcgtgtattcccgaagcgggcgtccgggcgggtgtcgtgggatgccgttgttgccctggttgttcccgtgcatacatttggcgggtaagcgacaactcattccccttttgtttcgggcccttggaaggcgggacatgttggatttcaggcaacccaaccggacgaagcaggaattcgaagagctggcgctagcccatctggacccgctctattcggcggcgctgcgcctgacgaagaacgagcgcgacgccgaggacctggtgcaggacacctgcatgcgggcgtaccgcttcttcgacaagttcgagcgcgggacgaacatcaaggcctggctcttcaagattctcaccaacaccttcatcaaccgctaccggcggaaggtgaaggagcgcacggtggtcgaaggcgtggagcgcgaggccgtccacgagcgcttcgtgagccgggacgcgacggacttcgcggccaaccccgagcagtacttcttcgaccggctcctgtcggacgacgtgctgcgggccattgacgcgctgcccatcgacttccggctggtggtcatcctcgcggacctccaggagttctcctacaaggagatcgcggagattctcgagtgccccgtgggcacggtcatgagccgcctgttccgcggacgcaagctcctgcagaagaacctgcgtgagtacgccgagggccagggcgtcttccggcacgacggggagccggtgaacgcccccgcggacctggaagagtatcgccacaggaagaagacagggtagaaacccgttcctagcgcgcgccatgaactgccaggacctcgaacggctgctctatccgtacctcgacggcgaattccagcccgaggaacgagtggacctcgaaacccacctctccgggtgcgctgattgccggcgccgcgcggaggaagagaagcagatgcagcaggcgctgcggcgagccgcgcgccactccgtttcaggcatgcgggcccccgcctcgctccgggccggcatccaagtgggcctcaagcaggagcagcgccgcgtccagttcggcgtctggctgcgcgcgggggccatggcgttggtggtggtgacggtgggcggcggctgggccgcgttccacgccgagcagcggctgagcgcggccaggacggaagcggtgcagcgccacagcaagagcaaggcgctccccttcgagattgcctccaacacgccggagcaggtggaggagtggttcaaggacaagggggatccgcgcatcaccgtcccgcagatccccaatgcgaagccgctgggcgggcgcatctccatcctcaacggccgggaagtcgcgtacatcagctacgaaacccttccggacaac

SEQ ID NO: 732 - DNA, 6567 bp, Myxococcus xanthus
  unsure (1)..(6567): unsure at all n locations
ccggcgccaggacatcgtgttggacggaacggccttcctgttcctcctcgcaatcaccagcgtcagcggcctggccttcgggctgcttccggccctccaggtctcccggctggacgtccgtggtgggctcgccgccgcgggcgatggcagcacggtgccgggtttcggccgtcgcctgggggcctcgctggtggttgtggagatcgccctatcgctggtgctgctcgtcggcgcgggcctgctcggacgcggctttctgcacctgctggggacttccaccggacttgcccctggccaggtcctcacgctgcacctgtccatcccagacgaccggttcttcaaggatggcgccctggacgcggagctgccgggacggctcttggagccggtgctggaggcggttcgcgcgctcccgggcgtcaccgcggcgggcatgacgtccgtgctccccatccaacgggcctggaacaacgctcggtatcagctcgaaggagcgcctctgccagagcccggcgacgaacctcgcgccgagcgccgcgcctccagtccgggctacttcgccgccatgggcatcccccttcgccaggggcgcgatttcacgtccctggacgccgcgccggaccagcccggcgtcgtcatcgtcaatgaaaccctggcccgccggcactttccggcaggaggtgccctgggccaccagctgcgcatcgggggcgacgccgtacaccatcgtcggcgtcgtgggcgatgtccgccaggcgggactggagcgcgaaccgctcgccgagttccacgtcccccatggcaggccctggggcgatgacgggctcgtcctggtcacgcgcacctcggtgcagccggagacgctgctgccggccatccaggaggccatccgccgcgtggatggcaccgtgcccgtctaccgggcgctcaccctggaacaggtcatctcgcaatccctggcgatgcgcagactcgtcctggggctgctcggcggttttgcggtcctcgccgtcctgctcgccgcctacggcctctacggggtcatctcgctccgggtcgtccagcgcacgcgggagctgggcgtccggatggcgctcggtgcccggcccgcggacgtgctccggctcgtcctgggccagggcgcgggcatgacagccgtgggcctcggggtgggacttggggccgcgtgggccctgtcccaggtactcgcaagccagcttcacggcgtcagcgcgcgggatccgtggacgttcggggccgtggcggcgctgctggcggccgtggcgttgctcgcctgttggattccggcccggcgggcgatacggatggacccgcttcaggcgctccggaaggaatgacgtcgggacttccgcgtcccatgcgcgggatgcggaatcccagtcatggaacgccgccggatgacacgtcgcgttgacgggaaatccagacgcgaatgcgactttttcctcgcgtncacgtgtttcctcattgggctggtttcaaggccggtttctcctcggaatccaacctctggcggcgggaatcagaagcctgctcgcatgttgggttccccgggaaatcttccctgttttttactggcttgacccagccatgagcttcccgcagaaccgcgacactcatggccctggaaaggaccgtttcatgaagcgtttgttcgtgattgccaccctcctcggcgcggctcccgcgatggccgacgagggcatgtggacctacaacaactttccctccgcgaaggtgaaggagaagtacggcttcgagccttcccagcagtggctggacaacgtgcgcctgtcctcggcgcgtctggcgggtggatgctcggccagcttcgtgtccgccaacggcctggtgatgacgaatcaccactgcgcgcgcggctgcatcgaccagctctccacggcgaagaaggactacatcgccaacggtttctacgcgaaggcgcagggcgaggagacccagtgtccggcgatggagatcaaccagctggtcaagatcaccgacgtcacggagacgctgaacaaggccacccagggcctgaccggtaagaagtacgctgacacgctgaaggcgaagatgtccgagctggagcaggcctgctccgccggcaacgccaaggcgcgctgtgacgtggtcaccctgtaccagggcggccagtacaacctctacgagtacaagcgcttccaggacgtccgcctggtgatggcgcccgagcacgccatcgcgttcttcggcggcgacccggacaacttcgagttcccccgctacgacctcgacgtgacgttcctgcgcgtctacgaggacggcaagccggcgacgacgaacaatttcttcaagtggtccgacaagggcgctcaggaaggcgagctgaccttcatctccggccacccgggccgcacctcgcgtggcctcaccatcgcggagctggagttccagcgtgacgtggtgctgcccaagacgctgatgacgctctccgagatgcgcggcatgctgacggagttcggccgccgtggcgccgagcagcgccgcatctccaccaacctgctgttcggcgtggagaactcggtgaaggcgctcaagggccgtcacgaggccctgctggacaagacgttcttcgcgcagaaggtcgccgcggagcaggatctgcgcaagaaggtcgaagccaacccggagatgaagaagaagtacgccgcggcgtgggatgagatcgccaaggcccaggcgcagctgcgcaacatccgtcaggacctgacgttcatggagaacggcggcggcctgtcctccacgctcttccaggtggcccgcacgctggtgcgcggcgccgaggagttcccgaaggcgaacggcgagcgtctgcgtgagttcaaccaggccaacgtcccggcgctggaggcccagctgttcagcccggcgcctgtctacccggagctggagattgcccgcctgacgttcagcctcaccaagatgcgcgaggagctgggctccgaccaccccttcgtgaagaaggtgctgggcaaggagtccccggagaagctggccgcccggttggtgaagggcaccaagctgcgcgacgtgaaggcccgccaggcgctctacaagggcggcaaggcggccatcgcggcctccaaggacccgatgatccagctggccgtcgcgctggacccggacatgcgcgccgtccgcaagtcgtacgaggagaacgtggagtccgtcatccgcaagaacagcgagctggtggccaagtccaagttcgaaatctacggcaccaaccagtacccggacgcgacgttcagcctgcgcctgtcctacggcgcggtgaagggctactcggagaacggcaagcaggtcagccccatcacccagatggcgggcaccttcgagcacgccacgggtgaggagcccttcgcgctgccgaagtcctggctgaagaacgagaaggcgctggacggcaccacgccgatgaacttcgtctccaccaacgacatcatcggtggcaactccggctcgccggtcatcaacaaggacgcggagatcgtcggcatcgtgttcgacggcaacatccagtccctgggcggcgagtacggcttcgacgagagcgtcaaccgctcggtcagcgtccacagccaggccatcatcgagtcgctgacgaagatctacggcgccacgcggctgctcgaggagctgcgtcccggcagcaccaaggtcccgcccgtgaaggccagcccggcgaagtaatgccttcgggcgaagatgggggccccggcgcggtcggccagggcccctgaaacacgaagaggctgcccggcacatgtcccgggcagcctctttcgcgtcagggcgtcaaacgccctaccgccctactcccattcgatggtcgcggggggcttggacgagatgtcgtaggcgacgcggttgatgccgcgcacctcgttcgtgatgcgcgtggagatgcgctccagcacggggaacggcagccgggcccagtccgccgtcatgccgtccacgctggtgacggcgcgcagcacgcacgtggactcgtaggtgcgctcgtcgcccatgacgcccacgctctgcaccggcagcagcgccgggaaggcctgccagacctccttgtagaggccggcgctgcgaatctcctcctggacgatggcatccgcgcgccgcaccagctccaggcgctgctcggtgacttcgcccaggacgcggatggccagacccgggccggggaacggctggcgggacaccatctcatccggcagccccagctcgcggcccagggcgcggacctcgtccttgaagagctcgcgcagtggctccaccagcttgagcttcatcgtctccggcaggccgcccacgttgtggtggctcttgatggtgacggaggggcccttgtacgacacggactcgatgacgtccgggtacagcgtgccctgggccaggaactccgcgtcctgcacgtcgcgcgcggcctcctcgaacacggcgatgaactcgcggccgatgatcttccgcttcttctccgggtccgtcactccggccagcttgtccaggaagcgctggcgggcatccaccgtcttcagcgggacgtggaagcggtccacgaagagcgcctccacctgggcgcgctcgttctgccgcagcaccccgttgtccacgaagatgcactggagccgggggccaatggcccggtgcagcagcagcgcggccacggagctgtccacgccgcccgacagcgcgcagatgacccggccgtgctcacccacctggcggcggatggtgcccacggcctcgtcgatgaagcccttcatcgtccacgagccgctgaccttgcactcgttgaagacgaaggcgcgcagcatggccttgccctgcggcgtgtggaccacctccgggtggaactggacgccgaaccagggcttcgtcgcgtgggcggtggcggcgaagggcgaattgccgctgcggccaatggcctcgaagccggggggcagcgcctccacccggtcgccgtggctcatccagacctggaccctgtccccgggggtgaattcggcgaaggggccgcggcgggccagcacctccacctccgcgttgccgaactcgcggtgggcgctccggtcaatcttgccgcccagcagcttggcggtgagctggaggccgtagcagatgcccagcacggggacgccggcttcgaagacgaacgggtcgcaccggggggagtccggggcctccacggacgccggtccgccagagaggatgatgccgcggggagcgtacttgcggatgtcctccgccgggaggtccgggcggtggatttcgcaatagacgcccagctcgcggacgcgccgggcgatgagctgggtgtactggctcccgaaatcgaggatcaggattttttcggcgtgcaggtccacctgggagtctccaagaggggcgtcgttgacggctgggggcccttatcgctacaaacttccggaatacaacgcccaagtaccttcaattgttcgaggcctggatgctccgccgcctgtccgcccctaccgctgctgcgaccctactcctgctgtccgcctccggatgcgtgaaggagatctcctcggatgagcggctggaccgcgaaacccagaatctctccgcgaaggagatgccgggtgcggccgagctggagaagctcacctgtgaggactccaccgaggcgctcatcaaggcacgcaatgtgaaccggccggagacggaccggctggtggactacatcgagctgtactcctccctccgcaagcggaccgccacgttcgaggatgcgatgaaccgcaacccggacctgagctaccgcgagggcacccagcacctggtcaacgccaaggacaactgcatccagcagacggccgacgtccgggtggagttcgagacctacatgcgggagctggtgggcgtgcccaccgtccaggaaatcaagggcggcaacaccgtcaccatcgcccggctcgacttcaacaccctgcgccaggccatcgagacgctggagccggacgacaaggacacgctgctcaaccaggtgaacgccgcggagaagcgcgtggccccgtcgacccccgcgggcgatgagtccgcccccgcgtcgggtggtggccgcaagcgcggccggtaagtacgcgctccggccgtttctggctggacacccagggccccgccgagaggcgcgggccctttttcatggcatcaggacgcggagcgggaggacgggccaccgcgctcctggcgccctccggactacccgacgcggtagttcggtgcttcctcggtgatgatgacgtcgtgcacgtggctctccttgagcccggccgaggtgatgcggacgaaggtggactgggtgcgcagctcgtcgatggtgcaggagcccacgtagcccatgccgctgcggatgccgcccatcatctggtggacgttcatcgccagggtgcccttgtacggcacgcggacctcgatgccctcgggcaccagcttcacggactccacgtccgccttgaagtagcggtccttggcgccctg

SEQ ID NO: 733 - DNA, 6988 bp, Myxococcus xanthus
gcaaatttagcatgacgtaccccgccttcttcatccccgagctgcgcgccgaaggcgtcgtttgtgacatcattaacgtgtggggaggctagccatcatgacccacttcgcctcacgccggggcagcgccctggccatcaccctgattgccctgacggtgctgctgctgctcgtggtgggcgccatcaccttcaccggccgcaaccagtccgccgccgtggccaagacgcgcagcgaccgcgtggaggcctgcgcggagacggcgcggcgctacctgctttcgcggctgaaggtgttcggcaccggcgccgtgcccgtcaccagcatcagcctggagcaggtgctgcaagacgaccaggtcgtcgccgacagcagcgtcatgcgcaccgcccacctgggtgacaccgcgtcggcgcccacggccgcggagctcgcctcgtcctcgttcagcagcggcaaggaccaggtgagcgacgcgggccacacccttcgagaaggcacggccggcggcagctactaccgcgtggtcgtcatgtgtgacgaacccggaggccggcaggccgagaccgagttcgtcttccgcttcggcatctgaccccttccgactccgcccttccccgagccccccatgaaggcactcttctccaccctgacagccctgtccgtgctgctggccgcccctggcgcgctcgcgcaggacccggcgtcttgcagcctccagtccacctcccgcctggacgcgctgctcaaccccgcgcgcggcagcgacgagcgcttcttcaccagccccagcggcccgcccaacatcctgctcatcctggatacgtcgggctccatggcgtactggcccatcgcctggagcaacaacgactcccacagctattccaaaaacagctccggcaccttccccggctgccgtcaggccaacatcgacgagctgaactacgacgccaacgtcgcgtacccgcggatgtggctgtcgctgaccaaccaggactcgccctggttcgtgcccaccagctactaccgcttcgatggcagcggcagcacctcgcagtccagcttcgggatgacccgcaacccggtgaaattcaacgagccgccgcccaacactgtcatcagtggcaccgcggcagaggcgtgcgcccaggtggtggactccggcaacaacaacacccaggccgccgcccgcgccgcgtgcgcgcagtgcctcgcgacgaagggctacttccaatacacgcaagagaagcgcgtggcttccggtaacttcctcaacttctattcgccgcgcggccactccgccgtcaacgtcatcagccaggtgctcaaggactcggagcgcacgcgcttcggtgtggtgacgttctccgcgagcagcgaagccaccgacacggcgaagtggagcggccaggacgtggtgcgcttcgagcgctttggccccagctgcggcgactcgctcagcggcgcgaagcgtgaagatcaccgcaacaacctgctcagcaagatgcggaacgggctgcgcttcaacacgggcacgcccctgacacaggccatgtggggggccagcacctacttccgctccgccggcagcgacccattccccgactggttcggcagcgactacctgcgcgactcgggcttcaacgacgaggccgcgcccggacgagccgccacctgcttcacctgcggcttcaacgccatgattctgctcacggacggggagcccaacgagcccggcggtgactccgcccaggtcccggcccaggtgcgcaacctggacgtcccctgctccaactgcgccgcggccagccagggcagcaacagcggcggctccagcagccacatccaccgcatcgccaagtggatgtggacgaacgacctgcggccggagctgtcagggtcgcaggcggtggccacctacaccgtgggcttcgcgctgacgaacacgcaggccatcaacctgctgcgcgtcaccgcggacgcgggcggcgggcgattctacgcggccaccaactccagccagctgaagacggcgctccaggccatcgtcgacgacgtgcagaaccggaacatcgcgttcgccgccgcggccatctcttcgttccagacgggcagctccacgctcagcgcgctgatgccgcgcatgtcgcccgcctccggtgacagcgcctggcgcggcgacttgtggcgcttcaaccagttcaacgagttcgtggaaggtgtcgacaagaacggcgacggtgacatggacgacatcttcgtcgtggaccgggacggggacatcgtcgtcgaggacacctctggcaacttcgtcaaggacggaggcagcaccccggccgcccagttctgggaggcgcgccgcgcgctgatggcccgggcgctgaccagccggaagatctacacggtgacggacagcaaccaggacgggcgcctcaccgccgcggacaacgcggcgacgcccatcgagttcaccgtggagaaccgcgaggtgctgaagagctacttcggcatcctcggcacccccgtctgcccgacggtgcagtcgctcagccccctggacatcgacccgggcacgttgatgacgggcctccggctgacgccccagcaggccgccgcggccatgagcgtcgcggtgcccggcttcggcaacctggcgcaggcgcagacctgggtgaacgacatctgcgtgcgcacgctcatccaatacgtgcgcggccaggacctggcggacgaggacggcaacggcaaccgcaccgaggtgcgccgctccgtgctgggcgacatcttccactccgcgccggtgctggtggacccgcccatggacaagttcctgtgcaacctgggcatgagcaaccagtgcacgcgcacgctctacagccagcaactgggcgtgtcgcccacgccgctcgccacggagagcatcagccgctgcggcaacaccgtggaggtggacgcgtatgacgcgtacctgcaccgctacctccgccgcgacaagctggtgctggtgggcgccaacgacggcatgctgcacgccttccgcgacagcaccgcgagcaccgacaactgcgagggcggcctgcccatgattgagtactcgcccagcaacggcgaggaggagtgggccttcatcccgcccgacctgctgtcgcgcctgcacgagatggcgggcggccaccagtactacgtggacggcgacatcatggtgcgcgacgtgtgggcggacggctcggacggctcgcagccggacggcatcaagcagtccaccgagtaccacacgatggcggtgatttcggagggacgcggcggcgtgcactacgtggcgctggagctgcgcgcggactcgggcaccggccgcttcggcgcgccccggatgcagtggatgtacccgcagccggactccccggaggccgccctcttcggcaagacgctcttctcgctcagccccaagccgccgcccattggccccgtgctggtggaggcgggcaccgcggccggtcccgtgtcccgctacaacgtggagacccaggagcggtggatggtggccctgtcgggcggctggtcccccggccaggagaagggccgcggcatctacatggtggacgcgtggtcccccgaggtgaatggccgcaccgacaacctgtggtggaagttcgaatacgacccgaacgccagcggcgagcagcacggccccgcccagcacctcacgcatagcgtggcggcgccggtggccctggtggactacggcgtggggggcaacgtgcagcaggacggcttcttcgatacggccgtcttcggtgacatgcgcggccagctgtgggtggcgcgcatgtccgtgcccggcgcgctggacccgagcacgggcctcatccgcaactggagcgccgcgcgcgccttccagatggaccgggacgccgtgggtccgtcgggcggccagggcgacagcctcacgcgcacgtggcccttctattacgtgccctccattggcatccagccgggcacgggcgccatgcgcgcgctcgtcggcacgggtgaccgctacgcgctgctggatgaccaggccggcatctgccgcttcgacaacccgcaggcctgcgcgcgctacgggtgcggcaacgtggaggtggactaccgcgtggaccgcatcggcgagaacatcacccagtcgcggcaccagtggacgcagcggggactggcacagtccacgctgacgcgtgggacggcctcgcagcccgcctgtggcgacccgggccagacggtggtgtcggcccggttcacccgacacgaggcccgctcctgcccgggagcaccccaggactacacctccatgagccccgcgcgtgtggagtgtggcaaggacgccgagggcaacttccgctgcctcgacgtgagcaacgtggcgcccaacttcgcggacctggagctgacccgcaccgtcaacgccattgggaagaatcgcttctacggcgtgcgcgtgtacggtgtggccgggcagacgttcgccgaggatgccaccgctgtttccgcggagggccccatgacggcgagccagttcgacgcggaacgcctgagcgaccgcaccaacgacaacgacaccagcggtgacctggtggacgtgacaaacatcacctgcgacgcgtccggcgcctgctccgcgacgggcgccctgcccgatggcaagggatggatgctggagtacacggacaaccacacccacaagacggcgggcggcgcggccacggtggccagctgcacgctgtggaacgtcatctacccgtcgcaggacggcgaggtgtgcagcagcaccgccgcccgggcccgcttctaccaggcggacttcctcagcggcctgcccaactgcgccgcgtccttcgagaacgcgcgctaccaggagcgcgcggtgctgtcaccgccgcccgagccccgccaccgcggtgatgatttcgcccacgggcagcgtgaaatacagcgccgtcatgcaggagcccggacagcgccaggccacctcggtggacgtgtcggagaacagcgaggtgctccagaacgtgtacgagctacccctcacccaggagcagcacgcctgccgccacgagaacgcggccagttgcctgccgtgatgacgtgaaggccgccctccccgctcgcctggggagggcgtctggcgttagaagacgggcatgcccgcactcgaagacgccatcgcgctcgcggtggccgcgcatcagggccagcgagacaaggccggccagacgtacatcctccacccgctgcgggtgatgatgcggctggacacggacgaagagcgcaccgtggccatcctccacgacgtggtggaggacacgccctacacgctcgagcgcctgcgcgagctgggctacgcggaaaacgtcctgggcgcgctggacgcgctcacccgccgccaggacgagacgtacgaggccttcatcgaacggctgcgcccgctggcgctcgcccgccgcgtgaagctggcggaccttgaggacaacatggacgtgcggcggctggcagcggtgacgcccaaggacgccgagcgcctggcccgctaccgcgccgcctgggcccgcctgcgcgagccctagaagacacgacggcccggagcgccacgggggcgactccgggccgtagtgctaccagcgcccgccgaggaaagcagggtgccggttccttcctctccgcgctagcccttggccagttggcggagcacgtactgcaagatgccgccgtggcggtagtagtcgagctcgttcggcgtgtcgatgcggcacaccaccgtgaactccttggtgccgctctcgcccgtggccttcacggtgagcttcttctgcggcgccaggtcctgcgccacgccggtgatgtcgaacttctcgtggccggtgaggcccagcgactgcgcgtcctggcccgcctcgaactggagcggcagcacgcccatgcccaccaggttggagcggtggatgcgctcgaagctcttggcgatgacggccttcacgcccagcagcatggtgcccttggccgcccagtcacggctggagccggtgccgtactccgcgcccgccagcaccaccagcggcgtgccctccgcctggtacttcatggacgcgtcgtagatgctcatccgctcgcgcgtggggatgtggacggtgacgccgccctccacgcccgggaccagcaggttcttcaggcggatgttggcgaaggtgccgcgcaccatcacctcgtggttgccgcggcgcgcgccgtaggagttgaagtccttgggctccacgccgttggccatgaggtacttggccgccgggctcgtcttggcgatgttgcccgcgggggagatgtggtccgtggtgacggagtcacccagcagcgccatcacgtgcgcgccatggatgtcctgcgtcgccttgggctccttcggcaggttgtcgaagaagggcggcttgcgcacgtaggtggacgtgtcgtcccactggaacgtggagcccttgcccaccggcagctgctgccagagcgcgtcgccctccatggcgttggcgtactggctgcggaactgctccggcttcacggaggtgcggatgacctcctgaatctcctcgttggtgggccagatgtccttgaggaacacgggacgtccgttggggtcggtgcccagcggctcgttgtccaggtccatgcccacttcgcccgccagcgcgtaggccaccaccagcggcgggctggccaggtagttcatgcgcacgtgcgggttgatgcggccttcgaagttgcggttgccggacagcaccgcggcgacgaccaggtccccctcggtgacggcgttggccacgggctccgtcagcggaccggagttgccgatgcacgtcgtgcagccgtagcccacgatgtggaagcccaccgcctccaggtagggcagcaggccggcgtcgcgcaggtactcgctgacgacgcggctgcccggggccaaggacgtcttcaccca

SEQ ID NO: 734 - DNA, 6566 bp, Myxococcus xanthus
ggggcgtggccgccgccggactgctgggactgggcggctggaaggcccgccacgcgaacgacgccgaagccaccaccccgcccgacgccaccacgcctggacaggtcgcggccacgctgcctccgaccccgccctccgagccgctcgccaccgtcgcgcctcccgacaccaccccggccccgaaggagagcgccgggcgccccggccctggcacgtcgcaaccgccccgcccggcttcgcgcggggtcaagggcgcgacggcaccgggaggcctgtcgccgcggacggatggcacgccggccgtgggcggcaccgttcgcggcatgggcacacgccccgcgggcgaggacgaggaagcaccgcgcaagccgctggtgcgcaagctgcctgtgtccatcctggtgcgcccctatggcagcatccgcgtcgatgacggcgtgcccagcgcccagccgctccagaagcatgacgtggaggtgacgccgggccggcacaccgtcaccatctcctgcgactactgcgaggacgtggtggacaccatcgacgtgcagccggacggcgacaacgtcttccacctgcgcgcccagccgaaggcgtcccgcctgtcggtcgacttcgagcccgcgggcgcgctggtgcgcgtgggcgacgagttccgctccgcggaggacagcctgaagacgcccttcgaggtccgctccccgcgaggccccgcgggcttccagcacaccgtggtggtggaggtctcccacccgggctacgtgccggagcgccgggtggtccatctgcggccgggcgaacccaccaccctgcgcgggagcctccgcccagaatgagccgctgcctcccgctcttgttcacggcgctgatgctgctcgctccgggcgccacgctcgcccaggacgccggtgacccggaggtcgccgcgctgcgtgccagcttcgagtacggcaagtacgccgaggtgatggaccgcgcggcctcgcgcatcgaccggggcggcctggacgaggacgacctggcggagctgcacaagctcgcgggcctggcggccttcaacctgggccgcaccgacgacgcccgccgtcacctgcgcgcgctgctccggttggatccggacttcagcctggaccccttcgtcgtcccgccgcccgcggtggccttcttcgacacgctcaaggaggacatggacacggagctggacttcctgcgccaggagcggcggctgcgtcaggagcgcgagaaggcggaggccgagcgccgcgagcgcgagcgcctggaagccgaagtgcagcgccgccgcgccgaggagctggcgtcccaggtgacggtgcgcacggtggagaagcgcaacttcctggtcaacttcgtccccttcggtgccggccagttccagcagggccgcaccagtctgggcatcgtcttcgccgccaccgaaggggtgctggcggtgacgagcatcatctccttcttcgcctacgaagggctcttcgaagagcgcaccatcgatctggacaacgtgctggacccggacggccgggcctccgtcaccgtgcgctacatccccaccagccgggccaggcagcgcgacgcgtggcagttgctcaagctgtcgtcggccgcgggcttctacgccatctacgccgtgggcgtggtggacgcgctgttccaccacgaggaccaggtggtccgcagcacggtggagcctcgcgccgaacaacccgcggagccgtcccctcgctccacttccgcccgcgcgacggcaccgaagacgtacacgcgcgtgggcctctacccgacccgcggcggactcggcgccggtctcaccctctccttctgacggagactccctccaggtacgtgaagccatggccagcctcaccgtccgcacccccgatggcaagatccgcgcagtctccctgcacaagcgcctcaccagcattggccggggcccggacaacgacatcccgctggaggacacctccgtgcccgccagcgccctgcacgtcaccttcgacggcacgcgctacgaggtaggcagcctgggcgccaccttccacgtcaacggcaagaagcgcgacgcccatgcgctctccaccggcgacgtggtccgcgtgggccacaccgagctgatcttcgcccgggacgacgcgccccgtgcaccgccgctacccgcgtcccctccgcgcgagctgattcacacgtccaaccccgactcgcacacctcggagctgcccggcgtccccggccgcgagctgctgctgctgcgccggctcaccgcgttcagcgagcggctgctggggctctacgacttggagcgcctcctggagggcctgatggacgaggccatcgaggtgacgcgcgccgacaagggcttcctcatcctgatggagaacggggacccgcgcgtgaaggtggcgcgcaacgtgtcccgggagaacatcgaggacgcggtggagaaggataaaatctccgactccatcatcgccaaggtggtgaaggagcagaaggcgctcatcgtcgcggacgcgctggactcgccggagttcaacaagagcgagtcggtggtgaacctgcgcgtccactccgtcatgtgcgtgccgctgatgcagaagggcgacctcttcggtgtcctctacgtgggcaatgaccggctggtgaaccggttcgagcccaagagcgcggacatgctcaccatcttcgcggcgcaggcgtcgctcattctccagaacgcgatgctggtgagcgacctcaagctcgacaacaccgagctgcgccgcaagctggaggaccagcgctatggcgacatcgtcggcgcgtgccagggcatgcgggacgtgtacaagcgcatcgacaagatcgcgcccacggacatctccgtgctcattaccggtgagacgggcaccggcaaggagctcatcgcgcgggaaatccaccgccgctcgacgcgcgcgaagggccccttcatcaccatcaactgcggcgcgattccggagaacctgctggagagcgagctgttcggccacgtgaagggcgccttcaccggcgcggtggccaccaaggccggcaagttccaggcggccattggcggcacgctcttcctggacgaaatcggtgagatgccgctgcagctccaggtgaagctcttgcgcgcgctccaggagaaggtcgtctacaaggtcggcgacaaccgcggcgagccggtggacatccgcgtggtggcggccaccaacaaggtgctcgaggacgaggtgaagaagaacaccttccgcgaggacctctactaccgtctcaacgtcgtcacgctgaagctgccgcccctgcgagagcgcggcgaggacgtggtggtgctcggccgcttcttcctccagaagtacgcccgcgagttcagctccaaggcccgcggcttcaccccctccgccaccgtgtccatgcgcaagtacggctggccgggcaacatccgcgagctggagaacctcatcgagcgcgtgctcctgttcgcggacgggcctctcatcaccgcccgcgacctgccggagccggtccgccagggaacgggcgtccaggcgggtgccaacctggccagcgcggtggcctccatcgacgttccgacgggggaagtcggcctgaaggacatcgtccggatgaaggccgccgagctcgagcgggacctcatcgtgaagaagctcgaggagacgggtggcaacgtcacccgggccgctcggttgcttcaaatcagccgcaagtcactccagacgaagatgaaggagtttggcttgcgcgacaccacaccagacgggcaggaagacggtccggacgaatagaccgcgaggaagcggaattccgcttcgcgcgcgtcggttccgggcccgcccacccattccaactcagggagcttgtatgcggccgaaccttcccacactcggtgcccctccgaagcgcagtcccttcggcacggtggtcgccgtgtcactcatcctcggcggtgccgccggcggcgtgtggtggtggaagcagcggatggttcaggcgacggaagaggccgcggcgcagatgcccaacgcagttcccgacgcaggcgccgtcgccgcggcgcccacgccggcgcccgtggccacggacccggtgaaggccgcgggcctggagcgcatatcggtgagcatcaacggccccctggagaccgcgctcgtcaacgccgctggctcggacgtgggtccggcgctggcgcaggtggtgacgcgcaccctggtgtggtgggtctccgtgcccggggagattctccgcggtgacacgctggaggtgctctaccagcgccgcaccaacgaggagcccctggtgcaggcggtgcgcttcaccagcgccaagctgggcaagacaatgagcgcgtaccgctaccatgccaacggcgagcccaatgcccggtactacctgtccggcggcgacgagctggagctgaggctggagcgctcccccatcgacgactacgagcaggtgacgtccctgcttcgcgatggccgcaagcacaagggcgtggacttccgcaccccggtcggcacgcccatcaaggcccccttcaacggcgtggtgaagcggaagaactggaacttcagcagcaacggcaactgcatcgagttggtggagtcgggcggcaaggggcgccgcgcgctcttcctccacctggacgaggtggacaagagcgtcaagccgggcacccggttctccgtggggcaagtcatcgccaagagcggcaacacaggccgcagcttcgccccccacctccactaccagctcatgacgcaggatgaccgggtgctggacccctacgaccagcacaagacctaccgccgctcactggccgcgcagcaccggtcgggtttcgaggcggaggtgcgccgcatggacgggttgctgagcgcgtccgtggtggccggcaagtaaaagccacccgtttcttgacactccttcgacggcacggctagctggaagccccccgggcttgccggaaggccggggagatttgccgtcggaggtcggatgcacaggcttcgcgtcgtacttgccgcgctgacgctaggcgcgccgttcgccgccaccgcggcggacatcacccggattgcgtcgtcgctcgaggaggacgacccgttcgacctcttcatcgacgtcggcttcgagcgcacgcagaaccgcgcgaagatcatccgcgagcagttggcccccaccgggcaaccggcgggccgccgggatgcgtcggagctctggtacaagggcgtggacgcccggctcaacctggagctgtccgtcggcctctatagggacctggagttctccttcgccctgcccgtcgtcttctcgcagaacgagcgttgggacttcacgtccaactcgtctcccgagacgtccaccatcaccaacaactgcctgaacgccaacggctctgtcatcccgggctgtctggagggctcggcaccgggcagcgccctgttcgacgtgccgcaggagagcttccgcggcggcctgggcaacatgcgcttcggcctggcctacgccttcttcaaccaggagaaggacgagacgaagcccacctggattgtcggcctggagtacgaggcccccaccgcgaagctgcgcgacgcggccgcggacacaaccaactcggacagccgcggcaacatcggcgaccgcatccacaagtaccagctctacacggccttctcgcgccgcatcggcgcagccgagccgtacttcaaggcgcactacaccatccccgtgcgcggtccgggtgcctactccaattgcgcccagaaggactccaacccggataacctgggcgccccggacaactgcttcacgggcccgtggaaccgcaaggagacgggcatcaacgcccctcacaccgcgggcatgctcttcggcgtagagctggtgcccttcaaccggccggcgaagtcgcagcgcttcgccctggacgtccggggtatcggcaactacgtgggcagcggccgctactacaacgagctgagcgccgccctgcgcaagctgctcacctccgaggactacttccaggtgggtggcatgctgggcgtcacggcgaacgcgtcgcaggccttccagattcgcgcgtccggcatgttcctctacaacaccaaccacgccctcaccgccgaggatccggggcgtgacgtgaacaacgacggcggcgtggacacacagcccggctcgcccgacctcaaccccaacttcgactggcgctacgacctggtgtctcgccgcttcctcgcggtggagagcaccacgttccgcttcgacctgagcgccacgttcagcttctagcgcggcccggtgggcgccgatgacggcgcccacctggggacctcagcgcttcagcgagagccccagccggtagacgtcctgaccggcccaacccgcgcggcgggccagctcggtgctcagcgccttgagcttctcgccgcgcgacagcccctcctccagggcccggcgcaattcctcctcggaccagcgcgtctcgccggtgcggccctccaccagcaccaccacctcgccgcggg

SEQ ID NO: 735 - DNA, 5649 bp, Myxococcus xanthus
ggcccgtggcgcgctgcgcactgccgcggcgcagccccagctcgcccccacctcgacatagccctcctcatagagaaggacggacaccagcagctccgtgtcgtctccaacaagagggcgaagccatgcacgcagctccgccatctccgactcgaaggagaggacgagcgacacagaaggtgtcggcaggtccagttggggctccccgctccccgtctctgccaacacgccatggagttcggcccctcgctccttgctcaaggccttcaggacgtcgcgctcggtacccagcacgagtgctgctgccacccgctggacgctggacaagttgacgcgcgccacgagtcccaggaaggacgcggcaatcgcagaaaccacctccgcgggcgagacacgaaagcgcctgagacagcggcgatacacgccgtccagccccggccatactcccagccacaacagcgccgtgaagaagccggactccgcccgcatctgcgccagcgtgacgaggccggcaagcactgcgtccttgacgtgggagtccccctcgcgcgcggtgagaaatgcgacaagggcctctggctgctcgaagtcttcgagtgtctcccaattgcgccgcagcaggcggtaggcgcgctgcgcttcggccgtccgaatggacacgccgagttcctcgtgaagtgtgttccagcatctacgcacaggcgcacatcgtcccagcccagcgctcggcaagggccagcggaatggggaagcgtggcgagtcccacacgagaagcgacgtcagcgtccagcagctcccgtattcgtgggagcgccaggacgctgtggggactcaatcgggattcggccagacgcggcacaggcccaagtcagcggccagtggctccgcgacagcagcgagcgagccctattgagactatcggggcgactgcaggggcaataggagcgggacaaggcagcccccacgcgtcggcctgaagccgggcgacgacttggacacccaaccccaccgacagcaccaggccggccgcaatcgctccacacatctcgctgaatccggaattcacggcaccttctccacaaccctcaataccaccgcgttgatacatgcccgcacactacggccgagacgtcgaaacctgagtgcgggaagcccgacaacgcgcacaaacgcagtaccggcgtcgccatactggggacattcacacgtcccttccacgggatgcaggtgacacgcaccatgcagccttcgagtgttggcatacacggccaaacgcgaattcagtgctatgccgacgcaccctgattctcgggcgaaggcgccgtcacgtgaaaaaatcggctgtctcagcgtcggggacatgcgagcgccgctctgcgactttcatgccgagacgacaccgcccggggcaccctctacacgggtgggagaagcgccaatggctccatccgccatccacgcaggtggagacgcgccgtccatgaatcaggacgcgcactccgtgaaacacagtctcctcacagttcaatcacatccaccgcgcagggggggtgcggcgcttccgtcggccctcacaggtggatgacggcccagcaagccccaggaatcgccgagagccctctcccaggggggaaggcgcccccctgcccctttctcgtgccaggaggccgtttccggccgttctgaggccatcctcaggccatgtcactcccgcgactcgtctcaatccccctcactcccccccgcgattcgtcggtccggccgggacacttcacattccgcagcagtgctttcactcaaagtttcagaggtggcaggggtggcagaggggtggcagtaccacctgccacctttttcttctttcttttcaacaacttatctcttggtggcagtggtggcagtcttttttcaggtacccctacgtgacgcgcgcgcatatttgaatggcactattcaataggggaatcgaagtctcgctctccctagggtgcattaccccaaaaaacactgccaccattgccaccactgccactccgttgttttcactggggaatttcgtggcagtctttcaaaaagtgcctgccaccggctgccacctttctgccacccggtgacggcatgtccccgaaatcgcgccggaggcctttgctctgccttatggccgcgtgtcgttcgccccgggaaaatcaaaaaagaaatcgggcaaaaagatttcttgtcccaaatcgaagggatggggtgcttttagggtgtatcggcaaacacgcgccgccgacatccgcgcatggcccttacacacctcctccagcccactcccgccccacagcgtccgcctggcgtgacgtgcgaagcctatgtccgcggcgagggcaagcactgcctgcactaccggcctggcggtggctgcaccctgcccggcgtgggcggcacctgcaccgagtggctgaaggtgaatcggcaggcccggcctcatcgtgacgtgaccgctcaacctgtccctgcgcctccggtgaaggccgctccagccgctgtggatctcttcggccatccgctgaccgaggcaggctcgaagaagctcgccccggctcccgcctccaggcccgcgccgccagctccgtctcccgatgtgaaggggctggacgcggagaccccgctctccggcctgcgcggcctcaccgacgaggacatcgccagcttcagggccctcaacgccgaggtgtgcttcgcctccgagacctacggcgaggtgtggctcgtcccggcctacaccggccaggcccgaaaggagctcacccccgagcacgccgccaccctggtgcgcgtcctgtctgccttcccgggctcacgcgtcatgtccttcgagaagcggcaagcctccgcggacgaggtgtcgccatgagcgtgccccgcgcctgtgaaacacacgcagcgggccatgctgcctgtccccttggacttgatgtgtctctcgaaaagagcgtgatgactgactcgcgacacgcccgccgcaccggcccggaggccacgtcatgagcgccctgcgaaaccagcatttgtcatacagccggctgagccgcttcgaggcctgcccgctgtcgtaccagctccactacctcgacaagcgcactgccgagcccggcgtccccctgagcttcggcaaagcgctgcacgccgtcctcgagcggctcctccaggaagtcatcgacaccgagtacgtgggccgcctctccgaggagcgcgccctccagctctaccgtgaagagtgggccgcctcgggcctctccggtttggacgtctttcagcagggcctccgcatcctccaggacttcgtccgccagcagggccgcgtggactgccgcgacatccttgccgtcgagaaggagttccgcttgccggtgggccccttcaccgtcctgggcttcatcgaccgcgtcgactgggtggacgacgagacagtccacgtcatggactataaatccaaccaccagctcttcacccgcgaggagctggactccagcctccagctcagcctctacgccctcgcagcgcgccgcatgtggccctgggcgaagaaggtgcgcctctccatgtggatgctgcgccacggcgtgctgcaggagacgacgcgcaccgaggagcagttggaagccgccctcgcctacgtcgagacgctgggccagcagatggagacggcggagtccttccccgcccgcctcaaccccaactgcgtgtactgcgaccaccggcgcgactgccccgcctacgcccaggcgctggagggccggcgtggcgtcgtctgcgaggacacgtctgacttggagtccgtcgcccgggagcgccaggaagtcgcccacctcgcgaagattctcggcgcgcgcaaggcggagctggagggcgtcctccgcgcccaccttgccgagcaggacgaactcgtcctcgccggcacgcgctaccgcatgttcaacaccaccagcctcgactacccgctggagcccaccgtcgcggtgctggcccccgccaccggcctcccccgtgaggatttggtgcagcgcctcgccagcgtcgagaagaaggccctcgacgcgctcctgaaggacgcgggcaagcgcctgggcaccgcgcgcgtcgcgctgctgaaggccgagctggactccctcgccgccaaacaccactcgcccaggttctgggccaaagaggttgcatagtgctgctcgctcatcctgcttctgacaccactcctgtctctgccctccgtccgccgctcttccccggcatcccgccgcacctgcggacgctctgcttcgtcgacctggagacgacggggttggatgcctcccgtcacgaggtgctggaggtggcggtgctgcgcgtcgacgcccgcagcctcaaggtgctggcggagtacgaggcccgcgtgaagcccacccggctggccgacgcgcaccccgaagccctggccgtgtgcggctactccgacgaggagtggcgggacgcgctgccgctccaggaagtcttggccaccgtgacgccgctcttggcgggcaccctcgtggccggccacaacaccagcttcgactggggcttcctcgtcgagtcgtatcgccggtccgagttggccctgcccagcgtcgactaccaccgcctcgacaccgccagcctcgcgtggccgctgctcgccaccggcgaggtggagtccctctctctcaacgccctggccaagcgcttcggcctccatcggccgacgcctcaccgtgccatggcggacgctcgctgcgcgctagaggtggcccgctgcctcgcggtgcgcatggcccggggcggccacatggagcggctgatggaggagtcgggaggtgtctcgtgagtggcgcgtcctcccgccgcaaaggcgccgatttcgagagagccctcgtccaccgcttccgtgaggccatgccggaggcgctcatccgccgcggcctccagtaccgcaccgggcaggagatgtccgacgtcgaggtgccgtgcttctgggtcgaagcgaaggcccaccaacgcaccaacgtccgggaggccatgcgccaagcggtggagacgtgcccgccgggccgctggccgctggccgtgtgcaaggacgacgggcagccacccctcgtcgccatgcagttggatgacttccttgagctggtgcgcgagtggtgggaggcccgtcctcggtgagtgacttcttcggccacctcctgggcctgctgcgtgtggaggcgctcgcctctcggcaccaggccgtcttcgcggctgcgcgcacgcggcggccggccttcgcccgccatgccacgctcgaatcggtgctggccgcgttgggtgacgcgcgcgaggagacgtacccggagcgggaagccctcacccgggccctggtggccgaaatccaggcctcctccagcccggcgtggacggctgcactcgcctccgcctacgcccccatgctgacgcgtctgcgccgccgcatcatcggcaacgcggtgcccaaagaggacctcgaccagctcgtcctcgccacctttctgtccgtcgcgcgcgccttccccctctcgcgctggggtgactggactgccgcccgcctgcgccagcagacagcgcgcgaggtattccgctacctccgcaaggagcgc

SEQ ID NO: 736 - DNA, 6794 bp, Myxococcus xanthus
  unsure (1)..(6794): unsure at all n locations
ctctaaaccgcaccggggctaagctcgacccggagtggctcgcggcggcggccccccacctgctcaagcgcagctactccgaaccgcactggtcggagaagtccgcgcgcgccatggtgaaggagaacgcgaccctcttcgggcttcaggtcttcaaggagcgccccgtggccctggccagcatggaccccgcccgggcacggctgatgttcctcgagcatgccctggtgcgcggcgaataccgcacccggggggcgttccaggagaagaaccgccaggtgctcgagcgcgtggcgcgcctgcgggacaaggcccggcgcagcgagctgctcgacagcgaggcgctgctgacgttcttcgaccagcgcgccccggcggacgtgacggacggagcgggcttcgaggtctggcgccgcaaggccgaggcggccgaccccggcgtgctcgtcctctcgatggaggacgccctctcacacgacccggacctgtccccggcgcactacccggacgcgatcaccctgcacggcgcgtccgtgccggtgacgtacaccttcgacccctcggccgaggacgacggcatcaccctgagcgtgccgctgctgctgctcgcccagttggtcccgggtgagctcgactggaccatccccgggtggcagcgggagaaactcaccgccctgctcgagcagctcccccgcgcccagcgcaagcagctggggccgttgccggaaatggtcgaccgtctcgagaaggaactggtgcccttccgcgggccgatgattccagcgctcgcgcgtgcggtgtcccgcctgtgcggcatggacgtgacggaggagtccctccgggcggatgccgtggtgccgtacctgcgcctcacgctccgggtgctcgacgagcggggaaaggagctcgcgcggagccgcgacgccgatgcgctgctcaagcagcacgggggacatgcacgggcggcgctgcgcagcgcggcaccgccttcagactgggagcgcaaggggctgacggcctggaccttcggcgagctgccccccgtggtcccccggcgggtcggcgggctcgaggtccgcagctatcccgcgctcgtcgaccggggcgctgccgtggacctggtgctgctcgagacatcctccgccgccgaggcggccacgcgcacgggggtccgccggctcctgatgctcgccgcgcgcggacacgtggccgtcagcgccgcgcgcatgccgctgcccttcccgtccctggacggcgcgccgcccgcgcggggccaggccgacgccttccgggcactcgtcctcgcacgaagcgtcgacgatgcgttcaagctcgcaccgggtgcgccgctgccccgaacgaaggcggccttcgaggcgctggtccgtgagggctcaccgcgcatcgagagtgcggcccgggactgggcgaacgccattgttgtcacctccgcggagctcgccgcgacgctcgcggcactcaaggcggcatcaaagggaccgagcggcgcggcggccgtgcgggacatccgctcgcagctcgggcacctgttccccgcgaacctcatcgagtggattcccttcgtgcgcctgctgcactacccgcgctacctccgcgcggcccaggcacggctgtcgcgtgcggtggcgaaccccagcaaagacgcagggaaggccgcgcccttcactcccctgtgggagaccttcctcgccaggcgcgccaccgtgcgtgaccaggaggcggcgcaggagctgcggtgggccttcgaggaactccgcgtggccatcttcgctccggaggtgacgacgcccgtgtcggtgacggtggcgaaggtcggcgcggccctcacggcgctgcgctagaagtgggtggctgtgcgtccgccacgagcgcatcggcgtcctcaaggtgctgccgcccgactgccaccgccggccggtagggtgggccgcgcccccccggtgactccggccagaacgagcctgtccgacgcttcagggggctacaccacttcgccctatcgatcctcagagccgaaacggaacggtattcgccaacgcggtcctcaaacgcctccgcagtacgaacctgaatctcttcgggcgccgcttcgtcgatgcaacaaatctgacgtgcgacattgagcagaaaatagggcctcgaatcgccctccacatccacggggaagcgctgaatatctccaggcgccaagttcctaaacacagatgcagctcgctcactgagtagaggggtcgcccccacccctgcgaactcgatatcaagcggctctccaggccgagagctcggaacccgaagtctcctatcgacctcgactggcctcccctgtctgaaccgccagaagtcttcgatctcccgaccgtccggcttggttgggtccaccagataccaacgctcccctcacatagacatccatcttgagattgaaaaagcgcgcgagcgccaaggccagcacgagcgcaccgagcttcacttgtcgcccccggtgtcgaactcctccggcattgcctccgtgggcgcccgcttcaacatcccgctgagcgactagggaaggcacgactcgggagagtccggcagtgtccggcatggcttcggggcgggactcgtcctgacgaggaagtcacccttcgtggcgatcaatcacagcacacacaaacctgaccgctcatgaagctgacagtgaatcgaagacccatgagaggcatcactgccgtcatcgcggcgcatcacaaactcgcaacccatcacgcgctccacctgggatgtgtttgacccactcacccgcgctcgttcctggcatgacgctccacaagtctgctttgccccagcggcaaccccttagcctgacatcccgatgacgtgcgccacgcccagggcgcaatcatccatatccactgaattaccacgcttactcgttttgatttgaactcaattcaagaccggtgctagtaaggaattggcttcggccgaccccgcacaaacaacacaggagtagtccatgacgaggaacgtgaagcgtttcctggctggctcgctgctgtctctcaccccgtcgatcgctttcgccggacagatcgaactcgacttccccgacttcctcacccagcgcagcgagtacgtcagcctccgtgagggggcggtgcaggtacccgtgcggaagggcccctcggtggaggccatcggccctgccgttgaagacttcttcgtctccaaccaggccggcgtcgacctccacctgggcatccagatcctgacgggctcgttcaatggcacctggaacacccaccccgtccccccaagcacctatggtgggtttcaggtcggcgcccccgcccccgccccaacggttatccagcagtactactacacggtcgacccggcgaacccggctggctcgaagacctgtgtctggcgcgtggaagtcacggacaacgccggcgcctgcaacgcgcaggtcttcttcggaacctatggcggcgccatctgcaccgtcgacgcggcccagtcgtccatcgacccggtcacgtgtcagacgcaggtcgtcaccaacatgcagtgagttgaagctcgcgccaccagggccgctccgggaggccctggtggtgcgtgcaccgtcatcgacggtcggcacggctccagcggaacgtcagcccggtatagccggcgggcgggcggctcccacccctcaggcccaggggaaactcgaggcccccctctgctcgcacttcgaaggaggggctcaagcgatacccgatgcccagtgaacctcccggtgcgagcaacaggttcgcgccattgaaccgcccttgaaaggcggtgagcggtcccgcgaaggcgcccgtcagcgatgcgccaccagtcagagtccacgcgcggctcagccgatagtcgagcagcgtctgcgcgccgagccggagattgacgggctccgtgtagttgttggtgacgggcacgtaccagattcccgcgctcggagcgacggaccacgtccaccgggactcctcgatgagccggtgccgtgttccaagctccaggcccagcaacgtgagacggccgccccaatcccagttctcgccagcgcccttgcggaaggtgagctcggggctggggaggtacgcctgttcccgcccacgctcgaaggccagcgcgttcaatgaaacgccgacctctgtcgtcccaacgggggttgtcgcagcgccgatgttccgcgcaccgctcagacagccaggagcgagaacgagcgccccgcccacccatagtgcccgtgtgccgaagcctcgcatcatcggggccatgcgaaccgcacccaaacgggatggtggtcgctccccgcgggacgccggtccacgccgcgctccagcggagcgagcccctgggcgaagacgaagtcgagcgggaggccgccaatcacggagtccaccgtgtcccccacgccttccgaggcccattggaagtcccgctcggaaaacagcttcaccatctgcctcaggcttcccgggtccgaggtattgaagtcaccggcgatgacctgcacgggtcccgtcccctccatcgcgtcgatgatggtctccgcctggtccagccgcccgccgagcccgacgatgggcgtggcgttgtgcacggaggccgtttgaaccagggtcccaccgatgtccaacgtcgcgaggaccgcgatgcggcggcgctgatggtacgggtcgtcatgtggaaggtggactttccggtccgcgacgatgggccaccggctcaaaagcgcgttcccgaagtcgtcgtcgtccacctgcacggaggcagggtagtagacgtaggccaaccccagctcacttgcgatgcggtcgacggacgcggcgtccatctcctgcatcgcgatgacatccgcccccgcgagcggaggccttgagagcgcggtgatggcctcggtgaccttttccgcgaaggacaagttgaacgtcaccacggtgatggaagcgggcgcctcggaggagacggtatcaggcttccgatggtcgccgctgtaccgggggccggcctcatcggtgtagttctccgcgagcgggcatcccgtcaggaacgtgagcaggagaagcgcccacggcggcgcgatgcgcagccgttggaggtagccaggctgccagacgccttctctggcgccaggcgcctccgccgcggcgtcgcgtgcgttgttgcatttcaaggacccgtgcatcgcgccactgaacgaagcagcgccccagagattccttccaccgcagcgccgacaccgcaccgctccctccaacgggcgcagagcaacagagggagtgaacgccttgatggagcaaccgcttcatggcccaaaccaaccaggcagccggatgcggtgcttgcacagatgcactcagtcacctgcggagtgagcccagtcctccacctcgctcgcggcggcacgaatcaccgcaagtacggcacggcagcggggcatcagcggccaggatgccgttgacgccccgcccttcccgcctacttcttggagctgctgcgcaggtaccggtagaactcggactcgccgcccaggaacagcgacgtggagctgtccacgacgtccgggtaggcctccagcgtccgcatgaactggtagaactccgggtcccggccgaaggcctccgcgtagatcttcgtcgcctcggcgtccgcggcgccggtgacgtcctgggccttgcggtaggccgccgagcggatctccttcaagtcacgctcacgctggccccggacctccgccgcgcggcccatgccctccgagcgggagcgctcggcgatgcgcttgcgctcggagatcatccgctcgaacaccttcacctggacctcgtccacgtagttgatgcggcggatctgcacgtcgaccagctccaccccgaactccttgacgatctccgcggcccgcagccgaatctggcgagtgagcttgtcccgcccctgggcgacctgctccagcgactccgcccgctccgtctcggcggtgtactcgtcgtcctcgaagggacggttcgtggagcggaccgcctcaatcagcgcgaacgacgcgatggtgttgcgcgtctcaccgtcgatgatgtcgtcgagccgggactgcgcgttgcgctcgtcccgcaggcgctgaaagaagcgcagcgggtccacgatgcgccagcgaccaaaggtgtccacccagatgtacttcttgtccttggtgggtatctggttcgggtcaccgcgccagtccagccaccgcttgtcgaagcggttcaccgtgtcgacaaagggcatcttgaagtggagccccgggtctacgacggacgcgcccttcggctcgccgaaccgcgtgatgacggcctgctcgtgctcgctcagggtgtaggtcgcggagaagcccagcaccacggccaggacggccaatacgccaaggggaatgacaaggcggctcatcggcggccctccgtctggctcgcgctcccggacaccgcggggtcggtcgcctgcatgttcaacagcggcgtgagccccttgacggactcatccaagacgaccttctgcccggcgctccggagcacctggctcacggtctccaggtacatgcggcggcgggtgacgtccggcgccttgcggtactcctcgtagacgcgagcgaagcggtccgcctcccccttggcgcggttcacacgctcaatggcatagccctcggcgctgcgcagcgccttctcggcctcgcccttcgcgcgggggatgaaccggttcagctcggcataggcctcgntgatgac

SEQ ID NO: 737 - DNA, 6155 bp, Myxococcus xanthus
cgagctctcaggcggttcggagctggccaccacctggcgcagcagcgacccggcgctgggcatccactcctccgccgcgctgtccatgctgccctacaacctggagcaggagggtgacgagcgcgccctcttcccccagggccggctggacgcggacctgcagcaggtggacctgcgggacatgaactcgtggcgactgcggctcgccgatgtccagacggcggagatgctggaggtccacctcatcaacgcggtggcgcccttcatcctcgtcgggaagctgaagccgctgatgctcagggaccgctcgtcccccggccacgtggtgaacgtctccgcgatggagggcagcttctcgcgcgggacgaagacggacaaacacccgcacaccaacatggcgaaggcggcgctcaacatgatgacgctgacctccgcgccggactacgcccgcgacaacatctacatgaacgccgtggacaccggctgggtcaccgacgaggaccccgcgcagcacgcggagcgcaaggtgcaggagctggacttccagccaccgctggacatcgtcgacggggcggcgcgggtggtggaccccatcatcgcctcggagaacagcggcgagtacgtctggggcaacttcttcaaggactaccgtcacaccgcgtggtgacacgcggaccgggggcgtcatggcaacccgcagtctccgcttcgaatcgtacgtggaggtcacccccgctgaagcctgggcgtgggtgacgtcgatgaagggcatctccacggagatgcacccgtatctgcggatgacggcgcctccgggcgtggcgaggctcgaggacgtgcccttcgagcctggccaaccgctgttccgcagcaagctgctgctgggcggcgtgctgccggtgggctggtccgacgtgacgctgcgcgagctggagccgggacgccgcttcgtcgaggagtcccccatgagcacgatgcgtcagtggcggcacgagcgccgcatcatcgaagcgcacgccggcgtcgacatcatcgaccagctcgacttcgagccccgcttcggcggccggctggcggaggccttcatccggcgcctcttcgagcaccgccactcggtgctccgccgcgcgctgacgccgtcaataggtggacgggcgtcccaggaaaagccagcctagcgggacatgagccccgaacagttccacgtcgaagtcctcaagctgctgctccaggtcgccaccgtcgatggccgcgtcgcgcactccgagattcggcacatcctggacaccgcgcgaggcatgagcgtgcccctgcaggagctggccgcgctgacgcgctgtctgcagaacaacgagcccctgcctccgccgaacatgggcatcctgcgcgccaaccccgccgccgtcatccaggaggcgaaggcgctcatcgccagcgacggcagcgtgcacgcggccgaaatcgagatgctgcggcagattcgggagctgctcggcgtcagcaactgacgtccgccgcgcgcgctacgactcggcctccggggcctccagcagcttgtagagcgtcttgcggtccacatcgagcaggcgcgccgcctcgctcttgttgccgcccacgtgctggagcacctgcgcggcgtagcggcgggacagctcggccagactcggcatgtcgcccgccaggcccgccatcttcggggtggacgcatccccgatgggctccgggaagtcctggggccccaggacgcccgtcacgttgagcgccagcgcccgcgccaccacgttctccaactgccgcacgttgcccggccagtcgtaggccgccaggcgcgcgttcgcctccgacgtcaccaccggccgcacgccgccgcgcgcatgtcgcccggcgaagtgctccaccagcgcggggatgtcctcgctccgctcccgcagcggtggcaggtgcaggtgcaccacgtccaggcggtacagcaggtcctcgcggaagaggccttccgccacccgcgtcttgaggtccttgttcgtcgccgccaccacgcgcacgtccaccttgacggggacgctctcacccacgcggcggatttcgccctcctgcaacacgcgcaggagctgcgactgtaccttcatgccgacgtcgccaatctcatccaggaagagcgtgccgccgctggcctcctcgaagacgcctcgccgcgcgccggacgcgccggtgaagctgcccttcgcgtggccgaacagttcgctctccatcagcgactccgtaatcgcgccgcagtccacggggatgaagggcccgttcatgcgcggcgagcgcttgtgcagcgcgcgggccaccatctccttccccgtgcccgtctcgcccgtaatcagcactggcacgttgctggccgccgcgcgcgccacgtgcttgtacacctccagcagcgccgggctgcggcccaccagcatcagcgaaccgcgctccacctgctggcgcagcgagcggttctcctccaccagccgcttctgctccagcgcccggcgcgccacgcgcagaatcgcgtccacgtcgaagggcttcgccaggtagtcgaaggcgccctgctggatgctgtccagcgcgccctcgatgttgccgaaggctgtcaccaccaccacgggcgtgtccggcagttgcgccttcacctcatggagcaccttcagcccgtcgcccggctcgggcatggccatgtccgtgaggaccaggtcaaaggcgccctccgcgatgcgctcggtggcgcggcgcgggtccggagcctgcgtcaccgcccccagcggccccagcaagcgctggagcaaatcgcgggcctgcgggtcatcatccacgacgaggatgcgggctgagctcatgttccgaccttgcgcattccggcggaagcagtcgttgtctgagaaccgctggtgcccgccgccgggcgcaccacgcgggggaagcgcaccaccacgtgcgttccctttccttcttccgagcgcaccaccagcgtgccgccgtgcgcctccaccacgcgcttggtggtgaccagccccagtccgtggcccggcagcccgcgcacctcaggcgcgcggaagaagggctggaacagtgaggcctgggtgcccggcgccatgccgatgccgttgtccacgacctccagcacggccatgccgtcctcggtggccacgcgcaccttcacccgggggtcgggccggcccgccgagtacttcaccgcgttggtgagcaggttgcgcgcactcacctgcaacaactgtccggggcagtccaccgccacgccgggctccagctcccgctccagcgccacgccctgcgccgccgccgtctgcgccacctccagcaacacggtggtgacggccgtgtccagctcacccaccgtactctcgccgcgcgtaccggcgcggcagaagcgcagcagcgcctcgatgagctcgcccatgcgaacagcgctggactcacactgcgccagcatctccagcgcgcccgcgtcgttcaccgcgccggtgcggcggatgagcgtcaggtagcccttgagcggcgccagcggggagatgaggtcgtgcgccacgcgccgagtgaaggcgtccagttcctggttgtgccggcccagctcctccaactgcccttggatgatggcctcctggcgcttgagcagcgaggtgacgcgccagcccaccagcgacgacaggaggatggccagcagcgtggcacccgcgcccagggcggtgttgcgcacgcgcatgtcctccaaccggttcaccagcctgcgtgcctcggccgcattttcctcctccagcgcgccgcccagtgcgtccagctccgccgccaacgggcggatgcgctcggccaggtggagccgggcccgctccgcctcgcggcgctgcgagaagatggccgccgcgcgcacctggtgccgccagcccctggcacgcggcgttgaagcggtaccacagcgccttctcgccctgcgggaggttgcgggtgtacgcctccgacgaggcgcggatgtccgccaggatctgctccatcaccgcgtccgcggcgcggcgctcggcgtcacccgtggcgcggacatgcgcctcgatggcggcctccagcgacagcgcgtccacgcggatgcggccaatggagccggcccgctccagcgcctcctgcaccaacccgtccacctggctgcccgtgcggacttccgtccacaacgtgaaagcagtgacggcggacagcaggacgaccacgaagaagaagccggcccggtagccgcggatggggatgcgggagctcgccacgccgttcctctatcacggggccagcgccgcgcgtccggcgggacttcagggcgccgtcggggcgacgttcccggccgccgggggggcagccggctggggcggattgttcaaccgccgccgtgcacgctccagcgcggactcgtaccagacgtccgacagctcctcgtgcatctccttcagctccttcagttcgttgacctcgcgctccagcgccagcaactgggtgttgtgctcctccagcgcgtgccggtccgcctcggtgcgcaccaactcttccagcagcgccgcgcgcgcctgctccgcttccgcgcgctccagcagcacccgctccagcgcggactccagttgggccatgcgcagcgcgaacgcctcggtccgctcccgctccgcctcgtactcgcgacgccaccggtccgcctcgaggacctgggcctccagtcgctcgagcggaatacccgtcgcgcaacccgtacccaggacggccaacgctgtcgcgaaacagaggaaccgcatggaccatctctcccacaccatgaccgcgcgacatgcgcggcgaaggtgctgggccgacaccctgcaaccagatgacgcgcgcagcttgctcaagtgctccgtcatcgtcaaagcagcaactgcccgtctggggagcctgcccccattgtcggagctccaactgcggagtttctccccacggacatccccgcaagatacctgctctccctctgacaacgctgctggcacgccgcctgctcaatccctcgctcgctgggacggcgcaatctcgcgccgtcgttcgtcaacggagcttttcatgaagaccgtgttcgccgccgccctcctcgccgccgccaccgcgttcgccaacaccccggcccccgccgagcccgctgccgaagccaagcccgccgctgtcgaagccaagctcgaggccgccgaggcgccccaggccgaagaggcgaaggccgaggcggcccccgaggccaagcccgccaagaaggccacgaagccggcgaagaaggccaccaaggccacctccgcttccgaagcaaagtaatcaagatttacggctttatagccggcacgcgggggtacctcttccaagggaggtacccccgttgcatttgcgggtccataaaaacccgctttgcctcgatttctgagatgccctctcgaaacgtctatcgaggtccgagaaaacccatccgggtcaggactttcgcacacccgtcaatccgtccagtgaacgtgagatttgacagaaatagaagaaacctgcttaatatgacttcagagaatcactgactgtcccggatagggacggaactcaaacgagcgcaccaatgatcgaagccttctcgaaggtgtcggaagcctcgaagctgctgctggagaagggcctgggcccgagcaccggcatggaggcgctgcgcatggtgggccacgcgctgggcgtggaccgcgcgtacatcctggagaaccgcgtgcagggcacgtacggccggttcatcacggacatgcgccacgcctgggcggagccgcccacgccgtcgccgctggccaacccggtgatgcgggccttctccttccgcgagttcgcgccgggctgggtggacatgctggaggccggcatggtggtggcgtgccccacccgtgacgcgcccccgacgataaaggatttgctggagcgccagggaacgcagtccatcctcctatgccccatcaacccctcccggcagcagtggtggggcatggtggccttcgaggactgccgccgtccccgcgcctggaagccggaggaagtgacgctgctcaagtccctggcgcgcgcggtggcggcgtccgtccgacatgggcagatgc

SEQ ID NO: 738 - DNA, 6289 bp, Myxococcus xanthus
ctttcgtgtgctctaaggacgcgccaatccgccggccccagggattccacctggatgtccaccggggagaagacggagctgaagctcagcgacacgcgcttcatggcgcgctcgggtccggccaccttgagggcaattcccaccaccttgcccaccagggtgtcgaagtagctgcgcaccagctcccgccccagggtccggtaggccgacttacggtccatgcccttgtagcggtagcgcaccgtcgcgtcctgacaacccacgaacacggccgccggataggtggcgcggggcttgtccatgtcgaagcccgcggccaggaactcggcctggagcttcgcgtcgggttgcgccaggcggaccagggattcgaacaacgttgattgaacagtgacttcggctggcatcggtggcgcggcaccctaggggagtcaagcggtgcgggaaagcggatgcaccggcggtgtttgactcgccaacgttctcgctcagtcgccgcgaaggccgccgtggtcaggcagttggagccgggccagcagcctgggcggcatccccagccccacgggcgtgaagtagacatggatgcctcacatcactcccggtgtctcagtgagtgagaatgattcatccgatccggcggcgaagccgtgcttgtgacatgcggcgacacacgcgtctcgtgcgtcgagaatccggagcaacggcccgaagtcgctcccagcggccgcgttccgaatcatgacggaagtcgcgcactggcaaagacgcaagggacacggcggagccccacaagtgtcagacagtcctgagaggatgtccccgggcgccaatgccagagggggagacccgcgcgacatccgtaacaggaattgggtgaagaaacctggccttgagcgttttctcaccggattgagacgtcgtgtctcagagggaacgcggctgtgacacatgctgtaacccattcatacacaaccaatctcgagagttaagaatacagccttggctttacgagcaatccgctattggcgtaggttttagatatgagcgcagtgtccaatattgagcacgaccccatcgcaatcattggcatcggctgccgctttccagggggcgcgaagtcaccacgccacctctgggagctgctcacccagggccgctgcgccatcgtagaagtcccgaaggagcgctgggaccaccgccggtactacgacccggacccagacaagccaggcaagacgtacgtgcgggcgggaggcttcctgcaggaggccatcgacacgttcgacgcggccttcttctccatttcgccccgggaggcggcgacgctcgatccgcagcagcgtctgctcgcggaggtggcgtgggagagcctggaggacgcgggccttccggcggacaagctcgcgggcagccccacgggggtctacgtcggcgggttcatgctcgacagcatgctcacgcacatggggccgatgaaccgcgagctcatcggaccgcacacggcggtgggctcgacgatgacggtgctctccggccgcctgtcctatctcttcaatttccagggcccgagcctggtggtggacacggcgtgctcatcctcgctcgtgtcgctccacctggcttgccagagcctgcgggcgcgcgagtgcaacatggcgctcgctggtggcgtgaacctgattctctcgccgcagtccgtgcagctcgtggccaagctccaggcactcgcaccggacggccggagcaaggcgttcgatgcctccgccaacggcttcacccgtggcgagggctgcggcatcgtcgtgctgaagcggctgtcggatgcgctcgcggacggcgaccacatcctggcgacgattcgcggctcggccatcaaccaggatggcaagtcgacagggctcaccacgcccaacgtgctctcgcagcaggccctcatccgccaggcgttggacagcgcggggctgaagccggagcaggtgagctatgtggaggcgcatggcaccgggacgcccatcggtgaccccatcgaggtggaggcgctgcgcgagacgtacggtgcgcctcgcgcggatggtggcgtgtgtggcatcggttcggtgaagacgaacctgggacacctggagtccgcggcgggcgtggcgggcatcatgaaggtcgtcctcgcgatgcgtcaccagcgcatcccggcgcatttgcatctcaagcaggtgaacccgcgcatccagatggagggcagcgcgctcaccatccccacgcggctcaccctctgggagacggccgccggacagccccgccgcgcgggcgtcagctcgttcggcatcagcggcaccaacgcccacgtcatcctcgaagaggcgcccgctccggcggcgaaggaggcgctgccacagcggccggagctgttgcccctgtccgcgcgcagccgtgaagccctccagtccctcgctgagcgtcatgcggagcgcctgggccgcggtggggcggcgagcctctctgacgtctgctacacggcgtcgtcccaccgcacgcatcacacccaccggctcacggtgctggcggacgcccccgagcgcacggtggagcggctccgggccttcgcgcgaggcgagctgcccgagggcacctggacggggcgcaaggcgttcggcgctcgccggaaggtcgtcttcgtctacccggggcagggcgcgcagcgggcaggcatgggccgggcactgatggagcaggagccggtgttccgggacgcgctcgtccaggtggacctggcgctgcggccccatctgggctggagcgtgctcgacgaaatcgccgcggacgagcagcgctcgcgcctggcggagatcgacatcaaccagccggtcctcttcgccgtcgaggtagcgctgacagccctgtggcgctcgtggggcatcgagcccgacgcggtgatggggcacagcatgggcgaggtcgtcgccgcgcacgtcgctggcgcgctgagcctggaggatgcctgcctcatcatctgccaccgcagtaagctgatgcggagcctgggcggccgaggcgcgaccatggcgctggtcgagctgtcggtggaggaggcagaggaggccatccgtccctggagcggcaagctctggctgggcggactgaatgccccccggtcgcaggtgctgtcgggggcgccggaagcgctccaggaggcagtcgcggcgctggggcagcgcggtgtcttcacccgctgggtgaagatggacgtgccttcgcatacgccgttggtggaggtcatcagccgcgaactggagggccgcgtggcgcgcatctccccgcgtgccgcgcaggtgcccgtctgctccactgtgacgggtgagttcctggatggtacgaagctggacgccgcccactggggcaacaatctccgcctcccggtgcgcttcgaggcggcgacacggcggctcctggcgagcgagcactccgtgttcatcgaggtgagtccgcaccccgtgctgctcccggccgtcgagcagaccctgggcgccgcggacgcggagggcgtggtgctggcgtcccttcgccgtggagaggacgaacggcacacgatgctgtcctcgctcggcgccctctacgcgacgggccaccgcgttgcgtggaaccggctgtacccgagcaagggccagctcgtgccgctgcccacgtatccctggcagcgcgagcgcttctggatggagtccgtgtctcgtgcagcgcggacgtcgaggtccacctcggggcatccgctcatcggtgagcgcatcgacctgtccgcgcagggggatgtctcccggctgtggcaggtgcaactgggcccgaagcacttcccgctgctgtcggagcatcgcgtccagggtgtgcccgccttgcccgcggcggccatggccgacatggcgctgagcgcggccagacagacgctgggggcgcccgtatccctggaggaggtgagcttcagcgcgctcatggcgttcccggaggacgaggaacgggtgctccagttgtggctctccacggagcgttcaggtccgcacgcgttccggctcttcagcgcgcccgtgcttcgggagacgccgtcggatgagttgaactggacgctccacgcggaaggcacccttcgccagggcgactcggccatcgcggagcccgctggactggaggcgttgcgtgcgcggctgagtaccccggtgtcggtggatgcgcactaccagggccttcgcgacatcggcctggactatggccccagctaccgcgttatcacggagctctaccgcgcggagggtgaggcgctgggccgcgtgcagctcgcgggcgagcggacggcagaggacgcccggtacagcctgcaccccgcgttgctcgacggttgcttccaggtcctggcggcggcgttgggaggcgtggacggcgaaggcggcgtgtatgtcccttcgtccttctcccggctgcgcgccctggctccggcggaggccgcgctctggagtcacgtccgcatcgtcaatggggccgcttcgggggcgagcgccatcgagtgcgacgtcaccctcctggatgaccagggacgggtggtggcggaggtgcagcggctggtctgcaagaaggtctccgcgggcagccagcccgtcgatgacgtggaccgctggacgtactccgtccagtggcagccgcagcctcgcgtggctcgggaggatgccgtggctgggcggggtgcgggccggtggctcgtcttcgcggatgcgcgtggcgtcggacagtccttggcccggcagctcgcggagcacgccgaggtcagcgtcgtggtggaggcgggggctgcctacgcgcggctctccgaagaccactatcgcgtcaacccgtcgcgcctggaggacttccaggcgctcctccgagacgccttcagcgagcagtcgccgtgcaagggcatggtgcacctgtacgggctcgacgtggcgtccagcgtggcggagccagagaccttcgagcaggccgtgacgctgagcgggaccagcgtcgtgtccctgctccaggcgtgggcccagcggggctggcgcgacgcaccgcgcctgtggctggtgacgtcgggtctgcacgtcctcgcccgggattcggcgccgggtgctccggcggctgctcctctcgcgggcctcgcgtcagtcatcacccatgagcacccggagcttcgctgcgctcatgtggacctgagcgcgcagccgtcccccgaggaagtcacgtcgctggccgcggaactcctcgcggacagcgcggaggaccggattgcgctgcgcggcggtcagcgccacgtcgcccggttgggtcggggtgtcgctggtgggaaggcggcggagccccgtgaactctcggcggaggggacgtacctcatcaccggcggcctgggcgggctcgggctggaagtggcgaagtggctcattcaacggggcgcccggcacctggcgctcaccggccggagcgcgcctaccgacgaggcgaaccggacgctgggcgaactccggacgagcggcgccgatgtgcgcgtctacgcggcggacgtcacccgcgccgacgacgtgacgcgcctgctggcttcgatggatgcggagctgccgccgctgcgcggcatcgtccacgcggcgggtgtcatcgccgacggtgtgctcgcgcagctcgacgcggagcggttccgcacggtgctggcgccgaaggtccagggcgcgtggaatctgcatgcccagacgctgggccgtccgttggacttcttcgtgatgttctcttccgccgcgtcgatgctcggctcgccgggacagggcaactacgcggcggccaacgccttcatggatgtgctcgcgcaccaccggcgtgcggcgggactcccagcgttgagcgtcaactggggcccttgggccgacgtgggcctggccgcggtggcgacgaaccggggcgaccgcctggccttgcgcggcgtgggcaacatgccgccagcgcaagccctggatgcgttggggcgcctgctggcgaaggaggccgcgcaggtggccgtggtgccgctcgacctgcggcagtggcgcgagttctacctgagcgcggcgcagtcgcccttcctctccgcgctgatgcaggagcgggtgagcacgccggcttcgcgcaaggggaccgcgcgggagatgctcgcggcggcggagccttcccagcggcggggattgctggagggctacctgcgtgagcaactgggacgcatcctccgcatggagccggcgcgcatcgaccccgagcagctttagagaac

SEQ ID NO: 739 - DNA, 4761 bp, Myxococcus xanthus
ctctaacgggcgacgcagggctatgcgtcccaccgtaccttgctgaaggacggtgaggcgtgcccgttgtgtggcgcggaagagcacccctacgcgcgcgaggtgtccgcgctcgatgggctggtcgcggaagcagcttcgcgcgtggagacgctggagacggagcggaccgcggccacccaggcggaggtagcggcgagcgctcggcgcgcggcggcgaatgcgcgcaccggacaggcggaggcgcgcaggcagtccgcggaggcccgcgcggaggcgcacggtgacgcctggcggaaggggcacaccgcgtggctggagtccatccgggaagagggcgcggaagtgtcctcccgtaccacctccgtgccggagtccgatggcagcgctcgaaggtccagtgcggacgggggagccgaggctgcgcggtcgtcggcgcgagccggaggcgctgatgcgtcgccaccggccgcagggggttcgcccaaggcgggcgcgtggctcgacgcggcgcgtgccgaggtcgcggagcggcttgcggcgctgaaggccgacgagcaggccgccgagtcactggcccgcaccgcgcgcgaggcccgcgcggcgctggagacgcagcgtactcggcgcgaggtggcggcggagtcgctgcgccgggcggaggaggcgctgtcgcgcgcggagtcggtgctcaaggacgtccatgtccggctcgagaccgcggagcagacgttgcggcaggtgctcgcggaggtgtcacccgtcttcaccgcggacgtgggctgggaccggaagctggaggaggacccggccaccttccgccgcaagtgtggagagcgggtggtgatgtggaaggggaagaggaggcccggctgaaggcggaggagcgcgaggccgaggagcagcgtcatcgcgcccgggcgcaggggctggtggaggtgagcacccgccacgccgaggagcatcaggccttcgccgtgcgcaaggagcaggagcgcggcgagctgacccgcgcacgcgcggccctgttgcacggccgtcccacggtggaggtccgcgccgagctccaggcacggctggaggccacggagtcggccttcgagcaggcacgtgagcgcgcggaagcggcgcgtcaggcggcgcaggtcgccaccgcgcgtgccgaggatgccgtgcgcgccaggacggaggcgctggccctgcgtgagtcggaaggcgccgcgctgacaacgctgctcgccgcgcatgggaccacgctggaggccgtgcggacgctgctggcattcgacgcggcctggcgcgaagcagaggctcgcgcactgtcggccctgcgcgaggcgctcgcccaggcgaccgccgtgctggcggagcgaagcgagcgtcgcgcgcggcacgaggactccggtcctccgtcactctccgagcaggacgcgggcgccgaatgcgagcggctgcgcgcggaggtcgaggcccgtcgtcatgccgaggccgcgctgcacgcgcgcctggtggccgacgacacggcgcgggcgcggcatggcgccgaggccgcggccctggaggagggccgccgcgcggcggaggtgtggaaggtgctgggcgacctcatcggctcgcacgacggcaagcgcttcaaggtcttcgcccagagcctcacgctggacgccttgctgctgcacgccaacgcgcacttgcgggagctcgcgcggcgctaccggctgatgcgcgttcccggacacgacctggacctccaaatcgtggacggggacatgggcgacgaggtccgcagcgtggccagcctgtccggcggtgagagtttcctggtgtccctggcgctcgcgttggggctggcgtccctttcgtcggagacgacgcaagtggagacgctcttcatcgacgagggcttcggcacgctggacccggagacgctggaggtggccctggccacgctggacgcgctccaggccacgggccggcaggtgggcatcatctcgcacgtcagcggcatggcggagcgcatcggcgtgcaggtgcgcgtggtgaagcagggcggcgggcgcagccggctggtggtggagggcgacccgggcatggtgcctccttccatgggacagcaggaggtggcgtagcggcacctcgcgggctcaggtctccatcagcccgcgcaccaccgcggccacggccaggggcgtggccacgcggtcatcgctcagcggcgccagggcccgggcgaactgctccgcggagccgaagcgctgcgaagggacgggcgccagcgcgcggtccagcaccagcgccagcgcgtcggggacgccgggcacacgcatgcgcacgggagtcacccggccgccgcggatggaggactccacctgctcctccgggccggaagggaagggcgactccagcgccagcagttcgtagagcagcaccgccgtcgcccacaggtccaccgccacggacacgtcgcccgcgagcagttccggggagcggtagtgctgcttgcccagccgccggatgtcctgcaccgcgcccgcgcgggagcgcgccacgccgaagtccgccagcttcacctcaccggtgcgggacagcagcacgttgtgcggggacacgtcgcagtgcaccacgcccagggggcggcccgtggtgctgacggcatggtgcgcgtgcgacagggcctccagcacctgccggacgatgagcacggagatgtcgatgggcagctcgatgcggcggcggcggcaccgcgccagcacgcggcccaggtcggggccttccaccagctccagcgccaggtagccaccgtccggcagctcgccgtactccacgaagccgacgatgtacgggtggcgcaggcagcgagcgagctcggcttcgtgcaggagctgctcgtgggcctccgcgtctctcaggcgctcgggacgcacgcgcttgagggccacctgcgctccggcatgtgggccctgctgcatccgcgcgagaaacacctccgccatgccgccgcgtcccagccgggacagcagctggaagcggccatggtcgcgaggccagatttcccgcacgttctccatcacgttcagcccacgccacccgcgaggctcgccaggtagtcgtccagcgtctgggagaaggtggcgtcgtcattgaggaacgccaggcccacgccgcccgtgtacgggtcgtccaccacgtggaccaccaccgcgtcgccctgcaggcgttcgccgttgggcagcttcacgtccacggtgacgacgctgtcgggcaggggccggtgcgcggtgcgcacgaagaggccgccgttggagatgttgagggcgtgctcacgcacgaagtccaactcggtccggaactccatttccagcttcacggcgaagcggcgaccgcgacgctgaggcccctccggcgggcggacgagcacctggtgatgtgggctgctgggagagggagcgggcgcctccacgggcttcgggctcggttgaggcacggaggccgcggcgccacccacggtgggccccgcgggacgcacgctgctgacgggcagcgtggtcaggtgctgctgaagcacccgcgccgcggcggagcattcgtctccccggaaggtggtgccgcccccgaaggccgccgcgcgaaaagcatctcgctccgccttgggcagacgccacagctccacgaacgtgccgccgctgcgcttcgcgtcctccgcgagccgctccacggcggagcgtggatagcctggcgcctccaccttcaattcaatgcctgcttcctcggggcgcagggccaccacgagttggagtgactgcgcggaggtgagcacctcgccaatcccttccacccaggctgccacgcgctccgggggagccgagccattccacaatgccgcaagaccgaagacgggcacgggcgcgacgatagccgacccctctcaacccgcgaaccccgtttaccaacagcctgggcgcaatccagccacgtcactggactgggatcatccagaccccgactcagagttgccccaggggaacaggtactcggaaactcccgcgttgttctctattatggaagtctgcttcgactcaccccccacttggagtcggagtcattggagtcaaagacgatgcgcaactccctgatgcggtatttcacctgcgcgttgctggcagcgtcgttgctgactggctgcggcggtgggaaagaccctgaccccaatccacaaccggacaccgatgctggccccggcggcaacggggacggcggtacggatgccggcccaattgaagaagacgcgggcgtgattccggatccggacccagacccgggtttggtgcccacggatatcgatgaccctgacaactcgacgaaggactccgactgtgacggcctgacggacgcggaggagttcgcgaccatctatcccggcggcgcgaagacgaaccccggcctgcgcgacacggatggcgacggcatccgcgacggcgtggaggtgggccgcacctcgagccccgacccccgctgcaacttccccggtgaccaggacacgaccacgcgcacctcgccggtgttggcggacacggacggcgacggcatcccggatggcctggaggacctcaaccgcaacggccggagggaccctggcgagactgacccaaacgccatcgactcggatggtgaccgcctgtcagacggtgcggatgacgccaaccgcaacggtgtggtgagccctggtgagacggacccgcgcaagcgcgacacggatggcga

SEQ ID NO: 740 - DNA, 6201 bp, Myxococcus xanthus
cgcgcggcttttgttccgggggctggcccctggcgctgccccgggggccccaccgggggctcgtgggggaggtccgtgccacgtccgcgggcagcgcgctggagctgcatgacttccgtgcgtaccagcccggggatgacctgcggcaggtggactggaacgcggtggcacgcacgggggagctcgtgctgcgtatccgccaggacgaggtgtcgccgcgcgtggaggtcgtgctggatggctcgcgctccatggcgctgtcctcgcgcaaggccgcttgcgcgcgggaagtggcgctgctgacggcggaggtggcggcgcggcagggactgacaccgacgttgctggtggccggtgcccggccggagcgtgctcagggacaggcgtgccgggcggccttggaagcggcggacttcgacgcgcgggacgggctgccggagtcgctggggcgcctgccgccgctgcggccgtgtgggctgcgcgtggtggtgagtgacttcctcttcgaagcggacctgccggcgatgtgcgcgcggctggcgcgtggcgcgtcgggcctcttcctggcgcaggtgctggacgccgaggacctggaccccgcgggtggagatggcgcccggctggtggattcagagagcggcgcggcgctggaggaattgctgacggatgaggtgctggccgtgtacacgcgccgcttcgcggagcatcagcgcggcttgaggggcgcggccttgcgtgctcgcggggcgctgctcaccgctcgggctcaggacgggctgggcgcgttggtggcggggccgctgcggcctctgttcctcgcggcgggtgcgtcgtgagggggcgctgggtagcgggcagggagcgcatcgcgggaggtgacgcgtgagcttcggcttcccgtgggggctgctggcgctgggcgcgctcgtgccgctggtggcggcgtatttcctgcggcgccggcagaagccggtggtggtgagcgcgctcttcctgtggcgcaggcccagtccccgcgccgaggcggggcctcgctgggagcgcttcacgcgggaggcgtcgctgctgctggaggtgctggcggtggtggccgccgcgctcttcctggcggacgtccggtggggggatgcggcgcgggttcggcacctggtgctggtggtggatgggagcctgtccatgtccgcgcgtgggccggacggtgtgacggtgttggagcaggtgcggcgcgaggcggcggcgcgggtggagtcggaggaggcgacgcaggtgacgctgctggccagtggcggcacgccgcgcatgctcgcggggccagaggcggagccttctcgggcgttggccgcgctggagtccttccaggcgcagggcgcggaccatgacccgatgcccacgctcatctgggcgcaggaattggcgggggcgggacggcgcgtggccttcttcacggatgttcctccagtgaacgcggccctggtgcccgcgtccgtgcggtggacggcgctgggggccgcgcgaggcaacgtggcgctggtctccgcacagcggcgcgatgaggggcccacggccacggtgacgctgagggtggcgcgtttcggggaggcgccggaggaggtggatgttcgggtccgcgcgttgccaggggccggtgcgaaggccggcacggagcgggtggaacgcgtgcagctgccggaggagggcaccgcgacggtccggctgacgttccaggaagcgggcgatgtggaggtgtcgcttcctgacgacgcgttgcccgaggacggccaggtgcggctgccgcccgcgcccatgcggcccatcgcggtggcgttggcgcagggactgggcgctcccgagcagaccgcgctggagcggttcctcgcggtatcgccggaggtggcgcgcggagtggagggctcggcgatggacgtggtgttggtgctgggcccgccggggacggatgcgcgggtgacggtgggggcgggcggctcgccgcgcacgttcgtggggccgttcttctccgagaaggggcacccgctgctggatgacgtgcagttggcgggcgtgcggtggacggcgggggacaatccgcctggaaagccactggtgagcgccggggacgcggtgctggtgtccgaggaggcggacggccgggttcacgtcaacgtggacctgtcgcgttcgaacgtgcagcgcgtgtccgcgtggccggtgctgctgagcaatctggtgcgcgaggcccgccgcacgcgggagggttttcctcggcggcagttgatgctgggcgagccgctgccagtggtgactctcgcgggtgcgcgttacgcgctcgtggggccgggtggcagccggccggtgtttggcgcgggcgaggtgacgctgtcacctcccaccgggcctggggcctattcgctggagcgtgacggcgacgtggtggacacggcgcaggtgctggcactggacgcccgggagtcggacctgcgtgagcgcgggcgcgcggaggtgccggcacgtgaggccggcgacgacgacgcgggaggcaacgcgccgggccgggcccgatggcctctggttcttctgctcgccgcgctggtggcggacttctacctcacgcggcgagagccgccgggcgcttcaggggcgagtgcgccaagtaccgggggcgcgtcatgagcgcgtcggaatcgcaaagcacgggccattgtgccagcaggacggcaggtgccgtgaatgtccgggcgtacagtcgctcgcacttcaaggcatcatggctgctcatcggtggtgcctgggttgccgcatgctccagtccgaacccgaacgtgagggcccgtcggttgccctctggcggcatcgcggtgaaggggcccctggcagggcctttcgagcaccgagcaggagcttgcgcagaacgcatgttccatcatgacccgtcagcccggcgcatccgcggggatgtacggtacggagtactgcgctctcgggtactactcaggcgagggaaagggatacttcctgagctacctgtccgagttgaggtcacgcttggacagtggaaggaagagctgcctgattccgtcggcgctcgacgatgaagcgcatggtgatgcggtggtcttctgggcgccgcacacgcatccgcacaatcgcgagttctcgcgagtcgacctcaagacgcatctgcgctggctgccgacgcgcgtggcggagaaaggcacgggtagggcctttcccaagtccatcctgctcctctaccgggagaagacaggcgagtgccgggtgtatcggtatgagcttccgtccaaaggtgtcttcgcgctccgcgacggagcgtgggtaccgattggccgagtctacgatgacgaaggaaacgtcgagatgctcgacgggatggggtggctgccatgaggtgctgtcacgatgggggagcctccctgcgacgggcgttggcctggggcccacttctgggcctctgcgggtgttccgcgctgggcatctaccgattcgacaagccggagagagcccctgcgaatgagtcggtgacgattccgagccagattgagggtggcgtggcgctgaccggacccatgatggcggccctcaaggtcgccatggatgattttcgtccaccctgggttacggcggagaagcaggagcacctggaggagaagtgcctcgcggattggcgatacatcgacgctcgtgtggttcaggcgaatgacgacctgttctatgtgacgttctcccccaacttgagcgcgtgtggcccaggccttgttcttctcgacggtggcgtcgtctacgctatcgatgggaagggtcgcatcctcgcggaaggggagtgacgggcgcatgaccttctccctcccgcaggcgtgggtgctgctgctgccgctgggcctcttcctctggaagtacggccgccggccgggcccgcccatgtggctgcgcgccgcgctgctggtgctcgtcgtcggcgcgctctcgggccccgagctgcgatgggccgatgctggcagtgacgtcgtcgtggtggtggaccgctccgcgtccatgcctcgcgacgtggaccgcacggcccaggaactcattaccctcctggagtcgcagcgccgtcccggggaccgcgtgggggtcatcaccttcggccgggaagcgcgcgtggagcagcccctcgccaccctcggaggctttggcggtttcacgcgccccgtggacgcggaggcttccgacctgtccgccgcgttggatgtcgcgagcgccctcatccccgacgagcgcactggccgcgtgctggtgctgtccgatggccgcgccacgggcgtggatgcgcgcggcgccgcgcggcgactggcggcccggggcctctccgtggactggcgccacatcgctcgccccgaaccgccgcttgatgtggccgtcgtctccgtggacgtccccgccgccgtctccgagcgcgagcccttccagttctccgccgtggtgcatgcctccgccgccgtcaccggcaccgtccgcctggagcgcaatggccgcgtgctcctccaggggcccttcgacttccagccgggccccaacgtgctgccgctgcgcgacctggtcgaggagcccggcctggtccgttaccggctctccgtggctgctcccggcgacggcgttgtggagaacgaccagggcgtcgccgtgctgcgcgtggaaggcccgccccgggtgttgctgctcacgaaccagtcccggggcacgctcgcgcagtcgctcgccgcttcggggttgcaactcgacgtgcgcacgccgttccgcctcacgttggatgacctggatggcgtgggcaccgtggtgttggagaacgtggacgccaatgcgctcggcgagccggggctcaacgcgctggcggcctacgtcgagcaggccggaggcgggctggtgatgaccggcggacgcaacagcttcggcgagggcggcttccgtcgctcgcccgtggagccgctgctcccggtgtccctggagatgcgcgaggagcagcgccgcgcgtccctggcgctgagcgtgttgatggatgcttcctgctccatggggatgaccgtcccggatgggcggacgaagatggagctggccgccgagggcgtcgtggccgcgctgacgctgctcaaccccaaggacgaggtctccgtgcacatggtggacacggcggcccatgaaatcttcccgctcagcccggtggaggcggggttgcccctggatgccgtcgcgcgcggattcagcggtgggggtggcatctacgtgggcgaggcgctccgcgccggccgcacggaaatcctccgcagcgagaagcccacgcgccacgtcctcctgttctccgacgcagcggactccgaggagcccgatgactaccagcgcacgctggcccacttgcgcgagcaggaagtgacagtgtccgtcatcgggctgggcgtgccctcggacccggacgcggacctgctccgggaagtggcccaccggggcggcgggcgcgtctacttcgccgaggacgcgatgagcctgccgcgcatcttcagccaggagacgctcaccgtggcgcgcgccaccttcgtggatgagcccgcgtcgctggaaggggcgccggacctgccgctgctcggccggctgtccgcggacgggctgccccaggtgggcggctacaacctcacctacctcaagccccgcgccaacgtggcgctgcgcaccctggacacgaatggcgcgcccatcctggcgatgtggccgcgaggcgcgggacgcacggtggccttcaccgcggaggtggacgggccgtacaccggcgagctgcgaacgtggtcctccctgcgcgcggccctggaggggatggtgcgctggacgctggcgggcgcggcgcccgtcggggacgcggtggtgcggaccgagcggagggggcacctgctgcgcgtgacgctggacctgcctccgggcgaggcgctgcccggcgtggtaccgacgatggtgctcctgcccggcgacggacgcgccgcgccggtggagcgtccgatgcggtgggaggatgaagaccggctcgtcgccgagtacccgctggagggcagtggaacgtggcacccggtggtacggttgggcgcgaaggtgctccgcgcgccgcccgtcacgctgccctatgcgccggagttcgagcccggctccgcgaaggcgggactggag

SEQ ID NO: 741 - DNA, 6375 bp, Myxococcus xanthus
aacacgaaccgctccaggtcgtcctgcaacgcccggcagtccgcgtaccgccgctcccggtccttcgcgagcgccttgtcgagcacctgctgcaacgccacgggcacatccggccgccgcgccgacaccgggatgaacgactcgaacagaatcgcctgcatcacgctcacgtccgtcgtcgcatcgaacggccgcttccccgtgagcagttcgtacagcaccaccccgagcgcgtagacatccacccgccgatccatggccttcgcctggagctgctcgggcggcatgtacgccaccttgcccttcaccacgcccgtcagcgtccggtgcccctgccccgccaccttcgcgatgccgaagtccaccaccttcaccgcgccctgccgcgacaccaggatgttgtccgggctcacgtcgcgatgaatcaagcccagcggctcgcccgtctccacgtcacggaactcgtgcgcgtacgccaacccctccgccgcggccgccaccaccttcgcgcagaaggcggggggcagcgcttcctctgcggcccgcttcaccagcttgcgcaggttcgggccgtcaatgaactccatggccaggaagaagctgccctcggcctcaccgaagtcgaaaatttgcacgatgttcgggtgctcgagctgcgccgccagccgcgcctcgcccaggaacatctctacaaaggccgcgtcctccgccaggtgcggaaggatgcgcttgagcacaagcgtcttctcgaagccgcgtggccccgcggccttcgccaggaagacctccgccatgccgcctgacgcaagctttcgcaccagttggtacttcccgatttgcattgactcgggttctcccaggtttgtcggaaaagtaaaaccacttgccgccagttctgccgtgcgccgagcaatcaggcgttgccaacgttgaccctgacgtgacgtggtccgtaggatttcgacatcccatgcccctgaaggtcatcggtccctaccgcgttctggagacgcttggcagtggcggggcaggaaccgtttatcgggccctggaccgccgcaccaccgacgaggtcgcgctgaagctgctttcagccggccccgcgcgggatgctcgtgccgcgcgcagactcgcccgtgagttcgacacactcgtggacctgtctcaccccaacgtcgtgaaggtgttcgagtccggcgtgcaccagggagtgccgtacctggccatggagctcatcgagggcctcaccctccgccactacctcgacctgagcagcggcgaccggcaaacccctccgggcagccacacgccgcgcagccccttgtccgtcctccggaccgcggacgacgacttcggccccttgagccggagcttctccgattcgatggatgactcggaggacagcccgtttgacggcaccttcggcctggaggccttcgcggaggaggcacccagcgaggacctcgagagcttcgcctccagtgccagcccgcacgtgggcatcggctcggatgattcgctggagggcttcgacctgccgccccccatgccgcgccccgcggagcccgaggaggagccggggcgcgtggtccgcgaagaggacctcaaccggcccgaacgcatgggacgtctcaaggacgccatgctccagatttgcgaagccctggcctacatccacggccacggcctggttcaccgcgacctcaagccgtccaacatcatggtggacgatgaccggcaggtccggctgatggacttcgggctcgccaagttcctggcggacgacgcggccatcaccgaggccggcaagctggtgggcacctaccggtacatggcgccggagcagattctgggcgagcccctggatggacgcgccgacctgtacagcctgggggtcatcctctatgagctgctcagcgggcggccccccttcgacgcgaagacgccgcacgagctctggcgccaggtgctggagacggagccgccccccgtgctggcgctgaaccttcatggggacccgcagctcgcgcgcgtcgcccaccgcctcatccgcaaggagccggacgaccggttccagacggccgaggaagtctacgaggccctgtccgagtgaatccctccaagctgcacaccctcaccgtggacgccgacaaggcgggccagcgggtggacctcttcattggtgaagcgctgggcctgtctcgcgcgcggctcaagcgcctcttcgaggcgggcgcggtgaaggtgaatggccgccccgcgaagaagggcctcacgctcaccgccgggcagcacatcgccgtcgaggtggaagaagagtcccgcgaggccgtgcccgacgcggacttcccgctcaccgtgctgcacgaggacgactcgctcgtgttcgtggacaagcccgcgggccggccgtcccaccccctgcagtccggagaaacgggcacggtggccaacgcgctggtggcccgctatcccgaatgcgctctggcctcgctggacgcgcgcgagggcggcctgtgccaccggctggacgtggagacctctggcgtcgtcgtggccgcgcggacgcgggacgcgtggaacgccgtgcgcgaggcctttggcagccgcgccgtggacaagcgctacctggcgctggtgacagggccactgacggacgagggcgacatcgacctgcccctgcgtcaccacccccggcatccggaccgcgtggagcccgcgccctacggggccgaggacgcccgggacgcggtgtcgaagttcaccgtgctatcgcgctcgggtgagttcagcgtggtggaggtgaagattctcaccggcgtgctgcaccaggtgcgcgcgcacctcgcgggcattggcgcccccatcgtcggcgacagcctctacggcggacgagaggccccagaactgggccgcttcttcctgcacgcccgctccctgggcctgacgcacccacagacgcggcggaacatgacggtccacagccccctgcccccggagctgcgcgcggaactggagcggcgcggcctgcccctgccccgcggtgagcagcgggactgagggctttccactattcgcccatcaccttgacgatgacgcgctttcggcgctggccgtcgaactcggcgtagaacacctgctgccagggccccaggtccagcttcccgcccgtgacggggatgatgacctggtggtggaccagcagtgacttgaggtgggcgtcgccgttgtcctcgcccgtgcggtggtggcggtagtcgggaccggcgggcgccaggtgctggagccactcccagatgtcttcatggagaccgggctcgtcgtcattgacgaagacgcccgcggtgatgtgcatggcggagacgaggaccattccctcctggatgccactcttgcgcaccagggccgtcacggtgtcggtgagacggaccaactcccgccgccgaggtgtctcgaaccacaggtactccgtcaggctcttcatatccgtatccgccaggcgtcagagtgccccgttaaagtgactcacaccatgcgagccatcatccatgtggacatggatgccttctatgcatccgtggagcagcgggacaacccggccctgcggggcaagccgctcatcgtgggcgggcatgcccagcgcggtgtcgtggtcgccgcctcctacgaggtgcgcccgttcggcgtgcgcagcgccatgcccatggcccgtgcgacgaaggccgcgccccatgcgctcgtcgtgaagccccgcttcgccgcctatgccgaggccagtgagcaggtgttcgccatcttcgaacgctacacgccgctcatcgagccgctgtcgctcgacgaggccttcctggacgtgacggcgtcggtgggcctcttcggcacgcccgcggacatcgcccggcgcatccgcaaggagattgccgacgagttgaacctccccgcctccgcgggcgtggccacggcgaagttcgtggcgaagattgcctccgacctcgccaagcccaatggccagcgggaggtgcgcgccgaggagacggtggccttcctcgcgggcctgccggtgtcgcgcctgtggggcgtggggccgaagacggaggaggcgctccggctcgccgggttgaagacgattggcgacgtggcgtcccgggatttggagtggctggaagacaggctgggctccagcggacggcacctgtgggagctgtcccagggcatcgacacgcgcgaggtggtgccggaccgggccgccaagagcgtgggcgcggaggacaccttcgacgaagacctcgtgggggtggacgcgctcaagccgcacgtccacgcccaggccctgcgcgtggcccggcggctgcggcgggcggcgctgaagggccgcgtggtgcagctcaaattgaagttcgcggacttcacactcatcacccgtcgaaccacgctgcgcgaggccacggatgacgggcagacgctctaccgcgcggcgctggagctgctggacaagtcgcaccagggcaagccgctgcggctcaccggcgtcagcgtgcagttggacgaggagccgccccagttgggcctcttccccgccgccgcgccgcgcaccgcgaagctgaacgcggcgctggacaagattgccgagcggtttggcagcaaggccatcaccaccgcggacatcgccggcagcgaggccaccgacagcgccgaacaccgctccgagcgcccggtggacaagggcgggcccaaggactgagggccccggtaagggtggggcctcacgcccgttcgcggagcggccccacacctcacggaagggacttcgactcaggcagcgcccgccccggaagacgagccggtgccctcacatcacggacgcgacctcgagtcaggcgtcgcccgactcggaggacgaatcggcgctctcaccggacgagccgttcgccgagggacggcggcggcggcggcggcggcggcgcttgcgctggcctcccgcgtcggactcctcgccgtccgcggcggcggcacgcggctgcggcacctcgccggccttccacgcctccaactgctcgcgattctcgcccgtggcctccaccgtcatctcgaacacggtgagggcctcgctgaagagcgggtgccgcttgaaggccgcgctgcgacgacggcgctcaccggacagggtgcgctgggccagcagcagcatgcggcaacgctcggcgatgcggcgcggtagacgcgcggactggacgaagcccgcgagcaggtcttccaccacctgcgacacggacgggcggccctcctgcgactcctcgggccccgtcgagcggctgatgggaatcagcaacatcgccaggaggatggcgtcgtccagcgcctcgcccgcggacacgcgccggtccagcgactccgcgaaggcgtagaacgtcttctccccttccttgccgtgctgcttgaggtacgcgttgacgggcggcaggaggattttgagcgcgtccagcgcgtccagcagcttcagcgccggcgcggacacaccgccgcggatgaggcggaacgtctcctccagcaggcgcgcgggcgcgcagcggggcaggtcctccaccgcgccttccatggccgcgtacgtccgcgactcgatgtccaggcccagcttcgccgcgaagcgcaccgcgcgcaggatgcgcaccgggtcctcgcgcatgcgcacttccgggtcgccaatggtgcggatgaagcgctcatccaggtcacggcggccccggacgtaatcgatgacccgcccttcggccacgtcgtagaacaggccgttgatggtgaagtcacggcggcgcgcgtcctgctgcgcggtgccgaagacgttgtcgtgggtgatgagcaggtcctcaccgtccccctcatcctcaccgccgttggccgcgtgctccagctccgtcggattcgcacggaaggtggagacctcgatgatcttcccgcctttgaagtagacgtgcgccagccggaagcgccggccaatcaggcggcagttgcggaagatgccgcgcacctcgttcggcgtcgcgctggtggcgatgtcgaagtccttcggcttgcgccccagcagcaggtcacgcacgcagccgcccaccatgtacgcctgatggccgtgctggtgcaggcggagcaccaccttgagggcgtccgggtccagctcatcggggtcgatttccgccggctcgccgctgggccggacatggggcgcgtgcagcgcgcgctcatcgggcgtcggctccggttcgggctccaggacgatggggacttcctcggcgtcctcgccccgggcctcggcggcgtcctcggcctcggcggcggccagcgcggcctcggcggcgcccaggacggcgtcgtccaggcccg

SEQ ID NO: 742 - DNA, 4402 bp, Myxococcus xanthus
ggacacctccatgccgcccagcgtcaatcccgcgcacagcgccgcgcccagtccgaagtggaagagggtggggcgcgcttccgccacctggccattctctccgcgctcactgagtcgcgagcgcaccagcagcgcccccgccgccgccgcgctgaacgccaccgtccatccaggggccatgcccagggcatagggcagcgcggtgaggagtactcccagacccccgagcagcacgcggtcccacttgtcgcctcgtgcacacccgagcacgacggcagcggggacgagccacgccaacggcaggggtaccccgacgcgcgtcatggccagatgcaacacgccggccccggccccggccgtgagcgcgcgcgttacggtctgctcgaaggcctcgcgatgatggagctgcaatagagtggcgttcatcgactccccacggatgtaggccgggcaggaactgttcctttcacgcatgggtggcgaaaaaggtctgccgatgaagagccccgtcgttcccgagacgatgcgagcgctggtcctcaccgcctatgacggacggccggagtccctgcgcgtggaatcacggccggtgcctcggcccaccacgggccaggtcctggtgcgcgtggcggcggcacccatcaacccggcggacctgatgttcgtgcgtgggcagtacggcatccgcaagccgctgcccgtggtgccgggcctggaggccagcgggacggtggtggcctcgggcggcgtcgcgggccgactcctggtggggcgccgcgtggcgtgtgtggcgcccggcgagggggacggcttatgggcggagtacgcggcggtgcccctggggcagtgcctgccgctgcggggccaggtctccgacgagcagggcgccagcctcttcatcaatcccttcaccgcgtgggtgttgatggagcgtgcgaaggagggggggcacaccgcgctggcgcagacggccgccgcgggcaccatgggacggatgctgctggcgctcgcgaagcgacgcggcgtggccatggtgaacgtggtgcggcgcccggagcaggtgtccctgcttcaggacctgggcgcggagtatgtgctgagcacccacgagcccgaattcgaggagcggctgctccgcgtttgtcacgagctgaaggtgtcgctcgccttcgacccggtgggcggacggctcaccgggcagttgctccacgcgctgccggagggcggcaccgtcatcgtgtatggctcgctctccgaacaggagtgccgcatcgcgcccagcgacctcatcttcgggcgcaagcgggtggagggcttctggctgtcggagtggcaccgccagggctttggcgccgcgcaaatcaaggcgctgatgggcgtgccgtcgctggtggggcagacgctggagacgcccgtgcgcgcccggctcccgctggagtcagcgggcgaggcgctgcgcatcgcctccgcggacatgacgtccggcaaggtgctcttcgttcccgcgcagggacaggcaccgggcgaatcactgtgagcccggctcaggccttgtcgcgggagatggggcccgtcttcgccttcgtcacgcgcaggtagtccgcgggcgcgagcacgagctgcgtgccacgcacacccgcggacacggcgatggcgtcgaacaactccatcgtctcgtcgacgtacacgggatagtccttcttgccgccgatggccgtgcagccgccccggatgaatccggtgagcggctggagctccttgagcggcacggtgtccaccttgcggtctccgctgagccgggccagggccttcaggtccagctccgcgttgccgggcaccaccgccatcaacacgccggtgcggtcgccgcgcgccaccagcgtcttgaagacctgctcggcgggcatgcccaccttggccgccaccgactccgcggacaaatcctccaggtccacgtcgtagtcgcgcagcgcgtacttcacgccgagcgagtccaggagtcgggcgctgttcgtcttcacggcctcacatccccagcgcggtggcggcggcctgcacgcgagcgagcgcgtcctcgggcgagctgcccaccgcggacaggtgccccatcttccggcccttgcgcgcctcccgcttgccgtacaggtgcaggcggacgccgggcatggccagcacctcctggaagcgagggccgccgtccttcagccacaagtcgcccagcaggttgacgatggccgctggacgcaccacctccacggagcccagcggcaggttgcacaccgcgcgcaccgcctgctcgaactgggaggtgaggcacgccacctcggtggagtggaagctgttgtgcgggcgcggcgccagctcgttgacgagcacgctgccgtccttcagcaggaacagctcgatgacgagcaggccttcgacctggagcgactcggtgatgccgcgcgccagctccgtggccgtgtccagcaccgcgggcggcagcggccccggcagcagcgaccacgcgaggatgcgctcctcgtggtgattgaaggctggcggatacaccgccacttctccattggggctgcgggccaccagcacggacagctcggactggagcgccagcgcggcctccaccaccacggagcgctcacccagctcgcgccacgcctgggcggcctcgtccgcggaggtcacctccacctgcccgcgcccgtcgtagccgccctcactggacttcacgaagcagcgtccacccagcgcctggatggcttcggccagctccgcggcggagtgcgcctcgcgccacgggcccaggggaaagccccccttggcgagccagcccttctgccggccccggtgctgaatcacgcggagcacgtccgcacccgggcgcatgggggtgtgccgcgccaccgcttccagcgtggggaggggaatcttctcgatttcgagcgtcacggtgtcgcacgcgcgcgccagcgtctccgcggccgccgtgtcaccgaaggacgcggtaacacacaggtccaccacggagtgggccgggcagtccgcgtccgggtccaacgcctgaacctggaagccgagcgtgcgcgcggccagggccatcatccgccccagctggccaccgccgagcatgccaatcgtgccgccgggcagcaccacgcgggggctcatgacagctcccggtgcgccagcacttcgtccgtacgcgccttgcgccaggccgcgagccgctcgcgcagctcggggtacttgaggcagaggatggccgcggcgtgcagggccgcgttggcggcgcccggcttgccaatggcctgcgttcccaccggcacgcccttgggcatctggacgatggacagcagcgcgtccaggccgctgagcagcgtggtgggcatgggcacgccaatgacgggcagcagcgtcttgctcgacaccatgcccggcaggtgcgccgcgccgcccgcggcggcgatgatgacggacagcccccgcgactccgcggtggacgcgtactccatcatccagtccggggtgcggtgagcggacaccacgcgcacctcgtgcgggatgcccagttccttgagaatgtcgaccgcgggctgcaggtgctccaggtcgctcctaccgcccatgatgaccccgacccagggggtgaccgtgctcgccattggtgtgcgcgcctccgtgcgctgtcccgccgaaaccaggaggaacgcggagatagggcggggggattccgcgggtcaacacggaaaggcgcgggtgacgaggatgacacgccggccttcctgcattcccggtgcgcactcgcacacagggtggggcagggggggatgagcccctgcccgccacccaggacggctaggccgcggagacgttgcggtcgctgccctcgcggtagagggcttcgatggcgtcgttgtagcgggccacgacgttgcggcgcttcacgctcatcttgggggtgagcatgtcgttggcgacggtgaagtcctcgctgatgagcaggaagcgctgcgggcgctcgtagcccttcacgtcgcgggtgaactcgttcaactgctcacggtagagctggagcacctcgggacgtttgagcagctccggcatggacgtcgtgtccaggcccttctccgtggcccacttcttcagcgtgtccacgtccacgacgatgatggccacgttgtacggcttgttcatgccgtggaccaacgcgttggcgatgtaggtggagagcgccagcgactgctcgatggggctgggcaccacgtacttgccgttctccagcttgtactgctccttgatgcggccggtgatgtagaggtacccgtccggatccaggtagcccatgtcaccggtgcggaagccgccgttcccggtgaacaccttctcgttctcatcgggcttg

SEQ ID NO: 743 - DNA, 7704 bp, Myxococcus xanthus
cagctaacagcccgccttgaggtccggcaacagcacctgccgggacggattgagaatcttcgccgtctccgccatgaaatggacgccacagaagacgatgacgtctgccttcgtgctcgccgcggcttgcgccagcgccaggctgtctcccacgaaatccgcgaggtcctgaacttcgctctcctggtaatagtgcgccaggatgactgcgttcatggaacgcttgaactcctggatttccttcgcgtagtcgacttcggcgcgcatggcacctcccgactcccacctttaaccgggacttgaagtgccggccagggtgcggtttgccccacttcgctggtgcatgggtggccgcgaatcaagcgggcggcccttttccaacatccgccctgtcctcatgctggggcactcccttccccatgaggtccggtaagatggcgagccgggccggacgccgcgcatgcggttcggccattgcatctgggaacttcgaaccacggggggaatgtgaggggtcgccgtcggaagctccggcggggcggtggaggctggcggtcacattccgacccgtgaagtggttcatccgggggcaggcggctctgacccggtggaggaggacatatgaccgtgacgacgcgcgcagtgctggtcgtgcatccggaggcggagcgtcgtggacggctccgcgccttgctggatggctacgaagtgctcgaggcctccaaccggcaggaggcggtcgaattcctcacgaaaaccgctcccgcgctggtgttgagcatccggacatttttccccggttgttgaaggatctggagcgctacaccccgcgctccatccgcgcggtgctctgccccagggacaatgcgcaggcccaccacagcctggtggacgtggccgccgcggggcacatgttcttcacgctggaggatgaccccagcccggcgctgcgccgcgccgtccaggaattgctggaactgcgcgagtccgagcgccgcgagccgcacggcgtcctggaggcctgcttcacggcggatggcacgacgttccgggcgcggcttctcgacgtggccacgggaggcctgggcctgcgcctggagtccagcgtgcgcatcgagcggctcacgccgggcacggagctgggagggctccaggtgctgcgcggcgacacgctggtgctgcgcgccggccatgccacggtgcgcatggtgcgcccgctgcgcgcgcacgaaggccagggcttccacctgggcgtgtcgctggagcgccccgtggagcacgcgcgctcgtccgccgcgccgctgctcaacgactcggtgcgcatccgcggcttgctgcgccgcgccgtgcgcgcgggggtgggcttcgggctgcgaacgcacgaaggcaaccggttggtggacttctcccgcgcggaggtgctgccggaggagtcccgcctggtgctgcgagagcagtcgcagccgggcacgctcttccatccaggagacgtggtgcggctgtgcctggacttcggtggcgtgtgccatgtgggcaccacggcggtgctggcctcggagccgaaccaggtggaggtggccctgccgcgcacgctgagcctgcaccaccgccgcaacagcctgcgcttccgctcctccgcggagcggcccttcgcggtgtccttcaattcgccgctgacgggggaggccatcgtccgcccgctgttggacctgcacaccggcggcttcgcctttcccttcgacgcgggccgggaggccttcccgccggggctggtgctggacgacgtgatgctgcagttgccagacggcacgcgctcgcgctgccgcgcccaggtgcaggacaccgggcagctcacggtgacggaggagggcgccagcatgagccgcccgcgccgctgcggcctgcgcatcctggagctggcgccggaggcccgcgccgccatcctggacgccttcatcaaggcacggtgtcccgatgcgcgtgatgcgtccgagctgcccttctccgacgtgtgggacttgttccgctccgcggacgtccgctttcccgactaccccttccacgagacggcgacgcccgagccgctggtggtcgcgcaccagcggctgggcaatggcatccacggcctgtccaaggccatcgtctatcagcgcgagggccggctctacggccacatctccgggctgcgcatctactcgcgcacctggctgtcgcagcacctggtggtgcggccgggctaccaccggcacgaatccatctcccaggaactggtggcgctcgcggccgactacgcggagagcctggacgacgtggagtacctgcgcgcgctgtggcgctgccgcaaccggtggacgtcgcgaatctacggcgccatcgccagccggttggagcgcccaggcctgagctgcctgcatgccttcacgccgtgccggctccccgtggacgccgcgttgccgccgcctcggagcgatttgcgcgtgcgccccgcggagacgtccgacctgcgctggctggaacagcacctgcgggagacgcaggacgtggtgcggctgcgcagctcggacctggtggagggcgagatgaccatggggacactgggcgggcgctactcggacgcgcggctgcggcgctcgcgcagcatctccgtggtcgagggcaaggacgggccccaggggttcgtcctcatggaggactcgtcgcccggtctcttctgggcggagtggtacaacgccttctcgctcgtcatggtggagccggatgcacgggaagcggatgccgtgcgccaggcgctggtgacacacgcggtggcgaactcggcccggcgcggccgctccaccgcggagtgcctggcctcggacgcggacctgcccgccctggaggcactgggtttccacaacctggtcaaggtgatggagttcacggcccacccccggctcgtgcgtgactggaatgcctacctgctcgccgtcttcgagcggctggcggcccatggccggggtggtagccggatggatgacaaggacatcgcggcatgacctacctgatggagtcggcccaggaggtgcaccgcctgcaagcgcaggcgagcgccacctcctacgcggagcggctgaggctcaccgggttgaggcccggggacgccgcactggatgtgggctgcggtcccggcgtcatcacctcggagatgctggacgtggtggggccgcacggccgcgtggtgggtatcgagccgcaggccgaacacctggcggcggcccggggactgctggcgggcaggcccaatgtggagctgcgtcagggcgcgctgccggatacacagctgcccgccgaccacttcgactacgtctggtgccagtacgtcttcgagtacctgggagagccgggccccgcgctggcggagctggtgcgcgtggtccgccctggtgggcgcgtggtggtggcggacatcgacggggtggggctgtggaactggccctttccggaggacctccaggaggcgagccagaagctgctcgccgccctgcgcgcagcgcgcttcgacctgcacgcgggccgcaagctgttccacctgttccgcaaggccgggttggtggacgtgcgcgtgcacatctccccgttctatgtggcggcgggtgcggtggacgcgcggctccgcgaggactgggtcatccgcttccggacgctgcgcccgctcgccgagcccttcttcgggggcgccggcccctatgacgctttctgtgaacgcttcctcgcactcctggacgacgccgacaccctcaaatatgcgatggtgttgacgaccgaaggagtgaagcgttgaccgtccccgcggaactggcctccgcaccgtcagcccccgacacacccgagctgagtgtccggatgctgcgcagcgtgatgttgtactacgagcggacctacggccgggaccggctggtgcgggtgtggcagcgcgaggagctgccgctgacgttggcgtacgtggagacgctcaccaacttcgtctccgtggggttcaccgagcggctcttcgacgtgctcgacaaggactccggtgatccggacttcatgacgaaggcggggcgcagcatcgccagtccggaggcggtgggcttcctctattacatgatgaaggcgctggccacgccgcgcagcgtctacgagcgcgcgctggagctggaccacacgtacaaccgcgtgggcggcttccacatcgacacgctcaccgactcgcgggtgcaggtgcgctacgtcagccgcatccgcgaaagagatcgcaacttctgccgcgcgcgccagggcaacctgtccgcgttccccgccatctggaacctgcccctggcggaggtgaaggagctgcgctgccaggtggatggggcggactgctgcgagtacgacatccgctggcagagtctgccgcccctggcgtggcgctacatcgtgggcggcatggcgggcatggtggccggcctggtgtcgggcacgttgaacctggcgccccccgtcttcgcggtcagctccctgggcatggtgggcgtggcggcgggggcgtggctgcacacgcgggcggccctgctgcgcaaggacgagaagctgtcggagcagcaccagggcctgcagacgtccctggaggacctgcagcggcgcaacgatgagatcttcgccgccaacaaggcgctcgaggaccgcgtggccgagcggacgcaggagctgtccgaggccaatacgaagttggaggcgtcgctcgcccggcagcaggagctggaccggctcaagagcgagttcttcgacaacgtcagccacgagctgcgcacgccgctcacgctcatcctgctgacgctggaggcgctggcgaaggaggcggagtcactgccgcccgaattgcctccgctggtgacgaacatggagcgcagcgcgcagcgcctgctgcggctcatcaacaacctgctggacctggcgcagttggagtcgggcaaggcgcggctgcgctaccagccgctggagctgttcggcttcctgagcacggtggtgccgccgttccacaccatggcggagcggcagggcgtgacgctgcggctggagggcgccacggtgacgcccgtccatgtggaccacgagcgcatcgaaatcgtcttccagaacctgctcggcaacgcgctgaagttcacccagaagggtggggtgacggtgcgcgtgcgcgaggacgactcggaggtgcacgtcgaggtggaggactccggccagggcatcgccccgcaggacatccccgtcatcttcgaccgcttctcccaggcggataacagcggcacccggcgctttggtggctcgggcatcggtctggcgctggtgaaggagacgctggagctgcacgccggcggcatctccgtgacgagcgagctggggcagggctccgtcttccacgtgcggctgcccaagggcaccgcgcacatccgcgaggatttgcgcgagcgccgtcaggccgtcatgcccgtgcggcgcgagcgccgcatctccggggccttcccctcgctggagccgacggggacggatgtcctgggcgcgtcgcctccgccggccagggaccacgcggggccagggcccgagtcgccccgcatcatggtggtggaggatgatccggagattcgaagcttcctcgcccggctgctggcccagcactaccgggtgatggaggccatcaacggcgacgacgggcgccagcgcgcgctgcgcgagcggccggacctcatcctgtcggacgtgatgatgcccgtcatgtccggcctgcagatgctgaccgccctgcgcaatgacccgcagacggtggacatccccgtcatcctcctcaccgcgcgccaggaggtgacggccaaggtggagggcctgggcaccggggccaatgactacctgggcaagcccttcagcccgaacgagctgctggcgcgcatcgaaacccagctgcgcctgcgcgaggcggccgtgcgcgccgcggagaacgagcggctggcggccatcggcctgctcacgtccggcttcgcgcatgaggtgcgcaatccgctcaacgggctgatgaacgcgctgctgccgctcaaggacatgctgacgggtggctctgccgacgtggagctgagcaaggccatgctggaggtggtggaggagtgtggccagcgcatccgccacctggccgaatccctgctctccttcacgcgcaccagcgagtccccggtggtgctgtccctggactcgtcgctggactccaccctgagcgtgctggcgtggaaggtgccgccgggcgtcaaggtggagcgcgcgtaccactgcagcgagcccatccggggcaatccaggcgccctgaaccaggtgtggctcaacctcctggacaacgccctgcgcgcggtgggcgacaagggccgcgtgcgcatctccacggccaacacggcggaggaggccatcgtcaccatcggtgatgacggggtgggcatccgcccggaggacatggagcggctcttccagcccttcttctccacccgcgcggcgggcgaggggacggggttggggttggcgctcagccgccgcatcatcatccagcacggtgggagcatcgccctgagcagtgttccaggggagggtacgcaggtggaggtccgcctgccgctgcgccccgtggcgccccgtgtcacgggaggcctgcccgacctcgcgtccgagccgcgtgtcggccgcctgggctgacgcagcacgcaaaggccccgcccgagcccacggcgtccggtcggcggagaaggggaattccctacccgctcaggtgtcctcctgggcacggcccgcgtgtctgctacagtcacgctcctttttcgtcgcaccctcctttttcaaggaaacgacctgcatgcaaggcaccgtagccgcgggtgatgcccgcaaggggcacccgcgagggctctacctcctgttcttcactgagatgtgggaacgcatgtcgtattacggcatgcgtggcctgctcgtgctcttcctcacgagcaaggtcaacggaggatttggctggtccaccgcggacgcactcagcctctacggcacctatacgggcctggtgtacctgacgcccatcgccggcggcttcatcgcggaccgctacatggggcagcgccgggcggtggtgctcggtggcgtgttgatgatgataggccacctcatcctggccttgcccagcgtgacgatgttctacgcgggcctgggcttcctcatcatcggcaacggcttcttcaagccgaacatctccaccatggtgggcgggctgtacgcgcccggtgacggccgtcgcgacagcgccttcaccatcttctacatgggcatcaacctgggcgcggtgctcggcaacttcatctgcggcacgctgggtgagcgcgtgggctggcactggggcttcggcgccgccggcgtgggcatgctcctgggcctgatcgccttcgtgtcgatgcagaacaagctgctggggcaggtgggcctggtgccggagcggatggtggccgccgccgaggcgaagccgggcaccccggagaagtcgggcttcggccgcgatgaaatcgaccgcatcctcgtcatcttcatcatggcgctgttcgtcgtcgccttctggacggggttcgagcaggccggtggtttgatgaacctctacacgaacgcgaaggtggaccgcggcatcct

SEQ ID NO: 744 - DNA, 4408 bp, Myxococcus xanthus
acgaagtccacgccctccacttggtcagccagctggagcgcctccgcgtgaggcaccgcggcgagcaccaccacagggtccaccttcgacttctcacgcaggcgcttcgcctcggcggccactgcgggctgcaccggcaggccctgcacctgctcatgggcctggcccggaacggcgagccccaccggggtgggtttggccatggcgggagagacgcccaccacgcccaccttcacgccgcccaccgtcgtcaccaacgaggcggggaacagcagcttgccctgcgcgtccgcgaggttcgcggacaggagcttcagcttcgcctgccgcgtctgcttcttgaggaagcccacgccgaacccgaggtcgcgcgcgcccacggccatggccgcggtgccctgcgcgtccatctgcgacagcacgagctccgcgcgcgcccgggcatccggggcctgcgcgctgtcccggctcttgaagagcgcattgccggcgtccagcaccagcacgggcgtgccctgcttgcgctccttctcaatcgcgacttttcgtctggccagaccgccagatgggttgtgccttcaaccacagggggcgacttcgcccccattgtctccggtgaagaggaggacgagctgcttgggcgccgcgcccgccaccaggggcagcaggagcagcagcgccagcgcggccagcttcaccggacgcgggctcacttcttgcccttcttggcgggcgccgccttcttgtccagctcggcgatgcgctccttggccgtcttcgcctcgacggacttcgggtagctcttgatgagttcctccagcgccagccgcgactcctccttcatcttcagctgggcgaagcagtccgacgagcgcaggtaggactccggcgcggactccgccttcgggaagtcctgcagcaccttgccgtactcgaagagggcctcgcggcacttggactcggagaagtacgtctcaccaaggccgaagtgggcgtcccccaccagcgggtccttggcccacttcttcatgaactcgttgtagagctggcgcgccagcagcacgtcgccagccttggccttcgctttggcgagcgccaggaactccttcttgtccgtggggcgcttgagctcctcggccttcttcttcgcctcggcttccttcagcgccgcctcgccctgcatggcgaccagcttctggtcctgcgcggccagcgccgtctccagctcggtgattttgtggaggtacgtctccacctggccacgaagctgggcgaggtcttcgacggtcttctggaactgcacgccgatgtccgcgtccttgcggcgcgccgcggtgtccagccccttgagggccttggtgacctccgcgaccttctcgtcgattttcggaagggtggcgacgagctgctcgcgcgtctccttcagctccgcctgaatctgggcggagtcggtgccgagccggtcgaccttcgcctcgagggcgcggccgcggtcagcgggatagaagcaaccagggagggccagcagggatatcagcgccaagcttcgcatcgggcgccatcttaggcgcaaacgccctgcccgtccggacttctctcgtccagttggggctcccgccaacgcctgcccggctggccggtcaccgcttctggatggaaaactccagccgctcggcagcatgcgcgcaggccacccggaggcggtcggggttgaggaagaaggccacggggcgagagcggcccgactccagggcctggagggcccggcggtactcggcggtagcctcggcggtgcgccggcactgctccaggagcagcccgagcaggtaccgggcggcggcgtggtccgggtccagcgtcaggcagcgacgcaggtcccgctccgccacggcgtcggagacacccgaggcggcgccatccagcacgcaggcgaagaggaggtccgcttccgcgcaggcctccgggctgggctcgggcgcggtggccacgggcccccggacgccctccacctcggtgggagccgggacagaaaacccatggtgagcctcggtgcgagcgcgcgcgggggctcggcctgggggcagggccgtgccacgcttccttgaaggtggcgcagcgccgttccaggagagcggggctggcggcgcctcggactccccttcctccggccggacgtagaagaacgcctgctcgccgcgccgcacacggagcgttggcggcacccggagcagcggctcggacgcggacagcaccagcgcgccgccgggcgccaggctccccgcgagcgcctccacggtgcgctggaaggcctccgcggtgaagtagatgaggacgttgcggcagaagatgacgtcgaagccgcctccgccgggcgccaccggatacggcgactccatcaggttgtggcactggaagctcgcgcgctcccgcagcgcgggcgtcagggcttctttcgcgccggaccggacgaagtaccgcgagcgcagctccggtgggacgcggcgcagctgctcccggccgtacgccagccaccgcgcacggcgcagcgtgtccccggcgatgtccgtccccaacaccgtgctgtccgagttggcccctgcctccgcgagcaggacgagcagcgtggccacctcctcgcccgtggcgcagcccgcgctccagacgcgcaggggccgccgattcctcgccaccagtggggagaggacctgcgctcgaaacgcggcgagctgcacctcgtcgcggaacaggtccgtcttgttcaccaccaccgcggcgatgaggtcctccaggtccgtcacgcccgacggggactggaggaacatcaggtactggtgcggcgtgaggccctggctgcgcgccgccagccgctcatccagccggcggacctgagggccactcagggccatccccgtccgcgccgacaggaaggcgcgcactccggaccatggcgcgccgtcagtcacccgggctcagcgccccaccgagagggactctccccgcgccagtcgcaccaacgtcgccgcgacttcgtcaccgtggatgaggtggtccaccgccttgcgctccaccgccgcgcccggcatgccgaacaccacgcaggactcctcgttctgcgccaccgccagtccgcccgcctgcttgatggccagcaggccatccgcgccatccgcccccatgcccgtcagcaccaggcccaccgcgcgccggccataggtgcgggcggcgctctccagcagcaccgtgccggacggcatgtgcccatcccgctccacgcccagcttgatccccacgcgtccccggaaggggatgacggtgtgctgccccggcggagcgatgaggacgtgccccggcatcagcggctctccgtcctgcgccagccggaccttcaacttgctggccccggccagccaccccgccagggactccgcgaaggcggcgttgatgtgctggacgatgacgatgggcgccggaaagtccgcaggcagctccgacagcatcttgaagagcacctggggcccgcccgtgctcgccgccaccaccaccacgcccatggacaccgccggcagcaccgacgtggccacccggggcggcaacagcgggccgcgctggggccggcgcaggtggcggatgacacgcaccgaggacagcagccggatttcgcgaaccaggttccacgcgtccggcccggcgtcgatcgcgggcttgatttgcagagcgagcgcgcccagctccagcgcgcggtacgtcagctccggcgcctgtgagcgcgggtccgccgtgagcaccaggatgggcgtggggcactcggccatgatgtgctcggtggccgtgagcccgtccatgacgggcatgtccacgtccatggtgatgacgtggggacgcagctccttggtcatctccacggcctgcttgccgtccgcgcaggtgcccacgacttcgatatcggggtccttgctcagcgcctcgcagatgagctgtcggcagatgagggagtcatcgaccaccagcaccgacactttcttgcccatgccctgtccataccccgtgcgcgagcccgggagtatagccaatgcaggggcttgtcagcccagcagtcgccgcaccacatccaccaggttgccctgggcggtgtagccagcccccctgccgccggtcatcctccccccacgggtggtgaaggctgaccaccgggaacctcgaacggacggggtgccccatggggctgcgcaggctcttcaccggccgggctcgctgctcgatcagccctccgtcagcggcccgcctcagctccgattctcccctcaacatggctttccaacctatatggataagcggggaagccattgacctgatgcgcgggagcggactaccgccgtccgctccctctgccgctcgaaaggagcgcatc

SEQ ID NO: 745 - DNA, 5097 bp, Myxococcus xanthus
tccacgacttgcgctcgcccctttgggcgctgacgctgtccttgtcgtggatggagcaggaggtgccccagcagggcatcctcggcgagtccgtccgcacagggctggccgtcaccgcgcggttggaccggatgatttccgacctcatggacgtgccccgcctggaggaaggccggctggagccgcagcgggccaccttccccgccacgcgcatcgtggaagacgtgcgccgctccctggagagcgtggcccgcgcgcgcaagctcaccctggacgcggaggtccccgtccaactggagctggagggcgacgccgacctgctggtccgcgtcctggagaacctcaccaccaatgccctgcgctacgccccgtcgggcgggagggtgcgcctggaagccggcgcggatgtgaacggccgctggctcgcggtgcgcaacgacggcccgcccatctccgaagaggcgcgcgggcgcatcttcgacaagtatgagcaggccgacgcggagcgggacagccgccgtggctacggcctggggctctacttctgccggctcgccgcggaggcccacggcgggcggttggcggtggaggacgcgcccggatggtccacgtccttcgtgctgcggctgccggcctgagcctcagccgctgcgcgccttcttctggcggcgcttgaggatgcgcgccacctgcgcgttcgcgttcgccaggacggagggcgcgtccaacgtggtgagcaccccatcgcgcagcaccggctggccgtcgatgaagacgtgcgccacgtcgctgccccgcgcggagtgcaccagcggcaccagcacgtcctcgggcgtggggcccgcgtgcaggccgctgacgtccaccacggtgatgtcggcgcgcttgccgggctccagcgagcccacctcgtcctccaggcccagcgcccgggcgccgtgcagcgtggccatctccagcacgcgcatgggcgtcatcgcgcacggccccacgcgcgggttgtgcatcaccgcggcgagcttcatctcgtagaagatgtcgagcgtgttgttgcagggcgcaccgtccgcgcccagcgccaccgccacgccggcctccagcaactccggcaccttggcgatgcccgacgccagcttgaggttggagccggggcagtggcacaccaccgtgcgggtgtcgcgcaggatgtcctgctcctcctgggacagccacacgcagtgggccatcgtcacgtgcgggccggacatccccaccgtgtggaagaaggccacgttgtcctcgccaccggtgtactggcggaccgcgtccgtctccttcgcgttctcactggcgtgggtgtggatgcgcagcccgtgctccttggccagccgcgccacctcgcgcagcagctccggggtgcaggacagcacgaagcgcggggcgaaggcgtagcgcagccggccgccgtgcgtgccgtgccagcgctccttcagggcgaggctctccttcagggagtcctcggtgctctcacgcaggcccgcggggacgcccgcgcccgcgtccatcatcgccttgccgcccaccagccggaagccggagtcccgcgccgactcgaagacggcgtcgtagtggtacacgctgcccatatcgagcgccgccgtggcgcccgagcggatgagctccgcgaaggtcaggtccgccgaggcccgcatggacgcggcgtcgtgcgaggcctcgaagggccagatgcgctcgcggagccagtccagcaactccagcccgtccgcgcggccacgaaagagcgtctgacaagcgtggaggtggccgtggatgaggcccggcagcaccacctttcccgtcacgtccaccacccgccgggtgccgcgaggcttgaggccccggcccaccttggcgatgcggccatcctggacgaggacgtccgcatccacgagcacctcgcgctcgcggttcatcgttacaaccgtgccaccagtcaggagcaaatccacggcgtgctcaggctctctcgctagaagaagtctttggtgaaggcatgcggcagcaggcctcccagggtgtagcgcgcctcgccgccctggggcgtccggctgcgtacgggcagctcctgcccgccaaactcggccatgacctggcggcacatgccgcacggaggacagggctcgggggtgtccacgacgatggccacggccaccggctgggtgtgcccctgggccacggccgccgcgaaggcattgcgctccgcgcagacggtgagcccgtaggtggcgttctccacgttgcagccggccaccacggcgccgtccgcaaagaggacggcggcccctacggggaaccgcgaatagggcacgtgggcgcgcgctcgcacgcgcgcggcttcctcaaacaggcgctcccagggaatctcgtccgccatgacgccctcctacacgaagccggattgaggtccgttacgagcgggccgtgccgctctgcacatcatccaggtggcgcgcgatggccagctcggactccaccggcaggtccacgaagcggacccgcgccgccggaccgttggcgcccggcgcggcctggagcacctcgcccttcgcttccacctcatcgggaaggatgggcagccggaagcgcacttccacgcgcgtcccctgagcccaaccggagccctgccaggcgcaaccgcccagggacaggtctccctcatgctgctcgaagtcctccgagctgccttcccggcgcaccttcaggcgcatggggacccggggcgaatcccgtcggtcctcggccttgtcgctcatcgagtcgttcctctcggccatcgccgttacctccctgccgctcatgctcgcgccaccgccagtcattggaaacccacgtgggtcctggcccgcgagcccataccgtagacgcgtgccgccgtctcgtccgaggcgacgttcccccctccgacaacccgccccgccttgtcacgacgccccatcacccggccatcatacgggggaacaccggcccgcgaggctgggaaaaattggggcccccaccgttccgggcggggccacctggccgattgccggcgcccccctctcggtgctggccccgtgagacctgggagtggcgctcaggctgggacgccctgatcccgggacgcccaccagtcctcgccgtagctgatgcagagctgctcgccggggtggatgtcccgcagcgcgtggtagcagaagacgtcccgggtcgcctcgcggtgataggacgtgttgggctctcgggcgtggttgtagatcatcccataccccagcacgagcgccacccactccccctctcggggcacctcgtgcctggcccattggagcaggaagacgtagtcctggagctgggggttctgcgagagggcgcggggcagtttgaggtagtggcattcctcgatgaggtcgcccgccttgatgaaggcgtccgtgaagacgccgtagccccactcgcatggacggaccttcacgcccggatggatgtacagcgccgcgccctggttcatggccccctgccccgcatggctcagggctgaaggatggcgccttcccggtgcggggtgaagccacaagatgccgccatgccccggcgcctgggcgggtccgagccgcctctgtgcgggcggtgcgtcaggccgctagagtgcgcgtccgaagttcctccccgcccgccccccatcccatccaacgcgcgatgcgtgcgcggcggcccgcccttgccctgacaacaccatgctgaccgaatccgccgttcccgaaacagcccccgtctgccctgaccatgccggcgaaccgtccacagggacgtgtgagcggtgcgggcgcttcgtctgcgcgaagtgccgaacagcccaggcgggtgtctgcgccgcctgctccgcccggcaggtccaggcactgccccacacccgaggccggacgcggtgggcgagcgtggccctggctgcgagcgcggtcctcgccatccctgtcgccatcctcaacctctggctctacctgcgcttcgacaatgggagccccagcctcgaggacgccgagtccttcgaccaactgaacgcgctgctcgcgctcccctccctgctgacgatgctcgccaccgtggtcctctacctgcgctggctgcgcctgagtgtgaagaccgccaatgccctgggcttgagcaacgaatcgacgggctgggccacgttctgctggttcattccgttcgccaacctcttcaagccgctcgaggtggtgcgagacctctggcaaggcctgggcggcccccctgagaggcagtccatgctcacggcctggtgggcgacgtggatcctcagcaacatcatcagcaacgtcggcaacgccttcgccagggcggataccgcgaaccccacttcgctgtccgtgtcgctcctcgccgggattctttcagagggcctctccatcgcggcggcggtgctgtgcatccgcgtcatcggggacatcgagtcgctgctcgtggcccgcagggcggaggcagaggcgaccatgaccggcgccaccctctgatgccccacgtgaaaggagccccacgccgcgccctggcagggcatcgacggggggctcccaggtcaccacacggctcggcgccctactccacccgctcgcggatgagcggccgggccacgggggccacgtcgccgaaccggtacgcggccaagaggcgcgccttcacgttctccaactgggccgcgtcgttgtagtgcacgcgcaccacgggctcgccctgcttcacggactcgcccgacttcttcagcagcgtgaagcccacggccgggtcgatcttgctatccgtccgctgccggcccgcgcccagcgccaccgccgccatgcccacgccctccgtgtcgatgccggtgacgaagccgtcccggggcgccaccacgtccacggtggccttcgcctggggcaacagggagtagtcgtcgatggagcgcgggtctccgccctgcacctggacgatctccttcagcttgcgcaccgtgctgccgtcctccaccaccttgcgcagcttctcgcgcgcctcgtccgcggcggcggccttcttgcgcagccccagcat

SEQ ID NO: 746 - DNA, 5752 bp, Myxococcus xanthus
gtgcctaagggcggagttcggcctggagctctcggatgcgctgatggccgagagagcatcccaggaggaacacccatcccctcgcccgcccccgaagccccccgatccgacgccccgggctccgaagaagcggcgcccatcggagaaaacggaggccgagtcggcacaccctgccgcgacgccaacccaggcggcggcgtccctccaccggccccctgcagagccaccggcatacccgaggccacagcaactcctggcgcgggaacaccaccatcaaagtcctcgggcacagccgccacgtcctcgacgacctcgccctcctccagcacctccccttcctccaggaggtcaatctcctccgcgggcgccggctccagcgcgaacggaggcggcgccacggcacgcggcgtctccgtcggcgtgagtcgcggcggcgaggcaggccgcgcccccccacccgctggcgtcagcgtcggaggcacgggcacctcgggcgtccccccccgcctcccgccgtcctccccgaaatcaatcctcgccaccggaggcgcggacgacgccagcgggtccaacggatgcgagctccccgacatggccgattcccaccggaccgagccggaatcctcgggctccgtgtccgggtcatcgccgctcaagtactgcccgggcgcgagcccaccgaacatcccttccgcctcgggctccgctctcacgggcgcgggaggtggaggcgtcatgctcagcgcggagggcatcgaagggagcgccacgggcggcgccacggccgcggtccgattcggacgcttcgtcgaggtcatctggatgaaacgcgtctcgcgcttgatgccgtagcgaagctcctggaactggaacagccgcagctccggcgtgacgtacggaacgatgcgcagacccgtgatgaaccccagcgcatccgcgtgctcgatttccagcgggctggccatcgccaccttgagccgccggccttcctgctccagcgggaaggcctggtgcttctccgccatcgccgcgggaagcagttgcagcaccgcgtccggtgccgccacgaagtccgcttcctgcgccaccgggtagcggcacatctcccccagcaccatggccagggtgtcgatgtcgaggatgtccagctcgacaaggttggagcccaaccttccgccgtagatgagctgggcccggagggcttcgtcgagctgcgcctgtgtgatgaggcccttgcggaccaggatcgctccgagcttttcggccatgtccggccgattctagacgccttctcagcgactgagacgcccctcccaccgcatggccgcggcatgccagccaggccgcacgaccggcgccacgggcacctgcgccgagtgaaaccaaggccctggcccaaaccccatgccgcaacggaaaaccgacactcaccgtgaaacggaaaatctccaaccacaccgttccagccacggaacccatggcaatcacacggaattgccagtttctcaagatataactgagagtgcagtcaaacccgccagggcttcactctcaggagaatcgatgaaacgcatcccactcgcatgtcttgtcaccgcgctgctcacgggggcgccggcggcgctggcctccgatgaggtctgccagcaggaagaagtttcctcttcgtcacagcggctcacgaaggtgggcgaggacgtcttccgtcgcttcgagacgacccacccctacgccatcacgcagattcgcgcctctgacggccccatccacacggacgtcatcacccacgcgggcgcggcgtacatcgcgccccacttcgagcggctcgacctggaggatggcgacttcgtcgtggtgcgctcgccggacaactcccggtcgtggcgctacgacaactcgcacccgggtgcgcgcagtggcttctgggccatccacattgccggtgagacggccatcatcgagctgcacagccgcgacagcgtcaaccgccgcggcatcctcaacaagcacggctactccatcgaccggtacgcccggggctacaccaacgaggagatgggcgtgtcgaacgacaaggcgctgtgcggcccggacgacacgcagtgggcgccctgctacgcctccagcgaccccaccctctacggccgcgctcgtccagtcgcgcgtctgctcatcaacggctccggtgcgtgcacgggctggctcgtgggcagccagggccatctgatgaccaaccagcactgcgtcggtacggcgagcgaagcgcagaacacccagtacgagttcatggcggaaggcgcgagctgttcgacgagctgcgcgagctggttcggttgtccgggcaacgtcatcccgggcggcacgttggtgaaggtggacgcgccgcgtgactacgcgctcatccagttgtcccagaacccggtgaacacctacggctacctccaactgcgctcgtccggcgccgtggtgaacgagcgcatctacctgccgcagcacccggccggccacggcaagaagatcgccgtgcgctccacggatgcccgggacgagtccggcttcgcggagatctacagccgcaacgaggcctcctgccagtccggtggccccaacgacatcggctactacgcggacacgcagggcggctcctccggctcgcccgtcatcggccattcggacaacctggtggtggccctgcaccactgcgccaactgccccaaccgcggcgtgcccatcgaagcggtcatcagccacctgggcaccagcctgccccagtgcgcgctgcccgccgccgactgccccaaccccggcggcaacggtgagccgccgcctcctcccccgccgccgcccccgccgccggagaactcgttcgactacaccgccagcaacaccaacagcgcgcagcagaacaccaccaatcacaccatcgcgctgacggcgggccagacgctcaccgtcgcgacgtgcggcctcacggggacgcagttcaccggtgacacgtggctgcgcctgcgcaaccccgccggcaccgaggtggccaccaacgacgattcctgcggcggccgcggctccagcatcaccttcaccgccaccaccgccggcaaccacgaggtccgcgccggctgctactccaccgggagctgcaccggccgcgtcgtgtgggaaatctccggcggctccggcggccccaccagcgggagcttcaacttcagcggcagcaacaccaacagcgcgcagcagaacaccaccaaccacgacgtcgccatcgccgcgggcaagagcatcaccgtggccacctgcggcgtgacgggtgcgaccttcacgggcgacacctacctgcgcctcttcaacggcgccacgcaggcagcggtcaacgacgacgcgtgcggcggccgtggctccagcctgacgtacacctcgtccacggccaccaccctgcagattcgcgcgggctgctactccagcgggagctgcaccggcaccgtggtgtggaacatccagtagtcaccacgcagcggcgttgaacacccgggcccgggccgtggcgagcgccaccgcccgggctctcggcgtcagtaggcgttcttcgacaggaagccgcccagcgccgtgcgcacgagaatcttcaggtccatcagcagcgaccagttctcgatgtagtacaggtcgtactcgatgcgcttctcgatgcacgtctggccgcgcaggccgttgatttgcgcccagccggtgatgcccgccttcaccttgtgccgcaggtggtagcgcggaatctgccgcttgaactcctcgatgaagacggggcgctccgggcgcggccctaccaggctcatgtcaccgcgcaggacgttgaaaaactgagggagctcgtccagggagtacttccgcaggaacgtgccaatcaccgtgcgccgcgggtcgtccgggcaggtcatcatcgcgccgccgtgctcggcgtcgatgcacatggtgcggaacttgaggatggggaaggtgcgcccatccatgcccatgcgctcctgacggtagagcatgggcccacggctggtgagccgcaccgccagcgcggtggcggccatgagcggcgcggtgatgaggatggccagcaacgagaagaggatgtcgaaggcccgcttggccacccggctccagccctccatcgggtcgccctggagacggatgatgggcaacccgccgaactcctccaggccaccatagagggtgatgtactggtacaggtccggcaccacgcgcacatccacggtgcgcagggccagcttgtccatcagcgccttgacgtgggcgtggcccgccagcggcagcgcgaggatgacctggtccaccgggtgcgaatccagcacctcgttcacctggtccacgaccccgatgacgcgcacgtcattcacgtactggcccaccttctccgggtgcagcgtcagcacgcccatcacccggaagcccagctcgcggtggtgctccactgtctcgatgacccgctgtcccaggtcccccgcgccgatgacgaggatggacttgaggttgtggccccggcgccggatttcactcaccagatagcgagtcaccagccggctgcaggtcaccagcgcgaacgcatagacgatgaagatgaccagcgtgaggcgcgaatagcgctcgcgaacgaagtacgtcaccgccacgaggatgagcgccgcggtgatggtcgacttgaatacctcgaacacctcgcccgtattcgtccgggaacgattggtgccgtacaggcgtgactggtggaatgtcaccgggaagatgacgagcaccatcagcagcgaaaagaacgagtccgtccagggaggtatcccctccgtgacgggcacgatgccggagaaacgcgtggcgtacgcgaggacgaatgccagcgcgagcatcaccatgtcggcgacgactttgatcgacgtgtagaaacgctggagacgactgaacaccgaagtactcctgtggcgtaatcaacgggtggccaccccggtgcaagactcgcgccctcttcatccggacgcgcgttttgcccatcaccgtttgatagccgcgcttgctagcacgaaaaaatttgtgaaaacaatgggttgcagcggccccgcccccccagccaggggcggtgtccacctgttgcccacaaaagaccaagacaggagcgacagcgaagtcacagtcccgctgcggggcctggggaatctggcaacacctcccccagcaccgcgtgaatctctcgaagaatggcactttgaaaatgcgcgcgaccgaagcgctcggcctgcgcgcgagcggcttcaggccgaaagcctgcttcccattcgtcgaaccggcgcacggcggcggcgagcgattccggcgtctgttctgagaagaacattcccgtccgcgccgtcaccgtctcgagcgcgccgcccttcccgtaggcgatgacgggccggcccgccgcctgggattccagcggggtgatgccgaaatcctcctcgggcgtgaagatgagcgcgcgagcgtctcggtatagcgccggaagcgacgcatccaagacattgccaaggaagcgaatattttcgggcaggcttccggcgctcaggcgcgcggcctcctggcccgctcccaccacccagagctgcgcatccaggcttcggaacgcctccaacgccacgtccaatcgcttgtacggcgcgaaggcccccagccagaggaagtagcccccctggcctcccccctctagagcggtagagcc

SEQ ID NO: 747 - DNA, 5400 bp, Myxococcus xanthus
gcagcaatagacatcagaatacaactcaccatcaatacatcccggaacgaggcgacctcgcgtggccctgttcgaaagcagtcgctgcgctgggccgactgagggaatgtcaccgcctccctggtcccgcgaggcgcctgttcggcgctcggatgcagattccgagacatcccacagacaaacatgcttcaactgttgcatcgacagtgattgaggcgaccttggggagggctttgccatgcagggctcctcccccaggttgctcgaggcccgtcaatctcagtcaggcaacgaagccgtgtagcacggctcaccgcgagtgagtgagtgagtgagtgagtgagtaatcccatcgggcctcgacaggagaagcgaatgaaccggttggtcgtattgttggtttcatggatggccatggtcctggcttctggtggcagcgcggcctgggccgcccaggcggaagcaaggcctcccgcggcagtggttggcggggacggaggcgagccccccgagctggtccccgtcacgacgagttggatctaccgcgatgccatggaagcaccgtggcaggactactcctgggccccccactcgctcaccaacacctcccctgtcgcagtggggcgctactccatctccgtgacgatgcgcgcctgggaggcgctgtatttcaatacatcgccgatcacctcgaacgcgggcatgacgctcaccctgcgcgtgcatggcgggacgggcggcaacaacgcggtggtgctgacccgggccgtggtgaatggcgccttcacgcctggcaccgagctggggccgtactgcaccggaggccgcatccgcgccaacacctgggtgacgtgcaccgttcccatctccctcctggcgccacagggagcacggctgacgggcctggttctccaggaaggcctgggactgagcctgcccacgctctacttcgacgagctgggcgtgcgtggcatggccacgccgcctccgcccgtggaggtggccatcacccccacctccgccacggttccggccggggggacgcaggccttcactgccacggtgacgggcagcaccaacacggcggtgacgtggtccgtgcaggagggcgcggcgggaggcaccgtcacgccggcgggcctgtacaccgctccggccatcgcgggcacctaccacgtggtcgcgacgagccaggcggatcccacgaaatcggcggtggccaccgtcaccgtcccgaacacgcccccgccgccgagcggcacgtgggtgtcgggctactacaccggctggaacgccgacatgtacccgccggagaaggtggacttctccgcgctcacgcacatcctcgttggccgcgtcactcccaatccggatgggaccgtgaacacccagttcgacaactcgaatggcccggccatcgcgcggacactgtccacgcgggcgcacgcagccggacgcaaggccatcatcatggtgggcggcgcgggtgagcacgacggctgggtgggcgcggcgtccaacgcgaaccgcgcccagttcgtccagaacctgctcaacgcgatggatacctttggctatgacggcctggatatcgactgggagccggtggaacaggtggacaagccggcgttgctcgcgctgatacaggcgctgcgcgcggcccggccgcagatgctgctcaccatgcccatcggctgggtcaacagcaacttccccgaggatgcggacccgtggttcaccaacctggtcccctacctggaccagatgaacgtgatgacctacgagatgacgggcccctggggcggctggctgtcctggtacacctccgcgctcacgggcgaggcgggcaaccaccccacgtccgtctcctccagcctcagcgcctgggccaacgcgggcatccccaagaacaagctgggcatgggcatcccgttctatggcatggcgtggcggaacatcaccggcccgtatcagccgtacacggactggtctgactacgtgggcagcgacaattccttcacatacagcaagattctccagttgtcggcgacgggcgtctaccactgggacgaggcggcgaaggccagctacgtcaccttcgacgtccccgtggaggacggcacggtgcggtggatttcgtatgactcaccgcaaaccattgccgccaagggcgccttcgcccatgacaacggatacggtggcaccatcatctggaccatcaaccagggatgcaccgacccacagactggcgccaatccgctgctcgacgcggtgaagaacgccttcctgccatgacccggagagggcaagggaccgcgctgtgcacgcagcgcggcccatgactccacaagaagtgccctacctggggcgtcaaaacgccccccgtgagaagcgacggccactgccgacacgcacgggcattgacgagacaccatgacacctgttcccgggggcgcgagcgccgtgctcgcctgcccccgcgacggggacacgaatcttcccaccgacacctttggaacggcaccccgattgctcatggctgcccacgatggaggcgtgactgtctacagcgggcatcgcgagcaccagggcagcacctgggggcagaaagagcgcggtggccgaatcgctgaggggcttgggcaacgacatgaatgacggcgttcgcacgctggtgagcggcaagaaggcgctcgacgtcggcaccgcgaacccgatgaatctccatccggacggcggctgggagctcctctagctgaagaaggactgaggcggccctcccccggccgaggccctggcccacaaggtctgggcttcggccggggtgccaggattggagaattcctatcggagtgcagtcaaaactccgtgtcagcccatggggggtggattcgcaaacgtggaggaaggactaaataggccgcatgcccctctcctccccgttttccattgccgccctgagtctgtcttttcttgcgccgatgtctgccctggcgtccggggacaccatcgccaactcgtatgtggacgtctccgcctacctgacgtcgaaggcggacatcgaggcgtggtaccagctccgggcctcgctgaagcagaacttcgatgacatctgcggcgacacgttctgcgagggcgaatacagcaacatcgagtcgctgcgcttccgctgctccgtgaatgccctgacgggccggatgggccagtgcgtctgggtcttcgccgccagcaacgaggaagtcgacccggcgacgggttcggtgacggtggatgcgcggacctgggcctgccaggtgcctgtcgccccgcgcaccacgattcaggagttcctgacagcgctcgcgggcacgtctccgctctacgccacgctgccgcgcacccagacccccctctacgaaggtctgggcaactgcctctgagtcacggagcctcgacgaagcccgtgcagcaacacgggcttccgccgcgccttacgcttccgcgaagttctcgatgagcgcgtcgatgaccctgacgatgtgcgccgagaaatcccggaagtgctcggcgtcctccgttcccaggcgcggggaaaggtcgaaggcctcgtcgtggtagtagcccacgacgcccagctcgccttccggcgtgacgtcgcgcgggttgaagcaccagaagttgtccaccgcgtcgtcatccgcgcgctggaagaacagggcctggttgatggcctcctccacctccgggtcgtcaccgttgaccgcgtccgacgggtccggcgccgccgcacgcaggaagcccggctcctccatgccgatgagctcccgcccaccgtgcagcaccttgaaggtgccgtaggtgctgatgaagtgcacgtagctgggaggcagcttcagcttgaacttcttctccagctgcgccacctcgtcggcagtcacgggcgtggagaactcgatgctcatgtcctcgatctcctccgccagggacttgagccgcttcactgcttccgccaccgcattctcattcgacgtattggccatgatgcgcgcacgctagcgaatccgtgtgccccgccaagccccttcagcgaagcagggctcgcccgcgaagaaggtgcttcgcgatttcttcgtaggaccagtcgccgtcggcgtccaccacgtccgcgctcagctgcttcgccagcgcctcacgaatgtcactggggtgtccattgaagtggtggtccgcctgcacgtcatccaccgcgtcgaagcggtcagccgccacgacgattctcgccttcagggaatccgagtaggtcgagtagtcgttgtagtaggtccacgccacctgctgcacggtgatggggcccagcgacaccagttcaccgtggaagagcaggttcttcgcggagagcgcgccgcccgtgaagagcagcgcgtagtcgaagccctcgtggatgatgctgccctccacctccaggtcacccgcgacgagcagccgggactggtcctccaggaccaggttccccttcaccacgacgcgtgacgcttccaggacgcggtcatccccctcggagagcttcaagtctccggacaccacctccgtggcgccggagttcgtcagcttcgccttgagcgcggcccgccgcgccgccgtgccgcagggcgtgtggagcgagcctttcttgagcaagtcatcgagcagggacatggccgcgcatcaaggcacggtgaacctggactctcaatgctccagacgtaggctgcggcccatgcacgagcaggcgctgcaatcgcgttaccgggagctactggagagcgtggaggcctgggcgaagggatttggaggaaggctcgtcctgggccctcccgtaccggacgaagacatcgacctggtgccggagctgctcggcatcccgtcgtccaacggaaggcccgtgctgcccgcggggctccgcgaattctggcggcgctgcgccttcgcgcgcgtcgagttccgcgactgggatgatggcggcgcctggacgcccctgcccgccaacttccgggtgtactcaccggacgaggtgctggaagaaacgcgctgggtccgcattcccacggacgtgacgctgggcaatcgccccctgtccaccacgcacctctacgccctcgcgacgtgtgacgtgctgccccgggacgctcagtggtgtgtcgcggcgagcggaggtgcgttgacggcccccgtcatcgtcctcaaccacatgggagacctgacgtgggcccagctccaggactcggggcagttcgtctgggccgaacagcagacggcgcacggcgccaccttcacgacgttcctggattggctcgagcactacgtccggcacacgtgccagctcgcccccgagtcgctctacccggacggcgtcacagcccgccccgagtagggacaccgtgg

SEQ ID NO: 748 - DNA, 5017 bp, Myxococcus xanthus
tcctggtcgaggccgccaggtcccccctttttgggccccgcggaattggaatgccggcccaatgcgccgtctgctggagcgcctgatacgcgaaccctcaccctcagcgcctcgcccgctggattgacaccgccaagccccatttaataagccggtcccggatgcagtcccttctgcgatttctcgccgtgctcctcgtcctgatgacgggcggcgtcttccagacgctggccctggcgtcggacgtgcacgacgaatgcgcggaagaggcatccgacgagtgcgaggactgctcgcccaactgcgtgctgtgcgtgtgctgcccgctgagagccgcccccgctcccgcgttgcccaacgcgcgtctcatcccgccgccccggccgctgcccatcccctcgcgcgtggaggagcccacgctctccggcgtagggaccgacatcttccagccgcccagagcctgacaccgcccttcacgggagacgtgtgtcttgcgagggccgtggccggacgtgcgcgaacgtcctcccgctgcgcccaagccctgtccgaccttcccgcgcaccttcgcgcgggccaccaccgccgtgggcacgcgccccggcaggagcgcctcatcatgcactcgctgcgtacgctgtccgtcgtcctgtccctgttcgccgcccccgtcctggccgacgagagcaagcccgcccagcagccccagacggccgggtccgagaagccgcgctgcgagcacggcgtccagaagagcctctgtgcccgctgcaacccgaagctggctcccgtcttcaaggccaagggtgactggtgccccgagcacgcgcggcccgaatcccagtgcgtcctctgcaacccggaactctccaagaagggcgtgaagtagatgcgtgcctcccgagtcggccccagcgtcctggcggtgctgctggcactgagcgccgccagttgcagccaacaagcgagtccccccacggcgaaggcgccttcaccgccgccagtcgcctcgggaggcacgtccaccccgtccgaggtcgcactctgtgagcaccgcgtccccgcggagctgtgcacccggtgcaaccccgacctcatcgacgtcttcaaggaccaggacgactggtgcggtgagcacggcgtccccgaatcccagtgcttccaatgcaacccgggcctcaccttcaccgcgcgggacaccacccccaaggattggtgcaaggagcacgcggtccccgagtcccgctgcaccaaatgcaacccgtcgctggtcgcgaagttcatcgaggccggtgactactgccgggagcacggcttcccggagtccgtctgcccgtactgccacccggagttggtgaaggccgcgggtgcccagccccccaccttccccgagccgggcacacgcgtccgtctcgcgtccgccgagacggcccgcgaggctggcatccagacacgtcgcgcggtgaagcggccctttgcccggaccctggacgtcgtcgggcagctcgacttcaaccagaaccggctggcgcagctgtccgcccgcagcgaggcgctgataacggacgtccgcgtggacgtcggcgacgaggtgaaggcgggccagccactggtgctggtcacctcgggggccgtgggcgcggaccagggacggctgtcggcggcacagacgcggctgacggtggcgcgctcggcgctcgagcgcgagcagcagttggccacgagcggaatccgcgcacgaaaacacgtggagaccgcccaggcggaggtcgcggcggccgaggccgagcgcaatgccgcccgcgcagcgctctccgccgcgggcgccaacggccagggcccgcaggggacctatgccctgtcggcgcccttcgcggggacggtggtggcgcgagacgccgtcgccggacgccatgcatccgctggacagccgctcatccaggtggcggacctgagcaccatgtgggccctgctggagattccggaggcggacgcgttccaggttcgcgcgggacagcgcgtcaccctcaccttcgaaagcatgcccggacagacgcgtgacgccaccctcacccgcgtgagcgcgtcggtggaccgggcctcccgcacggtgcgcgcccgggtcgaactgcccaaccccgacggcgccctcaaggccgggctcttcctcagggcaagggtccaggtcgccccggaacatgaggcggtgctggttccccacgcggccatccagcgcgcggaaggccagacgctggtcttcgtgcgcaagcagccggggctctacgagcccgtcgcggtggagctgggcgccagcacgcgcgaggaggtggaaatcgtcaagggcctctcggcgggggtggaggtcgtcaccaccggtgccttcctgctcaagacggagatcctcaaggactccatcggcgcgggctgctgcgagacggcgggaggcgagtagccgccatgctcacccggctcatcgaatggtcgttgtcccaccgctgggccgtcctcctgggaacgggggccctcgtcatttcgggtctgctcgccttccgggcgctgcccatcgacgccatcccggacacgacgcccacgcaagtgcaggtcaacaccgtcgcaccggcgctcacgcccaacgaagtggagcgccagctcaccgtccccgtggagcaggcgctcgcgggcctgcctcgcgtcagcgagctgcgctccatctccaagttcggcctctcccaggtcaccctccagttcgaagacggaaccgacctgtggttcgcgcggcagcaggtgtccgaacggctgagccgagtgcagctacccgcgggcatcgcgcccccgacgctcgggcccgtcgccaccggcctgggcgaggttttccactacctcgtcaagagccggacgaagagcctcgaggagctgcgcaccctgcatgactgggtcatcgcgccccaactgcgcagcgtgccgggcgtggcggaggtgaatgcctggggcggcgaggagaagcagtggcacgtcatcgtcgaccccctccgaatgcagcagttcaacctgtccctcggagacatctaccgggcgctggaggagaacaacgccaacgtcgggggcggcgtgctcgagcggggcggcgcggcgacgctcgtgctcggggtgggagtgctcacggacggcaacgccatcgaggacgtggtcatcgcggcgcaccacggcgttcccgtgcgaatccgggacgtggcgcgcgtcgaggtgggccatgaaatccggcgcggcgccaccaccgcggatggcgagggcgaggccgtgctgggcctgggcttcatgctggtaggcgaaaactcccacacggtgacgaaggcgctcgcccagcggctggaggacatccagcggacgctgccggaggacgtgcgcgtggagcccgtctatgagcgcaccgagctggtggaccacgtgctgcgcaccgtgcggaccaatctgctggaaggcgcgttgctcgtcatcgcggtgctcttcatcttcctgggcaactggcgcgccggcctcatcgtggcggcggccattccgctgtcgctcctgttcgccttcaacgcgatgctgcgcttcggcatcgccggcacgctcatgtcgctgggcgccatcgacttcgggctcgtcgtcgactcctccgtcatcatggtggagaacgcggagcggcgactctccgaggcccgggacggacgctccctgctggaggtggtgcgggatgccgccgtcgaggtccgcaagcccacgctcttcggcgagctcatcatcatggtggtctacctgcccatcctcgccctcgaaggcgtggaggggaagttgttccgccccatggcgctcacggtcatcttcgcgctcctgggcagtgcgctgctctccatgacgctgatgccggtactggcctccttcgcgctgaagcgaggcggcggcagccctcaccatgagccacggctcatgcgctggctccaacgaatctaccggcccgtcctcgaatgggcgctggcccatgcgcgtgtcaccctgaccgccgccgcgctcctcatcgtgggagccaccctcgccgccacgcgcctcggcagcgagttcgtcccccgcctgtccgaaggcacgctcgtcatcaacaccgtgcgcctggcggaggtctccctctccgaatccatccgctacggcagccagatagagcggctgctgctgtcccggttcccagacgaggtgcgacgcgtctggacccggaccggcaccgcggaggtggccacggaccccatgggcgtcgagctctccgacgtcttcatcaccctcaagcctcgggagcagtggaagcgggccaccacccaggaggagctggtgaacgagatgaaggccgaactggcggacctcccaggcatgcgcatggccttccttcagcccattgaaatgcgcgtcaacgagatgatcgcgggcgtgcgaagcgacgtcggcatcaagctcttcggggatgacctcgacgtgctcaaggccaaggcccgtgagctggagaccctggtgagggccatccccggcgcggccgacgtcaccgtggagcaggtgacgggccagcccgtgttggaaatcacggtggaccgggcggcggtggcccgttacgggattcccgctcgctccgtcctcgacgtcgtggaagcagtgggcacgcgcatcgtcggggaggtgcgcgaaggcgagcgccgcttcgacctggccgtgcgcctgtccgaggagtaccgcgaggaacccacgaagctcgtcaccatccccgtggcctcgcccggcggcgagcgcgttcccctcggacggctgacgaccatgaacgagacatccggccccaccaccatccagcgcgagtggggcaaacggcggctggtggtccaggccaacgtgcgagaacgcgacctcggcggcttcgtcgcggaggtccgccgaacactcgatgagaagctggagctgcccgcgggctactacgttcgctacggcgggtcagtttcgaaca

SEQ ID NO: 749 - DNA, 7850 bp, Myxococcus xanthus
  unsure (1)..(7850): unsure at all n locations
cgaagacgtcccgggtccgctcctgggccacgttggagatcttctccttggccctcctgcgccttggccgccgcctgctccgcggcttccgcggccttgcgcgccgccgcctccgccgcgcgccgggccgcctccgccgcacgcttcgccgcggcctcggcggcccgcttcgccgcgtccgccgctccgccaatcagttttccgattcccatgggggcttccttctccaggctgtcacggccgtgcgtcgtctcgcgggggcgggacgcggcgcgtgcgcgcttcaggggtgtggtgccggctgggggccttgtggcgggccagccgaagccctcagcagtgtcgagtcttgaaagcaggcatggacgactcctgccctttagaaagagcgggtactctgtgagggctgcggggattctcaggaaatgaggcggaagagtttcgtcggcgcggcagaaacctggccgccgagcgctggattggcgttttcccgccgcgggggagcgctttactgggtggcacccgcgtaatacaggagaagcggatgtgctccgcaggcccgacagccccgctatccccacccgggcgacgcgcgcgcgggatgctgctggccattgccctgggcacggcgcttgcgtccgtgccggggatcaacgcgctggaacggatggtggccgccgaggtccacgccgtgtacgggccctctgatgagagaaacggcgcgcgggtggaccggggcggcgtggccttcgtgggcaagcgcacgcgccagttgcgctgtgggcgactggccggggtggggagcgacacctgggccgcggtgatgagcgccacggctggggtgaagacgaaaccgaccctgggccgggaactcgagtcctttcagccgggcttccatgaagcccaccgtcaggctcgagaacgtcggcgggccgttgccaccgacactgtccggctgctgcgctccgcggcccggatggtgcggggaggcaacgccggtgaccggccgacgctcgtcacccagtcgttgcgcgggcctcccgggcgcggctgaagactgcgctcggaatcgggccggcgggtaacgcgcctgccttctttgtttcctcccgcatgatgcgcggtccgacgcacggcgccgggccggtccgaacctcaatcttccgctaggttgtttttttcgaggtgtaccgatgcatggagcccacgaggtcctccaagccattgccgtcgtcctgtgcgtcgcggcagtgacgacggtcctcttccagaagcttcgccagcccgtggtgctgggctacatcctggccggcctcgtcgtcggcccgtacctgccgattccgctggtcgccaacccggaggtggtgacgacgctctcggagctgggcgtcatcctcctgatgttctcgttggggttggagttcagcctccgcaagctgttcgccgtgggccccacggcgggtgtcaccgccgtcatccagtgcagcatcatgatttggctgggcttcgtggtggggcgcgccttcgggtggaccaccctggagagcctcttcactggcgcgctcatctccgtgtccagcaccaccatcatcgccaaggccttcgacgagcagaacatccggggccggctgcgggaactggtggtgggcgtcctcatcgtcgaggacctcatcgccgtcctcctgatggcgacgctgacggccatctcctccggcactggcctgtccgtgggggagctgtcgttgacgacgggccgcctggtggcgttcctcgtcgggctggtggtggtggggctgttcatcatcccccgcgcggtgcgctacgtggtgaagctcaacaagccagagacgaccctggtggccagcgtgggcatctgcttcgcggtggcgctgctggcgcaggccttcgggtattcggtggcgctgggggccttcctggcgggctcgctggtggcggagtccggcgaggagaaggtggtggagcacctggtgcagccggtgaaggacatcttcgcggccatcttcttcgtgtccgtgggcatgctcatcaacccggcgctcatcgcggagcactgggcggccatcctggtgctcacggtcgtggtcatcgttggcaagctcttcagcgtgacgctgggcgcgttcctcacggggcacagcacccggacctccgtgcaggcgggcatgagcctggcgcagattggcgagttctccttcatcatcgcgggcctgggcctgtcgctgaaggccacgggcaacttcatctacccggtggcggtggccgtctccgcgattacgacgctcacgacgcccctgctgattcgcgtgtcagggccggtggccagctatgtggaccgcaagctgcccaagccgctgcagacgttcgtgacgttgtacggcacctgggttgagcggctgcgcgacgcgccccggcgccagacgttcggggcctcggtgcggcggctggcgcggttgatggtgctggacgccgtgttgctgattgtcctggtgattggcacgtcgttgacagcgggcaagctgggctccctcatcgagcagcggctgggcatcgatgagaacctgtcccgctacatcatcctgggcggcgcggtgctgctctccatcccgttcctggtgggcgtggtgcaggtggcgcgccggttgggcgaggagctggcggaggcggcgctacccgggcggaaggatgggcgggtggacctagcggcggcgccccggcgcgtgctgctggtgacgctgcaactgggcatcatcctgctggtgagcgtgcccgtggtggcgattacccagcccttcgtccggggcgccatgggccccctcatcttgctggccctgattggcgcgctgggcgtgacgttctggcgaggcgccaccaacctgcacggccacgtccgcgcgggcgcgcaggtcatcgtggaggcgctggcggcgcagtcccactcgcgagagccgggcgcggatgagcacgcgctcgaccacgtctccaaggtgctcccgggcctgggcgagcccgtgcccgtgcggctggagacctccagtcccgcggcggggaagacgctggccgaggtgaacctccgcggcctcacgggggccacggtgctggccatccggcgcggggactcgagcgtgtccgtgccgtccgcgcaggaggtgctgcagccgggtgacgtgctggcgctgacgggtacgcaggacgcggtggaggcggccaagagcctgctcaccggtgcaccggcgcccacctcggagccggagccgacgggcgcccaggtgtgagggacacgggcctgggggcggcgttcgttccgcctccggggcctaccgcttcacgctgtacttggcgatggcgtagagggcgcgtaccccgtccttccagccaatcttcttgccctcttcgtaggtgcgcccgtggtagctgatgggcacctcgaagacgcgccagcggccacgggccaccttggcggtgatttccggctcgaagccgaagcggtcctcctccacctgcacggagcgcagcacctcggcgcggaaggccttgtagcaggtctccatgtcggtgaggttcaggccgctggtcatgttggacagcgtggtgagcacgttgttcagcacggtgtgccagtaatagaggacgcgccggggcgtgccggtgaagcggctgccgaagacgacgtccgcgaccccgtcgatgatgggctggatgacgttggggatgtcgcgcgggtcgtattccaggtccgcgtcctggacgatgatgatgtcacccgtggattcggtgaagcctcgccgcagcgccgctcccttgccctggttcttctcctggaagaggacgcgcacctcgttgcggttgcgcggtgtaccgcccaacaggcccacaccctgctcctgaagctggcgcaggaattcgcggctgccgtccttggagcagtcgtcgatgaggacgagctccttcgggaagtcgacggcgacgcagcggcgcagcagttcggcgagggtgggaatctcgttgtagacggggatgacgagtgagacgagcatggcgttttgcggctgtaccgcattttgcgtcatggggcgaccttctggcacggaaggtgcgggccgggtggggcgcggcgttcagcggagcgctgcggcccggagcgcgtccatgagggcgtccaggtccgcgtcggtggtgagcgggttgatgagggtgacacggagatagacgtcacgggtgcagctttgtcatgcaccaggtagaaatctccgcgagtccccagtcgctcgctcagcttcgtgtggagggtgtcccactgctcgccggggacgtgcgcgggcgtgtggcgcgagcagaggatgttgcactcgggcggcacggccacctcgaagtcgctggcggctgagaggcgctgggcgaagcggtgggcctgctcgtaggactccgtcaccgcgtcggagaagagccgggtgcccagcacggcgaggcaggcgtacaccttgagggccatcatctccttggtgcactccagggtgcgcagggccacgtcgctccaggggcgctccgcgtcgccgtggaagatgtagctggcctcctgtgagaaggactcgaaggagcgggcgccgtcgcggaagaggacggccgttaccagcgcgggcatcagcagccccttgtgggcgtcccacaccacggagtccgcccggtcgatgccgcgcacgaggtgccggtgggcggggctgaggacggcggaggcgccgtgtgcgccgtcgacgtggaaccacaggtcatggcgctcgcagaagtcggccacgggttccagtgggtcgaaggcgccggtggcggtggagccggcgttggccaccacggcgatgggcttgcgcccagcgcgcgtggcggactcgagcgcggcgtcgagtgcctcggggcgcaggcggaagtgttcgtccaccgggacgggcgtcacgccgccttcgccaaagcccatgacgcgggtggcgcgggcgaggctgtagtgcgtcgtctgggcggtcagcacggtgaggggcggggcccggcgtgggcgccgccgttccacgcgtcgtagccggccttggcctgccgcgcggcgagcagggcggtcaggttgcccagggaaccgccggaggtgagcacgccgtcggttgtttcgggcaggccgagccgcgcggccatccagcgcaggacgttgcgctccatggcggtggagacggggcccatctcgtacacggccatgccgttgttgagcagggaagacaccgcgtcgcacagggcggccagcggcacgggggccgtcacctggtggcccacgtagcgtgggtggtgcaggtggttggacccggagagcacgcgggtgatgaggtctgcgaagtcgcccgtgggcgcttcggggaaggctgcggcgaagcggtccacgttcaccgcgggggcggcccaggggagcacggggccttcggcgcgggtggcgcgcgcgaggtagtcggagagcgtgtccatcagccggtgggattctcggcggaaggcgtcagcgtcgtaggcggcagcgattcgcgcttgaaagtccgtcatggcgcggcggaacgtaaccgtgccggtgcgagggcggaatggtcccttcgtccgttaccgggtgtgcggagaacccttggtaagaaggggcgagtgagcaggcggggtggcgtgtggtggtggcgcgcactaagcttggctcatggggcgcgcatgccgtgtgccctgctcacgtgaggaggatggccatggccgacccgaaggtgacgattacctactgtaccgcttgaggctacaggcctcgggccgcccgtgcggcggccgcattgaaggatgagctggatgtagaggcagagctgttgccgggcccttcgggtagctacgaggtcgccgtggatggcaaggtcgtcatccggaaggcgtcgctcgcattccccacggaccacgaggtggtggacgcggtggcgaaggtgctggggcggtagcgggcaggttgccttggccgcttcgtgcgatgctgggcgcgagtgaggggcgggccgcctcacgacgcgcccgcttcgcgcggacgagattcgccatggttgagcaggggaacttcaatgtctgcacggcgctgtgccacgagagtccttggcgttgctgctcttctttgggtcacgcccctggcggcggctgagaagtctgtctttgcacgactgcatcctgcaatgactcgcgccgaggtcgagaagctcgggaacaaggtatccctgggggcataccaggggcatctcatgtcctcgttcacgagcgaaggtgcgcttcagcgcgtcggcgcgattgccacgttccggcaggggagttgtccggaggcgctggagagcgtgcgccggtacctggagcaggatttcggcgcgccacgcagtctgaaaccgcatatcccactgtatggcgggctgcatcagcgctgtcatgactggaggctcggtgccgcgtggctgcaggtctgctgcgctcggcatgaactcaagaagggccgtcccccgttgatgcacgtatcggtcacctatggagtcaaaggcagggacacgcccgttgagcatggaggccacggaggggactcgctcatcatccccttcgacggttttcactgacatgcctctcacaagaacgtgaacggcaccactcacggcccgagtccctcgccgttggtgtgcaagcgtccagccaacattccaagaaaggcatgaaaaatcgagtgctacgcggggcaggcggccgagcaaccaagcgggaatcaggtcccggtggtccgctcccggacatggcgtgggggccccagctttagggcataggaggtgacactcatggcgtggccgacagtcgcgtcgccctacgagcggcgctccctcaccagtggactgcgggttcgggacgaaagcggggcgatgctgggctacgtagccctcattggccgcgagcacctgctacgcgcggcgctggcccttcagccggcagtggacggagttcccgctggcccgcgtgcggcatgtctcccggggctcggtgttcctggaggggcagatgccggggcgggtggtagcggccgacaagggcgcacacgcggagattcccacgcagaccctgcccctggcggaactggacgaggcgtccactcccgcctgagcccttcaaccaggtgcggcgcggcgcggggttttgtgcttcaaggaggcgccatggcccctatcgatgagctgtcccagagggtgtccgccgcgttcgcggatcggacgttgttgaaggacgcggcccacgtggccgccgtgcgcgagacgctggcgcggctggactcgggtgagctccgcgtggcggagaagggcgtggacggctggaaggtgaacgcctgggtgaaggaggccatcctcctcttcttcgcggtgtcggagatgaaggtgatggaggtggggcccttcgagttctacgacaaggtaccgctgaagaagggcctggaggcggcgggcgtgcgcgtggtgcccccgggtacggtgcgctacggcgccttcgtggagaagggcgcggtggtgatgccgggctatgtgaacatcggcgcgcgcgtgggcgcgggcaccatggtggacacgtgggccacggtgggcagctgcgcccaggtgggcaagcacgtccacctgtccggcggcgtagggctgggcggggtgctggagccgccttccgcgtcgcccgtcattatcgaggacggtgccttcctgggcagccgctccatcgtcgtggagggcgtcntggtggaagaggaagcggtgcttggcgccaacgtggtgctcacc

SEQ ID NO: 750 - DNA, 5308 bp, Myxococcus xanthus
gtgctctaaagccggggcaggccatcggtgccgccgtcacgctgcgcggcgaccgcatgtacgagttcatggaccgcctcatcaccgtggcgctgccgcgcgtgcgtgacttcaagggcgtgtcccccaaggcgttcgacgggaagggcaactacacgctcggcgtgcgcgagcagatcatcttccctgagatcaactacgaccagatcgagaaggtgaaggggctcaacatcagcttcgtcaccactgctgccaacgacgagcaggggctggcgctgatgcgtcacttcggcatgccgttccgtcagtaagccctcgagtcaaggacccgacgaaacatggccaagctctccaagatcgcccaggcaaagcgcaagccgaagttctcggtgcgccagtacaaccgctgcccgctgtgtggccggccgcgcgcgttcctgcgcaagttcaagatgtgccgtatctgcctccgcaaccgcgccctccgcggcgaagtcaccggcgttaccaagtcgtcctggtagccggaagggcagggtgcctggcgggcctcatcggccagccaggcacattgaagtaggaagttcgtagtggcggtcagcgcgaacccccgggatgggcccggcaggcgcggtggctgcgaacgcggggcgcccggtacggggcctcgtttgggaaggtactccatgccggtcaatgatcccgtcggcgacatgctgacccgcctgcgcaacgcttcgcgcgcgcgtcacgacaaggtcgtcatcccccactcgaagctcaagctcgagatcatcaaggtcctcaaggatgagggctacatcggcgagttcgtggtgcacgagcagaccgtgcagaacaagcgcacggtgttcccggagatctccgtgcagctgaagtacggtccggaccgtgcgccggccatcaccggtatccgccgcgtgtcgaagccgggcctgcgtcgctatgccgcggcgcgtgagattccgcaggtgctgggtggcctgggtatctccatcctgtccacctcgcgcggcatcatggtggattccgaggcccgcaagcagaaggtcggcggcgagctgctctgcaccgtctactagccagccgccagggtgcggcgccccgtgagggagcgcgccccaggcacacaggaccgaggcaaccatgagtcggattggaaaactggcgatcaagctcggcgacaagacgaaggccgtcatcgccggcgagcaggtgaacttcgagggccccaagggcaagctgtcggtgaagctgcctggcaaggtcaaggtcgagatcaaggacggccagatgaccgtgcagcgcgaggatgactcgcgcgaggcgcgcagcctgcacggcctgacccggaccatcctcgcgaacgccgcgaagggtgtgagcacgggcttcgagaagaagctggacatccgcggcgttggtttccgcgccgaggtgaagggcaaggccattcacttctcgctggggttctcgcacccggtggtgttcaacctgcccgagggcgtgaccgccgaagtcgacaaggcgccgcgcaacgaggacagcttgcccaccgtgggcctgacgctccgttcttcggacaatgaagcgctgggcgcgacggcggtgaacatccgctcgctgcgtccccccgagccctacaagggcaagggcatcaagtacgccgaggagcgcatccgccgcaaggagggcaagaccggtacgacctagtcgtcctgtctttcctgagtgttccaaactccaccgggtcctcgagacctggtggcatcatccggaggcggaaggccgcatcgcctccggacggaaaaggaagcagccatgcctacgaagattgaagcccgtctcaagaggaagaaccgcatccgcaagaagctgtcgggtacgacagagcggccgcggctcaccgtgtacaagagcctcaagcacatctacgcgcaggtggtggacgacaccacgggcaagacgctcgcgtttgcctcgtcgctgtccaaggacctgaagggtcaggacgagggcgacaagaaggcggatgcgaagcgtgttggtgctctgattgcgcagaagtgcaaggccgccaacgtcgaagcggtggtgttcgaccgcaacggcttcccttatcacgggcgcatcgccgccgtggccgacgccgcgcgcgaggccgggctgaagttctaagaattcgaaaggaatcccccaagtggcaactccgatcaatccgaacgatctggacctcaccgaccgcgtggtgaatatcaaccgcgtggcaaaggtcgtgaagggcggccgccgtttctcgttcgccgccctggtggtggtgggggacggcgccggacacgtgggcgtcggcctgggtaaggccaacgaagtccccgaggccatccgcaagggtggtgagaacgcgaagaagaacctgttccgcgtcccgctcgtgggtcacaccattccgcacgaggtgctcgggcacttcggcgctggctgggtgctgttgaagccggccacccagggtacgggcgtcatcgccggcggcgcggttcgcgcggtgctggaggcggcgggcatccggaacatcctgaccaagagccaggggtcgcggaacccgcacaacgtgctgaaggccactgtcgctggcctgaagctgctgcgcagcgcggagcaggtttcgcgtctccgtggcaaggacgtcgagccggcgaagctcgccggggagcagaggggctagcccatggcgctcaaggtgaagctggtgaagagctttgcgggtgcgtccagcgacatgctggacaccatccgtgggctgggcctgaagaagttcggtgacgagcggctcctcaaggacacgcctgcggttcgcgggatggcgttcaaggtgaagcacctggtcaccctggaaaccgtttccggcgacgcgccggcgcccaagcgccgcaagcccgccaagattgccctgcgggagcgggcgatcgcgtatcaggccaagcagaacaaggcctgagtcacgagaggatcgagacgatgagcactctgaacaaactgcagcgtccggcgcgctcgtggcaccgcaagaagcgcgtaggccgcggccagggtagtggtcttggcaagacggccggccgtggtggcaagggccagaaggcccgcaccggcaacatgcggttcgaaggcttcgagggcggccagagccccctgcagcggcgcctgccgaagtttggcttcacgccgccgaaccggacggtctacgcggtcgtcaacctgtcggacctcgagcagcacttcgatgccggcgccacggcggacgtggagacgttgcgcaaggtgggcctggtcaagggccgctaccacggcgtgaagctgctggcccgcggcgagctgaccaagaaggtcaccgtggtcgtgcacaaggcgtctgaggcggcgaaggcggccatccagaaggcgggcggcgcggtggaagagattccgctggtggcccacaagccggagtccgcggccaaggcgcacgctggcaagggcgtcaaggctcctcggcagcccaaggcctgagcgtgcctggcgcgcatcacttgctggtggtgcgcgcagtttcgcttgtgtaggcttctgcgcccctttcccactcgtggaacaggggcgttttgtcgtcctggcagaaccctctcgaagaggatggctaccccgtggctctgaacgccttcgccaacgtcttccgtatcgctgagctgcgcagtcggctcgcgtatacgctcgcgctgctcgccgtctatcgcatcggcatcttcatcaacacgccaggcgtggaccgttcggcgatgaacgcgttcatggacgcccagaagcagtcgggcggcctcgtctcgctgttcaacctcttctccggcggcgcgctggagcagatgtccatcttcggattgggcatcatgccgtacgtcagcgcctccatcatcatgcagctgctcgccgtggtcgtacccagcctggagcggctgcagaaggaaggcgccggcggccggcagaagatcaaccagtacacccgctacggcacgatcgcgctctccgtcgtgcagggcatcggcatctcgcggtggctggcgtcgctgggccgctccgacggtggccagagcggcttcaaccaggtggtcgtccccgatgacagcgtctggttcaccttcatgacggtggtcagcctcacggccggaacggccttcatcatgtggctgggtgagcgcatcaccgagcgtggcatcggcaacggcatctcgctcatcatcttcgccggtatcgtggcgggcctgctcccgggcgcgaagcagttgctggacctgacccgtcaggacgtcatctcgatggccgaggtgctcgcgctggtcgtcttcatgctcatcatcatcgccgcggtcgtctacgtggagcgaggcatgcggcgcatccccatccagtacgccaagcggatggcgggacggcggatgttcgccggccaggcgacgtacttcccgatgaaggtgaacacctcgggcgtgattcctcccatcttcgcgggcgccgtgctgtccttcccggccacgctgggaacctggttcccgttcctgcagggattccagcgcgccatcgaaggcaacctgtggatctacaacgggctgttcgtcgtgatggtcatcttcttcgcctacttctatacggcgctgacgttccggccggacgacgtggcggacaacatcaagaagcagggtggctacatcccgggcatccgtccgggccgtcagacggcggagttcatcgagcgcgtgctcaaccggctcacgttcggtggtgccatctacctgtcgattgtctgcgtgattccgtcggtcatcagtggcttgctgggggtgcggttcaccttcggcggcacggcgctgctgatcgtcgtgggcgtagcgctggatacggtgcagcagattgagggccacctcatcagtcgtaactacgagggcttcgccggccctcgcggcccgcgcatccggggccgggtgcgcgtggcggcctgagcctccgcgcgggcgttccgggcgcctctccccgtcgcggggaggggcgcctcgtcgttcccaggctaggtgttgttcaaggatattcgctggtgcacacggagcgcgctcgggggtttgagtcctacgacttccgtgccttccttcggagcaaagaggacacatgaacctgatcctgttggggccgccgaacgcggggaagggcacgcaggcgaagcgactgttcgccgacttccagatcccccagatctccaccggagaca

SEQ ID NO: 751 - DNA, 5538 bp, Myxococcus xanthus
ctctcaagtccatggtgatggcggacatcctggacatggtgacgcacgaggcaccgctcatcctcggcggcaccacgctggcggtattgctggccatgtggctgacgctgggcggcctgcgcatcgccctgctgtgcatggcgcccaccgtggtgtcactggtggcgctgctggggctgatgccgctgctggggctggagttcaactacctcaacatcctcgtcatcccgattctcatcggaacgacggtggacgcgggggtgcacctgctgacgcgattgtcgtcaccaggccatgacttcgtgtcggtgtattcggagacggggaaggccatctgcggcggcttgctgaccagcgcgatgggcttcggtgcgctcttcctcgctgaccacccgggcctcaactccattggcgcacttgccaatctgggcttcgccaccaacctcctcgtcatgctggtggccttcccggccctgctgctggtgctgtcggagcgcaggctgaagcgccattccgcccgaaaggaatcgcagaaaccggagccaccgcgccagtcggggcgcggcgagcccacgcacgcaagctgaaacacacacccacgacggagggagcagcatggcgaagcagatgaagcggggttggatgtgggccggagcactggcgggtaccctggcgttgggaaccgcgtatagcgcgacggaggctccggtgcaggtggcgcaggtggacccgtccaccggacagacggtgacgccgggcaccgcgccgagcaacaccacgtcgggcacgggccccggcacgacgccgcagacgggctcgacgaacacgaaccccaacaccctacccccggcgacgaaccccaacaccctgcccccgggaacgtccacgacgacgccgggcacgggcggctccggtgctacgggcaccacgccctacaacacgggagcggagggcgccacgtccaccgttccgggcaccacgccctacaacacggacgcgggcacgggtggctccggggtgctccccacgccaggcatcggcaccacgcccggactcgacgccccgacgggcaccgggacgtccaacaccgtccccgcgccctccggcgtcgtgaacgacggcggcaccggcttctagctgtctcggcgtcaccctgaagcagcgccccatccggcaccgcgggcctcgcggtgccgctgatggggcgttgccatgctggacaggcgcgtccgcgcctgctttgtcccacgggcatggagaccctcgtgacgcgcttgttgtcgctgcgagtgggcatgccccgggagctgggcgtcaccggtgccgcctcgccactggagcggccctggaccagcgccatcttcaaggagccggtgacagggccggtgtggctgtcacgcacggggctcgccggagatggccaggcggaccgcaaggtccacggcggaccggagaaggcggtcctcgcctatcccatcacgcactacgacttctggcgcgaacgcatggcgcgagacgacgtcggcgcgggcgcattcggtgagaactgggtgctctcccagggcacggaagcggacgtctgcatcggagacgtgctgcgcgtgggcggcgcacgcgtgcaggtatcccaacctcgccagccctgctggaagcccgcgcgccgctggggacagcgcgacctgtcgctactgctccagcagaccggccgcaccggctggtactaccgcgtgctggaggaagggcccgtccaggaaggcgacgtggtggcgttgctcgagcggcccttccccaccttcaccatcgccttcgccaaccacgccatgcacggccacgcgccggaggacgccgcgctgctggcggagtgtcccttgctgacgccgaactggcgtgactcgctccgcaggcgcgcgcagggtagtcggggagatgaccgcccgcggctggtgggacccaacagcgccgactgaaggtcagtgcccgcatggcaagccgttcccgcgtctcattcccgccgccgcctggagagcaggcggccatgggaggggcctctagcagagcgctcatcggctgctcacgttcccggccagcagcagtcagacacaaaccgaccggagaacgagccatgacgaagttcctcaagacgaaggccgtccttgcctctctcgccgccggtgccatcgcgtttggcaccgcctgtaagtccgactcgggcgcgacccgagaaacgacagacaccactgacaccagcggcatgggcacgatgagtgacccgaacaccggcacgagtacggacacccgcacggacaccacgacaccacctggcacgggcggcacaggcatggatgacccggccctgtcgcccgagtcggagaccgtggacccgacgctgaacccgggcaccggcggcgcgggtacggaggtggacccgaacctggacccggacatgagcagcgagccaggcaccggcggcgcgggtgacgtggagccgctcgacaacacggacaccgatgagatggatgccaatgacgactccacgctggagccgggcaccggcggcagcggcatgacggacccggacacccgggtgacgccgcccacgccgctcccggagacgggctcgacgcgctaagccggcccgcacttcacggcaatgagacgatgcccgcggcgaccgtgccgcgggcattgtcctttatgacgcacgccacgacagcgaagaagacgatgcccgcggcgcctgtgccgcgggcatccccctgtgtgtcatcagcgtgggactcagctcacgctgaagcccggatacggctgcggtgacttcaccggctcgatgatgcgttggctgccacccgtccccggcgtgccagcgggaccaccctccggctgcaacgcgggcggactgccgcgcggcgagcgctcctcgtcctcggtgtctgcattccggtcaggcgcggtgggtatggcttcaggtggaatgtgcaacacgtccttcttgctcatggcggcctcctttcctccaacctggggcccccctccgaaatgggcacctggcatctggccgcctgcctggacggatgcttatgacctcggatgggttgcccgcgcacggcccgccgtatggatgaacccacgcctgtcgtgcgtgaccacgttgaggacgagcgggcagccactgcccgtcggtggcaccgtcgaggagagccacgctgaaatagtgaaccgaacctgaagcgcggttcagaatctggtgggatgcgatgagcgtgaagttggcattggccggcaggcgacgggaaagcgaacacctgttctcccctcccgagggccccatcccctggctccagcggatgtcgtcgtggttccacgagcgccatggcgagctgctcgaaagcgccgtactgggcaccggccccctgggcgctcccacgctccgactgcggctgcacccggcggcgggcgaggtcgcgctggtggccacctcgggcgcccacgtctccgtgtccgcggagacgtccaccgtgggccccggctaccaccgcttcctctgcgacacgctgagggccatgggtgacgcgctcggcatcgtctgggcggagggccgcgcgtcctcgaaggggggcgaccccaccggctacttccacacgggagacgccgggcccgtggatgtgcacatgctggcgtcgctccaggaagccgtggggtgggtgctgcgcatgctcccccagggcgagtccggcttcgcgctgtccatgcgcttcggccacaccttcgaatatcccggtgcgctgctgacgccgctggggcctcgcgacacgcgctggctggtggacgtgtacgaggacccgcgcaggggcatcgacgtgttcccctggtggacgccgggcatcgacgcgcgcatgcggctcaatcgcgcgcggtgccgcctgtggacggacgtggtctggcgcccaccgctgctggacgacgagcgccacctgatgcgcgacgtggcccgcctgctggagcaggcctggcgcgagaacccgtccctgccctatccgtggcgggagtggcaggaggtgctcggcttcctgggcgtgggaggcaccctggccgaggaagtccaccagcgcgcctcccaggcacctggcggcccgcccatgggctatcggcgcggcgaggtccaggtggcgctgccagcgggctgggagattcgcatcccggggtcgctcgcggaggcgcacctgcaggatggaacatgggtggcccgggaccatcggcgcagcgtgcgcttcgtccccctggaggacggcggcgccgacagcctcatgccctccctcatggagcgccgcgcgatggacctggagcaccacggcaagcgggtcagcggacgggcctcactccacatggagccgggcgagtgccggctgaccgccctgtgtacctcgggcaagcgccgcgccctgtgcgtggtgagcttcgacgacccggacgagcaggactgggcgctggggacctggcgctcactggaccacgctgtcgccgcgtgacgcttgccagcccagaggtgccatcccacattgagcaggcctttccatcagaatcgagagcctgcaatgagtcgggaagtctggccaggcaagccctggcctcgcggcgccaccttcgatggttcaggggtcaacttcgccatctactcccaggtcgcgacccgcgtggaggtctgcctgttcgaccccgcggacccggcgcgcgaaatcgaacggttcggcctgccggagtccacggacttcgtgcaccacggctacgtgccgggcctggagccaggcacgctctacggtctgcgcgttcatggcccgtacgagcccaccaagggccaccgctgcaatccgcacaagctgctggtggacccctacgccaaggcgctctacggcgacgtggactggcgccagccggtgttcggctatccactggggcacgagcagcaggacctggcgcgagacgaacgcgacagcgcggcgggcgtgcccaagtccgtggtggtgagcgactacttcgactggggcaatgaccggcgcccggacatcaactggcgtgagacggtgctgtacgaggctcacgtgcgcggcctcaccatgcgccaccccggcgtgcccgaacacctgcgtggcacctacgcgggcctggcctgcccgcccgtcatcgagcatttgctgaagctgggcgtgacgtcggtggagttgctgccggtgcatgccttcgcggacgactcgttcctcgacgacaagaagctgtccaacttctggggctacaacacgctgggctacttcgcgccggagcagtactacgccagtcgcaagacgcccggcgccgccgtcgccgagttcaaggcgatggtgagggacctgcacgccgcgggcatcgaggtcatcctcgacgtcgtctacaaccacacctgcgagggcaaccacctggggcccacgctgtcgctcaagggtatagaccacgcgagctactactggctgaagcggcggggggggctgacaagtgtctcaagggggc

SEQ ID NO: 752 - DNA, 6594 bp, Myxococcus xanthus
actactcctagtgagctctaaagcgagcgccgcggcggtcggctcgttcacgatgcggcgcactgtgaggcccgcgatttcacccgcgtccttggtggcctggcgctgggcgtcgttgaagtacgcggggacggtgatgaccgcctccgtcaccttctcacccaggtagttctccgccgcgcgcttcagcttcagcagcacctgcgcgctgatctccggcgcgctgtactgcttgccgtcgatgtccacgcgcgcatcgccgttgggcccccgggcgaccttgtaggggaccagcgtggcctcctcggacacctcgtcgtgccgccggcccatgaagcgcttgctggagtagatggtccgctccgggttggtgatggactggcgcttcgccacctgaccaaccagacgctccccgtccttcgtgaacgcgaccaccgagggcgtgatgcggctgccttcctcgttgacgatcaccttgggctcgcgaccctccatgatcgcgaccacactgttcgtggtgcccaggtcgatcccgataatcttgcccacggttcctatcctccggaaaagactgcgttttttctgaaaacttctgatgtacgcccaacgtaaccacccacccctcgctgtcaaacgagagggaccaccgggccgcacaactgaaggtggcactccccgctgcgtagcgcagtgcgcaggcccacacgcaccgcgtcacagtcgtgccacccgcacgccacgggtgcgtaacgcgctctacaccgccgtcaccccgaggtagcaaccgggcgggcttctgggcagcaggtaacgattcaaccccttggaatctcaagcccgcccgcctgccgacgccctgcgtcatgacttggcgaggattgtgcactggctgcgggtgtcgccgcccggtcccccaccggcgcaaccttcggagccgccctcatgctggtccagcccctccgctctcccgatctccgccgtgcgcccacatcggacgtcaccgccgagcccaaggtcgcggtcctgctgaacgccaacgcccggaaggtcgacgctcgggtggtgaagtccctgtcccacgtggtgccggagcaggacctgttcctctcccgctcgccgctggacgcccgccgcatcatccagacggtgctggagcgtggctaccccatgttgttcacgggcggcggtgacggcaccttcatgggcttcgtgaacgaggtcctccatcaggtaggtccgcgcggccggttcgcggggaagacggcgcctcgcttcggcgtcctcaagctgggcaccggcaatggcctggccacctacgtcaacgcctccggaacccggagcgacggcatcctcaatgacgtgctgcgcgcccgcacgggcgaggttccgggctaccgccccatggacctgctgatggtggacgggcagcgcgcgcccttcgccgggctgggcgtggatggcaaggtgctcaacgactacatctgggtgaaggagaacctgggcaagggcttcttcaagagcgtcctcagcggcagcggcgggtacttctccgcggtggcctgcaagacggtgcctcactatctcacccactcccactgggtggagtgtgaggtcgtcaatggcgcctccgaggcctaccggctggggccggatggcggcgcgatgggcgagccgctggccccgggtgccactctcttccgcggccggctgatgatggcggcggcgggcaccatgcccttctacggctacggcttccgcatgttccccttcgcgggccagcgcccgggattcatgcagttgcgactggggcaggtgacgcccacgcaggtgctcacccacctgcccaagctatggaacggccgctggttccccgaaagcctgatggacttccacgcccgcgaggtcaccatccgcttcgccaaccccatgcccttccaggtgggtggcgacgcggccggctaccgcgagcaggtcaccttgtccgtggctccggagtccgtcgagttggtggacttcaccggcgcgctgaactgagcgcccgccgggtgccgctcctggttacccgcggtcgcgggacgctgggggcttctcgccctgctccttgcggcggcccacgacgaaggcgtagctgacgctggccttgccgttgctctcgcggtgcagcgccagctcctcgcggagcgcggcgggctgcgagccagggacggacgacaggaacgtctcgatgtcccggtagtgcgcgtccagctccgcgtcatggagcgactcggcggactcgggctcgtagccggcgccctccaccacctgcagcaactcgcgcggcagcagcagcggcccggcgatgcggcgctcccagaagtcgagcgaggccttgggagcaaagcgccccacccgcgcggggaacgtgaagcccagccgcccgcgcttcgacagcagactgcgcatgttcgccagcgtggccttcaacgcgtagagcacacggccctggatgaggatgccgttgaactccccatcggacaggcccagcgcgtccagcgacacgcggcggacttcaatctgctccgccagcccctgtgcccgcacgcgctcacgcaccgggttgaggagggcgtcgtcggtgtcggccgcgacgacggtacagcccatctcccgggccaacagcagcgcggcgcttccatcggggccacagccgagcaccagcacgcgcgagccgggctccagctgggccaccttcgcgaagcgccgcgttgcatcatccgagctgaaggcgcgccggacatccgcggggtgatacagcgggaagggctcatgcgggctcatggctcccatatacccgcctcctccagagacttccagccacgggcccctacaagtagtagatgacccgctcgtccttgtggagcccatcgtagatggcgcgccgctgctcctcggacagcaggtacacggacacgctcagggagacgtacttgcccttgctgctgggttgctcgcgaatggaatccggcgagagctccgtgcccaggaaccgcttgaacagctcacggacatgctccacgaagccggccccctgcgcgcccatcaccttgaaggtgtagacggaggggtactcgatgaggggcgtcttctccccttcgccggcgggagggcttcctgcgtcttccttcgtcatgtctcgtaccagagaggctacagcaggttggcggcgagctcggccagggcgctgcgctcacccttggacatggtgatgtgcgccgcgatcttctcgctcttgaagcggttgaccacgtggaccaggccattgttcgtcgcgtccacgtacgggttgtcgatctggaacgggtctcccgtgaggatgatcttcgtgttgtcgcccacgcgggtgatgatggtcttcacctcgtgcggcgtgaggttctgagcctcgtccacgatgatgaactggttgggcaggctgcggccacggatgtacgtgagcggctcgatctccatcagccccaggtccagcagttcgtggtagccgcgcccggccttcttgtccgcgcggctgaggttcatcaggaactccacgttgtcgaagatgggctgcatccagggattcagcttctcctcgacgctgccgggcagatacccgatgtcccggcccaacgggaagatgggacggctgaccagcagcttctggtagagcccctcctccgtcaccttctgcaggcccgcggcgatggcgagcagcgtcttgcccgtgcccgccttgccgacaatggtgaccagcttgacgtcgtcgttgagcagcaggtccaggcagaaggcctgctccatgttgcgcgggcggacaccccacgtcccgtccttgatctgccgcaccaggggcaccaggcggcccttggacccgttgaagcggcccatggcggtgtgggacgggttcgtctcgtccttgaggagcaccacctgattggcgaacagggactcggcgtccggcggctccacctcggcgccctggcggtacatctggtccaccaggtccttggggaccagccgctcggcgaagccggtgtacagctccgtgatttccacccgctcggtgtcgtagtcctgggcgataaggcccagggcgtcggcgcggatgcggaggttggtgtccttggtgatgaagacggcctgcgtgcccggctccgcctccatcaggtcgagcgccaccccgaggatgcggttgtccatcaggttgctgtccgccatggacggaggcagcgcacgttcggtaaagctcacgcgcaacaagccaccgtgcggcagaggcaccccttccttcagggagccctcggcgcggaacgaatccaggtagcgcgccaccaggcgcgcgttgcggcccagctcggagagatcgcgcttgaactggtcgatctcctcgatgacgtagatggggatgatgacgttgttgtctttgaagccgtagatgctgcggggatcgtgaagaaggacgttggtgtcgagaatgaagttcttacgcatcgtgggttgcgcgacctgaaggttcggctgcgaccgcgagggaccgtgcgacggtgagtctcctgaccactataggcaccggcttcaggggaaacagcctgcttgtcgccaggacgtgcggctgtccgaaaccccacgccccagacgccggggatgacggcggttcgcatggcgcctttctgcgagtcaccatggatcaaccctgtagcatgagcggccgtccgttcagtgcgccacgacaggcgcgagcggatcatatccaagcagctccgccacccgctcgggcggcggccccgggggcatccgctcccagggaaagcgccgctggagtgtctcctcatcgagcgtgagctgccgccgggcatccagttggagcgcgtcatcccacgtgttcgcatcgaagtgcagccccagccgcgagctcagcggagacaccatgggcgaaggcttgaaggccacggcctctccgtgctcgtcccgcatgcagtgcagctccaccgcccacgcatggagccagcgcggcaggtgccgccccgcctgacgaagcgcgaggaagcggccctgcgcggcgccatccacgaagaggaagcggcggtcatagacgcaggcggcggcgaaggtggacggcgtgagggccaaggcctcggtgccgatacggcgggccatcagcaggagcacgtccaggatgtggccggcgagcttgagcccggggtggttctgcccgggcagcggaggccggttccagtcgaaggcgcgccccgggttctggagcaacagcgagtccaggtacagcagcggcgtggcggcgagcgcgtcaccgagccccacctccgccccggtcgtccgccgcaggtccaggtccgccacggggacgtagaaccgcctgctccacaggatgatgcgtggccggtacgggtccgtgcacacgacgcgaagctccagcggccccacccgctcctcgacgcgctggaacagcccataggcacgtagggcccgctccaggccctgggggctgtaggtgccaaagacgaggtccccgcgggaggcttcggcgctgcccagccccaggtcttccagggtcatccccgcgctctcggaaacggccaggtccggcccgctcagcgcctgatagatgcgacggtagcgggggttgatgggctgaatccgaggcatggcttccacctattcgtagcggatgtccaccaccgtgagttcgatgtccccgcgcggccgccgcacctcgaccgagtctcccacggccttgcgaaggagcgcccgccccatgggggattcgacgctgatgcgcccgcccgaggcgtcaatctcgtcggaacccacgatctggtaggtgctgcggccgccgtcctcgtcctccaggctcaccgtcgccccgaagaagacgcgggagcggtcggtctgctcggcgggcgtgacgatggtggcggtgtccaggcgcttctggaggaaacggaggcggcggtcgatttcgcgcaggcgcttcttcccgtagatgtactcggcgttctcggagcggtcgccctgagcggcggcagcggagacctcggccgtcaccttggggcgctcctcgttgagaaggtggacgagctcgcggtgcaggcgctcggcgcccgcccgggtgaggtagcggcggaacggggcccgctcggcgtcgtcctcggtctcctgttcatccggatgtacgtcctgggacatggttcctgtatatcgccctggggtgacacgcggcgaagggcgctggccctgacgttcaccggaaagcggtcggggcgtgtcagaaacagccccatgcgctcgccagtggaaagcgtcgccgagtgctggtaggaagcgcctgccccgggggcttccggggtggtggcgaaaaatttaaaaaagaatagtgcgagtcgctagctcagctggtagagcaccggccttttaagccgagggtcgggggttcgagccccccgcgactcatgtagttgaagtgaaggtgtgctgtccccgtcgtctagaggcccaggacgctggcctttcaagccggtaacacgggttcgaatcccgtcggggacactgtactgagag

SEQ ID NO: 753 - DNA, 6161 bp, Myxococcus xanthus
cgcgcgacggctacctctggctgggcacgtgggaggggctggcccgtttcgatggcgcgcgcttcacggtgttcgacaagcgcaacgcgccggagctgcgcaaccacaccatcaaggcgctcgcggaggatgcgtcgggcacgctgtgggtgggcacgggccaggggctggtggcgtaccgcaagggccacttcgagcgcgcgccgggcgccgccgcgtcgctggactccgcgcgggtggagacgctggtggccgcggatggcgtgctctgggtggggacgacgacgggcctctggcaggtgccgctgggcgagggcgtggcgcgccagtacacggaggcggatggcctgcctgcctcccacatcacggcgctgacgcccggtgagggcacgtcgctctgggtgggcacgccggaggggctggcccggtgggtggatgggcgcgtggagccggcgccgttccccttccccgggccggagtcccggccctatgtgatggcgctgcgtcgcgatgcgacgggcgtgctctggctggggacgaaagcgggcctctattcgtggaatggcctggtggcctcgcgcttcacgaccgacgaaggcctgccgtccctgtccgtcaacgcgctgtacgccgacggtgacggcaacctctgggtgggcacgcatcgcggcggcctgacgcggcacaactcgaagggcttcagcgagccggtgcccggcatggagtggatggcggagtccgcggtgttgtcgctgctggaggaccgggacggccacctctgggtgggcacctattcgggcctgatgcgcctgcgtgacggtcccttcgccacatatggcatccccgagggcctggccgacgagacggtcagcgccgtgctggaggaccgccgcggcacgctgtgggtggggaccaccagcggcctgttccggtacgagaaccgcacgttccaccacgtgggcaccgagcaagggcttccggagagcgtcatccccgcgatgcacgaggcgcatgacgggacgctctgggtgggcaccctcaccggtgcataccggtatgacggccagcgcttcacgcgggtgtcgcgcgcgcaggggctgccgcacgacgtggtgacggccatcctggtcgactcgcggggggacacgtggctgggcacgcaagcgggcctggcgcggatgcatggcggcggcgtgacggtgtacggcccgaagcacggcttcaccaaccccatcatcgtcatggtggaggactcgcgcggccgggtgtggttcggctcggacacggggctggtgcgctgggacggcgagcagaagggcttccagcgcttcacgcagcaggacgggttgccgggcgacctggtgctggcgctgcacgcggaccctgacggtacggtgtgggtgggcacggagacggggctgggccggtggcgcgaggacacctgggcgcgcttcaccgtcgcgcagggcctgtacgacgacgcggtgttcagcctggtgccggacggggacggctcgctgtggatgagcagcaacaagggcgtgtcccgcgtgtcccggcgcgacctggaggacgtggcggctggcgtgcgtccgcgtttgacgacgatggacttcgacacgcgcgacggcatgcgcagcgcggagtgcaacggcaacacccagccgtcggcgtggcggggggaggacgggcggctgtggttcaccaacctgcgcggcgccatcgtggtggacccggtgcgggtgcgcgagagccggcagccgcccgaggtgcggattgaagaggtgcgcgtccagggcacgccggtgccgatggaggggccggtggagctggagcccggggcctcgcggctggagattcgcttcacggccttcacgccggtggacgcggcgcggctgcccttccgctaccggctggcgggccatgacgacacctgggtgcacgcggagtcgcggcgggccctgtacaacggcctgcggcccggcagctaccgcttcgaggtccaggcgaagggccgggacggcgggtggaccgagccggtgtccctggacgtcgtgttggagccgaagctgtggcagcgcacgggcttctggctgctgtgcgtactgggcgtggggattctgggcgtcagcgtgtacctgctgcgcgtggggcagttgaaggaccgcgagcggtggctggcggagcgcgtgaaggaccgcacgcaggcgctggcgcgggccaacgcggagctggaggcgaacatgcacacgctccggcaggcgcaggcgcagctcgtgcagacggggcggctggcggcggtgggacagctcgcggcgggcgtggggcacgaaatcaacaacccgctggcgtacatcgtgtcgaacctggagcacgccagcgaggaggcggacgcgctcgcgcgggagttggacgggacgcgcgacgtgggcgctcgcttgaaggatgtgaatcaggcgctgcgtgacgcgctgctgggcgcggaccgcgtgcggcgcatcgtccaggacttgaagatgttctcccggccggatgacgagaagcaggggccggtggagttgcacgcggtgctcgactcggcggtgaagattgccatgggcgagctgcgcccacgcgcgaagctggtgcgcgactacggcgacgtgccgcgcgtggagggcaacgaggcgcgcctggcacaggtgttcctcaacctgctcatcaacgcggcgcaggcgctgccggagggacaggcggggacgaacgaggtgcggctcgtcacgcgcaggggcccggatgggcgggtggtgacggaggtgcgcgacacgggcagcgggatttcgctggagctgctcggccgcatcttcgaccccttctacacgacgaagccggtgggcgtgggcacggggctggggctgtcgctgtgccacgcctacctgacggccatgggcggcaccatcgccgtggacagcgaggccgggcggggctcggtgttccgcgtgacgctgagggccgcggcggaggcgcagcgggttggcggggacggtgcctcggtggagcctcccgcgacgtcggaccgaggcgtgccgggggccgccgtgcctgtgactccagcgtcttcgggagacatcgcaacggtgcccgatgtgtctgtcgagcacggtgtggcggcgagcgacgcgaccacgatgcgcctgcgtggcgaggccgccccgcgtgccgaactggactcgacgccgcaggcctctgctccggagcggacgcaaggcgctgggtggggcatcactcctccacaggcgaagtccacggacggccgggcagcggattccgccgccctggcggcgagccaggagaacggagggcggatggccgcacagaacgccagtgtcacgtccggcatgtcacggtcatcggaggcgggcaccgtgggctcgcaccagggagagccgtcgtccacccatgcgagcgcggaggggtcgcctccagaccgcatgggcgaggatggacggttctccgctaccgaggcggcaacgcgaggccgcgtgctggtggtggacgacgatgccctggtgagtggcgccatccgccgcactctcgcgcgagagaacgacgtggatgtgttggtgagcgcgcggcgagccctggagaagctgaccgggacagaggcccgttacgacgtggtgctctgcgacctgatgatgccggagatgaccgggatggacctgtacgacgcgctcgcgcaggtggactcgcgagcggcggagcgcatcgtgttcatcaccggcggtgccttcacggccaccgcgcggacgttcctggagcgcgtggcgaatccgcgcgtggagaagcccttcgacccggaagccttgcgccagctcgtccggtccgaagtggcgcgtgctcgccgggaggcgtcgggccgggcggcatagctcctggcccggccgtgtcagaggtccagcaccagccgcttggagcgggcgcgtgacacgcagacgagcatgcgctggtcacccgcgggctccgcctggaagaaggtgtcgcggtggtcgggctggccatcgcagacccgtgtgacgcaggtgccgcacgtcccggcctcgcagtcactggggatgcgcacaccgttgcgacgcagcacgttgagcaccgactggccgacgggtacctgcagcacctggcccgtgctgcggatggtcacctcgaaaccctgctcctcccggcccgtggcggcgctggtgccctcggcggtgaaggactcgaagtgcaccttctcccaaggccagcggtgcagggtggccgcgtcgcgcacggctttcatcaaccccgtgggaccgcagcagtacagccgggcccccggctgtcgcgtggccagcagtcccttcacgtccaggccccgggccgggtcccctccgtcgaaggagaagcgcacgtgctcggcgaagggcgcctgggagagcagttcgtggaaggcggtgcggccgggcgcgcgcgcgcagtagtgcagcgtgtagtccgcgccggtgcgctgaagcacgcgcgccatggacagtatgggggtgattccgatgcctcccgccaccagcacgtagctgcgcgcgaacagcagggggaagttgttgcgaggaggcttcacctccagcacgtccccctcgtgcacccgttcgtgcatggcgttcgagcccccgcggcccttggcatcgcgggccacggcgatgacgtagtggtgggtctcctccgggtcgttgcagagtgaatacgcgcgcaggaagtctcccggacctgggacgcggacctccaggtgggcgccggcctcgaaagggggcagggggcctccctccgtcgcgaccagctcgtacgacaggatgtcctcggcctcgcgagtcacgcgcgcgacccggacgcgcaggatgtcattcatcacggtgctctcccttccccagtcccaccagcggcgcaccccatcctcccgaggtacggtggcacggacattggcccgcgaaacgcccacgggtgattgcccgggagtctcggagcccgtcgcatccccagcggtgtggcgggttgcccgttgagcggccgtgcggccaggccgcccatgtgccgctcgcgcatccaagcggcgtcatccccaccatccacgacatgccgcgctgcgccagggggccagcggccaacgaactcttcagggaggtgagtccatggatgccatcgcgttgctgaaggcggaccacaagacggcggagcagttgtttcgaaagttcgagaaggcgggccccaatgcacacaagttgaagcgtcggctggtggaccagatggtcaccgaactggccgtgcacgccgtcatcgaggagcaggtgttctaccccgcggttcgttcacgctcggaggagttggggccggacgtgctgcgctcgttggaggagcaccacgtggtgaagtggctgctggcggagctggacggaatgtctccggaagccgagcgtttcgacgcgaaggtgcaggtgttgatggagaacgtgcgcgcgcacgtcctgcaggaggagagcgacctcttcccggcgctgaagaaggtcttccgtccgcaggaacttcggacgatgggcgacgtgctggagatgtcgcggaaggcggcgcccacgcggccgcacccgatggcgccggacacgccgcccggcaacctggtcgtgggcgcggtgtcggcggtgatggacatgggccgggatgcgctgagggccgcgcggcggaaggccaccacgaaggtgcgctcggtggcgagccggggccccggtcaggtggtgcgggagatggccggcgccgaagccagcggtccgtgacattccgccgggacaggattccggccagtccggcgctccttcttcccggagggagaaggagcgccccgggcacgggcacgaggaatatgaatgtcacccgttgacggccgttccaaggggtaaggacgttgcagtacgacccgcagcggcccattcctgaggaggcaccatgttcgctcgacctgttcgacccctgttgctgacagcgatgttgctcactggcctgacggccttcgcgcagccccagcccgtctccgcgccgcgtgcgcaggccccggcgggcatgcggacgattcgcgtggaaggcaccggtgaggtgaaggcgcagcccgacgaggcctgtag

SEQ ID NO: 754 - DNA, 6189 bp, Myxococcus xanthus
gcgctccggattagaaatcgtccgggcatccaccgacacccacgccttgtcgacgcggatacgcccctggtcatccttgaccacagaagccaccacggccacgtagctgaggaagctgcggtgcgcggcgagccccagcgcccggccattcgccttgcgcgcgtcccagccggacatcgccgtcacgcgctcgatgacgccgcgcaagcgccccgcgtccacggggtggtcctccaccgacgcgccatagttccgcagcgcggtgatgcccagttcctggagcgacgccttgcgcggcggccccagcacctccaggagcatgtcgcgcgaatccgtgccgcgaaggtgcgccagctcgtccacgaacgcgttcacggagaaggcgtggaagatgttgtagacggaccggagccagccgatgcgcacgtgcggaggcgcctcgcaggtctccgcccggacgttgggcacggagagcgccaggtcgagcacaccctgctggaggtccgacgggctgggccgcgtggcctgcccgaaggtggacgcgatgggcgggaacgcggtgcggtgccgccacgcgatgaccttgccggatgcatccagcccagcggtgagctgctgcgcgctgacggggtggtagtagtcgtgccggacgtcgtcctcgcgcgtccattgcacgcgcaccggaacgcccgcttccttcgccagccacaccacctcggcgatgaagtccgccttggacttgcggccgaaacctccgcccaggaacgtgacgtggacctggaccttctcctctggcagctccgccgtcgccgccgccacgccgcgcgcagcctgcggatgctgcgtgggcgcccagacctcacacgtcccgttctccacccgcgccagggccacgggaggctccatgggcacgtgggactggtgggggatgtggtactcggcctggatgatgcgggcggcggaagcgagcgccgcgtcgatgtcaccgacgttgcgcgccaccgttcccggctcgcgaatcgacgccgtcaactgctcccggtacgtcgtcgagtcataggaggcgttcggcccgtcctcccaggtgatgtccagggcatcgcgcccgcgcatcgccgcccaggtgttctccgcgagcaccgcgacgccgccccagaactggaacgtgtagggcggcttcggcgcgggcagttcgagaaccttcttcaccccgggcaccgcgagcgcgcgggtggcgtcaaagcgaacgaccttgccgcccacgacaggcgggcgcgccaccaccgcgatgagcatgcccggcagacggatgtcggcgccgaacaccgcggttcccgtcacataggccgggccatccagcagcggcatgggccggccggccatccgcagctcactcttcggccgcagcttgacgtccttcgccttcgggatgggcagcctcgacgcatcggccaccagttcgccaaagcccagcgagcgcttgccatcgcggaggaacaccgcgtggtcgcgggcctcgcacgcctccggcttcaccttccagcggcgggcggcggcggccaccagcatcacccgagcggtggcccccatgcggcggatgtcgtcgtacacgccccgcacgctgctggagccgtccgtgttctggtcgccgtagaccttgtcaccgtcgggctgggccaccgtcacccgcgccatgtccgcgcccagctcatcggcgacgagcaccggcagcgagctgcgcacgccctgccccatctccgagcgggcacagacgatggtgaccgctccgtccggagccacgtggacgaacacgttcgggttcaaccccggagcgcccttcgccgtggaggcgtcactggccgccgcggccaggcctccggagaagacccccagggcgagccctcccacggacagattcagcccttccaggaacgagcgccggctaatcaacgtgagcagcttcgtcatggcggcctcgtcactcctcggacatgcccgcggccttcttcacggccgagcggattcgcgtgtacgtcccacaccggcagaggttgcctgcgagcgactggtcgatctccttgtcggacggctgcggcttcttcgccagcagcgccgccgcgcacatgatctgccccgtctggcagaagccacactgcggcacccccagctccacccaggccttctgcagcgggtggttgccgtcgggcgacagcccttcgatggtcgtcaccgagtgcccctccgcgcggcggatgggtgtcacgcatgcgcggaccggctgcccgtcgaggtggacggtgcacgagccacacagcgcctggccgcagccgtacttcgtgccagtgagcccgagcacgtcccgtaccgcccacagcagcggcatctccgggtcgacgtccagctccttctcctcaccgttgatgcgaacgcgaaccgtcacggccgtgcctcctcgctcgggcactccgagcccgtctccacccaggccgcgacgatggcgccgaactgcgcctgcgtccccggagcgggcttacgccccgagcccgggttccatccccaggccaccaatgcgtcgtgggcgttgtgttcaatcatctgctcgggcgtcttgccgccgttgcgcttcgtgtccttgagctgctcgcacacctcacgagggctcttccccacccacgccatttcgatgggggcgacatgccacttcggcgcgccgggcacgcgtgccaggtcctgattcttgtcctgatggcagctgatgcactccatgcccaccacgccctggtcctcggggccgcgcaccacgggcgggtcatgaagctggccgtcgtcaccttgcagcgggctgtcacccgccgggtgacagttcgcgcaccgcgggtggaagaagacgcgactggcctccaggaagagcgcgcgggagcgctccttccggtccaggatggccgcgaaggcttccacgggtcgcaacgcgttgggggcaacctcgggcagcgcgggaatctgcgccgccgcggcatcgggctcccgcttgcaccctcccgccagcaggagggcggagagcgaggccatgaccggaagagatggctgcatcacgccaaggctccggcatgtccgtaccaactacaaggcgaatgttcgggggccaggatgaccccacacgtgacggttcagtgaacggcactcgcttcagcctgcgcgacttccgcctcagcggcctccacttcgtcgaaccggaattttccgtccttgaagtccgctctcacgcggctgttctcatggatgtcgcccgagatgagcttctccgcgagtggcgcctcgatggcgcgctggatttcacgccgcagcggacgcgcgccgaaggttgggtcccatcccttgtccaccagcgcttccagcgccgcgggcgtcacctccaggtcaatgccctggccgtgcagcaggcggcgcgtcttctccagcatcaggtccacgatggcgcgcagctgcgcgcggttgagcggctcgaagaccaccgtctcgtcgatgcggttgaggaactcgggcgggaagtgccccttgagcacgcccatgacgcgctcccgcatgcgctcctgcggttccttgcgcgcggtggactcctggatgaggtgcgagcccaggttgctggtgccgatgatgacggtgttcttgaagttcaccaccgtgccctgcgcgtccgtgagccgtccctcaccaaggaactggaggagggcgtcgaacacgtcggggatgggccttctccacctcgtcaaacagcaccacggagtagggccgccgccgcacggcctcggtgagctgcccgccctcctcgtagccgacatagcccggcggcgcgcccaccagccggctcacggtgtgcttctccatgtactcactcatgtcgaaacggatgagccgctgctctccgccgaagagcgtccgcgcgagcgccttcgccgtctccgtcttgcccacgcccgtggggcccacgaagaggtaggtggccaggggcttgtcggacggctggagcgcggactgcaacgtgaggatggcgtccaccacggcttccacggcttcgggctggcccgctacctgccgctgcatctcccacgtcagcgcttcgcgcttcttcggctgggcgcttcccaggatgaaatccggtaggcccgtctgctcccgcatcgcgtcgatgacgtcccccgacgaaaagcgccgggtgcccgaggtgctgacgccctgtcgggccatgacgcggcggagcagacggacggccttgcccgggaacgcctcgtgcgacacgaagcgctcctgcaatgagagcagggtctccagcgccagcggcgagagctggaccgcgctgtccgtgccttccgcctccaggtcgcgcacggtgccgaggagcgcgggcagcgtggcacgcgcatccagcgcggggacatggatgacccggaagagcgaggcgagggtgggggcttcttcccgcacgcgctcgaagcgctcgggcgtggactcggcgagcacggtgagctcgccccgggccatgtggggctccaggaactgcgcgacgttggtgcgctcattgcgcgtgcggcccgcgtagacgagcgaggccaggtcgtccacgtagagcaggtcgccgacctccatcagctccttcaccacgccccgcgcgcgggcctcccactggcccacgtacatcatcccggcgatgaactggttgccgtccacgcgccacacgtcgcgacgcacgcccgcggcgtcctgccgggcggtgagccggctcaccgcttcatgaatcagggccgtcttgcccgcgccaggtggacccaccagcaccagcgcggagccttcgcggccttcgagcgcctctacgagctcgcgaaccagcgcctcccggccgaagcaacgttccagcgtgccgtctcgcgcaccgtggctcaggttgcgcgccacggcccggagctccaccagggtgaggcgccgccggttgcggcgttgctcccgctgctctggcgtttcgggcgcggtgtcttccttctccggattcttggtccggcggcgtcgcgcgggctgggccggtcgcggcggcgtgcgcgggaggacggagggggcataggcatccacctccaggagctccagttgctcccggccctgggcccagtgcgtgtccagggagtccaggttgtgttccagacaccaggccatcagccgtcgcgcgagcgcctggggcaggtccgcgggctggttcagcgcgaagcgcgcggcggggagccgggtgggggtgacgacccagaaggtgtcacggggccacttctccagcagcacggacatggtgccctggaggacgacgcgccggttcttctcccggtcccttccttccgcatcgacggtgacgcgcttgagggcgaagtggggtggaagttggtactgcgccacctgggagggcgattcgcgctcgaagcgctccatgacggcgagcgcgagttcgtctcgcagcatggagaggctgggccccaccttgtgcagcgccgggaagaaggcgggcacccaggcctcgacgagccggccgctgtgcggggccaccacgaagggaagcttcaggtccatgtcgtcagtcctcgtcccggctgttgaagacgcgccactgcatccagggctccagcaggggctccaggtcaggcccctccagaccgaagcgctgctgcaccccggtgcgaaggtccgtcagcgtcccctggccggaaccgctgcccgacaggcgcacctgacggacctcgtttttcggcaactgcttctgcaacgcctcccgggaggagaggtcgaacagcgagaggggccgcggctcgaagtacgcatgcaccatcgaaatctgactgccttcgatgaagcgatgcaggccgtgctcgccagcgagcagcagggcgtgggggccgcccttgacctgaatcgcataggcgaccggctgcacgacgagcttgtcgaaggtctcatcgtcggcccaccgccattgcggcggcggaggggtgcgatgggccttctcgccggacttgcgctcggggacggcgagcaggcctcgccgcttctccatggacgccttctgggcccacccctcataggccgcggcgagcatgcgtgcctgcctccacgcgccgcgacctggcaccaggtagagggtcgcgccatgtgacgggg

SEQ ID NO: 755 - DNA, 5155 bp, Myxococcus xanthus
cgtgctctaaagacgcccgcgagcacggagcggagcatggtggacagccgcagcacggcggtctccgcgacggcgccgtcctcacggcaccactccgcgatggcgttgagcgtgttgaagaggaagtgcgggtccaggtggctgcgcagcgcgaggagctgggcctgctcggcctccagcgcgaagcgggcggcgcgggcgcgctcgcgggtgaggctctcctcgaagccgatgtcacggcccaggccccagccccccacgaggaagagcgcgccgcacaccgcgaggttggtgggctgcgtgaggaaggtggggcccatgcccaggagcttcggcagcacgaagccggaggtgagcaccacgccgctgcccacggtggcgtagagcaggagccggatgccgccatggctgaggtccaggccctccgggaagaggacgcggtaggagactggggccaccgcgatgaagagcaggcacatcaagaggcccagcccgaacgcggcccagaggggggcgtggctgaagcgcacctgcgcggtaatcagcgcgacggagatgacgaggatgggcagcagccgtcggggctccacgagggcccgcagggtggcgcggacgatggagccttccgttgtttccagcatgcgccagcgggagcctacaccgccggccgcgtcactgcgccgggcgctcctccagctccgtctcgaaggcgtccagcagcatgctgccggcgaggacgacggggaagaggacgatggcggcgacgacgaggacgggggaggggagggcgaacatggcggggggctcctgactccgtgaagcatgcactgccagtctgacgtggcttcctggcctttgctgggaccttcggcctgagtggtcgttccctgacaacgagcggtttcgggcgctgtttccaggcgcggtcttgcccggcgcgccccgccgaggacgacggcgccgggtcagggggctccgaggtggagcgcccgggcgccgaggcgccggatggcgggaacgagtccgccctcttgcatgagcgcgcgggcgatggggctgggccgctcggcctggaaccgttggccgctcgccacatgctccaccaggcccgtctccaggtcgacgacgagctcctcgtcttcctggaccagggcgtggaacgcagggctcgtcacgacgaggtggggcagcgcctcgttcaccaggttgcgccggtggatgaaggcatagctgctggcgatgacggccttgatgccggccccggccagcgcccagacggcctgctctcgggagctgcccgtgccccagccctcccctgcgacgatgagcgtccgcccctgctgcacgcgttccagaaactcggggcggacatacctgaatgcatggcgagccagctccgagggctcatcaaggtggcagaactcgcccgggatgatggcgtccgtgtcgacatggttcccgaagcgctgaatgcgtccagcgatgcgtcctccggaggccgtgcccgcgcgcgtgccgccgtcatgtggctggggcgtcatgggcagtcgtggctcggaggaccggaactcgatggggcggcccgctggcttgcgggcgaggattcgctcgaggacggacgggtcgatcctcttcagcgcggcgcgggggtcctccacgcgcatctccagggaggaggccgctacagtggccgccgaggcgagccaagcgtgtgatccgggccccatccggttctcgtagttgcggttctgtgatgtgagccacacctcgccgggaagggccttttctgaggccacgcccagacacatggagcagcctggcgggccgattcggaagcccgcctgctcgtagtgccgccacaggccggcttgccgcattcgttcgtggatggcgaggtccccgggcaccacgagccgcttgggtgaggcggggcgcgccgccttgcctcggagcgcctgctccaacaggagcgccgccagcacgagctcctcctcggtggtggtgcacgcaccgatgaagcagccgtccaccgccatccctaccgcgtcctggacctccagcacgttgtccggagcgtagggccgggcgagctgcggcccgagcttctccagcgcgatgctgaagcgctgtacgtagggcgcatcctcatcggcgcggaagtacagggcctcgtccttgttcgacgggcgcatggcgagccactcggtgaccctcgcgtcgggctcgaagatgccattcagcccgccgagctccgccgtcatgttcgcgatggtgaagcgcatgtccgtggtgaagccgcgcgcggcttctccgcggtactccaccgtccgctccagcgcggcggtgttccttccaaggagccccaaggtcttcaggatgatgtccttgccgccgatgccaaaggcaggcgtgccctggtactccacggtgatggcctcgggaacctcgagccatgtctccccgagtaccatcgcggcaacgatgtccgctccacccagtccgatggcgaaggcgcccatccctccatgggaggtggtgtgtgaatcggctcccagcaccaactgtcctggctggaccagctctcgatagaacttcgtgtgaaggatggtctcgttggcatcgtagaagtggcgcagcctccgttcgcgggcgaagtcacgcgagcgctgtaccagccgctggacgcgcacgtccttggcaagggtcactgcgtccaccgtgtggtccacggcgaggaagacgcgctcccggtcgtggagctccgggcgtcccagggcctggtaggtgcggtccatgccgttccaggccagctcgctcgccatcgtccagtccacccggagctgcaggacgtctcccgcctggacccaggggcgatcgaggcgccgggcatggtgggccaggattttctgcgtcagggtcatgggtcgggtgttcatgtgcagcgcctttcttgggacgcgctggcgtcccctcaagaggatggcgttccgctcaccagcctcacgcggcagggcaatccgcccctacgtgcgggtccgccggagtccctggagcatccggtccaggatggcgtcggccgcctccgtcgtggagagcgttccccccacgtcgcgcgtgcactggccctccgccaccgtctgctgaacggccgtgctcagacgccgggcggccccagcctgaccgaggtgctcgagcatcagggccgcgctcagcaccatggccgcggggttggccagccccttgccggtgagctcgggtgccgagccatgcacgggttcgaagagcggcgtggagtccggattgaggttggcggagggcgcaacgccaagcccaccgctcagggccgcgcccaggtccgtcagaatgtcgccgaagagattggtcgtcacgatgacctggagggactccggccgtgtcaccatctggagcgccaaggcatccacgtagtagtgccgcgcctcaatctgcgggtattcggcggcgacctcacgaaaggtccgcagccagaggccgtgggcggcaatggcattggacttgtcccccagcgctacgtgccgcttgccatgggcgctggcccacttgaacgcggcgcggatgattcgctccacccccttgcgggtatggatttcctcggcaatggcgacctcgtcgagtgtgccccgcttgaagctcccgccgatggcgccgtagatgccctccgtgttctcgcggaagattgtcatgtcaatctcttgcggtcccttgcccttgagcggggagaggcgctccgccagcggagagcagggccggaaattgacgtagaggtcgagcccgaagcgcaggcccagcaggatttccctcgcatgcgcattgtctggcacgcgcgggtcccccatcgcgcccaggaggatggcatcgaactcggtgcggaagacatccatctggcccgggggcagccccacccctgtcctcaggaagcgctccgcgccaaagtcaaacgcctccagtgagagcccgagccgcatttccgcgtcgagcacttgcaggatgcgcatgacctctcgggttacttcgattccaatgccatcaccagggatgaccgcaattcttgccatgttgacagagagaatccgggaatcccgagggcgcggcaaggtgtgaagttgtctgacatgtgtatgtcgtcgcgatgtgagtctattgggttctggtcttccggttgggggtggtcttttcttggtgccaggatttgttgccgcgaacccgcaggtcattcgaaaccgctgagggcaaggcatttccatgcgcgacccggccaggactgtttctcattccgagttcatccacgactggaatggaaggggggccgccccgagccctgcattcccagtcgagatcaacgatgagacgctccgggatgggatgcaggcgacggccgtcaccagccccacggtggaagagaagcgcggcctgctcgagttgatgcaacacatcggggtgagcgcggtgagcctcggtatgcccgcggcggggccgtgggcgctcgaggaggtcgtgacgctggcgcgccacatccgggaggaggcgctgcggctcgagcccaactgtgcggcgcggacgctgcacagcgacatcgtccccattgtcgaggcggtgcagcgggcggggcagcccatcgtggtgcatacgttcattggctcgtcccccctacgccagtgcgctgaggcatgggacctggacttcattctgcgttcctcgacggcggccatcgacttcgccgtgcgtcaggggctggaggtcgcgttcatcaccgaggacaccacccgctccacgccggagacgctcgagctcctcttccgcgccgcggtggagcatggcgcttcccggctggtgctctgcgacaccgtggggcatgcgacgccagccggaacccgcgccctggtgcggtggacacgggacctggtggagcggctcggcagtccggtgaaggtcgagtggcatggtcacaacgaccgagggttggcgttgatcaacgcgctcgtggccctggaggcgggagcgacgcgagtccatggttgtgggctgggaatcggcgagcgcacgggcaatgcccccgtggagttgctgctgctcaatctcaagctcctggggtggattgaccaggacctcacgcggc

SEQ ID NO: 756 - DNA, 6427 bp, Myxococcus xanthus
  unsure (1)..(6427): unsure at all n locations
ctctcaggggcaccttgcggcggctctcctccagcacctcgcgatagagcgcggcctgaccgggctccatctcgcaccaggcgacgctctccgtcttcggcggcaggtccttggccacttccgtcttcaggcgacgcaggatgaagggctggatacggcggcgcagccggtccttcgcggtgctgtcgttggccacctggatgggctgctcgtagcggtccccgaagccatccgagctgccgaggaagcccggcatcaggaagtcgaagatgctccaaagctccgacaggcggttctccagcggcgtaccagtgagcgccagacgcgtctcgctggggagcgccttgcacgcctgcgcggtggcgctgcccgcgttcttgatgttctgggcctcgtccaaaatgatgtaacggaagccaacctgggacagctggtccaaatcacggcggaccagcgcgtaggacgtgaggaccaggtccatgcccttcaggtcctctgcccgctccttgcggtcctgaccgtgccacaccatcgtcttgaggcccggcgtgaagcgctcggcctcgcgctcccagttggccagcacgctggtgggcgccaccacgagcgacggcttgcgcccctcgtcgttggccaccttctgcatcaggctgagcgactggatggtcttccccagacccatgtcgtccgcgaggatgccggacaggccatggcggcgcaggaaccagagccaggacaggcccgcctcctggtagtggcgcagcgtggcctggagtccctcggggacgcccaccttcggcacgcccgccgactcgcgcagctccatcatggcctgccgcgccttggcctccacctcggtgaactcccccaggtccgccagcaggtccaacgcgacggcctggtgcagcggcagccgcgtgcgcgagcggcccggcagcgcgccggcttcctcgagcaggtccgccacgcgcttgatttcgacggggtccgcctccgcgaaggtaccgtccttcagggggacgaagcggcggcccggagtccagccacatgcgcaccgcgcccaggtccacggcctggtcgtcggtgacgaactccgcatccaggtcgaaccactgcacgccgctcatgcccacgcggatgcgcggcttgagcttgggacgtaggcgcaccttcggggcctgcacgccaaagcgctcccagtcctcggggagcgaagccaggccccgggcccagaactcaagcgcggtgtcggccgtggcgtcgaacacctgcgcctgcggctcgaagcgcagacccagatccagcagcagcttccccgcgccgcgctccagctcctcgcgacgccggtacagcttgcggctgtccccgcccacgccgctggcgtagcccaggtgcgtggcagtgggggacaccggcaccgtcgtctggccgtacttggcggccagttgcaccttcacgcgctcggggttgccttccagcatgagcatgaaacgaggctccacggcctcgtccacgtcgatgtcgtccgccttcagcgccatgcggaagcgcggcaggtgcgcggcgaagaaggtcagcacccggtccagttgccccgtggggaaggacatgctgggctcgagcagccacttgcgcagcagccgcggcgggaagtccggctccaccgggtgcaggttctgcccctggatgacccaggtgcgccggcccgacaagaggatgacgtccttgagcgcgtagctcgcgttgtccgggaagagcagttcgatgcgcgcggtggcgccgtccgggcgggactccagatgaatctggggccgcaccggcacctcggtgtcgatgagcgccgtgccacggtagatgacgcggcggtggcgcaagagctccagcgcctcgctcagctcctcgtcggacaggaccaggcgcgagtcatagcggtgctcgtggcgagacagctgcatgaagacgcgctcgtccgcgggggagatgcggccccccgtctgcagcagccgcttgacgtggatgggccccttcgtctgcgcgtcctgccggcgcacgtcgatgatccactgccgggtgctgccgttccccgtgctggcggccgtgaggcggtagaagaactcgtagtcgggctgagaagacagaccgagccagctctccaccttggccagggccgggaggctgaccgggtcgccgctcgatggcaccggctccacatggggctcgtcatcgacgacggcttccttcggctcgggagcggcggcgacgggctcggccgggcgaggcgcgggcgggccgggcggacggaaacgcgcggcgtagatgagcgccgcggccaccacgtgcttgcagtgggggccttcgacgttccacgacgggcaggtacaggtcgacgtggctcggccattccccagatgcagggccgtctgataccgctcaccggacgaaccggcgacctgggcgctgatgcggtccccttcacgattgaggccgaagacgcggcgcgactccgccacctctcgcccctgcttgaaggtcgtgggttgaacttcggccttcagggcacggagccactgggtgtcctgaggcgggaggatctctcggatatcggcggtggattgcacggctggcacaggccccaggctccaaatcgccagggaacccgttgaactaccacagcaacgaggctcccggtcgcgggaaaaatcaatgcgtccgccagcagaatccaccgctggcatcaagctgtgagagcatcaacccccgccatggcccggaccgtccgctttcgcgcctccgatacccgcctgcttttctggaaggcatccggcacgccgagccgacgcgccggccctctccccagaggcgggacgcccccgtgaggccattccgcctgacgaatgccccccgcgggcaggggtccgtcgccatggcgacagggcgggcggccgtccgagccttccgtcccccggtcctccccttccccgccccaccgtttttcatcctcccgctggagcgcacgccatgcacccgcccgtcccgagcctgaccgacaccaccctcgtcgccgacctgaatgcccggctccgggacgtaccggacttccccaagcccggcatcgtcttcaaggacatcacccccgtgctggcggacccgcgcctgttcggccgcgtcatcgacgccatgtcggcgcccttccggggccagcacgtcacgaaggtggtgggcgtggaggcccgaggcttcctgctgggcgcccccatcgcgctggcgctcaacgcgggcttcgtgccggcgcgcaagcctgggaagctgcctcaccgctcggtggtggagcgctactcgctggagtacggctctgacggcgtggagatgcacgaggacgccatcctccagggggagcgggtgctcgtcgtggatgacgtgctggccacgggaggcacggcggaggccaccgtgaggctcgtgtcccggctcggcggcgagttggtgggcttctgcttcctcctcagcctggacttcctcgaaggccccaaccgcctcgggcgcgagcgcgtgacgacgctgctgaccttctgattggcgcgtgccgaccgcgaagcgctccggcctctcccaccggagcgcgatgccacgcccggacgacggcacgcccacggggatgagcggcgagcaaccttcagttgcatgtgaacgtctcccgcaggggtcatcccgggaaatcaggagcaggatactgggcgaagcatgaattgattgagacagcggccccccgcccggccggaacggcccctgccgtgttgcctgctgacatgcgggccgggcctgcgcaccctccaacgagaaccaaccaacgcttccacggaggggacgacatgccggaagtacacactcgcggcggcgcccgcatccgctacgacgacacgggccaaggtgagcccgcgcttctcttcatcccagggtggtgcaccacccgagcgagcttccagaagctgattccccgctgctccgccttccgccgtgccctgtccgtggacatccgggggcacggcgagtccgaaggtggaggcaccgacttcgacagcaccacggtgctggaggacctgctcgcggtcgtggaggccagcggcgcgcggcacatcgtccccgtggccatgtcccacgcgggctggtgggcgctcgacttgcgacgggcgttgggcccagcgcgtgtgccacggatggtgctgctggactggattgccaccgagcccaccccggccttcctccgcgccgtgcgcgggctccagacggagcgctggagcaaggtgcgagacagcctgctccagggctggctggaggggctcgacgacgacgccatccaccgcttcgtgcgcgacgacatgggcgcgttcgacgaagccatgtgggcccgggccgggcgggagattgaagcggcctacgcccgcgagggctctccgctgcgagcgctcgccgcgctggagcccatgccgcttacgatgcacctgtacgcgcggccggagtcacacgactacctggcggcgcaggtggacttcggcgcggagcatccaggttttcacgtgctgaagctccccgccaccagccacttcccggcgctggaggtgccggcgatggtggccgcgggcatcgaggcgctcgtctccgcgcgagaggtccccgtccacgcggacgccgttccggcctgaggcggcgcggggactaccgcagtcccagggcttccttcatgccatcggtgcgctcccgggcgcgccgcatggcgatgcggttgagctcggggtccacgggcagcggcatccacgccaggtaccgggcacccgggccgccatcttcggacttcccgctcgcgacgaccatcgtccgatgctggaaggcctcttcccaggggccgcaccccgacatggagaagtgcttcacggtgtcgtctttcgcctgcgtccaggcgatgcagggaaattcggagcagtccaccgccaccacgtcgagccccatgccgcactcgttggcggcacggaaggccacgcgctcgaagcccttgggcgtgaagggctccggcagttcgggcgcgaaggcgaggggccgttcttcgggcgccgtgtcatgcccgctaccgggttcggccgaagcaggcgaggccggctccgggagcctgcgaagcactgcggcttcacgtgccgccttcggcgcagtcaccgacgcctcccgcttcggagactccgacgggcggggtgcaggccgtgcagcgggtgcggaagcctggacagcggcctccccggacggtccctgcggcgtaacggaaccgctgctgaaccagaccccggcggagaatgccagggccacgacgagccccaggagcgcgaagcgaagcagtttcatggccacacctcattcatcgaggatgaacttcacggggcgccccgccgcgccgcaacagtcctcgggcacgcccttgccgggaacaagcgtgagcgccgccccctgcacgcccaggcagagccccaccatgacgccagtcagcatcatcgcgcgggagcaacgggcggttcgtgtcatgcggtccacgctagcagcgcctggggctccatccacattcgggccctcgcccccaggggcaggtgggattgacgcccttgcctgccctgtttataagttggtcaaacaaccaataaacacgccccatgccccgtccatccaacaccgaggagcgccgtcagcagattgtcgcgggcctgctgaaggtcatgtcggagcgcggttacgagcgcgcttccgtgagcgaaatcgcgaaggcggcggggttgagcgcggggctggtgcactaccacttcagcggcaagcaggagattctcctcacgctggtggagcagctcgcggcgcaggcgcggcagcgggtggcgacgcggctggaacgggtgaagagcccggacgcccgagcccgcgtggatgccttcgtggaggccttcctcgccacgggcgacgacgcggccccggcggccgtcgcgagctgggtcaccatcagcgcggaggccatccggcagcccgaggtgcgagccatctacgagcaggtggtgcgcgccgacctggagcacctgacgtcgctcgtcgccgccgtggtgggacggcgcaaggcgcccgcgctggcggccgggctgttcgccgccgtgcagggctacttcgtgctcgccgccagcgtcccgggactggtccctgcgggctccgccgccagcacggtgaagcgcatggccgcggggctgctggacccggccggcgcgaaggaggacgcatgaggacggccacgaagctggggctcctctccagcctctacctgtcacaggggcttcccttcggtttcttcacccaggccctgcccgtgctgctgcgccatcagggcctgtncgttgccttccattcggac

SEQ ID NO: 757 - DNA, 6351 bp, Myxococcus xanthus
gctcccccagcgccacggcgcggatgtgctcatcgcggaccaactggtctaactgtgttaggtacagcttgcgccgcgtttcgagcgcccgcgccgcggcgtccaggcgtcccagccgggtctccgcgttcgcgcgcaggcccgaggcgatgaggcggtaggagcgcaggacatgctccggcgtggagtgggcccacttcaacgcgctccggacaccgggcgtcgccaggtctcgctcgacctgctccaggtcctccaaggtccgctgcggctgaccagcacccagcgccgctgcgccgcgcgccagccgcaccaccatccggttgcgcaggccctcttcgtcctgggggctcgcttccacgagcggcagctcccggtcatagagcgtcagcgcccgttcgaagcggcccgcggcgaggttgtagagcgcggcgcggtccagggccagcgggaggaacctggacagccgctgcgtggtctccaccatggccagggccttgtccgccgcctgggccgcgtcggcttcacggtcgacgtggagcagcgcgtgggcccgcgccatggacaccgcgagccccgcccaattgtccgcgtacggcagcttgtcccgctgttcgaggtagcccacggcgatgtggaagttgcccacctgcgtgtgcaacagccccagcgcgccgagatttatggtccggtgacggacgttgctacgaatgacgtgcaggggcaccatgtagtatcggttggcgtgctccccggcggcggagttgcgggtgctcacgaagtcctcgtgatggatgtgtcccaggagcgcctgcaccacgcgctggttcttcacctccggacacgcggggcgctgatccctcacctccgaagtcactgcctgcgcatgggcatccccctgctacttggagagctggcgcacggcgacgtaggcctttacgaagtgcgcgagcggtttcggcatgttcggagcggtggtggtgacttccttctccaccacatccggactgacgccggctcgcaagcgcaggttcatggcttcgacggcgctctccagcgagcccgtccgctgcgtcaccaggtcgaagtccgcacgcgccatgtcctggcgttgccgcgccagccgccggtaggcgcggcccattattgcgcggcgaaagagccgctcggcgcggcgtcgctcctcgctccccggtggcgtgtcgtcgacgtagaccatcgccagcgattccatgatgccatcggcgccgagccccgccgcccgctccacggcgtcctgaaccaggacccgtctgcgcagcgggtccttctgctgccggtagaatccgagcagcgcctcccgcacggcacgaggaggccgctcgcttcggagcgcattgatgtggcggcccagctccagcgcgtacgcgtaggccgaaccaacgggcgctgtcgtgagtgcctgcgccatcgccgcgtccgcctcgtcgtaggggcgtccccggtacagggcgcggaccgcggcgcgagcgaagtcgagctggtcgtcggccgggaagatgcggtgctcggagagccgccggcccgcttcaatcaagggctcgcgctcatggagcttccggtacagcgcgtctgctcgcgcgtggtacgcctccagcaccgcgcgcggcgtggtgtcggcgatttcggccgcctccagctccttccgggcccgcgtgaagtcacccgcgtcatccgccagctcactgcgcaccacgcgctggaagacagcggccgcggggctgggcgcgttcgcgggatccagcgcggccatgcgcttctgctccgcgacactcagctcctccaccatgcggccccgctcgcgctccttcatggctcgccggtgttcgatgaggacgcggagcggttcctccaggcccgcggtggcggggtcgctcaccgagcccaggtggcgggcgtagaactccgccgcgctgaagtcctcgtaggccaggtgcagcatgctcatgcgcatcatcagcaggcggcgaagtctgggccgcgtctcgagcagcagccggtggcgatagagcagcagctcatcggcgcggcggcccaccatcctcagctcttcgctgagccggcgtgcatcccaggcactggggacctggccatccagcggcatctggtacacgtccagggactgcgcgcgtgaacaggtcgccgccagagccgtggccgcgggcgccgggtactggcagttccaggaggcactggtgagctggtccggattggcggcggcggcttgctcggcggcgtcgtcacgctccgtcgcgaatggcacccggaacagcacgccgctgtcgctggcatcgatgacgccatccgcattcgagtccgtgaagaactgcaccacgtacaggtagcgcccatcccgggagaacgtcggctgtcccgtctgccccgggatgtcgagcgacagcgggacgggcttcgcgccgggggcatccaggcgcagcgcctccagatggggcgcggcgcgcgcggcgaagccggggcccacctgccgcacggagcgctcgatggggacgtacaccagccagcgcccatcgggggagagggtcgggctggtcaggttccgctcgagcaggggcgtcacgcgccactcgccgcccagctcgacgcgcgacaggtggaggtcgccctggatggtggtccggctcaccagcgcgatgtgcgacgcgtccatccactccgcctggagggcgttggcgtctccttcgagacacctgcgctctttcgcggtgggcaactcgcgcacgcaaagctggccaccggcctggttgcggaacgagatgtagagcaggtgcttgccgtcgggactgatgcgcggccaggtgacatccgcgccttcgtcgaacagccggcgctcgcgtccgcgctccaggtcctgcgtgaagatttcggtcgcgatgctgcggttggacgcgaagatcaacgtgttcccatcaggcgccaactgccccaggaactggtcgcccacgcccacggtgagccgggtgggcgtgcgcagtcctccatcgttctcatcgtcctgcgcccagacgctccccgcgatcagcgtcaccagggccacgacgccccgtctccgccgcgtcagcactgcttctctccccaggtcccatcctcggcctcgacccaaccgccgcagacgacaccctccgcgtgcaccttgtgccagttccggcgcagcgtctcttccgggacgtcggggcgggccgaccgcatccacttccagagcaactgacgggagcgattcacccgctcgaccagggccacgtcgtcggctgtcattcgcccggcctggcagcggcgccgggtattcaccagcagcccgtcccgcccttcgcccacgcagtggcgacggagcaggtcgtcaacgcggtccgcgggcgtcctgccgatgttctccaccagcggcgtgggctggatgcccagctcttccagttgattgggtgtgaatggcaccggcgtgggattcatgcccgcgcgagccagccgctgctccacgtccttgaacgagcccgaggcctgttcctcgagcgccgtcgcgcggtccaccatgacaatctccggtgcgctgatgcacccggacgtggcgagggcggcccacagcagcaacccacggtgtttcatggcgtggtctccggaggagtcatggatttgatgagctggtcgacgatggggcccatggggatgcctcggatttcgtcgatgctgagcagcttcgccaggccgcccatggtgatgcgcaggctgccgaagccgtggttgaagctcacccgcacgtgctccgggtagcccagccgcaaggcatagcggacccggttggtggcggggttgacatggcgggggtcttcgatgtcgagcaggtccagcaggtggcggttgccaatgcgcagaatctccgcgcggccattgatgctgcggtccttcgcggagatgaccacggcggcattgccgtcgaagggctcgcctcgggaggactggaccccggtggctcgcacgcgggcctccagggtggagtgcttgccttgccagtccaggagccactgtccggtgatgcgcccaccgcgaacccccatctccaactgcgtcatggagacgacgtgctggtcgatggacaggttccccgccaggggcgcgacggcgacgagcggcgtgctgatgcgtttggcggacacatacccgctgcgggagagcaggggatgctggtcggcgaaacgaagcatcgggtacgggttcacgtcgatgtcgctcagcagccgcagttgtccctcgctgaactcgaggttctcggtgagcgggacgttgccgtccatcccttcaatctcgaacccctgctcgggcaggcgcaggttcaagtcctggaggagcaggttggagacggtccggaagacgacgaggtcgggtgagcccacgcggaagtcgacggtgaccttgccgcttccctccagcatcccggggcgcgcgagcctggccatgtcctgcgacagctcgccccggagccccaggcggcgccggtcctcgctgaggtcgagccgcccccggacctttaaatgggtgctggtccccgcgttggtcagttggagctggggaacatggatgacgcccgtgggcttgcgccgcgcggagaacgtcgcttccacgtcctggaccggatagggcagcgccgggttctgttcgagcgcgcgaagcttcaagtgctgcttcagctcgatgtcatccgcttccagcgcctcggcgaagctggcggtggtgtcgctggtcagctccgagaaggacagccgccgatcgctcaatccgaccgtgagcttctccacgcgcaggtcactgtgaacggttcgcttgggaccttcgacgcgagacgccagctgccaatgcagcgcgggaacgttgagcgaaagggcgtcctgcctccagcgcaggccccgcgcgctcaccaccgctgttccatcgaagctggcggtacgcgccgggtccggggcgagtcgcggggtgccatcggctgtgacacccgtgagcacgccgcgaagcgtgccgtgcagctcgatgcccaccgcgagccgcccggcatccagctccgggggcacctgcgccatggccagcaagggcgccagggggcccagtgggggaatgtcgcccttcacgtcgatgcgaagggcgcgggccttccggtcgaacgccgccgcggcgtccagcatgaccttcggcccttcatgactggtgaggcccaaccggaacgcgggcttccggcggttgaggtccagggtcagcgtctgatgctggagccccatgtccttctcaccagtccggagcccttcgattcgcaggtccacatcgccctggtggcgccaggcgtcaccccgcgagcgcatcacgacggcgacgtcgctggccgtcacgttgtcccacgcgggccgttgcagcttcagctccgtgcggtgctccagccggggcgcggatgagaagagcgccttcacgctgcccttggagtccaggctcacgcccaggtgccgccacggaatgcgcgccgcgaccgagtcgggaatgaaggggcgggcggcggcgaggtccggggtccgagcggccagggtgtaagacaccgcgtcggtgtccttggtggcatccagggacgcctgaatgtcgccgatgtcgagcacgagctgcgcgcggcctcggctgagctggggctcgtcgagctgtgggaacgcgttcgacgcatcgagcttcacgcgcacggggcctttcagcagcgtgcgcccatccggcgacgacacatggagcgccccgacgggcacgttcgcgctcagtgcgaggggaggtgctgccgccagcggcgcgctgagctggaagcccatccgttcggcctgcgctcggaggtcgggagtccggaggtccagggactccaccatgcccgacaggctcgcgttcccggcgacctggagcggggatgagggctctgggcggagctgatgtcccttcacttcaccgtgggcctttggaatccgcagggccgtggggcctcccacgtcgaggccatcgattccgaacgtcagctgcgcggagagcccttgccgcggatcaggtgtcgccaccagggtgacgcgtcctccgccgagcgccagccggactggctcacccgtcacccggagcgacgcgacgtccacgtccaggcccagtctgccgcgaggccccagttgaggcatcgcgctcagggtgacgtcttgtgtgtccagcttgacctttccgcgctcgagcgtgaacggacgccattcggcagggattaccgccagcagccttccgagctcgatgtccgccgcttgacagcac

SEQ ID NO: 758 - DNA, 6047 bp, Myxococcus xanthus
cgcgagcgagccaagtccctgccgcgcggtggagtacgccagcgcgacggtggctgagacatccacgcggcgcaggtccagcgggcgcgggcgtccatagcgcagcagttcgtccacgaagtgactggcgcggtcgatctgctcccgcatggccgccaccgtgtccgggtccccgccccttcgctccagcagcttgaggtgcgcggcgagcacgcccaacggattgcggacctcgtgggccactgcggacgtgaattgtcccaactccgccaaccgcgcggattggtccgcgcgcgcctcctcgcgagcgagcgccacggccagttcgtcactggtggcccggcccttgaggagccggcgccccagccaggcctgaagcgcctgacgcacgggctcgaacgcgagcgcggccagggccaggaggaagaaggcacctacgcggtactcggtgaggaacggctgcccgctgcccgacagcagcgtcaatacgccaaagaggaagcccgcggacaacaccgccgccaccgcggagtagacgaggctgcgttcgagcagccgtcggtccgcggctggctgatgggcattgatgacatgcaccagcaccagcagcgccgccagcaccaggtacatcccgaacggcaacgcgtacccgcccgacagcaacagggcgttgccgatactgcccaggtacgcgagcagcccggcgatgcccagactgaggaggatgggccgtcgctcgggagcttcgccccggtacgcgcgcgacagatgcaccagcggcacgcccgccgccgccacggcgagcatcatggtgggccagaacagggggcctcgccccatcgccagcggcccgtgcaggacgttgggaaggaacgcgccaatgcccgtcaccaccaccgccacgcagtacgcgagcaccaccagccgataggagcgctgccgggtcacgtcataggcggagtgcaggtatgccgccgcgacgaaggccccacccgccacgaagcgctcccccacccacgccatggacgggatgcagagcagcagcagcgcgcccgtccaccctgcggtcgccagacagtagagcgtcaggcctcgcgcgttgtgcccccgaagcacggccgtgaagaacagcagcagcgacacggagaggacaggcacgaggctgtaggcgaacaagggccccatgcccgtactgtgacagatcagcgagcgccgtgaggcggactcgccgccgaggtatgggcggtgatggcccgggtcatcgtctcccagtcatccgggtgcaggtcatgccccgcgtcgtgcagtgtcaccaggcacgcgcccttgacggcacggctcaaggccacgccatgcgcatggtcgatgaccgggtccaccgagccgtggatgaccagcagcggcgcttcaatctcacgcgtccggccgtaccactccaggccaccggacagccccgcgtggttcaacgcgcattgaggcgcgagcgcgcgccggtagtcctgtactgctcgcgcccgcacccgagcctcgtcgaacgaccttcgcgcacggcccacgcacaaccgtgagagttcgacctggaaaccgatggcctcggcctcgtcggaccagttcagcgtggcggcccgctggaagtgcgcgagcaccgccgggtccatacccgggtcctcgaaatcaggctccgagaaaatctgggcgctgatgagcgtcagcgagaggacgcgctccgggtacttcaacgccacgagctggcagagcaggccccccaatgacatccccacgaggtgcgcgcgctcgatgccgtatccatccagcacggagatgacatcggcggcgaggtcgtccagcgtgtagggcgtggctcctggcacaccgtgcgaggagcgccccgtgtcgcggtggtcgtagcggatgacgaagcgccccgccctcgcgagctgctccatgagcccatcaggccaccccagcatcgagctggccgcccccatcaacatcagcacgggggcgtcgccctcacgcccgaagccctcggtacagagccgaatgtcgcccgattcgatgatgcgctcggacatccaggaacccctttcgacagccaggaactggcgcggatgacgaattaataaccgacgcgtcggttatattcaacccacacatcttggttgcccctccaagcgacacaaccttcagtcgaaggactctcgtgggaacacgcacccgagcaacgtgcgcaagcgagcgaggacgtactccgtcaacggcggcgtccgctccaccaaccactgcatcgtcgcacccgcgatgacgtcttgaagcagggcggacaccgcgccacggtcgacgctgggaggaagccggacggcgatggcgtcgcgcacgagcagattccgctcatgtgccatccgcctcaacgtggggtctctcacgtcctcccaggccaggagcaggtgtgcgtcgagcgcctcgccctcccccatcaccgagaccagggtcttcaggaaacgccagagaccctgtgctccgacttccacgggcagaccggcgaaatactcgcgcttctgctcggcggtccgctccatgagccggaagtagaggtgctccttgttcttgaagcgctggatgagcgccgcgcgggacatgcccaccgcgacggccacgtcattcagcgtgaatgcgcccggcccgttccgaagcaacacgaacatggcggcgtcgaggatggcttcgtcgctgtgcagcttgggccggggcacgggccgtagataacacgcgcggcgaacgcgcgcgctcagcgcaccgtggcgagaaagccgtccagcagccggttcacctcgtccggagcgtcgagctgcacccagtgccccgtgccctccaccttcgcgtgcggcagctccggcaccaggtggtgatacgagcccggttcctcattgaaggccgtcacgaccgacagacgcggccccgagtagcgccgcagcggcgtcacggggtcgaagtccagcagggcccccagtccgccccggacgccctcttgggacgtggcgcgcatctcggagagaatgcgctcgcgcacctccggccgggacggcgccaacatgggggaccaggcctcctccaccaccgcgctccaggcctcggtcgccagcaccgccatcaagccccgggcctgctccgctggcatcgagcgtccatccgaggccgggtcgaggaggaacaaccccgcgacgcggtccggctgcgcccccgcgtaggccacgcagacggccccgcccaggctgtgccccaccagcacgaagcgctgaagccccagcccatccaccaccgtccccacgtcccgcgcgaagtcctccacggcgaagccgccgtcccgtggcagctcggacttcccgtggccacgcaggtccagtgccaaggcccggcggcgctcgcgcaggtacgacagctgcgcggcccagtgcgtggtgttgccggcgctggaatggacgaacaccaccggcagtccacccacgcccccatcgtcgacattcagcattcccgtggaccccatcatgacggcctcctctggcctcgaagcgcgcagtcgtgcgcgacgtgatgcttgtggagtacggcccatccctgacagaaactgtcagcaatggcacgagtcgaccgggtaatgcggctgctggacttcctgcggggacgggatgggacgacggtggcggagatctccgaggcgctcgaagtgagcgcacgcactgtccaccgggacctggcgacgctgcgggaacagggcattcccctgagcagcgacacaggccctgggggcggcgtccggctggaacgggaccggggcgtggcggccgtccacctgtcgcaggaggaagtagtggcgctctggctggccgccaacctgtccgcgacgggcagcacgttgccctggggcggcgcggcgcgctcggggctccagaagctcttcgccagtgtccccaaggagcgggcccggggaatgcgcgagctctgccgccgcgtggtcgtgggacgacccgcgagcgcccgcgtgctgaaggacgtcggcacaccgcccgaggagctgctcgccgtcttcgagcgggccttccgcgagcaggtctgcctctccttcgagtaccgcgaccggcacggcaaggcgactcgccgcatcgtggagccgcacgggctgctggtggagtcgcccgtctggtacgtgctggcccgggacgtggagaaggccgcggcgcgcatgttccgcatggatcgcatccgccgggcccgcctcgtccccgaccgccccttcacgcccgacatggagggcttgcgagcccaggccgatgcccagcgcgcgaacggtacgcgagccccaggctgaggtaggctgcgcgcccgccggagccggagtgcgcgccggagtcaccaggagtcacacggtgcggtacttcgccatggtcgcggccggggccaccctctgggggtgctgggcgctcttcttccgtccagcggggctcgccggggccgcagaacgcattcctcgtgctcctggccatgtcgctcccggcgcccttcctgttccggcgcgatgccctgcgcgaccgccgggccaccctggcgatgctcgtcgtggcgctggcggacgctgcgaacacggccctcttcttcgccgccatggagcgcgggccggtgtccatcgccgtgctgacgcactacctggcgcccttgctgctggcgctgctggccccctgggtgctgggcgaggagcgctccacccgggccctgataggcggccccgtgacgctggtgggcctggccctgctcatcggccggcccgacggcgacttctcagggctgacggcgctgctgggcgcgggcagcgcctgcttctacgccatcatcgtcctggccgcgaaacaggcggcgcgggcctattcacccatggccgtgacatcactgcatgcccccatctccgcgggcgtgctgctgctctgtttcggagaccgggtactgccacccacggtggatggaggcacgctcctcgtgctcgtgggcggcatcgtttgcggcctcattggaaacatcctcttccataccggtctgcggcacgttcccacggcggccacggcggcgctcacgtacctggaaccgctcaccgcttcactggtgggctgggccttcttctcggagacgctgacgcccgttgccctgggcggaggcctgttggtgctggtggccggcgcatgggtggcggccgagcgacgcgccaccctccaggccgtgccgctgcgcgccgcggcacgttgaacgcgtgcgccaaatcaccccttgcatgcttggggagtcctttggtcctcttgggcccccgcacacactcttccctccgttcctggcgacgccgtatgcctatggaaaccgcagccgacagccgtgagtatcgcgtcgtcttcttctgtcccgcgtcgagcgcccggctcgagcggatggaagtgcccgtgcgacggctgctcacgcgcatccacgcgccgcccgcggagctggcgccgctccaggaagccggcgcgattaccgaagccggctggcaggtgttcctggtccgctcgctgacggagcgctccgcggcgcaggccatggccgcctacgtcagcgaggccacgtgcgcgctggccgcggagctggacgcggaggtgctggggctctacgtggacgtgtccggtgacacggcgcgcatctgccgctgcggccccgaagacgggccggagacattcgcgggccgccgtcaggccgcgctcaaccgcaccgccgaatggttggaagtgacgcccgtcagcctctccgccctcttccacctcgacctgcccgacgcggagtacgagccggacgcggatgaccgcttcgtcgaggagaagctgcgcgaggcccggaccctcatggagcgataccgccagggcaaatgaggtctcgaacgcccgaggacctcgcgggtcgctgcccgcgctgcttcctccccgctgccctgtgtctatgcgccgaggtgccgtgcgtctccacgcgcacggagt

SEQ ID NO: 759 - DNA, 5552 bp, Myxococcus xanthus
cgaaatggcggatgttggcttccgtgctttgctcgaagaccattttcgcttcatgcttggatagtttcatgggcgccttcaagaggtggcattgggtagaggcattgcagccttatgctggtagtgtaccgcttgggcgaatgcgaggatactcaatagtgtagcttcattacccaatcaccctcactccaatctccgtgccaccccggcgctcgggtcctcgctcgcgctggcatgccagggcgacggcccagaacttgtccgcgtgcccgcggttggtgcgctcggcgtcgaaggacaccttcccggaagggagcacgcgccgcttgatggagtgaatctgcccgacaagctcacgctggcgcggcagggtgacgtcgcggcgctggaggagaatcttgaagtcagtcgcccagcgctccttggcctcgttggtgaagttctcctccacgacctgggggaagtcgcgggcgaggttttcagcgagattcatgccgatgccgctcctgtccacgctgaggcgcgccacgggaaggacggagaggatgcggcgcaggtgagcctcctgctccgcgaagggcacgccctcgaagctcttcagcaggcggcacgtgaagcggccctccacctcttcgaagacggccagctcggagcggtctcgcgtgcggcccacgtcgaagcccgccaccaggcggccctggggcacgggcacgtcggacgcatcctgggccaaggacagctcgtccgtggtgcacgggaggatgagctcgtaggggaggaagctgtaggactcgtcgacgtaaaaggcattcgaactcctgctggaagtcctccaggggcagggagtcgaactgctcggtgaggacggggcgcccgaatcgagcgacgcgctcctcggtggacatgaggggcgcctccactgcggcgcgcctcacgttcaggctgaagaagcggcatagccaccagggcaccaactggcgggtgtggtgcgggtacttccgcagctcctgcgtgtctatctcccagaagatgccgcgccggccgagcggggtgctgccccctgtgagttgtccatgcgagcgcaggatgagggcggtgctgcctgtatagacttcgcggtcgttgaccaggtgcgcgagctcgtcgaggtagacatcgccgcgcttgccgcgcggaggcttggcgggaacggagatgatgcgcgagaggcgccggcctcgtgagttcgactcgaaggccagctccgtcttggcatccgtcacgagcttcttctggtaggcgagcggcagctcctcgtacacctgccgggcgatgagcaccttctcgacggcgtccgagaggttgtacgagacgaagacggccgtgtggccgtcgcgcaggtggcagcgggcgagggcctcgagggcgaagaggaaggagaagcccacctggcggctcttcgcgacccagcggaagcgggagcggttgccgaggaaggactgctgatacggctccagcaccacgggctcgttgtcgtactggcacaggccggaaatgaatccggactcggtggccagccactgggtgaggtcatcctcggtgcgcttgacgatgccgagcgtcacggtgtcctccttcagccgaggccgacggaaatggccgaggaacgagcggcatcctccaggacgccgagcacctcgggtcgccagaggagctggtaggcggcatggccgttgcggctgaaggggacggcctcggcgtactcccggcccgcgtccgtcagctcccactcctcccgctcgttgcgcccctggaggccgcaggctgccaggcggaggttcatcttccgggcggacagccccagcttctggccgagctgcgtggcgttgagccgcgcgggtggctcggcggcggccggcagccccttccggtgaggctccatcgtcagtcccgtgtcccggtggatggcatcgagcgcgcaggccgctgccagctccggcttgaggcctggaacgaaggaagcgagcgtcctggccacttccaggtgggccagcacctggacttggagcggcgaggggcgcggctgtggtgacggagcgcctggcgccgtgtagctgcccgtcttacggatggagggcaacaccgtgtgtgtcacccagcggcggaacctctctaccttctcggccttctcgtggctgtggggcttggccgcgaagatggcgcggtacagccccggctcactgatgatggacatctcccgagtccctgcgtccgtacgcacgtcgtgcgtacggacctcgtccgttgcgagcacgcgtgtcaggtcgctggccatgcggtattcgagggattctgcgatgtctttggcgacgaaccaatgctcgccgtgcgcgtcggtgacgacgcggacgtggtgcgactcgaagtcgaatgcgacaggctgattcacagggactccttcctggagaggttggggaaggccagggccgcttgcggccccggcggagattcaatgagcagcgtggttaatgacttgtcttgtcggggcgacagagcgcgtatggccgcgtcctcttcacgaaggagccgccatgtctgcctatgctgctgtcgcccgagccccgcgcaccctcacggagaaggaggtggcgctgctgctgcgcgccacggggctgcacaaggatggattcagggaccactgcctctacagcctcgcactggcctcgggcctgcgtgagcacgagctggtggccctcaacatcggcgacgtcttcgacgagcgcgggcgcgcacgccggcacgtgacgctgaccgtcttcaagggcagccgccggcacccgggcccccaggaggttgtcctctcggacacggtgcgcgcgaagctggagaagctgctgcgcctgaagcgcgcgcaggggcatgacgtgagcccccaggcgccgctcttcctgagccgcaagggcctgcgcctgtccacgcggcaggtgcgccacggcttcgcggtgtggcaggtgcgcgcgggcctggagcggcacctgaacttccacgccgtgcgccacaccgcatgcaccggggtgtaccgaaggacgaaggacatccgcctcacccagaagttcgcgaggcagcgaagcgtcgactccaccgccatctacacgcactcctcggaggacgagctggtgcgcgtgacgaacgacttgccctgctgatggggcacgccgcctccgcgctgagcgcccgcgagagcccctggttgggccggggtgccgcgcggaggcggtgaggggcaggcgtgcgcaaggctcgcgcgggccgccccaagcgcagccggcgaaagtgaacgcctcgcgccgttcacttaccgggtgcaaatgaacgggcgcggggtgttcactttttcggaggtgactctctcgaaaagggccccagatacacgcccccgcaaggccggccccacgaaaaatcgcaccaccccccaccctggcgtcaggggtaggcggggtaggcgtgctggcgtcatcggtaggcatggttgcgcccggccggggcaggcggtgaaggtgactggggaggagctgggccgcgcgatgggcagcaggcggccccaaccagcggaaagcggcaatgggcctcggcgcttcggcgcctcacgaggcctcgtaagcgcgcgaaacagcgtgggggcagtgacgccgaatggccgcctttacgcattttcggccattcggctcggccctggtaacggcacgcgcgcccaggtgcgcgcggggcggagtgtggaggcgcggagggcttggctcggagtcgtggggctcacgaggaggacaaaggcctgcggcccgaagcgctgggggacacgcgcgcacgaaaggggcgccacgcggcgacaggcgcggcgcgcggggctgcccgggggcgcgcgccaggtggccacgtggcggccagcggggcttcggtggggagggggcaggcgggccggggaagtgaacggcgcgctggcgtccggcccgctggacggagtgtgcttccgggcccgaattatggcccggagcgataccgcggcgctcgagcacctggtggctgtccgccctaacctcgcgaaactacgggggctatggtgccaggcgtgtgcatccgcgcgccaggcaggagctccacggggaaagtgaccaggcctggccaggcgcggcgaaagtgaacggcgaaactgaacgcgaaagtgcccgcgttcacttaccgatgggcactttcaatcggggtcggcgggggcgcgacgtccttcggaggtgctacgagggcgtcgtccttggggctctccggggcggcggtgtcgaggtcctcggcgtcgctcgccgtcacctccgcgtccacctcaccgcgctcggcgggcgtcgtctcacgagcagcgcgcagggcctgggcgtgtcgggcctggaggccctccaacgagaaggtggcgtgcagctcctggcgggagtcggcgccacccatgacgaactccttgagcctcaccatggtgttgaagtcggtggggttgtcgacgcgcacgcggccctcggacagcgcttcctcgaagccgaggaggtagccgtcaatcatcttcagggcgtcgtccttggagacggcgatggcgttggcgcgcagttcaatcagcttctggtccgccttggtggcgatgcgcgtcttggcctcttcgcggcggcgcaggcagttgtgctccttcgcgtagttggcaacgagcgaggtggcgacaccaaagcgctcggccagctcgcggtaagaggcgtagctcgtcatggttgagccgtcggggagcgtcttcacgtcgccgaagacgagggcgcggtccagctcctggcgtgggagcgcgggctcctcggacttacgggggcggcctgtcttgcgcttcggaggaggtggggcttcggccggcgcgggcgcttcatccagcgcgggcgtctcgtccggctgctggcccgcgaggaggcgctttcggcggccgaggcagtcgtgctgctgggcgtaccgggcgacggcgctgtgggcgacgccgaagcgctcggccagctcgcgcaaggaggggaagcggcgcttcacacggccccgcgtggtgggcacctcctcgccttccacgaggagcctgtccacctcgtcatgaggcagccgagggccttcggccttggtggggcgccccagcttcttgaggggcttcttctgggccatgccttccctcagcagcctccggggggctgtactgcggcgtccacgtcctgggtgcgcaggcgctgcatcagccgcgtgcgctggcgcttcagccgctggtacacccgctcgacctcggtggtgtcgccctcgacgaggcggctgacgtaggcgcgcagcttctcgcgccggacgacggtggccatgaggacctcgacgtcgctgcgaggcagcgtggcccgggcgaggtgtaccagcaccgcatccctccgcacgaagctccggcggacgctgggccgtctggggctctccaccggcgtggcgggccgagcgtcgggcagccactcggcgagctgcgactgcgtgtacgtgtc

SEQ ID NO: 760 - DNA, 6404 bp, Myxococcus xanthus
  unsure (1)..(6404): unsure at all n locations
gcagtgacccggggcctcccacgccggatcccccccagatcgccctgacggtgcccgcgagcatcatctccgacgacaagttccaggtcatcgtcacggtgtccgggctgcgaggccggctcgacgctcaacgtcaatgaccgggagaccatgctccggaccttcccgcacagcgtcggcaccatgacgctgacgctggagcgcaacgacattccctacgccacagcgggcctggccgcgaacctgtcgttgaacgcggtggccacgtgctctgacgggcgtacgaatcgctcgcagcccgcccctgtctcctacttcccggtgcagcgccgcatcgtggagccgcagaacgccggacaggtcgtcaccgaccacttcgtcatcgacggcaccagcgccaacccgaccttcttgggctgcggcgtcccgccgacggagatttccacgctgtaccgcgtgaacctcagcggcaaggtgacgggcactgtcggaatgcccatcgcctgcacccccgagacggtcatcaccgagcgcaaccccatcagcggcaagcgctgggtgtggaccccgaacgtgggcgccttcgccgtggacgccgacctgcgcatcaccgcgcgcacgacgacggacatcggccccacgcaactcactgtgctgccgggcggtgacgccatcatcgtcaaccgcatcgacgaggtgcgccggctctcccacaaccccgacggcacgtcggagagcgtggccgaggtcaagtggctctacgcgcccacgacgctggagagcgtcatcgctccgcccctggttcgcgcggacgggttgattctcatcgcctcactgggcacgggcccggatgcttcgcgcacggacgtcaccgtcaccgaactgtacgcgggcgagacgggtgagcagggcgccggcggaacggcccgggccgcatacaagctacggaccttcgcgcgcaacgagcgcctccccctgggcgccttcaacgacacgggcaacacgctcttcctgggcctccagctcggctcggagcagtcgcaggtcatcgcgtgcgccgcgaaccaggacgagtgcaagggcgctcgcatccagtggaccagccccgcgctaccggtgccggtggcgcacatcctctatcacccgggcgcctcgcgcctcgtcgcggtgggccagcagcgcgtgtggttcctcgacgcgtcggggcagattcgcaaccgggacaaccgctccatcgacgcgaatggcgcgctgaacgtgctccaggtgctgcgccggccgaactcgccggagctcttcctgctcaacgcgccggcccgcggactggatggcgcgccgacgctgcccaacgaaatcgtcgccgtggaccagacgtccggcggcgaggcccgcgagctgttccgccaccaggtggtcggcagcctgggcggtgcaatcgacccggaaggccggctgtgggtccgcactggcttcgacgtggtgcagacgctgcctctgtccgactaccgccgctaccggccgtagcgcgcgcgactcagggcctgctggcgacgaggagtgcctccacgttgccagcgggcccgggcaccgtggagtccatcaacccgagtacctccaggccctgctcgcggacgaacgccgtcaccgtgtcgatggcgtcctgcctggcagngacatcccgcaccacgcccgccttccctacccggtccggccccacctcgaactggggcttcaccagcgcgaccaagagcccgcccggcgccaggtacgtcagcaccgacggcagcacctgcgtgagggagatgaagctcacgtcgatgacgaccacgccgactgtctccggcaggtcttcttccgtgaggtagcgcgcattgacgcgctcgcgcgagcgcacccgcgggtccgtgcgcagcttctcgtggagctgcccgtagcccacgtcaatcgcgtggacgcgcgtggcgccgtgctggagcaggcaatccgtgaagccgccggtgctcgcgccgatgtccgcggccaccttgcctcgaacgtcgagcccgaagcggtcgatggcgcccttcagtttcaggccgccgcgcgacacgtagggaagcacctcgcccttcaggcgcagctccgcctcctgcggaatcagcgttccgggcttgtccacgcgctggtcgcccaccaccacctggccggccaggatgagcgcctgggccttggtgcgcgactcggccagtccgcgctccaccaccagcacgtccaaccgctccttgcgaggcttcaccgtccgccccctgccagcagcgcgaggcccgcgcgccgcagaccctccgcgtccagcccctgctccgcgcgctggacccgcgcgtccccatggggaacgaacgcatcgggcatgcccatcaaccggacgcgggccatcagcccgtgcgccgcgaagagctccagcaccgcgctgcccaacccgccgcgcgtagtgccctcctcggccaccacgacatgaccggaccggccggcctccagcaaggcggcctcatccagaggcgaagcgcagcgcgcatccagcacgctccagccgggctcgccccgcgcggcctccagcgcggcgatgcccaaaggccccaacgtcaccagcgtcagccggggctgctccgcgcgaagcagccagcgagccccccgcagcggtgcctcgcccgcgcccagtccttcgggcaggggcggcagcgtgccgcgtgggaagcggatgacggaggcgtgcggcgccgccagggcagtgtccagcataggcgccaggtcctcccccaccatgggcgaccacaggtgcaggtccggcagcgggcgcagggacgccacgtcgtaggtgccctggtgcgtcgcaccatccgcgcccaccagccccgcgcggtccacggcgaagacgacgggcaggcccggcaggcacacgtcgtggatgatctggtcgtacgcgcgctggaggaaggtcgaatagatgcagcacaccggccgcgcgccggccgaggccagccccgcgctgaaggtgacggcgtgctgttccgcgatgcccacgtcgtgcacccggtccgggaagcgcgccttgagcgcgttgagcgccgagccctccaacatcgcgggcgtcaccgccaccactcgtgggtcccgggccatcgcgtcctcgagcaccgccgcgaaggcttcgctgaaggtccgctggccaccgcgcgagcgcaccagcttgccgtcccgccactcatacgggcccatggcatgtccacgcgtctgcgtgtcggcctccgctggcgggaagcccttccccttcagcgtcagcgcgtgcaccaccaccggccgcgacgaggcacgggcctcccgcagcgcgcgaatcagcgcaggcaggtcgtgcccatccaccgggcccaggtaggtgaagcccaggccttcgaagaagtcgcgcgcctcgcgggtgcgcagcagcgcggggatggcccccacgttggcgctgatggacatctggttgtcgttgaggacgacgaccaacggcagggagctcccccccgcgttgttgagcccttcaaatgtaaggccccccgtgaggccgccgtcgcccaacaccgccaccacgtggccccggtgcccctgctgccgccggccctccagcacgcccagcgccgcggacaccgccgtgcatgaatgcccagccagcagcgcgtcgtgaggactctcccgcgggtccaggaacggcgcgatgccgcccgcgtgccgcagcgtgtgcatgcggtcacgccggcccgtgaggagcttgtgcgcgtacgtctggtgccccacgtcgaacagcagcgcgtcttgcggcgaatggaacacgcggtgcagcgcgacgatgagctccaccgcgcccagggaggcccccaggtggccccccacgcggccgcagatggagatgatgtcctcgcgcagttcctggcacaggagcggcagtgcctcctcgggaagtgcgcggacgtccgagggcgagccgatgcgtgacagcaactccgacattaggacttccgctccaccgtgtagccgcgccaacgccgccagcggcccgtcctcgccttccagagggcgtacggccgcgatggcctcggccaccttctggtccgccagcgtccgcgacgcctccaggcccaccaccgccgggaaggtgaagcgcccggccgcggcgtccgcgcccgcgggcttgcccagctccgccgccgtggccgtcacgtccagcacgtcatcggcaatctggaaggccagccccaccgcgtcaccgtaggtgtccgcgcgcgccaatgcgtccgcgtctccaccgctggccagcacgcccatgcggcacgcggcccggatgagggcgcccgtcttcatgcggtgcatccggatgaggtagtccagcgcggacggccggtcctcggcggtgtccagcacctgcccgcccaccatgcccgccgcgcccgaggccaccgccagctcccggcacagcgcggcgcgcatgctctccggcccactggccaccagcgtgaaggcctccgtcaacagcgcgtcacccgccaggatggccatggcctcgccgtacaccttgtggttggtgagccggccccggcggtagtcgtcgttgtccatcgccggcaggtcgtcatgcaccagcgagtacgtgtgcacgtactccagcgcgcacgccgcgtcgcccgccaccgccgatacggcgcttccgcgcgccacgaggtccgcgaaggccaggcagagcaccgggcgcaggcgcttgccgccggccagcagggagtagcgcatggcctccgcgagctgcggcggcgtcccggaaggcccgagccgcgccacgcgctcgttcagcagggcctcgacgcgcgcctgctgagcggccagaaaggagttcagttgaaacgttgccacgagcgtccgtgctcctcttatggaatctgcgcgggcacaagctcgcgaatgcggctgacgagcttgtccatgtccagcggcttgacgaagtagtccgcggcgcccaccgccatgccgtgccgcttgtcctcgggctccccgcggccactgatgaagatgacgggaatgtcccggaactgctcgttcttcttcaccgcccggcacagctcgaagccatcaatccaggacatgttcacgtccaggaggatggcatgcggccggtgcagttggagcgacgcgatgagccgcaggccgttggccgccatggtgacggcgaagccttcgtactccagggccgccgccagcagctcccgcgtgtcgcggtcatcatcgacaatggtgattttcagcttcgacatgccggaatggacgcgcccgagcacctagaacgggacgtcatcctccgggggcgggcgaggagtaggggcccgaggggccgcgggcgcgggcgccgccggacgcgcggcgaccgacaggggcgccaccacgtcgtttccgtcctcgtccagcaggagctgttcgatgcgctgctccgcctcggtgagcagcttctcgccccggcgcaccagccggatgccttcctcgaaggccttgagcgagtcctccagagagagattgccgctctccagccggcccaccgtctcctcgagccgggagaccacgtccccgtactgctcggggacctcggcctccgctaccttgtccgccttgggcgccttgtccgacttcgccacttccatccacctccccgcatggggcgcgggactctagagggtggcccgtcagcagtccaccggccctttcaccgccgtgacggtggcttcgatttcttcacatcccccgagcgacttcgccccgttcgacgcgagcttcagccccaggcgctctcccacctggacatccgcgccagtgcggaccaccgcgccatcgcgctgtcggaacaccaccgaataaccgcgggacatcaccttcaacggactcatggcatccagacgtccctccagacgctggaaacgcttctgtgcatccgccagggccccttgctggagcgccagcagccgcgcccggtgcgcggccagccgggcgcgctcacgggacacctgggccgccggtgacgccctctcgagccccagccgtgccgtcgccagcgccccgtgccgcgtcgccacacctgcgcgcaccgcctccgacagccgcatggccagcttcaacaggtgcgcccgctgctcccccagccgtgcctggggacgcgcccgctgcagcctttcggtcagcgaccgcagctcctcgcggtgcccccgcacggctggccgcagcacgcgcatcatcgactccacctgctcggacaggtgcagccgctggtggttgatggcccgccgagggtcctccagccgcgacgcgagctgcccttgctcctcgcgcagctccaacacccggcgctccaggcc

SEQ ID NO: 761 - DNA, 5971 bp, Myxococcus xanthus
  unsure (1)..(5971): unsure at all n locations
gggggcgatgccatcaccatcaccgccagcgggcagttcgccttcgcgacgccagtggccttcggcgcgagctacgacgtcaccgtcgaggcggtgtatccggtggcctgcaccgtgagccgggggaccggaaccatgggcaaccaaccggtgacgaacgtgagcgtcagctgcaagacgacacggttctcgctggggggcaccgtgacgggcatccttcccgcaagctcggtggagctcacgaccggcacggagtcgattcgcgtcaacgcggacggcgccttcgccttcgtcgggccggtggatgacctgagtggctactcggtgacggtgagctcgccgcccatgggccaggcctgcgacgtgcgcaacgggacgggcaccgtgagcggggcgaatgtgaccagcgtggtcgtgacctgctgggcgttggagtattcgctgggcggaagcgtggcgggactctctgggggacagtcggtggtgctgaagaacaacggaggggatgcgctcaccgttgcgtcaaatggctccttcactttcccgacgccggtgtcctactggagcacgtatgccgtcaccgccgaggctcgctacccgctgatctgcagcgtgccgaatggcacgggccgaatcggggtagggggcatcgcggacgtggtggtctcctgcaccacgcggtccttcaccgtcggaggtgaggtggcggggctcgtcgagggaaccgcgttggagctgtggaacaacgagcaggagcgcctcaccgtttccgcgaatgggcccttcgccttcctccagccggtggcggacctgagcgcctactccgtttcggtgatgacccagccggagggacagtcctgtgaggtgcggcagggcacgggcacgctggggggcgcggccgtcacgagcgtgtcggtcgtctgctcgccgaggtcctatctcgtgcgcggcaccgtggcggggctgggggatgggcagtcggcggtgctgaggaacaacggaggggatgacctcacggtctccgccgatggcgccttcgccttcccgacgccggtggccttcggcgcgacctattccgtcacggcccaggcgaccgcgccgctggtgtgcaccgtgtcgaacggtacgggcacgatgggcgagggtgacgtcacccacatcgaggtgctctgcggcacggcgtcgtatcccgtgggtggcagcgtgagcggcctggccgagggcgccatgctcgagctccagaacaacggcgacgaggtgctcctggtttcggccaatggtgccttcaccttcgcccagcaggtcgcggagcagggcagctactcggtgacggtgaagactcagccggagaaccaacgctgcgccgtgagctccggcggggggaccgtgagcggtgcgcccgtcacgaacatcgtcgtcacgtgtgagaacgtctaccggctgcgcgtcagtgtttcggggctgaccggcacgctggggctgaagtccggcgcggacaccctcacggtcgccaccgacggggagtcttcgttcccgctgccgctgcgtcctggcgaggcgtacgcggtcgaggtgagccgtcacccgacgggacagacctgcgaggtcgtctcgggcggaacgggcaccatgggcgaggcccacgtcaccgtcatggtggcctgtgaggcgaacgcgatggtggtccgggtgggcgcgggcgccgcggccctcaacacgaatgccacggagatcttcatcgatgagtaccgccccatgggtggtgctcccgtgcgcaccttcgccattcccgcctcgagcgcggcgggggcggcccgcctcacggtggccggcagtgatgtccaccagggttacctctcgcgctcgggcaatggtcgcctgctcaccttcacgggcttcgatgcggacgtgggcctggcgaacgtctcgggcacggccgcatcggagacacctcgggtcatcgggcaactggacctcgcggggaccttcaccctccctgtgcgtctgagcgatgcctatgaccgagaccaggtgcgcgcggcgtcgacggtggacggcaccggctactggctgtcggggcgaggcggcggcatccgccatgcgctgcctgccgagaacaccacggtgtcgacagccatctccacgggcgtgacggacacccgcttcgtgagcctgttcgacggccgcgtctacttctcgctcggaatccctccgagcccgaatccccagggctacaaccagggcgtcctgacgttccccaccgagcagcccaccgcggcggtcgcgccgaaccagctcccctcgttttcgacgacgttcaactcgtccggcttcgcgctgctcgatgagcgtcccgaggtggccggtgtggacaccgcttacgtgtccatcaacctcaaccagaatgcgagccagggcgggactccggacacgttgcgcctggagaagtggaccttcgacggggtgagctggagcaaggtgtccagcttcgtgcccaccttcgccgtcgcggggaccaccaccgtgcgtatcgccacccatggcgtctcggcggtgcggactccccgaggagttcgcgtctacgtcaccacgtaccagtcgagtggtggtggcgcgggcaatctcctggtgtccttcctggatgatggaagctcgtccacgccgtccgtgcgtgtcgtggccacggcgctggccaacaccagcttccggggcgtgagcgccagcccgctgccctgagtcgtgaagcgcgcggcatcagcgtccctaggggattcctgagggacttccaggggcgcccccgatggtgcgcgccacccgaatccgtaccgtttcgtttccaactccatggttgctgttcgtcgcacgcgcggcggtttgctgcagagaggtccatccatgtcagtgcgttcccgttgtcgtctgcttcatcccgcgttgctggggctggtcgcggcggcagtccttgccggctgcagtagcgagaagtcctcccccaccgtgaagtccctgcggatttcgcctgagagcttctcgctcgccgtgggcatcggcgcggacgtcaccgcgaccgccaccttctccgatggcagcacgcgggacgtcacgcgtgaggcctcgtggtcctcgacggatgccgccatcggtacggtgtcatccgaggcgggcgccgcgccccaggtgcgcgcgctggccaaggggcagacgacgctgagcgcgacctactccgacgtctccgcgcaggcgcggctcgacgtgacggatgccacggctgtcgctctctccatcgagccgaaggacttgtcgctcgccgcgggcctcacgcagcagctcgccgccacggctgcgttctcggatggcacttcacacgggctcaccagcgatatcacctggtcctcctcgaacgaggcgattgccgcggtctccgagagcggcctggttcgcgccggttcacccggcgaggccaccctcaaggcccggttcggcacgctggaggccaccgtcaaggcgaccgtcaccgcggccgtcgtgacgtcggtggcggtgactccgggtgacgcctcgatggctcggggcagcacgatgatgctgaccgccatggcgacgcgctcggatggcacgacggtggacgtctccaatgaggccacctggagctccagtgatgcgagcatcgtgtcgctgaacaagcgcgtcgcgagcggcgccgcgctgggggggggccgagtcaccgcgaccttcgcgagcgtgagcggcggcaccgaggtgacggtctccgaggccgccgcgctcgccgtcacgccggcggcgagcatgctgattgaaggccacccgagccagctccacgccgaggccacgctgtccaacggccgtacccaggatgtcaccgcgagcgccgcctggacgagcgacatgacggacgtggccgtggtctcgatgaccgcatccacgcgtgggcaggtgacgccggtggggcagggctccgccaccatcaccgcgaccttcaacggacttcgcggtaccggccaggtgagcgtgtcgaagctgagcatcaccagcgtcgtcccgacgttccagacgatggaggatggggtggtctccttcacggcgcggatcaccaaggccctgccgccctccacgaggctgcggtggcgcgtgtcggtgattcgtcacaacccgccggccgatctccacctgccccccaccgatagccccgtggtgggccagccggtgcgctacttctcgggcgccgcgggtgaggtggccgaccggccggagacgtggacaggcggctcggagaccgacgcgagtggcgcggcctacgtggggcaggatgcgggcttcgaggtggtctcgaccgggcttcagggcgcggagggccacacgtactccttccgcacgcggttcgccatcaagggcgactactcgttccacctcgagctgttcgaggtcggcgccgggggcgagctggttcgaatcggcgacgccacggagctgagcgccaccgtggggacgatgcgcgcgacggatgactccgagctgctgctcttcactgcttctccctcggcggaggcccagacggaggaggagtccttcccgcaggcgttcgccgtgcgcccggatggctcccagttccgtcaaatcacccaggcgcccacgccgttcttctctccgcgagacgtccactcggaggtgattcgttcgccggaccgcaagtcggtggtctgggtggacgggcgagacaagttcgggggcatctacttccaggggctcctctacatcgcggacgcggacggaagccgggtgcggcgcctcacccaggcgagctcgtcgctgtgcggagagcgcatgccggagtactcgccggatgggcagtggatttcgttcatgaggtcgtgctctcgcgacccgtacccgggacgtgatggcctcgagttcaccttcatcatccgcgctgacgggacggacgagcggcgcgtcctcatcagtggcatcaacgacatgccgccacccgttcccatctcgccgctggtcttctcctccttctcgcgcgacagcaagacgctctacacggtgcagtacgcgacgaagggcgcccagctctgggccttctcgctggaggatgggagcgcgcgctccatcatcaacttctccgtccagggacaggagatggcctccattgtgcggttcccgatggagctgcccaacggcgacctgctgtaccactactggaacgaggacgtgtggacggacacgtggctggagcgcatccggcctgacggcacgggccgcgaaatcgttcggcccgtcatgcgcggcagcaggggcgagttgctccagtccctcttcacgctctctcccgatggcacgaaggtcgcctacaccgagcgggacccggtgacgggggtcaacaccatcatggtgtccaacatcgacggctcggaagccgtctccatgaagaaccctccggcctacttcgtgcggcgcatcttctgggctcgctagcgcgcgtgccgagcccccccatccatcttccgaggtccatctcgtgaaatcgctcttcaagaacctcgccggtgtcgcgctggcgttcgcgggcacgcaggcgggtgccgattcccttcccaactacgatgcactgctggagcgctcgcccgctcccggagcacgctcgctcctggaggacagtgggagtctgggcggacaggtgctgcaccgcgagcaccggctcggcgtgccgaccttcgtctgggcctcgcggcccgcgcaaggtatggcgtttcccccgtcgcttcgcgcggccagcgactacgcgcggatgtctccggcgaccgcggcccggctccagctcgatgcgctggctccgttccatggcggccggtcgctctcgcaggtggggacttcggtcgccagcgttcgccggagcccgctgggctcctcggtggtgacgctgcngcaagaagtggggggagtccag

SEQ ID NO: 762 - DNA, 6611 bp, Myxococcus xanthus
gccttaccgtgggccacccccgtgaggatgagctggcccgtgttcgtccgcacgctggcgtccggaggctccacgtcggcgatgagccggtacttcgcgtccacccagcggaagcagtccagcagcttgtgcgccaggttcgcctgcaattgcttgtacaagtcgaagggactgatgaggcccttctgcaccagcaggccgctgagcggcacctccgcggagatgctctccgccagcgccttctggtagtccgtctccgacagcttgcccttctccaccaggtacttgcccagcgtctcgtggaggaggttggactggcacgccaccggcgcgccgtcctcgaagacgatgcgcttctcccgctggcgcaccttcaattccaacgtgcaggtgcgctcctccgccatcagcgcgtgaagcagcagggggaacggcgtatcggccagcactccctcccgctggcggaggacctgcgacggcgtggggaacatgggcgagagcctagcgctactcgccctggtactcctccatccccaccgcactgggtggctcgccatacgcgccatggtcgtagcggccgccgtagtctccctctggggttattacgaaccggggcaacatggacgccagcaggctcagcaccagggccacggccgccgcgtacatcaacggccggctgggccgcgcgcgccaggcccacttgcgctcccggcgccgctggaaccggggcgccaccacgtattcggaccaggccaggtcgcgcatccgcttcgcgtcgtcgccgcggcccgcccggctcagggccttggcgagcaggtagcggccttccaccgtgccgtgtcgcaccttgcagtagcgctccagcgcctccaccgcgcccggcacgtcgccgcgcttcagccggaaacggccgcgctccaggtcgatggcgcccagcttgtggtccgggtccagcttcgccgcctcgtccagcagcagctcgccgcgctgcgcgtccccggcgcccaggtaggccacgcccagcaggtacagcgtatccacgtcctcgtcgcccgcctccaggttgggcttgaggatgtccaccgcctcggcgtagcggcgctgctccacgcggatgtccgccagttcgtgccgcgcgcgccgctcatgcgggttggtgaggatggtgcccgccagttgccccgcgcgctggaagcgcttgagcagccgcaccgggctgggcagcacctgccacgtgaagcggtccgccacgaagatgatgacgatgatgaggcccagcgacagcagcgggctgcccgtcagcagggtgaggaacagccacaatatccacttgctcatacgcctctcgaaatccgttccagtggacgccgcctagagcagccgcgcgcacacggcgctgtggacgtccgcgcccttctccgtcaatgccagccgcccgtcccgcagcgtcgcgaagccgtgcgccaccagccgcgcgacttccgcccgccggggctccaccggctgtccatatcgctcgcagacggcctcccagtccacgcccgacaccagccgcaggcccatggccaggcgctccgcgaagagctcctccgggcccagcggctcgcggccttcctctggcagccgccccgcctccgcctccacgaggtagcgctccgcgctgcgcaggttcacgtaccggtgcggctggggcgacagcaacatgcccgtggcccccacgcccagcgccaggtactccccgccggtccagtacagcgcgttgtggcgcgagctgaaccctggccgcgcgtggttggacacctcgtagcggtgcagccccgccgccccgtacacctcgcgcaccacccgcgccatgtcgaccacggtgtcgtcgggcggcagctccagctcaccgcgcttgagccgcttcgacaggggcgtgtcctccgccagcacgtcgcgctccaccgtcagcgcgtacgtggacaggtgctcgggggccagcgccaccgcccggcgcgcatccgcctccacctgcgccaccgtctgcccgtgcacgccatagatgaagtccatggccaccaccgggaaggccgcgctccgggccgcgtccacggccccttccaccatggccgcgtcatgcgcgcgccccaacgccttgagcgtctccggctggaaggactgcacgcccagcgacagccggttcacccccgccgcgcggtagcccgcgaagcgctccgcgtccgcgcgctccggattgccctccagcgacacctccacgccaggcgccacccgcagcctcgcggcgatgccatccagcacctgggccacgtagcgcgggtgccacagggacggcgtcccaccgcccaggaagatggagtcgagcaccttccccgcgagcgagggctcggcggccagccgggtgtccagctccgccagcaccgcgcgggcgtagcgctcctccggcacctgccgcgccaccgccaccgcgaagtcgcagtacgggcacttcgcgaggcagtacgggaaatgcaggtacagcccgaagcgggccgccggcattcccgtgagggcatccactggcgcgtcgaaaggcatgaaggaaaaacctctacctcttgcccttcaattgcgcctccagccgggcaatcttcgccttgtagcccgccgcgttctcgagcgctgtctcggccgccaccagcttgcgcttgaggttggcagcgtccgccttgagctgctcgcgctccgcctcccagtccgctggcgcacccgcgctctgggagggagtccccggctgctccgccagcttcgcctcgagcgcccgccgtgcctcctgctctgctcgcagcgaggattccacgtcggcccgcttctgctcctcggccttcagcgacgcctccgcgcgagccagcttcgcctcggtcgcagcgcgcgccgcgtccgacttgccggccgccgcggcctgggccttcgcgccttccaaggccccctccatcatcttcagccggccctggaggcgctccaccttgtccgcctcggcgcgcgcggcctccagctcctcggtgagcgaggccacctgcgcctcggcgccgccctgccccaccgtcagcgactccacctgggcctcggcttgggccgccttcacctccgcatcggtgcgctcgacctccgccgcctcgcggcgcgcacgctccagcgccagcgcctcgtgggccttcgccacctctgcttgcagccgcaccagctccgcctcgcgctggccggacgccgcctccagcatggacacccgggcggccaggccgacgcgctcggcgtccttggtggccgccttcagctccaccgcggcgagctgttccttccacgacgcatggtccgcgtgcgcggcctccaccgccgccgtcagctcggacaccttcgtctcggcctgctgcaccgcctcgcccagcgccgccgcgtccgcttccatgcggtcgcgcaacgacacctgctccacctcggcggcttccagcgcctccttcagcgccgcggcctcgccctccgccaggtgcgcccgctcactggcctgtgccaatccctcttccagggcctgtgagcgctcctcggccttggccgcctccgcctccagcttcgccttgagctgggccagctccgcggtgcgcgcctccagcgcctgacgcagcgcgggcagctccgcggcctcggtggtgcgggcggtgagcgccgcgcgcaggcccacgatttcggcgtccttcagcgccagcgaacgctccagctccgccacctgctcctgcagggtgcgcagcccgtcctccaccaccgccagttgcttgcgcgcctcgtcgcgctcggcctccagcgtacccgcgcggccctgggcctcctccagcgagctcttcgaccagtcgctctcgctctccagcgcgctcagcccagattgggcctcctccagcgcggcctccaactgcgcggtgcgcaggcccagcgagtccttctccgccgaggcggcctccagctcggaggtcagccgctccacgtcggcgatggcctgctggtactgctcctgaacggcctccagggcgccctgggcctcggacttctccgcggccagctccgccacgcggtcctgggccagcgacagcgcttccttcgcgccaatcagctcctcggccacggcgccacgggcctcgcgctcctcctggagctccgccgtcaggcgcggcacatcggattcgacctccgccagcgcgcgagacaggtccttgcggtccgcctccaccgcggagagctcatcctggaggctggcgagccgcgactgggactccgcctccgcccgggccagctcctcctggaaggcggagacactggccttcgactccgccagctccttgcgcgccagcgtcagcgactgcttcacgccgttgagctcgccgtcgcgctccgcgtacagcgtccgggcccgcgccagggtctccgtcttctggcggaccacggcccggaagtactccagcttgtcctcgggcgagccgcccatgggcatccggatttcgggcggctcaccaaatggatcattccccggggcccgcgcggcgcggacggcgggggcagcagcggcagccggggacgcgggcgccttcggggacgcgggcgctcccgtgcccttgggcacggcggccaggggggcggccggacggcgcggcggcaacggaggcggagcggcgggcggtggagccgagggcggtggctttggcaagggcctggaggccacgggggcgggggcggcgggggccaccgaggcaccggtgtcttccaggtccaggctttcgcgcaggtccgcgagcggatccacctcttccggaggtgacggcatgggcgggcgcaggttaccccccgaacgggctcacgaccagagacgcgtgggcatgtgcgcgtccgaagtccatccatccggtcggacggcagccgtacagtctcctcgacgccgaggctcccaggcgttagccagtgagggaaaacatcacacctcgccttgccctcccagtgggccggtgacagcttcggaagtttctatggccatccgctacgcgctacccaacgggcttaccgtcgtcttcgaggagcagcacgccgccaaggtcgcggccttccaggtctgggtcaaggccgggagcgccgacgagcggccggaccaggcagggcttgcccacctgcacgagcacatgctcttcaagggcaccgagcgccgcggccccggtgaggtcgcccgggacgtggagtcccatggcggcgaaatcaacgcctggacctcctacgaccagaccgtctaccacatcgtcatcgccagccagttcgcccggatgggcctggacatcctgggcgatgcggtgcgccggtcggccttccacgcaggcgagctgtcgcgcgaaatcgaggtggtgtgcgaggaaatcaagcgcagccaggacacgccgtcccgccgtgcctcgcgtgacctcttctccaccgcctaccaggtgcacccctaccggctgcccgtcatcggcaccgacgagagcgtgcgcagcttcacgcgggagaaggtgctggagttctaccaccgccactacacgcccaagaacctggtgctgtcggtggcgggagacttgcgcgaggcggagctgcgcgagtgggtggacgacatcttcggcggcgactggggccggccgtatgagggccgggtagcgcgcgccccggagcccgtggccgcgggccggcgcatcctgctgcgcccggacgaggtgaaggaggcctacctccacctggccttcgggattccccaggcggaccacgaggacgtgcccgcgctggacgtgctggcgatgattgccggccagggagacgcgtcccggctggtgcgcgaggtgaagcgccgccacaacctggtcaacgacatccacaccttcgcgtatacgcccacggacccgggcctcttctccgcgtcgatgacgctccagcccgccaacgccgtccgggcgctggaggaggcggcgcgagggctggccacgctgcgcgccacgccggtgacggcggaggagctggccacggccaaggcgctggtggaagcggaggccgtgtaccagcgcgagacggtgcagggcgtggcccggaagatgggcttctaccagtccggcatgggcagcctggaggcggaggcccgctactacgaggccgtgcgcaacctcacgcccgagcacctgcgcgccgccgccgagcgctacctgcgcttcgaccgcgccgtcgtcaccggcctgctgccggagggcacgccgctgacggaagcgcaggtgcacgaggtgctggatgccgtggaccgcgcgcccgccgcggcgccgcccgagcgcaagccgcgcaaggtggccgtgagtgactcgccggtgcgcatcctgaagggcacgagcgccggccccagcgacatcatcacggagaagctgccgtcgggcgcgacgattgtcgtgcgcgtggagcccgcggtgccgctgttcgccatccgcgccgccttcgcgggcggtctgcgctacgagacgccggaggacaacggcatcaccacgctttgctcacccgcagccatcaccgcgggggggaacgccggacggcac

SEQ ID NO: 763 - DNA, 6083 bp, Myxococcus xanthus
  unsure (1)..(6083): unsure at all n locations
gtgctctccagcgaaggcgaggatgccgcccagcggattgttgatttcgtgcgccaccccgccggcgagctggcccaccgcggccatcttctccgtctcgatgagccgccgcgtcatcgactgctcctcggtgacgtcccggtaggtgcagacgacgcgctcatcccccgcaatggggtaggcggccaccacgaaggtgcgcccgccctgacggacctcaccgcgcgcgcccttgccgctctccaccgccgccggcagcgggcagcccgtgcacggctcgttgcggccgaagaggtagcggtagcacgtggtgtcggagggaatctcctcgatggagcgccccgccacgtccgcgtacgccaggttcgcccgccgcaccgcgaagtcccgcgcgcgcaccacgcacagcggcgtctccatgcagtcgaaggacagctcccactcgcgcttggcctggctcagcatgcgcgtgcgctgggcgacgcgctcctccaggtccgcgttgagcagcttcagctccgcgttctgcgcctgcgtcaccgtgtagagccgctcgttctccgcctgaagcgcgtactgctcgaaggcgctcttcaccgtcaacaccaggtggctgtcgttccagggcttggagatgaagcggaagatctccgaccggttgatggcctcttcgatggcctgctggtccgcctggcccgtcagcatgatgcgctgggcccgcggctcctgctgcttcacccgggtaaggaaatcgacgccattcatccccggcatgcggaaatcggagatgaccacctcggggtggaaggcctccaccgcccgcaggccctgctcggcgtccgtcgccgtctcgatgtcccaatcgccgcggcgcagcacccggcggatggacttgaggatgttctcctcgtcatccaccaggagcagccgcccgcgtggcgattcggcctgctgaccgtggacatatgcggcttgagaacccatgaattgtttccgcccctagacaaatgcaatggccctgccagcagaaactccctgcccaacagtctggaatcacgggccttgacatttccatggcgcgaaaaaacgccaggtccaattagacccatccccaccaaatgggtcaacatagaccccgggtctttgacccgggctaggttccgagcggaccgaccgggagctggggatgtaggcagatgcgatccctgccgtcccgtttggcctggtagagggcctcgtcggccgtcaggagcagctgctccggggtgaggacggtgcggtgggggaagctggaaacccccaatgacgcggtgacttgcaggctgtccgacacctccagccgcagggcgcgcagctcgcggcggacgcgctcggcgacggtgagcgccccggtgaggtgggtgcggggcagcagcaccgcgaactcctcgccgccatagcgggccaccaggtccgtctcgcgcacgccccgggtgagcgcggcggccacctcgcgcagcacgccgtcgcccgcggagtggccgtacttgtcgttgatttccttgaagtaatccaagtccagcaggatgagcgacagggagtcgtcataacgctgggcacggcggaactcctccctcagccgctcctggaaatgccggtggttgtggaggcccgtgagcccgtccgtcgacgacagccgctgcagctcgctcacctgggcggcgagcgacgccatccgggcctgcgcggccagggcgcgatgcacccgggccaccagttcatccggcgtccatgggtccaagacgacctcagcgccgcggcgcagggcctccagccagaatgccctgggttcgggtggggccacgagcaccacggggggccccaccgggccttcctcgggtatcaggcgttcgagcaaccccacgctggcctgggtgtcctcgcccgggcagagcaccaccagcgatacctcccgcgccaacctcggcacctccgggccgtgggcggtgattcggagggcgaaatcctccgggcccagcgcacgggccaaccgaggcaacgtcgactgcgagtcgtccactaccagcagggtgaagggcctggagttcacagtgtccccgcaaaatggtgatttcacggtatcataggcatgcgacgatatgcgacccctgcaattggataaaaaccggattctctgctagcgagccgccaacttcgcaggtccgcccgccgaggtccctcgtggcccaatacccaagcatcagcctgttcttccccgcctggaacgaagaggactacgtcgagcgcgccgtcagccgggcgctggaggtcctccccgccctgacggacgacttcgaaatcatcgtcgtcaacgacgcatccacggaccgcacccgtgaggtctgtgaggcgctggcccagaaggtcccccaactgcgtgtcatccaccaccccgtgaatctgaagctgggtggcgccatgcgcaccgggctggcggcctcgacgaaggacatcgtcgtgtactccgatgtagacctgccctgggacatgcgcgagctggagcgggcgctgcacctgatgtcgtacctggaggcggacatgatttgcgccttccggttcgaccgcacgagcgagggcgccaagcgcatcatctactcgttcgtctacaacatgctcatccggtcgctgttcgacatccagatcaaggacgtcaacttcagcttcaaggtgatgcaccgccgcgtgctggaggccatggagctgcacagccagggctcgttcatcgacgcggagctcgtggtgaaggccatccgccagggcttccgcgtgttccagatgggcgtggactacttcccacgcacgcgcggcgtgtccacgctggcctcgccctccgtcatcacgaagatggtgcgggagctggtgaagctctatccgaagatgcgcgcgccgcagccgccagtgcacccggtgcgcttgccgccttccgtgcagcagctccacgcggtgccgccgggccgcacggcgcgaggctgagccccgcatgacgcgccccctcacgcgcctggtggtgaacgcggacgacctggggctccatgcctcgctggacgcgggcatcctccgcgcgcaccgcgacggcatcgtcaccagcgccacgctgctggccacgggccccaccgcgcccgaggccgccgcccgcgcgaaggaggcacggctcgcggtgggcctccacctggcgctctccacgcggctgcctcccgcggcgcccgcgcacgaggtgcccacggtggcaccggagggccggctgcgtggcagctgggccgacttcgcccgcgcctggctcaccggacaggttcgccgggacgagctggcgcgcgagctctccgctcagcttcagcgggcccgcgccctgggcgtgacggtggaccacctggacgggcaccagcacctgcacctgctgcccggggtacgtcccctggtggagtccctggccgcgcgcgaggggctgcccctgcgctggccggacgccctgcctcgccctcgctggctgaaggcggcccgggcccccgcgctgaaaggcccacggtnngctggcccgtggcttcgcggccgcggcccgacgcccttcgggggncccccccaaaagaggccgtngncggccccgggggtaggaagccggccgggggccggggcggtcccttttcggaaaggnccgggagggcatggcccttgggcaccggagggccccgnncccctggcttncgncgnnngtggtgggaaccgccgncttgccccggccggggccgacttttcgaaagctgggcttggtcacccccgggtgaaggcacgccgcacgtccccgaagacccggcgtggcgctacggctggcaggcggagctggccgccctcaccagcgcgcgcgtgaaggcgcggctgcacgagcgcggcatcgagcttcacagctacggaacgctgttctccgccacgtagaggacgtgcggcgtggtgtagccctggcccaggtccaccacctctcgcaccgcgaagcccgcgtccttcaggtagcgcgtcatctcggctcgaggcttcagcgccatgccgccgctggccttcgtgcggcccagcagcgacaccatcacccactcctgcgccagcgccttgcggtgcttccaggagccgtcaccctccacctccttgagcagcagccgcccgctgggcttcagcaggtcccgcaccgtggagaggaagccgggccacttcggctccggcagcaggtacagcacgtcgcacaccaccgccgcgtcgaagcgcccggaagcgcccccggccagtgtctcctccacggtgccttcctcgatgcgcacgttgggctggcccgcgagcgcccgccgtgcccaggccaccttgcgcgagtccgggtccacgccgtgcacggtgcggcgcgggtcctccagcgccagcagcgcggacagcaacccatgcccacagccaatgtccgccacagcgcccacgggcgtgcgcgcggccatggccagcagcggcgcggagaaggcccgcgcgtggacgtggaagcgctcggcgacgggcagcccgtcgtagcgcaggagggcctgttcgatgaggtcgctcatgagacgtagtagtccgcgccgaaggcccacgagaggacgagcagcgacgcggcgcccaccgccagcgccccgcgcagcagcaagggccgctcgcgcaggagcatcgccgcggtgaggaagacggggaaggcggacagcaggtagcgccccatgcccatgaagtccttggtggaccacgcgggcaacccgacgatggccagcacgtagacggcgtagccccaccccagcagcttgcgcgtgggccacaccagcgccagcgccagcagcgtgaagaaggcgtgcgcggccagccggaaggcctcgcgcttgtcctgcggcgccagcacgacgcgctcgaaccagctcaccttcagccacgtgtgccagcccggaatctgctcccagccgggcgagccctgcaccttcacgaaggccaccgggtcaccgaactggtgccacaggaagagcatgtacgcgccgaagcccaggcccgacagtaccggcaggaagtccaccgcgctccacttctcgcctcgcgcgtgcttccactccaggcggcgcaccagcaggcccagcaccaccgcgggggccacgggccgggccgcggtggccaccgccgcgacgaggacggcgggccccaggtgcccgcgctccagcagcaggaaggccgcgaccaccagcaggacgaacagcgcgtccgaatacatggcgccgtagaagtagagcgtgaaggggtagcaggccatcagcagcccggccttcagcgccgtgtcctcgtccgtcagcttgcgcgcccagacggtgaagagcatcaacgccagcgggccgcacagcagcgtgatgagcacgccggactggtacacattgggccccagcgactccaccgcgcggatgagcagcgggtacagcgggaagaacgccaccgagctctgctggcccggggcgaactggtagccctcctgggcaatccgcatgtaccaactggaatcccaggccacccagcccatggtgaagtactcgtcgagccggacgacggggttgttggggtccttgtggaagaagcgccaggccccggcggtggcggcggcgccacaggccacgacggccgacaggacgacgaggacgatggtgcgggacgcggagcgggccatggggcccgggaggctcgggccagagacggcctccggtcaagcccgggagccgctgatacgcgggactcccgggtgccggcacgggaatgactcagcgcgggtagaacgtcttgcccgccttcaccatctccaccaggtgcggcgcgggggcgaaacgctccccgagcttgtcgtggtagtgctccagcttgcgcagcacctcggcggggccgcggctgtccacgtagtggaagggcccccccaggaagggcgggaagcccaggccgaagatggcgcccacgtcgccgtcacgcgcgctgcggaggatgccctcgcccaggcagcggatggcctcgttgaccatcgg

SEQ ID NO: 764 - DNA, 5630 bp, Myxococcus xanthus
cggagttcacttcgggcgcgagctgtccgctccacccgggattcgatgcggtgggcacctgctcccgctgcggcaacttcatgtgccgcacttgcggcgaggggggctcgcaagcctggtgcccggcctgccgtcagcgcgagggcgtggggcaggcctttccgttgacgcgcgagaactggagcgtctccgggctgatggacctgtcctgggatgcgttcaagcgcgagtgggtgatgctctgtgtcggcgtgctcatcttcctggcgggctccttcgccgggcaggtcgtctcgcaagtctcctcgatggtcggtggcgcgacggggagcaccgtcatcaccgtcctgggcttcttcatcgggatcattggttcctacgccatccagggcgggataacgctgggtttcctccggatgagcatggacgtgctcagcggccggcgcgcggacctggggcggatgttcagccagttcggcaagattcccacgtacctggggacgctgttcctgtccttcctgttgatgctcccgctcctgttgctcatcgtcgtgggcgcggtgggcgcggggttggcgactggcaccgtgtcctggtcggagctggtggcgctgaaggacctgcctccctcggagctggactcggccgtgacgcccatgttgccgggcttcgcggtgatgggggccgtggccttcgcgctctacgtcttcccgggcgggtggctcctcacgccgctcatcctgatgcagccggagctggcccggaccgaatcgcccggcgccgtggagacgctgcgccgctgcttcgactactcgcgcggtcagcgcctgcccatgattggaacggtgctgctggggggcttgctcgccatggtgagcgtgttcctctgctgcgtgcccgtgattcccgccctgggtttcttgcagttgctgatggccgggctcgtcatggcgctcagcagcggcgccgaagaggcctgagccttccctccaccggggccttgcgcgcccgtcgcgcgcagggcctccggaagggtggggcgcctcagtgcaccacgcgctcgggtgaacccgagcggggcacggacaccttgcccaggcacgcgaggatgtgctcgcggtactcggccagctcacgcaggccgcacagcatccaccggccgccgatgacgagcgtgggcacgccccgcacgccacggtgggtggcatcccggtgctcgtcgaggatgaggcggcgcgtctcctccgagcggaaggccgcggagaattcgttcatcgccaggcccacgcgcgaggccagctcgaacaccacgtccgggcgggatacgttgacgccctgctccagcgccgcgcgctgcatggcgcgggcgaggaacgcgcgcgcctgcgggccctgcagccgcgccgcttccagtgccgccaacgccggcacgctggtgcgcggtggatcgcccccgagccacaggtcggtggacaacatgcgcgcggcggcatccggttcgcgctgtgcgcgctcgacctcttccaccaacgcgcgttgttcgcgcgtcgtgggcagcacgtcatggacgcgcagcggatacggcctgacgctccagcgaacggcttcgcccagctcctggcgcaagacatcgaggcgcaggtcggcgaggtagcaccaggaacacagcacgtcctggtagagggtgatctgcagcggcttgtgcagcgttttcatttgagggccgccagattagagggccacccgcgtcgctgccaactcctcaggacacacgggccacggaggcattcctgtgttcctgaggagcatgcaaggtgccttgccccggctgtgtgtctgctcgaaagcaggcgagcaacctcacgtgacccgggttcacgctcacccggcgcgcttcgcctcggcgtacttcagcgcgtggtcgatgatggcccccgcgatgtccatgcccgtggcgcgctccaggccctcgaagcccgggctggagttgatttccatcagccgggggccggcgtggccctccagcatgtccacgcccgcgacctccaacccgacgacacgcgcggcccgcacggctgcttccgtgtagggcgcggtcagctcgattgcctgcccttcgccgccgcggtggatgttggagcggaactcgccggacttggccttgcgccgcatggcgcccaccacgcggtcacccacgacgagggcccgcacgtcccgtccctcgctctccgcgacgaactcctggagcacgatttcctgtcccaggtcccagaaggtgtcgaggatggtctgcacctccggcagcgtgtgggcaatcatcacgcccacgccctgagtgcccttgatgagtttgatgatgacgggcagcccgttgacctcctccaccagccggcgcacgttgctgcggtcgtgcgccatgacggtgcgggggatgttcagcccggagcgcgacaggtactgcagcgcgcgcagcttgtcgcggctgcgcgcgatggacgtgggcgggttgaggacgggcacgcccatcatctcgaagtggttcaccaccgccaggccataggcggtgatggacgcgccgatgcgcggcaccaccacgtccacgccacgcacctccacgccgcgatacgtcatgcgcggtgcgtcttgcgcgagcagcaggcagcaacgcagcgtgtccagcaccaacgggcggtggccccgcgcgcggatggcggccaccagcctccgtgtggagtacagcgcgcgcttgcgggacaggatgacaaccgtcttcttcgcgtgccctcgccgtggggcccgttcgggacggtcgggtgcctgggacccgggcaggaccgggaccttcttcggcttcactttgcgcggagacatgggcggggcacgagagcctagcacggacgcccgcgaggggcgggcctcgtggggggcctttgctatcctcgtgcgcagatgagtgctccccctctgcaccctgacgacatccacaccagtcccggcgacgtcggacaagacctgaaccactctccgttgttgggcgaaacgctcgtggtggacccgcgcaccacggtgaagctccacaagtgccgcctggccgtcacctccggaccggacaccggccgctcggtggtgagcgacaaggagcggctgcgttgcggcgcgcatccaggcaatgacctggtgctggtggaggaccgcaccgccagccgtcaccacttcgaaatccagttcaccgagcgcggctatctgctggtggacctgggctccaccaacggcaccttcctggatggccggcgcatcgagcgggcctacctgtcacccggctcgcagattcgcgcgggctcgtcggtgctgaccttcgcgccactggatgaggaagtcaccatcgagcccgaccgcgagggcgagctgtgcggcatggtggggcagagcatgaagatgcggcagatattcggcctcatcaagaagatcgcccccatgggagtgtccgtcatcatccaaggtgagacgggcaccgggaaggagctggtggcacgcgccatccatgagctgtccggccgcacgaaggggcccatggaggtgctggactgcggcgccattccgcccaacctcatcgaaagcgagttgttcggccatgagaagggcgccttcaccggcgcggtgagcagccggccaggcgccttcgagcgcgcgcacgggggcaccatcttcctggacgaactgggcgagctgcggctggaccttcagcccaagctgctgcgcgtgctggagaaccatgaagtgcggcgcgtgggtggcaacgacgtcatcgaggtggactgccgcgtcatcgccgccaccaaccgcgacctgatgaaggagattcaggtcggcggctttcgcgaggacctctacttccgcttgtccgtcatcaccatccagctgccgccgctgcgacagcgccgcgacgacatccccctcatcctcaagcgcgcgctcgcggacccggaagtggtgggcaagcacggcaagaagcgtttctccgcggagtccctgggcctgctgatgtcgtattcatggccgggcaacgtgcgtgagctgatgaacgtgttgtctcacgtcctcaccttcagtgagggcgaggagattcagcccgcgcacctgccgcctcgcgtgcggggacaggtccgcgaagggccgctgcccttcaacgagcacctctccttcaaaaacgccaaggagcaactgctggagaacttcgagcgtgaatacatcaccagcgttttgacgcgctgcgaaggaaacctgtctcgcgccgcgcgtgagagtgggctccaccggaagtcgattgaacggctggtgaaaaagtaccagttggacacaaaggggatgaagtcacgttagccccatgagtcagcggtggatgctgtaactcggttgtttcacgccagaaaagcgcgtttgtcgcagagccgtgttctcctgttcgcgatgcaaggaacgccccgtcaagttgacgtatgtccgatctggactgaattcccggaacatgcgcccgccatgaattcaatgcgcccgagcggaagacgcgaatccggacaggcgatggtggagtctgccctgacgctccccttgatggtgttcctcatcttggggacgctgcagctcttcctgatgctgcaggggcggctgttggcggagtacgccgcctttcgcgcgacgcgggtgggcagcgtcaaccatggcgactgtcaggccatgactcacgcggccatcctcgcgctgatgcccagttattattcgttcctgggcggcgcgggcggctcaccggggcagaagctggccaatgccttcgcggcccgccgcgacaaccagtacaacggggcgacagggcgggccaaccgggtgtcgatgcccgacgggaatcacaccggggccatcgtgtggatcatccgcgacagcccactggccacggcggtgccgaacgaggacgcgctcttcgaccagttcgacaatccggcgggcatcgtgcggctcgagacgcggctggtttactggtttccgctcaagattcccttcgccaactgggtcatcgcccggttgacgatggcgcgctgggggtggcgggattacacgaaccagaacccgttgatgcagacccaacgcgccagatggacccaggggcctccgtccatggggctggaagggctgattcgtgaagaggcgctgcggcggatgaactccgagcagtacgtcatccccatccacgcctccgcttctcttcggatgttgacgccggtgcaacggcgcttcttccagacgcagaactgcgctcctgctcccgaggcactatgacgcacaagctactgagccgcggacagacgctggtgctgttcgccttgacgctgttgctcctcaccctgctggtgaccttgacgttgtcgtttggctccaaggtgaaggagaagatggaggtccaggccgcggcggatgccgctgcctacagccaggcggcgacgacggcgcgcgtcttcaacgagatggccttgatgagccgggcgcagattggccacctggtctccaaggccgcggtgaacagcctcatcgactggagcagctactaccgcgcgcagattggcgccacgcgaaaatgc

SEQ ID NO: 765 - DNA, 6281 bp, Myxococcus xanthus
ccttcgccttgaagtccgtgccgccgtgcagggtgacgagcggcgcgggaatcttcgaggccaccaaccgcgcggtggtgtccgggtagtagctctccatcagcaccatgcgcgcctttcgctgacggccctgggccaggacgctcgcgacgtgcgacgggttgggcgggatgccgggcttgggctccaggtaggtgatggtgtcgaagcccagccagtccgccaggtacgccatggtccggtggtaggcgatgacgggctggccacgcagcggcgccagccgcttctcccagtccgcgcgcgacttctccaactcggtggtgaaggtggcgaggttgtcgcggtaggactgcgcgttcttcggatccaactgcgccagccggtcggtgatggctcgcgcgacggacagcgcctggcgcgggtcatagaggaagtgcgggttgccgcccgggtggacgtcgccctggccccggtccacctgcgcggtggggacctccagcagcttcacgaactgcgaggccaccaggtagcccgggttgcccacgaggattttcgggttgcgcgcgcccacctgaagcgtgggcagccagccgatctccaggtccaggcccaccgcgatgagcaggtccgcgcggttgagcgccagggcgaggttcggcttggcatccacgaagtgcgggtcctggctggacagcgccagggcctgcactttgacgtggtcgccgcccacggccttcgtcaaggcggccaggtccggcagggtggtgacgacgttgaggtccgcgcgagcgggggacgcgacgaagagggtgaaggcggcgcacacggccgcgaacagacgggagagacgcatggtcatggctccttcgaaaggggtttagaaagcgtgggcgccgtgggcgccggtcaccagctcgagcgcgagcatcagggagtagccgggctcatcccgccacccggcatggtccctggcgccctggaggcgcagccgggagaactcggtgggccagaaggtgacgttggcggacacgcggttgcgtgactccgtccagtccgggtccaacgggtcgatgacgcgcgctccgtcttcgcctcgcgccgccgttcccagctcgtagcgcagcgcggtggcccaccgcggtgagaagcgccacgcggcctgcgcgtaggttatgaagtccgtcagcacgtccccgggcacctggcggcggcggtaaaaggcctccgcctggagcgtgatgagcgtggtgttgtgggcctgggtgatgggccggtagcgcaggtacaggtccgtgccgaacgcgtccgtgcggttgcggtagccggtgggattggggccggtggcggtggacaggccccacatgagggacaggtcatccgacagcgggaagaactgcttcaccgcgccggtgagctgcaagtcgaacggagactgaacccgttcgctggtggcgcccaagaagctgcgtgcggtggccccgccggtggcgtcggtggtgctgccaatcacctccacgtaccagggcaggggcgccagccaggacacctcggcgcccagtcctcggttgctttcgcctccgaagatgcggcccacggcgaagggctggtccacgaagtcccacgaatgcgggtgcgtggggttgatgcggccgaagcgcgtgaggaactgaccggcgcgcacctggaggttgtagggcagcgccagcgtggtgccgtaggcctcttcgatttccacgccgaactggctgaagacgatgttggcgtcgaaccggaagtaggggtccaccaccgagccgatggacagctccaactgctgcaggttgaagccgttgcgcgtggggtcgtgcgcgccgctctgcaggggctccttgtctgtgaaggccgcggcggccacatccaggatgaagctcaggtccaggaagttcgcgcccgtgttgggattgttcaccccggggatggagagcgcggagccaccgccaggcatggaggccggcggcgccgcggtaccggtgggcgcgttctgctgcgcggacgcggcatcgctgccaagcgccttttcaatctccttcaactcctcgggcgtgagcgcgggcgcggcgttttcccccggctcctgcacgggggcgtccgccggaggcgcggaggcgtcctgggcgcgggcgccgctggcgaacagcaagggcgtgagtgaaacgacgatgagagcgccgtgggcacggcgcgaacgggttgccacctggaatactcctcgaacggggcggccgcgtagcggtcacgcccaccaatgacctgaaagacctcggacgacgcacgtcacgcgtgcgcgggaggcgaggccttgggggcggtatcgaggatggagaggggggcctggacgcgaggcggcgcggtggccggacggctcacagcgagcagcgtcagcaccagtgtcgtgcggtagggcgtcagaagctccgggcgggagccggacgtcaccagcggacattcctcatgggggagggcggccgagtccgtgacggcttcgggcagggcggatagctgcgggctctggtcgatggcgagccgggacagccgcgcgcccgtgccgagcgccgtctcttcgaacgtctgatgctgcggacagaaccgatgcgcgtgctcgtccctcgcgtgcatcagcgcgcccagcggctgacacagccacagcgcgacgagcagcgtcgcggtgcagcgggcgaaggtgtgggctcgctgattcatcggaagggacggttgcccgggtgctctaatgacgcggcacggcgggtgtcaagggacgctatcacgctctgtttcgtccgggtggggatgtgtcggccccggccggacgttggggaacttcaggaatgaacggacatctggacggaggattcattccagtggcgacgctggacgtactcgacgcgcggggccgcgcggtggtgcaggtggacggtgtcgcggtggccctcttccgcgtgaatggggagctccatgcggtggcggacgcatgcccccaccgggccgggcccctgtccgagggggacctggtgggatacgtggtgcactgtccgttgcacacctggccgttcgacatccggacggggcagtgccctcggcatccaggggtgcaggtccgcacctatgtggtgcgtgtgcagggacagcacatcctcgtgtccgcatcaggtagggtccacgccccctgagtgccggccccttccaggagcgattccactgtgacttcgtcccgagcccgccgcaaagcccccgccgctgccgcccccgccgctgtccccgatacctcggccatggcgcgtgccgtggcggacttcctgcgcgccgccggtctgaacctccaggacgtccacctggcggacacccccacgcgcgtggccgaggcctgggcggccgagttcctcgacggctacagccgcaccccggagcaggcgctgggggagacgttccccgcgccgccgggctcctcgggcgagctggtggtggtgacggacctgcgcttccactccatgtgtccgcaccacctgctgccgctcaccgggcgggcccacgtggcctacgtgccgggcaagcgggtggtgggctttggccggctgtcatcgctggtggactgcttcgcgcaccggctcatcctccaggaggacatggcgcgggaagtggcgcgttccctggcgcaggtgctgggcagccccgccactgcatgcatcatcgaagcggagcaggcgtgcctgcgcctgcgcggggacaagcagcgcgacgccgtcactcacgcggaggcctatgaaggcaccctgcggcgcgacggccccctgcgcccgtgagctgtggggcccggttgggggcccggcgatgattgcgcccctgccgcgcgtggagcccgagcgcgtggcccgcgtgcgcgaggcgctggccgccgttctggctccggagcagctgcgcgtggatgacgccgcgctggccgcctacgcccgtgacgagtccgacagtggcgtccatgcgcccgacctcgtcgtcttccccgcggacacgcggcaggtgtcggaggtcttcaaggcgtgcgcggtgcacggcgtgcccttcaccccctgtggcgcgcgcagcggcaagagcggcggctcgctgcccttgcacgggggggtggcggtgagcctggagcggatgaaccgcatcctctccatctcccccgaggacctcaccgcggtggtgcagcccggcgtcatcaccggcgacctgatgaaggccgtggaagcggtagggctcttctatccaccggacccgaactcctgggaggtgtgcacgctgggcggcaacgtggcggagaacgccggcgggcctcgggcactcaaatacggtgtcacgcgcgactacgtcatcggactggagtgggtgctcccggacggcgaggtggtgcgggtgggccggcgcaccatcaagggtgtggcgggttatgacctggtgggcctcttcgtcggctcggagggcacgctgggggtcgccaccgaaatcaccgtccagctcatcccgctgccgcgcgaggtgctgacggccctggtggtttttccgtccgtgctgcacgccgcgcgcgcggtgtccgccgtgctggccgcgggcatcctcccgcgttgcctggagctcatcgatgacgtggccctgcgggctgtggacggccgcggcttccagttccctccgggcgcgggctccgctgtcatcgtcgaggtggacggcaacggccgcgagggcttgctcgctgagctgtctcagttgggtgacatctgtgccagccagggcgccaccgagacgctggtggcccaggatgcctcccagcgcgagaagctctgggccgcgcgcagggtgatttccccagccctccgggccctcaagcctcacaagatttccgaggacatcgtcgtgccccgctcgaagattccggaggtcatcgagcgcttgaaggccatgggcgcggagctggggctcaccgtggccacgtatggccatgcgggcgacgggaacctgcacgccaacatcctctacgagggcgcccaccaacggccgctggtggaggaggccctgcggcgcatgctggtgatgaccgtggaactgggcggaaccatcacaggcgagcacggtgtggggcacgcgaagcgggaatatctttcgctggagcagtcccccgcgctcatcgacctgcagcgcaggctcaaggccttcttcgatccatcagggttgctcaacccttcgaaaatcttccccgcgctcatgcgttcttgattcgtggccgacgcggctcgtttttgtcccggcgtcgagcggcttaccgtccaaagcgtgggaagggctgggaatgtcgcgcgaaatgcctaatcggacctggaatgagaaaccctttcgctcgttgcgcgtcttagttccaggtggacgcgaggcggcggggggagagcgcgtccggcatcgaacggaggacgggaaatcatggccaattcgacgaagtacgcagccgaaggcctgtcgcactaccttcggaacctgggcgggcaccagcagctgacgcgtgagcaggagtacgagcttgcgcgtcgcgcccgcaagggtgacgagtccgcgcggcagacgcttgccagctccaatctggccttcgttgtcgccgtggcgaagaagttcgccaatcgcggcgcgcgactggatgacctcatccaggagggcaacgtcggtctcatgaaggcgatcgagcacttcgatccaaagaagaacgtgcgcttcgccacctacgcggtgtggtggattcgcgcctacatcacccggtacctgaaggacaaccgcagccaggtgcgcggtggtgaggccgagcgcggcagcatggtggacttctcgctggacgccaccatcgacgaggacggcgagacgaccttcctcgatcggctggaggacaacagcccttcgcctcagcaggtgttcctggcgcacgagcaggacacggagattcaggaggcgctcgccaaggtgcgcaagcgcattggtgacctgggctgggacatcctcacggagcggctgacacaggacaagccgctgacgctcgaggaactgggccagcggtggggcgtgtcgcgcgagcgcgtgcgtcaggtggagctgaaaactaaaaacttcctggagcggtacctgcacgggttcaactagaacgaggagcaccacctgtgcgagcgggccgccaacccggtgtgagcggtcattcagggcccttcccacctgggaaggcgcgtcatcggggc

SEQ ID NO: 766 - DNA, 5262 bp, Myxococcus xanthus
gaacgccttcttctcccaaaccttctcctgcttggggtccgcctggagcgacagcgcgtaggccgcggcggcttccttgaactccttcttgctcaggtggtcgctgccgacgatgcgttgcttcttcgcggtgtcgtcctcagccttacacccgacgactgcgccgcccagcgtgagcgctccgaccagcagaccgacttttcccaggcgcttcatatctgtgcctctcaagattcttgaggacccaccctcacgggtcctgatttgccggggagcatacccgaagtcgagccgccgcggcccttcgcccgatggcctgctccctggtgagcaggcaggccgcgcaccggatgtcccagcgcgtcatgctgtcagcacgagcttgaccagctctggcgggctgccgacgcgcatgggcggtccccagaagccgcagccacggctgacgaagatgttggagtcaccgtgcgcgtacagcccggcggagtgctcccacgccagaccaatcagcatcgtcatgggcatgagctgtccaccgtgggtgtgccccgaaatctgcaggtccacgccgcactccgccgccaccttgaagttcgcgggttggtgcgccagcagcaccgcggcgcggtcggaatcccgccccgcgagcgccagctccaggtcgtaacccttcttgttgcgccgccgacctccgctccagtcatccacgcccaccaggtcgaaggatgcgcccttgtcaccgatggggacgtgccggttgcgcagcaccgagatgccgagtgactccaggaaggccgaccactcctcgtcacccgagtagtagtcgtggttcccggtgacgaagtagctgccgtagcgggacttcagcgcggcgagcgcggacacgtggccgcccagcgaggccacgtcgccatccacgaggtctcccgtgatggcgaacaggtcggggcgcagcgagttggcctgctggacgagcgcgtccatgtagcggcgctggatgaagtggcctacgtggatgtcggtgagctgcacgatgctcagtccgtccagggccttgggcagcttgggaatcctcaccgccacttccgtgatgagcggcggcgagaaagcgcgccagcttccgtaggcggccagcccgcctcccgcgacgaaggcggtaccggccacggcctggcccaggaatcgccgccggtcctcgtccacggtggggctggatgctggcgcgggaggcgcgggaggggcgtgtggccgcagccgtcttgccagggccgtgagcccccggccggcgtccgtcaggagcagggcgatgacgaggcagagcgccacgcccatccacgtgtacaccgccatggtgagcagcccttcggcgctctccggaagcaggtccagcacggtgcgccggttccccagcacgcccgtcatcagcacgagcacgccgatggccagcagccgaggcatgcggccctgcaccagggggcgcaccagccgacggtacacatacaggtggcccagcaccgcgccgagcccgatgagcatcgaaaaggagaagagtcgcagcggcatgacggaaggggcgcgggaggggcctcacggtaccacggcacggcccgcgatgagcctggcgccggggatgcgaagcgccctccaccggggggctgccgggctcgcggggcgtcagggcgcctgatagaggcacacgcgtcagcctgggaggaccatggacatggacaaggtcatcgtcatcactggagcaagcagcggcattggcgcggagctggcgcggcaagcggccgcgaagggcgcccggctggtgctggccgcgcgccgcaaggcggagctgaaagtggtggccggccagtgtgggcacgaggcactcgccgtggtcacggacgcgacccggcgcgcggacatggagcggctccgtgacgccgcgctcgcccgatttggccgcatcgacgtgtgggtgaacaacgcggggcgaggcatcacgcgctccgtggcggagctcacggacgaggacctggagaccatgtggcgcgacaacgtgaacagcgccttgtacgggatgcaggcggtgttgccgcacttccagtcgcgcgacgccgggcagttggtgaatgtctccagcaccctggggcggctgcccatcgttccccaccgttcggcgtacagcgcggcgaagcatgcgctcaacgcgctcagcgcctgcctgcgccaggagctgcgtgagacgtacccgggcatcaccgtgacggtggtgatgcccggcgtggtcgcaacggcattcggggacaacgcgcttggcggagggcccgattcgcgggggctgccaggggctcagcgcgtcgaggatgccgcgacagtcatcctcgattccatcgaacgtccgcgtgccgaggtctacacccaggcggcgacccaggcacaggtggagcggtactaccaggatgtggaggccttcgagcggggaggcacctgacgcatctgagccgtccccgcggcgacgtcagagcacccaggcgcgccgggtgttcacgtcgctcttgaagcggtggtaggggttgccggagtcctgcacgatgatggtctccgacccgtcgtccaggatagcggtgactcggatgtcgttcaggttccagttgtcaccggtctcgaaggggttggactgcccggattgaaaccggatcgcgaactcgcgcatgttgctgtagaggacgccgtcggggagttcgacatccacggtgcgcgttgacccgttgggccagttcgcgccgttgttcaggttctggctgatggagatgtggctgccattgatcgccgtgtagctgaactcggcgaaggcgttgctcgctttgcgcaggtcgtcgcttccggtgacgatgcggacacgaaggtgcgtcacctgccggtcaccatccacggcgtgtgccttgccaggggtcatgaggagcatggccacggccagggtggctgtgacggcagccacgaagcgcctggaatacgtggtcggagtgtgggtcgtgttcatgtgagacttctccttgctaattcgggagtgggcgtgtgtgtcattggctcgctgcacgccgcccgcgagccgatagggaccctgccttggcgcgtttcacgtgaacactgccaatctttttgcactgccctgaccacgcgggcgtggggcattgccctgggatggcgagacacgcggtgctcatcctggtcgtggccctgttccgcgcggcggcgttcgccgcgcccccgcccgagggctttggcggacatccggagtccctgcgcatccggctggtgacgattggccccggcgcggacatgcaccagcgcttcggtcacagcgcgctgtgggtcgaggacacgcgcctgaagaaaggccttctctacagctatggcacgacgtccatcgcgaatgggggaccggtccgcttcctcctgggccggccgacgttctgggcggcgcgcctgtccgtggagcggactttcctgctgtaccgcgcactggcgcggtccattgacgtgcaggacctcatgctcacggtggagcagcgtcaacggctcctggctcggctggagcgagacgtccagcccgcttcgcgtgaatatgcctatcacccgctcaaggacaactgcgcgacgcgtgtgcgggacgtccttgatgaggcattgggtggcgcgcttcgggaagcgctcacggagccggcacgtgccacccaacgagagctcctccggcgatacatccagacgcatccggtgtcggagctgctcttgatgttatggctgaacgacgccgtggacgcgcccgcgactcaatgggaggaggccttcctgcctcgggagctcgccaggctgctcatgggagtgtcctacgtggatggctccggcaggcgcatcccgttggtaaatcgcgagggggcctcatccccgtccatggacgcgtccgctcctgtcgacgccggctgggaaggaacctccgcctgggggcttggcgcaggaggcgcggccctggccatcatcctcgcgttcctgcgtgggcgtggcacgcaccggatgttccagattctcttcggcctctatcacgccgtgttcgggctcacgctcggcgcggcgggcgtggcgctgggtggtttgatgctgttctccaggctcgatgtcatgcagggcaatgagaacctgttgctggccaatccgcttgccttcggactgcttccgctgggcatcctcatgatgtccggcagtgagcgcgcggagcgctgggcacgccgatgcgtctggctgctcgcggcgggttcgttgctcgcggtggtgctcaagctcttgccctcattcgaccaggacaaccgcaggcccatggccttgtggctggtggcgaacctcggactggggctcgctcacgcctggcggttgcgccggccatccacggcgcctgctcctgccgccggggcgagggaaggggcccgcggctctacccgctggtgggcagtgtgacttcgacccgcgcgcctccctcgggcgggttgcaggcgcgcaaggtgccgccgcttgcctcgacgagcccgctcaccaggagcatgcccagcccagcgccctctggcttggtcgtaccggcccgggggcgttccccctccagcagccccggtcggaagcccggtccatcatcgctcacgctgagcaggacgcggtgcagcgccgggttcggctccacgctgattcgaaccgtgcgcgcgccttgccggccatcaccctcacaggcgttcacgaacaggttggtgaccacgtgcgtgagccctcgctctccaccgacaatccggacgctgacgtcgttggcggcggcacgcgccaggcccgctgttccttccaactcgaaccggacccgggcgaacctcgcctggacgacctccatggcacggcgcagcgtggcgcccacgttcaccgccgtcgcatcttcaatcacagtcagctcgctcagggtccgggccttcacgctctcgatgaagctgctcagctctcccaggtcctcgaccagggcgctcgcatggccgggcgcgctggcgctcaggggctcgcggaggaggaggtcggcgcgcagcctcgccgcggacagcaacgtgcgcacgtcatggtgctcgcgcagcagcgcgcgcaggttcgtgcgtgcacgctccatgtggacactcgcggttccggcctccaggaccagccgccgtgcaatgccacaaatcaccgaggcgaagacgcccgcgctgccgatga

SEQ ID NO: 767 - DNA, 5641 bp, Myxococcus xanthus
atcacgcgcgggggcccgaacgaatcgcctgggccgagtcccggatccgtcaggcaccgagcctttcgacggaggaacgcctagacttgctcgtggtactcggcacgctggcatcccgccggttcgggcaggacaggctcagtcagcacttgaggaacatcatgattgattcaccgttctgggaagagcagcgcgcgaaagagagagcccgcgcgtggagccaggtgctgcgggccttcgtggaagcccgtggccttccccaccctgccgacgtcagtgagcgcctggagcaactggacgcgtcctccctggaagccctcgtgaccaaggccgtgaccgacccagacaccgcagccaccgagctgcgcgccgtcctcacggcgccgaagcactgaccgagcgcccctactccttcaccgcgcccgccgtaagcccggacacgatccgccgctggaacagcaccgtcagcgccaccaggggcagcgtggccaccacggaggccgcggcaatctccccccagggctcacggtactcgctggcgaacaggctgatggccacgggcacggtgcgcttctccggggtggagaggaacgtcagcgcatacaggaactcattccacgcgaagatgaagacaagaatcgccgtcgtcgccagccccggcgcggccaggggcagcagcacctgccggaaggcctggaacggcgtacagccatccacgcgcgccgcgcggtagagctcgtcgggcagcgcgcggaagaacgacgtcagcacccacagcgtcagcggcaaagcgaacgtcgcatacggcaaggccagtcccaccaggctgtctcgcagccccaccgtgcgcagaatcagatacagcggactcaccgtggcaatcggcgggaacatgctcaccgccagcgccgcgctcagcagcacccccttgccacgaaactccagcttcgccagggcgaacgccgccgccgcccccaccgtgagacagaagcccgtggtcagcgccgccaccaccagcgagttcaacaccacgcgcaggaagggccgtccccacaggacgctcgcgtagttctccagcgtcaggtgcgagggccacggccgggtcagctcgccatccggccacaggctcgtcagcacctgccagcagaagggccccaggaagaaggtcaggaacgccaccaccgccagcgctgtgcccagccccggccgcttcatcgcgccgcctcctcgcgccccaagagccgcagccacaccgccgccagcaacaccacgcacaggaaggtcgccaccgacagcgtgctcccgtacccgaagtcccccgaacgcatcagcgtcttgtacgcgtagatgctcagcgtatccgtcgtgttcgccggcccgccctccgtcagcacgtagatggcgtcgaacacccggaacgcatccaacgaacggaacagcaacgccaacagcagcgccggcttgagcaacggcagcgttatcgagacaaaggtccgccacggcgaggccccgtccacccgcgccgccttgtacaggtcctcggagatgccctgcaggcccgcgagcaccaacagcgccacgaagggcgtcgtcttccacacgtccaccaggatggctgcgtgcaacgcatacccgggtgcccccaaccagttgatgtcctgcccgggcaacagccggttgatgacgccgtactcggggttgaacatccacgcccacagccgagcgctcaccacggtgggaatcgcccacggcaccagcaccgacgcgcgcagcagtccccttccagggaacgacttctggagcagcaacgccagcggcaccgcgagcaacaactccaccgtcaccgccacggccgtgaagtacgccgtgtttcccagcgccgcccagaagcgcgagtcccccagcaggtacgcgtagttctccagccccgtgaagcgccgctcgccaaagacgaggatgaagcggtgcaggctcagccacaccgcggcgaggatggggtacagcgccacgccccccagcaccaacaccgccggcgccaccagcaggtacgcctgcctccgctcccgcgccagcgagccccttggattcatcgccgagcctcccacggcggagccgcccccacccgcgagccgcaggcattcaaggcgccaccacccgccgtcatcgtgccagcgcgccgctcccctcctccgctgaaacggtgcgtgctcacggcccctcccccgtcagatggtccacctgccgctgcgcccgcttcagcgcgggctcgggcgtgcgcagcccggccacggcggcggagaactcgctctggagcacatccgaaatcaggttgtagtacggcgtcaccggccgcggcttcgcgcgctccaccatgggcagcagcccggcgatgaagggcgcctcctcgcgcagccgcgcatcctggtacacggcgggccgcggcgggttgcgcgcgtagttcagcgccagcacccggttggcctccggggatgtgaggtgcgcaatcagccgcgccgccagcttccgccgctccggcgacacatgggcattcacagccagttgccacccgcccagcgcccccgaacccggctcgccgctcaccgtcggcaacggggcgatgcccaccttgccgcgaatgggcgagtccggcttctgcgcctcgttccacgcatacggccagttgcgcatgaacaccgcgcgcccttcctggaatacccggcgcgactcctcctccgagaagcccgtcaccgtcgcgggcgacacgccgcgctccaccagccctcgcagatacgcgagcgcctcgcgcgcgggcgcgtcatccagcagcacccgcccatcctccgacagcgcccggccgccgtgcccccacagcgcctcgtacacattgcaggacaggccttcgtactgccgcccctgccacacgtagccctggagcccgggcgtcttcgccatcgcctcgcgcgcgaagcgctccagctccgcgtaggtgcgcggcgcgcgcggcaccaggtccgtgcggtagtagagcagccccacgtccaggtaccagggcaccgcgtacgtgcgcccctccaccaccacggcctccacggggccggggaagaagtcctcgcgcagccgctcgggcgggaactccgcggacaggtctgcaatccacccagcgcgcgcgaactcgggcacccagacgacgtccaccaccagcacgtcgaaatccctcgccccaccctccagcgacgtgaggaagaactggtgcgccaggtcggacgcgttgggcagcgcctccgtgacgagctccacccccggattctcccgctcgaagcgcgccagcagctcgcggaacggctccggcggcccccacagcggctgatacttgaagaccagccgcgtgcggcccccggcctcgcccgccgcgtcctgccgccggcagccccagacgcccaggcccacgacgaggctcagcgcgagcacgatggaggagacgcgtctcatgcgcggccatgactccagccacccccgcccccgtcaagcccgggaatccggggtcggtccgcacgtcaacatcccggaagtcttgcgcactgaatgaaaacaaaccttccagacatccatgcgcgtcccgcaaaaacaatcacgcccgatgagtcatcatgaaccaagggagagccacgattcgcttggacgctgtctcagcggtattctcatccaggcaggaacaactgggagggggaagcgatgaaacagcagcctcgggattggcagtgcggagcccaccgggcccacttcgaggagccggacaccctggtcgcggagttcaacggcctcatcaccctggaagaggtgaaggaggtggtgacgctctaccagcagacggccaccgaccacggtcagtactacctcatcgcggacatcggccgctcgcagctcgaagcagccggccgccggtacatgtcggagaaggccagctccgactggtaccacgccatcctctacgtcggcgccgacatcgtcatgcagaccttcgtcaaggccattgccctggcgctgctcttcaccggcaagtcgaccttcgagacggtgttcgtgaagacgcaggacgaagcccgcgcctgggtggcccagcaccggctccggctcaagagcaaagcaggatagcaggtcgggaattccacgcccaaattgacaggcatgcatctcgcgctattccctggtgagcgttatgctcaccagggtttctggagggagtgacatgcagcaactggaatggacattcggttcccactcggtgcgctatgaggcgcccgacgtcgtgcaggcgaccttcgtcggccccatcgacctggatgaaatcaagcgcgcggtcgacgtgtacggggagattgcccagcaatacgggccctactacctgatcgccgacatcggccgctcccaactgggcgcggagccccggcgctacctgtcggagaacggcaaggcggactggttcaagggcaccgtgtacgtcggcgcggacgtggtgcagcagaccttcggcaaggtcatcgcgctgggcatgctcttcaccggcaaggcgcgcttcgagacgaccttcgtgaaggaccacgacgaggcgcgcgcctgggtggcgcagcaccgccagaagaacaagaagaagctgggctgagcctccgcccgattcccccctcacgccctggagtcctgaccaccaccatccggtgggcacgctccaggtgcgccctcagtccgcccgaatggcacgcgctgagtgaacttttgcacactgtcaggcccttgccgcatttttactggaatcaaacgtcagcactgaaaaccagtgaagatgaaaaagtgtgcccttgctggcaataaagccagaattcgttgtataggcggattaggggagccccaccctgcccggtcgttcctcgccggctccccacacccctgacccaccgcctgtaggggcctggcccctccattgccattcacccgttgcagacgaaccgcgtgccggggggccgcgctcgtctggcgagccacgccatgcctgtgtccgtgcaaaagcaggaagagaccggagtcccagcccacgcgtccgcgggccgttgtccccacctgggtgcccagtacaacccgttcacgggcccccacgcggaggacccgcacgccttcttcgagaagctgcgcaaggacgagcccgtcagcttcagccccatgctgaacatgtggctggtcagccgctacgaggacatctcccaggtgctgaagagcccggcgcagtactccaaccgggacatgctggcgagcggcacccacctcacggacgaggccaaggccatcctggaccagggcttccccaccgcgcacgtgctgctgggcatggacccccccgagcacacccgcctgcgccgcttgatgaaccggggcttcaccgcgcagcgcatcgccggcatgggccccttcatccgggagatggccaccaccctggtggaccgcttcgcccaggacggtgaggcggacctggtgaagcagctcgcctggccgctccccgtccacgtcatcctcggcgtcatgggcgtaccgcaagaggacgtctggaagatcaagcgctggagctccgactggcagcagcctttagagcaca

SEQ ID NO: 768 - DNA, 4854 bp, Myxococcus xanthus
cagcgcgaggggatgggcggtgagcgacctggtggcgcggacatggtgggcggcgcggcgaggcctgccgggcctgcggcaggcacgcggctatcagcgccgctggttccgggcggacctgctctcggcgctcaccattggtgcgatgctcatcccccagggcctggcctacgcgcagctcgtgggcgtgcgtccagcagcgggcctctacgcgggcgtggtgggaatgctggcctatgcgctgttcgggccctcgcggcacctcatcatcggacccgaagcgggtgccgccatcctcaccgccgcggcgctcgcgccggtggcggcgggggcggcccccgcgcgctacgcatcgctggcggcactgctggcgctgctggtcggcgtgctgagcctgctcggagggctgctcaaggtgggcgcgctcgcggacttcctgtccaagcccatcctcatcggctacatcaatggcgcggcgctcatcatcatcggcagccagctcgcgcggctcttcgggcaggagcgccagtccgacacgttctcgggtcaggtgttcgaggtggccacccacctcgaacggacccacgtcccgacgctcctgctggggctgggcgtcatcaccgcgctcgtgctgctgcggcaactcctgcccaaggtgcccggtccgctcatcctggtggtcctcaccacggtggcgggagggctgttccagttggagcatgggggcatcaaggtcgtgggccccctcgccgccgagccccccgctccaggcctgccgtccctgcgcttcgaggacgtgcggtcgctgctccccgccgccttcagcctggcgctcgtcaactacgccagctccgtgctgacgggccgattctacgccgacaggttccgctaccggctggacagcaaccaggagttcctcgggcaggccgcagccaacctcgccactgcgttcagccaggggttccccgtgacggggagcgactcgcgcacggccgtcaacgtctccatgggggggcggacccagctcgtgggggtgctcgccgcaggggtggtgctggtgttcgccttgttcctcacgcccctgctccacgacttgcccatggtgacgctgggcgccatcgtcttcgtggccgcggtgtacctgctggagttccgagccatcatcgacctgtggcgcgtgcggcgcgtggaggcggtgctcgcgtgcgtgacgatggcgggggtgctggtgttgggcatcctccaaggcatcctcgtcgcggtggcgctggcccttgcggacctcatccgccgggccgccaggccccacgacgcggtgcttggcgagcgcgagggcgtgcccggctaccacgacatcgagcggttcgagaacgccgagacggtgcccgggctcgtcatctaccgcttcgatgcgccgctgttcttcgccaacgcgcgccatctgcgggagcaggcccgggccttggtctccagcgcggatgcgcccgtgcggtggttcgtgcttgatgcgtccgccgtgttcgacatggacgtcaccgctgccgatggcctggagaagctgcgccgtgagttcgaggaagagggcgtggtgctgggcgtcgccgaggctcgggcgccgctgcgcgcgctgctgcggcgtaccggcctgctggagcggctgggcccggagaatgtgcatgccaccgtggaggcggcggtgcaccacttcctgaaggacgccgacgcgaggcacgcccgcgacggtgagcctccggcgctccctcccgtgcattgagcgggggctcgagcgccatcgagggggaacaggcttgcgcccgtcctcacccggtccgcagtccggcccgttgcctcccctcccgccccctcctcctgaaccatgccccagcggcggcgcgtgcacacctcctgcccaggaggcagcacatggcaagcaaggcgaaacccacgggcaatggaaacggcaacggcaagcagtcgcgtaagcccaacatcctggtcatctggggcgatgacatcggcatctggaacatcagcgcctacaaccaggggatgatggggtacttcacgcccaacatcgaccgcatcgcgaaggaaggcgcgatgatgaccgactgctatggccagcagagctgcaccgcgggccgcgcggccttcatcaccggcatgaacccgcttcgcacggggctcaccaccattggcatgcccggagcgaagtatggactccaggactccgaccccaccatcgcggagatgctgaagccgctgggctacacctgcggccacttcggcaagaaccacgtgggtgactccaacccctacctgcccaccgtgcacggcttcgacgagttcttcggcaacctctaccacctcaacgcggagggcgaaccggagtgcccggactaccccaaggacccgaccttcaaggagcgcttcggtccgcggggcgtcctccggagctgggccacggaccgcgatgaccccaccgaggacaagcgctggggcgtggtgggcaagcagcgcatcgaggacaccggcgcgctcacccgcaagcgcatggagaccgtggacggggagttcctccaggggaccctggacttcatggagcgcgcagtgaaggacggcaagccgttcttcctctggcacaacaccacgcgcacccacgtctggacctatctccaggagaagtaccggaacgccaccggctacggcctctacgcggatgccatgcgggagctggacgacatcgtcggcgtgctgctggccaagctggacgagttgggcatcgccgacaacacgctggtggtcttctccaccgacaacggcgtggagaagatgggctggccagacgggggcaacagcccgttccggggcgagaagggctccacctgggagggcggcgtgcgcgtcccctgcatggtgcgctggccgggcgtggtggagcccgggcgcgtcatcaacgacatcttcgcgcacgaggactggatgcccacgctggtctccgcggcgggcggccccaaggacctcgtggcacagtgccagcgcggctacaaggcgggtgacaagaccttccgggtctacctggatgggtatgaccagaccgggctgctcgcgggcaaggagaagggaccccggcacgagttcatctacgtgctcgacagcggaaacctcgcggccgtccggtacgacgactggaagctcatcttcagctaccaggaaggcgaaggcccggacatgtggttcagcggcaagcgcttcgacccggcgtggccgtacctcatcaacctgcgctcggacccgttcgagtacggccccaaggccggcctgtacttgaagtggtacggggagcggatgttcacgttcgtgcccgcgcaggcgctggtccagaagttcgcccagagcctgctcgactacccgcccagccaggccccgggcagtttgagcatcgggcccatcaaggagcgcgtgaagcggaagttgttggaggcgcgcgagcgcaaggaggagacggccattggcgaccaggtcatggcgctggccgaacaggtggagcggttcgtccgccgcgcccagcagtcgcacgcgtagccacgcgcggctccgggcggcggaacagcgccgccgcccgtgtccgccgggcggacctccggggcccgtccggattggcgctgcatcgttcgcccccgaggcgctacgcgctcccggaacccgatggcgcggtgtcgtcgccgtccacggggatgcgcggcggcaccaccaaggtcgcgaataccaaccccaacaccaactggagcgccaccatcagcacgtcgaacggccgggcatcctccgcgcccgggcgccccatgccgagcaacgcgatgatggcctgcgtccccatgaagcccggcgcgagctgcaacaagcccggcatgatgaccgtcattggcatccgcagtccgccccggccgtagagcaacccggccacgcccagcacgaacgcggccaccatcgggctcccctgctctcccagcaccgccttcatcccagcctgcgtcccgtaggcgatcagcaccccgccgacgatgcccaccaggtcgcgccgccgccccgccatgcagacagccagtgccacgccaccgaccgccagcagcaagaaggtgacccaaggcgacagcacgtgcacgtcgctgtactccggtaccggcaagagaaagccccacaaggtcgtggccgccacgatgcccacgccaatcatcaggaagcgcagcagtccatagaccagacgcgtcatgcctgcctccacggactccgaggccaactccaatgagccgagcgtgaccaccatcgcgggcaccagcagcaccgccccgccaaacaacgcttggaccacatcgaagggcggcaggacgaagcggagcccgaacgccaccagcgttcccaggaacgccgccaggaagctcttctgcaggtccacccgctgcgagaccaacgttccgaaatggatgacgcccgcgatggcgcccaccaggagggccgcgaacatctcccaccacgcgccccccacgcgcgccgcggcggcggcgccgtacacgccataggccaggagcacgagccacttcgggtagggagagcgctcggccacgatgcggtccaacctcgcacgggcctccggcaggcccacgcctcccgccgcgatgtcatccgtcagttggaggagcctcgccgcacggcccaggttccagtgcgggttgaagggcagccgcgcgaagtcggcgggcgaccgtcgaggggccaccacctgcgtcatggccaggctctggaccgtgaagacctccgtgctcagcccccaggcccttcgccgccggggcacgcgcg

SEQ ID NO: 769 - DNA, 6567 bp, Myxococcus xanthus
caggtagcgcgcgaagtaccagcaggagtcaacgaaggtgtccatggtttccgcctcgcgccgggcaggcccgccgcacttcggacacgaggtgttcacccacgaggccaccttcgccagcggcggctcacccttgccggtgagcaccgcctgggtgtcgatctccggcaggcgcacgggcagctgcgccaccggcaccgggatgccattgcggtccgggtcgcacttctcgcagtagacgatggggatgggcgtgccccagtagcgctggcggctgaagccccagtccttctggcggtacgtcaccgtcgccttgcccttgccgtccttctccagcaacgcggccatggcctgacgcgcctgctcggatgtctggcccgtgtaggcgcccgagtcctccagcacgccgtactccgtataggccgcctccagcttgtcacccggcgggagcttgtcaccggacgcgggctggatgacgaccttcacaggcaggctgtacttgcgcgcgaaggcgaagtcgcgctcgtcatgcgcgggcacgctcatcaccgcgccggtgccgtagtcgctcagcacgaagttggcgatccagatggggaccgcctggccggtgaagggattctccgcgtaggcgccagtaaagacgccctccttctccgtgccctcgcccaggcgctccgtcttggactgcgcggccatgcgcttggcgaaggcttccacctccgcgcggcgctccggcgtcgtcacctgggccaccaactcgtggtccggcgccagcaccacgtaggtgcagccgaagatggtgtcgatgcgggtggtgaacacgcgcagcgcggtgtcgtgcccctgcacgcggaagtcggcctcggcaccgtccgaacggccaatccagttccgctgcgcggcggtgatgcggtggggccactccttgagcgtgtccagcgcgtccagcaactcctgcgagaaccgggtgatgcggaacgcccactcgggcatctccttgtccaccacgggggagtcgcagcgctcgcagacgccgtccttcacctgctcgttggcgatgacggtgtggcagcccgtacaccagttcaccttgctgaagcggcgatagacgagcccacgctccagcatctggatgaagaaccactgattccagcggtagtactcgggatcgctggtgttgacctcgcgatcccagtcgtagcagtagcccaggcttttgatttccttcttgaaggacgcgatgttctcggccgtgcgcaccgccgggtgcacgccgtccttgatggccgcgttctcggccggcaggccgagcgcatcccagcccatgggatgcagcacgtcgaagcccttcatccggaagtaacgcgcgtacacgtccccgagcaggtagttgcggacatgccccatgtgcatcttcccgctggggtacggcagcatctcgagcacgtacttcttgggtgcaccggggcggctgcctgcccggaagatgcccgcgtcgtcccaacgggtctgccacttaccttcaatcgcctgcggctcgtaacgctcgttcatcaccatacccatcgagtctcttagaggagggacgtgccccaggcaacagtctcgcccggagaaatccgtcccggacggacggcggccccaggatcggctgacggggggccccggggcctggccgcggcccaggccggagacgcgcagcagcctcgctgaggacagatgcaagtccagcgggctccagcggcaggcaaacattcccgccaacttgaattcaaagattaacaataaaagtgaggatatgccgttgacggccaatcgttgagccagtgacgattcgcctcaccggcatcctgccttggggggagccgtccatccgcagcgagtgaggaccgaatgacgctgagaagggcgttgattccggggtgcgtgtttgcactcttctcgttggaaacgctggcgcaagacgaaaatatcgcgccacccgcagccgaaacacagacaccggcggcacccgcgccaggggttgcgccgcagccagcgcccacggcacccgcgcccgcgccggtgagcgggcgcacggtgaagggccgagtcgcggaccggctcaccaatgagggactgcccctggtgcgtgtcatcatcaagggcaccacccagggcgtggagacggagctggacggcaccttcaccctgcccaacgtgccgacccgatcggtgacgctgctcttctccagtcaggactacggcgagcgcgaggtgctgattggcgccaaccagcgcaccgtcgaagtcgcgatggagaacatcttcgcggaggagatggtggtggtggggcgcgccagtgaggtggcgcgtaagaacctggccaactcggtggcatcggtgaactccgaggagatcaaccgcgcgcctgcccagacggtggaccaggcgctccagggcaaggtcgccggcgccaacatccagagcaacggcggcgcgcccggtggcggtctccagctccggctgcgcggagtgtccaccatcaacggctcctccgccccgctctacgtcatcgacggcgtgctcgtcagcgacgtggccatcgcctccggtgtgttcgccatcaccgagtccgtggccggcgccaacgcgaaccccacccaggacaaccaggtcaatcgcatcgcggacatcaaccccaacgacatcgagagcatcgaggtcctcaagggcgcgtccgccgccgccatctacggctccaaggccgccaacggcgtggtcatcatcaacaccaagcggggccgctccagcgagccgcagttcgaggtgacccagcgcctgggcatgtacacgctggccaacaagcttggcacccgccgcttcaacagcgtggaggaggtgcgcgacaccttcggagaggccgcggtccagtactacgagcaggggcgaaggttcgaccacgaggccaccctggccggccgccgcgacctgtcctcggagacgctggccagcgtcagcggcgtgacgggcaacacgaagtacttcgcctcggcgatgatcaagaacgacgaaggcatcatcgccaacaccggctacgagaagcagtcgttccggctgaacctgggccagaagctgggtgacgccgtggaggtcaacgtcgccaccaacctggttcactccctgggtcagcgcggtctgacgaacaacgacaacgcgagcatcagcaactacatggtgctgccgcgcgcgccggagttcctcccactggaggccaactcggacggcgtgtacccgcaaaaccccttcctctccaaccgcgccaacccattgcagacggccgcgctggtgaagaacgacgaaaacgtgtggcgcttcatcgggtccggagacctgacgtggcacctgtggaagacggaggcccaccacctgcgcgtgctggccaacgcgggcgtggaccggttccagcaggagaactcgctcttcttcccgcccgagctcaacttcgagcccatcgatgacggcctgccaggctcgtcgctcttcggcaccagccaggtgcgcaacctgaactccggcctgaacctggtgcacacctacaagcccacgtcgggcggcatcgtggcgaccacgtccggcggtctccagttcgaagagcgcaacatcgattccatctacatcgtcagcaagaacctgaacgccggccagcagaacgtggacagcggcacggtggtcaacctgcggcagaaccgctcgctggtgagagaccggggctactacgtccaggaggaggtcctcctgctggacgagcgcctgacgctggtgggcgcgctgcgcggcgagcagagcagcgccaacggcaaccccaacgcgctgttcctgtacccgaagctggcctccgcctaccggattccctcgttccacccgaaggtgaacgagttcaaggtccgcgcggcctacggagagacgggcaaccttccgctgtacggcatgaagttcaacggcctgcgcgccaccggcaacatcgccggcagccccggcctggtgggcacgggcatcgcgggtgaccggaacatcaagccggagcggcagcgcgaggtcgaagccggcgtggacgccctcctgttcggcggcgacgtggtcgcggaagtgtccatctaccagcgaaacatcagcgacctgctactgcagcgcgccctggccccgtccggtggcttcgccacgcagatcttcaatggcggctcgctgcgcaaccgtggcgtcgaggccatggtccaggtaacgcccgtgcgcggcggcttcgagtggaccagcggcgcgacgttcgccctcaaccgcagccgggtgacggacctgcctgttcccgcgttcctcgccggtgggttcggcactgccctgggcgccttccgcatccaggaaggcgcgacggcgacgcagattgtgggcaacgacggcgtcgacgagaacggccgcccgattgtgcggaagcttggcgacaccgagcccaccttccgcatgtccttcaccaacagcctcaagtaccgggacttcagcctgtccttcctgttcgactggcagcagggcagcgacatcatcaacctgacgcggtacatctacgacgacgccgggacgtcaccggacttcacgacggggggccgcgagcggctcgtacggcaacgtacgcacgcgagcacgtacatcgaggacgccagcttcctcaagctgcgtgaggtgaccttcatgtaccagctgcccaaggactgggtgtccatggttccagcggtgaagtccgcccggctcagcctgagcgggcgcaacctcatcaccttgactggctactccgggttggatccggaggtgagcaacttcggcaaccaggccatctcccgcaacgtggacgtggcccccttccctcccagccgcagcttctggacctccctcgacgtcgggttctgagccatgaccatccaactgaccaagaaggcattcgtggggctcttcaccgtcctgggcctgagcggctgcgggagcctggacgtcccggacctgaacaaccccagcctcgatgacttccgcgagcggcccacgcgccccgcggtgctcaccgccgccacgggattgctcctcggccaccgcgctggtgtcgccgctcccaacggctacgtggcccagctcggcatcatcgggcgcgaggcgtacgtcttcgaccccgcggacccgcgcgccgtcggcgaactgctgggccctaccctggaccctggcggcccggcgttcggcggcaatcactggaccaacccctacctgaacatccgcaacgccaacgcgctgctggactccctcgaccaggtccccaacacgcccgacgctgagaaggagggcctccgcggcttcgcgaagacgatgcaagccctggacttcctcgtggtcatcaacacgcgggacattgaaggggcccccatcgacgtcaacctgcccattggccaactggcccccatcgtcggcaaggaggcggtgttcgagcgcatcgccgccctgctcgacgagggccacgcccacctggggagcgcgggtgagtccttcccgttccagctcagcccaggcttcgccggcttcaacacgcccacgacgttccgacagttcaaccgcgcgctcgccgcgcgagtggctgtgtaccggggacgctaccccgaggcgctcaccgccctgagccagtccttcctcaatcagagcgcatcgttggacctgggcgtctatcactccttcgggacgaactccggcgacacggacaacggcctcatcagcgtcaacgtctacgcgcacccgtcgatcgtcactgacgcggagttccaggagaatgacaccgtggatgaccgcgtcgtccggaagctcacgcgcctgcccgagcccaggaccgcggcggacgggaagctgtcgacggagtggcgcttccgcatctaccccacgaacaactcgcccgtgcccatcatccgcaacgaggagctcatcctcctgcgcgccgaagccaacattggagatcggaacctcggaccggcggtggacgacctcaacttcatccgcaccacctccggccggctgcccccgcgcctggacatcgatgagaacaatgccctggatgagttgctgaagcagaagcggtactcgctcctgttcgagggtggccaccggtggattgaccttcggcgctacgggcggctcgacacgcttccccgtgagctggacccggacatcgagccccacgagcgcttccccatccccgcagcggagatgaacgcgcggcagtaagcgctgctcgcaatccctgaagctccaggtgcacggcagacaggcgtgcacctggagcgcgggcgctcagtcgccctgcttcagccccggcccgttcgggcgacgagcgcccccagcgcggaccagtccaaatcgccgtggccctgcgcgacgcctcccaggaactggtccttcacgaggctggccaggggcatgggcacctcggcggtgcgcgcggcgcccaggacgagctccacgtccttgaggcccagccgcatcttgaagcccgccgggctgtacttc

SEQ ID NO: 770 - DNA, 5280 bp, Myxococcus xanthus
tctacggtgctgggcgcgtggcgcgccggggtgtccgccgtctgggtgcagggcagcgcctggagcacgcagtccgcgtagggatggacgaagaagggcatcgagtagcgcaccgtgtcctcttccttgctgcgcgggttcaccacccggtgcgtagtggcggggatgatttcgttcgtcacgcggctgagcatgtcgcccgagtcgacgacaatctgtccgcgcagtgtgtccaccggcagccactccccgtcgcgggtgagcagctccaggccggacgccgtgccctcgcagaggagggtgatgaggttgatgtcctcatgctcggcggcgcgcacgcccccggggatgaagcgctccttcagcggcgggtagtggatgagccgcagcacggagttgccgtccgtggccatgccgctgaaggtgtcgcgcgccacgccgaagtactcggccagcgcctggagcatgacgcccgccgcgccatccagcgcgttgaagagcgacagcgtgtgctcgcggaaggtggacacctcggtgggccacacgttggggccatagagcgcgtggtacttgtggtcaggtgggagctcgcggcccacgtgccagaactccttcaggtctcccacctggcggttcttcgcgtgctcctgaccgtagccgatgtagccgcgctggccgccgtgccccgcctgggcgtactgggccttggtggcctcgggcagggcgaagaagcgctccacgtccgtgtacgtgcgccggatgaggccgtcgtcgatgccgtggccttccaccgtgacgaagccgaactccttgatgccgtcgccgaacacctgcacgaagcgggcgcgctcctggggtgtgcccgtgcggtaatgggacaggttgacgacggggatgcggcgctgggttggcgacatggcgccgcactttaaccaccgtgatggattgtcggcacgcacagcgtccgccagaggaccctgttctgcgaccatggcttcgagggtgcggcaccagcggacatctgccctcatcccccgtggaagtcagtgctcccggagtccatgttggtgggcaggttggggggaggcggatgcccgaggtgagcagcggtggtgggtgtggggcgtgtggccggcggcatggggcggatgcctcgtgtccgacgctggtgcgcgcggacgtgcgggccgggggaacggcgcatcccaggtgtgcccccgtggtcgaggcgcaggaccctctggtgggcgtccggtgcggcagcttccggctggtgcggcgcctgggccggggcggcatgggggccgtctacctgggagagcacgtctccattggcagccgggtcgcggtgaaggtgctgcacgcgcacctgacgatgtacccggagctggtccagcgcttccatgcggaggcgcgggcggtgaacctcatcggccacgagaacatcgtcagcatcttcgacatggatgccacgccgccgcgcccctacctcatcatggagttcctggatggggctccgttgtccgcgtgggtggggacgcccctggccgcgggcgcggtcgtctcggtgctgtcgcaggtgtgcgacgcgctccaggccgcgcatgcgcgaggcatcgtccaccgcgacctgaagccggacaacatcttcctggtccggcgcaagcgcaacgcgcccttcgtcaaggtgctggacttcggcatcgccaagctggcggacgcgcacatgccccagacgcacgcgggcatcatcgtggggacgcccgagtacatggcccccgagcagtccctggggcgcggcgtggatggccgcgcggacctgtatgcgctgggcgtcatcgcctaccagctcctcactggccggcttcccttcaacgatgagggactggccgcgcaactggtggcccatcagctgaggccaccgccgccccccagttcggtgtacccggccgtgtccgccgcgttggagcacgtcatcctgcgcgccctggccaagaagcccgaggaccgatacgcctccatcgcggcgttccggaacgcgttgcaggtggcgctcgccgagcacgtgcgcgtgtcggcgcggaagacgcgtcccggaggactcgcggtgctcgagcgggcgcccgtcgcgccagacatgcccaccgaaggccagtcgcgggggcggcttggcgtggacgcgcgggcggggcatgtgccttcatcgctcgcgagcacgtcccagcggcgtcttgcccccgccgctccggcggtgccccgggcctccctcgtggaagtgccggtgcaggtcgtgctgcggccaggggaaagccctgtgcggctcaggggcagtggcctctcccggggcggcttgttccttcacggtgggcgcgtactgccgccgttgtgttcgcggctgcccgtggtgctggagctggcgtccgggcccctgtcggtcatgtgtgaagtggtgcgggtcgttccgcccgcgcaagcgcgcgtctgggggatgcccaccggcttcggcgtccagttcgtcgaggccaccgccgtgctcaaggccgccgtggatgcgctcctccagggcgagccggtacgtgccgtcccgcaagtgccgctcacggaagacccggccgtggcgcgcttgctggaggcctggcgtcagcgctcggcgggggacgcgtatgcggtgctggcgctggagcctgactcggacatgggcacggtgcgcctgcggacccgcgaggcctggcgctcgctggagtccctggagcagcactcgctgacgcctccccaacgcgcgcaggtggatgcgttgcgcgtccgcgtccgcgaggcggccgaggccttgggcgccacggtgcagcgggccctctacgatgcctggcgcggcaatcatcgcggggtggcgaagtgcctggaggcagggctcacggccgagcagttggagtccctgcggcgcgagttcctggcgcgcaggccccaggccatgggcacggcgcggagccacttccagtctggtggcgcgctggagcgcgacggccagctctcccaggcgctggatcagtacgaacgagggctgaagctcgcgccgctggaggtggacatgctccagcgctaccgcaggctccgccgggtgctgggcgggcgggcgacggcgccgaccggacatgacagggcccggtcaccttgaagaaggcgccgggcccaggagcacttcctggatggaaggccacttgaaattacggctcttcgtccaggtcctccagggaaacagcggtccggcaggcctggctgagcccgtagacttgtgccgcgcagccgaacagctcaccaaagtactgcatctcgttgccctcggagcaggtgttgaccctgtccaggcacttgatggctccctctatcttttccttgtcgctatcggtgcacttatcgaggccgcgcttgcattgctggatggcggcgtccagctcattgtccgatagcccagtaactccacaggcacggccctttttgtcgacctcgttgctgctgttgtgcaggtcttcgcaaaggtcatcatcgccaccgccacagccggtgccgaaggcaagggcgctgctggcgatgaggccgatcaggagcttcttcatggtagtccccctttggacgaggttgtcgggctggcgcgcgaaagggcggccgaaagcccgggtgctgagttagcattgacccagggggtgggtaaacagccggggagtggccgtctgatccttcaaccaccttgactccccagggtatctcccgtaaatcccgccgcctttggcgcgattggatggtccacccgtccgaaatgcgcggtcgattccacgggttgacccaacccgacagatgacaggggtttgacgatgtacgcagtgattcgcacgggcgggaagcagtaccgcgtcgccgagggcgatgtggtccggatcgagaagatcgcgggcgacgtcggggccgaagtgaccttcacggagattctgctggtcggtggttcggagagcccgaaggtgggccagccgaccgtcgctggcgcgaaggtcgtgggcaaggtcctggcgcaggacaagcaccgccgcgtcctccacttccggaaggagaaggagggctggacccgccgccgcggtcaccgtcagccgtacaccgaggtgaaggtcacctccatcgccggctagtccgggcggttttacctcaaacttcaggagcacggtgtcatggctcataaaaaaggacagggttcttcgcgcaacggtcgcgattccaacccgcagtatcgtggcgtgaaggtgtacggcggtgagacggtgtcggcgggcagcatcctcgttcgccaggtgggcacggtcatccacgccggcgccaacgtgaagctcggccgcgacttcaccctctactcggtggtggacggcgtggtgaagtacgagcgcctgggccgcgaccggaagaaggtttcggtctacccggccgccgctgagcaggcgagcgcctgacggctggctggcctttgaggccggcaaccgtgcggcacccacgagcgggtcgcttctccagtccacgcgcccttccggcagcgggatgcgagggcggcccgctttttgtttatccaggagtcccagatgaagttcgtcgacgaggtccgcatcttcgtgaaggcgggggatggcggcaacggcgccgtctcgttccggcgggagaagtacatcgagcgcggtggccccaatggcggggacggcggtaacggcggctccgtcgtcttcgtggcggatccgcagctcaccacgctgctcgactaccgctaccagcagcaccaccgcgccaggaatggcgagcacggcatgggcagcgactgtaacggtcgcgccgccgaggacatggtgctcaaggtgcccgtgggcacgctggtgaaggatgccaacaccggagagctgctggtggacctcagcgaggccggccagcgctgggtggcggcgaagggcggacggggcggcctgggcaacatgaacttcgccacttccacccggcagacgccgcgcttcgcccaggatgggacgaagggcgaggagttgacgctccggctggagctgaagctgctggcggacgtgggcctgctgggcttccccaacgcgggcaagagcacgttcatctcccgcgtgagccgggcgcggccgaaggtcgccgactatcccttcaccacgctggtccccaacctgggcatggtccagtacaaggacggcctgtccttcgtgatggcggacatccccggcatctttagagcacaca

SEQ ID NO: 771 - DNA, 5275 bp, Myxococcus xanthus
cgcgctgtcgttcttctgccgggagtcctccgcctggttccgcgaggccccgcccgagcaccgccgccgtcaggtggcccggatgctcgcgcggctgcggcccgaacatctgcgctggttgggacacatgcgcttggcgccggccgtgcgcggacagctcgaggtcctggtggccgcccacttcccggtggacggcacggcctgagctggacggcacgcgcgcggcctcccacgctacgcatgagcggtctggtccggtgggcaagcaaaggcgttgtcgttcatcgtgacgtcgcccgtgatgccagcggcctgctgtcgctcggtaatctcgcgcaggttgcgctcctgcttgtgccccatggctccgcccagaatcacgcccatgatgaggacggagaagatgacgactcccaggatggtggcgccaaggatttccatgagctgaccctcgcttgctggggccgcgcgccacggaggcgagcacggccactttgtcttcaccctggaaaggtgtgtcgtccctcccttcacggcgctgcttccccgaccgtccgtggcagggacgtccgccctcccggcagacaggcggctaacgcgagagcatgtctggtttctcgaagcgaggcagacacagccggaagcgcgtgccctcttccgggtagccgccgcccagccgggtgcacgtgaagtccaacaagtcattgctcatccgcgccatccggtccgcggagacggagattcggttgacggagatggcctgcaacgggctgcgcaggtcatgcccgaggacgcccaggaactgctcgcggaacaccaccgtctgccgcggggatgccctcgaagagcaactgcaaggcgtccacgccagggaggcgggcgccccggcgtcccgtgtcaatgccccacggccgcagatgcctgtcatgacacggacaaatcagacatccccttcgcctgccatggaaaacacttccagcagcctctcacgcaaaggcatcaaactcgggaatcatggcacgcagccaacacagcctgtcaccgcgatataatgagagacgacggaggacgttggcatcggcgtccgcccactgtacgcggagcggctgggaatgggcaggcgagcaagcgggccctcttcgcctcgaccgcacggccaccctccggccagggaacgagcaactcccacatggcgggttcgggggagggacaccaccttccgcaagcggatatcgcctgagagggataggccgcgtgaggagcgtgacacccccatgtggagcccatctccccgtcgagttcgtcccgcgccgtggcgcgtgcgggggggtacgcgcgcatccgcgcggcccctggcggccccgccggcgacgtcccgtcccctggacacacacgcaccgccgcgcccctatcggggacggccgcatggcgtgtcctccatggcctgtggactgtcgctcaccgcattgggcggcgccggcatccaggtgctgggcccttcctgtctggagcggctgcgtcggcggaagcgggggctccatcgctggtggcaccgctcccaggagccgctgatggagtccatggagacggccctgaccatggcgctgctcggcgtgtccgtcctgccactggtgggtgacgacaatccaccggaggagtggaccgcccggcccgacgcggtgcgcgacatccgggacgacgctccggacgacgacctcgatttcgagtctgccttcgcgtcctactaacgcgcctgttaacaccggggcatgacgaccgcgccccgccccaatccgctgctgtcggaccgcgacgtggacttccagctctacgaggtgctggatgccacgtcgctgtgtgccctgcccgcgttcgcggagcactcccgcgacaccttcaccctgctgctggacagcacgcgtcgcttcgcgcgcgaggtgctctaccccacctaccgcgacatggacgcccagcccccgtccttccgcgacgggcgcgtccacgtccacccgctgatgcgcgagctgtacccgcgtctggtggagctgggcctgctcaccgccacgcgcccgcccgacgtcggcggacagcaactgccgctcaccgtgcacgcggtatccaccgcctacctcatggcggccaacctgagcgtctacgcctggctgggcctgacgctgggcgcggcgcacctgctggaggtgttcggcacgccggaggtgaaggcgaccttcatggaaccgatgtaccggggcgaatggacgggcaccatggccctcaccgagccgcaggcgggcagcagcctcgcggacgtgcggacccgggcgacgcccgcgccggacggcacctggcgcatccagggttcgaaaatcttcatcagcggcgcggaccaggacttcaacgagaacgtggtgcacctgacgctggcgcgcatcgaaggcgcggagggcggcacgcggggcatctccctcttcgcggtgccctctcggcggccggagggcggcacgctggtggacaacgacgttcgcgtggcgggcgtcatccacaagattggctggaagggcatccccagcctggctctcaactatggcgagtcgggtgactgccacggttggctggtggggccccccggacggggcctggcgtgcatgttccagatgatgaacgaggcgcgcatcatggtgggcatgaacggggtggccaccgcgacggtggcgtaccacgaggccgtggcctacgcgcgtgagcgcccccagggccggcccactggcgtgcgcgacgccacgcggccgcagacgcccatcatcgaacacgcggatgtgcggcggatgttgctgcggcaaaaggccatcgtcgaagggggcctgtcgttgctgctcgccgcgtcgtaccaggcggacctcgcgggccatggccaggacgaagccacgcgccagcgcgcgggcctgctggtggacctgctgacgcccgtggcgaagtcgttccccgccgagcgcggcttcgaggccaatgcgctcgcggtgcaggtgcatgggggctacggctactccagcgagtacctgcccgaggcctggttgagagaccagaagctcaacagcatccacgagggaaccaccggcatccagggcctggatttactggggcgcaaggtggtggctggaggcggcgcggcgctccagtccttcgcggaggaagtgggcaccacggtggcgcgagcacgcgcggcgggcgtgacgccagagtggggcgaagcgctcgaacaggcccttgcggagaccaccaccgtggtgacggagctgggcgcgcgtggcatgtccggcgaggtcgagttgatgctgcggcacagcgcggacttcctggagctgttcagcgtgctcgcggtggcctggcgctggctggcccaggccgcggcggcgaaggaggcgctggagcgcggcgacccggacgccgacttctacgagggcaagctggccgcggcgcagtactggttcgcggtggagctgccccgagtgccactgctcgcccggctgtgccggacaggagaggattcctacgcgcgcatgcgcccggaatggttctgagacgacgcccccgacgattctcctgcatgaatcgttggagctcgtaagatgtaaagcgtgactgtttctttccacctgtgccagcccggtggaggcgcgtcgtgcggagcctgctgcggcctctacaacttccgggaccactcccgcctggccgtggcggagcagctctccatgcagacggagcggctgcgccgcgtgccctgggaagcctcggcgtggcacgaagccgcccgtgagttgctggcggctcggcgcgccgagcccatgttctccgccgtgcgggtgtgtccgctgctgggcttcgtggacaacgagcgcaagcaggtaggctgcctggcccacccactggtgacgggcggcacggacctgcgggactgcggcgtgtaccgctcgtccgtctgtgagacgttcacctgcccctcgttcggttggctgacggacgcccaggcgaagctggtgcaggtcgcctgcgcggactggtacctgtacgggctggtcatcaccgacgtggagttcgtccgcggctgcctgcgcctgttggagtgggagctggccgggcccgcgcgtccggaagtgctgatggagcagccggaggcgctcgccgcgatacggcggatgttcgccctgaaggagacggcgccgcgacggggaacgaatgccacggtgttcggccgcttcaaccgggacgccgatggcgagcccgtgccgcgcaccgtggactacgtgaagctgggcgtgcgcgcgtcgccggaagacgacgtggtgctgtgcctgggctatgcgccgaaggacgccacggagttgatgggcgcacgcgaactggtgcgctcgcacgtgaaggccgtggcccgcgcgctggcggcgtgacgagtgtccaaccgtcatcgcggatttccaacgcacggctcccaccgaggggccggcgcacaccgtttgcattggaagccgcgaaacggaacgcgtgggaactcgaggggcacaggatgggaagaggatgggcgtgggtgggaatgctgggactcttcgcgttgacgacgggctgccgtgagcgggagcctcgggcggcggtggtcacgcccagcggcgtggaagcggacatgacggccagggccattgaacgcgagcccgtgttggcggtgaacagttcaacagagcccgccgcgctccagccctcgatggcgatgcatgaacgggcgccccggatgaacaccccgacgcgagcgcccacggccctgagcgacacgtccgtggctccgctggagggcgcacccgtgcgcggcgccccggatccgatggcggagtcctccgcgccgtggacgcagccgcaggtgcccccgagccgggtgatgattggctccgaggcggtccaggcccgggaggatgaggactggtacctgggcgcggcgcgcgcggcgcaggacgcgacggtggagacgggccagggcggctcgggcaatacgcccctggaggacgtcatcatcgcctccagctccgtgaacgggcgcgtcacgaaggtgaagcagaacaccctcatcgtgaaggaccgggagggcagcgtctacgagttggagctggacccacgcagccgtggcctgcggcaggggcggaaggtgccgctgcgtcagctaaaggaaggcacgccggtgcgtgcgcaattcgtcctcatgggtggccgcaccgtcgcgcgcgacgtgcag

SEQ ID NO: 772 - DNA, 4526 bp, Myxococcus xanthus
gatgttggctgcaggagcggtggcgctgctgacgccgggtgtgtcgttgatgggtagcatccatgacggcacgcggcgatgtctcatctagagcggcgcgggggacctccaggtctacgccgccgcctccacgggaacgccccaggtcgtggtggggccagggggcgtcccggacctgcaacccattccggactacggcgccctggagccgcggctgcgcgacctccccggcatccaggaggtggtgccgctggagctgggcatgggcgctgtgttccgtggcaacgccctggatgaaaagctggcggtgttgcgcgaggcggcgcgggcgccggcctccgaggaacgggacgcacggctgcgccgtctgggcgaggacctgcggctgacgctggcgcgggtggcgcgcaacgcggatcgccggagcgaggccttcgcggaagagcccgccttcgcggatgacctgcgcgtgctgcgggacgcggccgagcccgccttctgggagcggctcaccgaggacccacagggcctgctggaggtgttggagaaccgcgtggcgcggcaagcgggcgagggtgaagagcttccggtggactacctgggcacggacgtggcgcgcttcgcccgggccttcccgcgcttcgagctcgtctccgggcagcttcctccgccagggacgcggggcctcgtcatggggcacgcgacgtacgagcagcacttcaagcaccccatcgccgtgcgcatggacacgctgcgccgcgagcgcgagcggggcctcacgttggcggaggacgagcagctgcgcacgctggtggagcgcaacgtcgcggaggtgccggacctggtggctcgcctggacatcgagcgcgccacggcgctccaggccggactggcccgcgtgctgggcgagccgggcgaactggaggccctgctggcgcgcttcctctcggtggacgacgccaacttcgacacccgcttcggacagttctacggggagctggcgccctcgctgccgctgtaccggctcaagcccggggacgtgctgtcactgaagacgccgctggagagtggcaccgccgtgccagtgcgagtcttcggcatcttccgcttccggggcctgggcggcgacgacggccgggtcaacaccatgagcgtggtggacctcgtcacggcgcggcacctgtctggccgcttcacccaggcacagcaggacgaggcgcgggcgctgttcgagacctttggcatggaaggggaggccatggcgccccccgagtccctggacgccttccatccgcctgacatcgtggacgcggaggcgcagacggcgcacaccgaacaggccccggtcttcgagcgtgctcgggccctgccggagaccttctccgaggacgagctctcacgcggcacggtgttgcaggccgcggtggtgctggcgcccggcgcctccgccgaggacgtcgcggcccgcatgcgcgcgctgcccggtggtgaagcgctggccacggtgggttggcaggaggcgggtgggttgctgggcggtctggtggtgatgctccaggcggtgctgctgctcttcgcgctgttgatgtcctccttcgtcgcgctggtcgccgctggaacgctgctgctgctggcgcgggaacgcgtggcggaggtcggcacgctgcgcgcggtgggaatgcaacgtcgcgaggtcttcacctcgctgctgctggaagggtcgctgctgggcggtatcggcagcgtcctgggcgcggtgctgggcgcggcgttgttgtggcttgcgaccggagacggcgtggcggtggaggatggctccctgcagttcttcctgggcggccccgtgctgcgtccagcgctggcgctgggcggaaccgtggccgtggtggtggcggtgacggccgtggtgctgctggcgacactggtaccggcctggcgaggcagcgcggtggagcccatcgaagccatgcggaagggcgagggctgaaccgatgcgcgcacttctccagattgccttccgaaatctcctggcccaccgcgagcggggactgttgctgctcatcgtgctcgcgggcgccagcgccgtgctggtgggcgtgatgtccgtgagcgcgggcgtcgcccgggcgcagcgcgaggccgtgaggaccttcctcgcgggcgacctcaacgtcgggggctacttcaaggagcatcccgactccatcttccccgtggtgggtgacacctcgcgggtccgctccgtcctccagccgcacgtgcccgcggagtgccaggtgcgcgagcggggccggggctcggccaccgcgggtgcgggacggcaccgggtgcgctcgtacctgatgagcctggacgtcgcggccgagggcaacgcgggcttccgggtgcgcaccggttcgctggaagccctcgcgaagccacgcacggtggcgctgtccacgtcgctggcggagcggctccaggtggaggtgggcgagctggccacgctcttcgtgcagatgccgggcggcaagcgcaacgcggtggacgtggaggtggtggccctgctggagcgcgcgggtgtcctgggcgagtccgcggggttgctggtgtccaacgcgatgctgcgcgagctgtatggcttccgtccggactcggccagcgtgattcagctcctctgcggcgacggcacggagctggagccgctggcggggacgctgcgtggcgcgctccagaaggccggctacgaggtgctgccgcccgcgcacgaggcctacggcgacaagctggggcccctgctgcgcgagggctgggcgggccagaagctggacgtgagtacctgggaggacgaggcggccttcctcgacttcgtggggcagggcctggggctgctgctggtgctggtcggcgcggtggtgttcggcgtcgtggtggtggggctcttcgtctcgctcaacgtgtcggtccgcgagcgcacgcgggagattggaacgctgcgcgccatgggcatgcagcgccgctcgctggtggccgccttcatgctggaggggctgctggtggggtgggcggcctcgctcgtgggcgctggcatggcggcggggctgggggtgctcctgcgcgacgtgctgccagtgccggacgcgctctccaccctgttcttcagcggcacgttgccgctggcgcccaccttggggcacgtggtggccgcggtgctcctggtgacgctgggcgcgggcctggcttccatcgtcccggctttccgggccgcttcgcttcctcctcgttccgccatggagtccttgtgatgaacgcacgacgcccgctgtccgtcctgttgctcggctggaccctgctgcttccggcggtggcgctcgcggaggccgagcccaagctggcgcccgatgccctgctgcgccacatcgacgagaagatgtccttcaccagcgactacaagggcgtcatccgcctctatgagacgcgcaaggatggcgccaagcgggccatggaggtccacgtctaccggcgcgaggccgacaatgacttgctcttcctctccaccaagccgcggcacctcgcgggcatggggacgctgcgcatcggccgcaacctgtgggactacgaggcgacgacgggctcgtggcggcgcaacacccagcgcaccaacctgctcaacaccttcacctgcgaggcggacttcgaccgctcgcggctggccgaggactacgccggcaaggacgagggcgacgacaccgtcaacggcgtggcgtaccgcaagctgctgctgacggcgaagaacgaccaggtgacgttcccgctgatgcgcatctgggtggacccgcagaacaacatcgtcaagaaggtgggctacaccgcgtccggccgcacgctgcgcaccgacatcgtgcgcagctaccagcgcatcaaggacccgctctccggcaagcatgtcctccactacaaggaagtgctggagacggaggagcaggaaggcacgcagatggtggtccgctacgacgaggtggtgttggcgccgctggacgccaacatcttcaccaaggcgtggctggagagccgcctgcgctgactagcctccctgccgcttcagcacctccaggaggtggttcgccaactcctggacgcagggctgctggagcgtgccgaagtgggaactgggcagcggcaccacgtcgagctgctcgcgcgtcaggtgccgctcccatcccagcgtgtccccgtgcagggcccgtgacggcgcgctcgtgaagagctgcacccgggcgcgcacggacggcaccttccagcccaccacctgcggcaccagcacctcgcccagcacgtgccagatgccgagcacgttggcggcgctagagtggggggccagcatgcccagctcgagggccagggccgtcacccgctcccagagcgcggcgtaatgcaacggggccagctccgcctccagcgcggtgtgcaggacgccgaactcctccggcatggagcgcaccgggttctccgccgacccctgaagcccttgcaccgagggcagggca

SEQ ID NO: 773 - DNA, 6250 bp, Myxococcus xanthus
acagcaccaccgtcaccgtgaagcacggcccgccggtccgcgtggaggccgagggcgtcgcccagcccgtcgccaagggtgaatccatccgcgtggagaagggccatccgccccccgcgccccttcgaccgctggtggcccccagccccgggcagccggaggattccgcgcgcctgaagcgacgccccgaccgggacgggcacctgggcccggtgaagctgacctgggaggctgtacggggcgcggaacgttatgaagtggaagtgtcgcgcgcgcaggagcaacgcgccgtcttcacgcagacagtcaccagcctggaagcgaagctgccagtgctacccgcgggaagctaccggtggacggtgcgcgcggtgggccccgcgggtccgtccgagcccagcgcgcccaggcacttcgagctggtgtccgagcgcctcaaactcgaagtgaagaagggccagtggcagtaacccctggaggagccacgccgtgcgcctgttcaaagccatcctcctgttgatgctggtggtgggcgtcgtccccacgctgatggtggggtggctctccgtctcccacacccgggagctcctggtgcgcgacgcccaggaactggcacaggagcgcgtgaagcagctgcgcctcaaggccgaaatcttcctcggcgagcccaccgacgcggtgctgggcctggcccgcgtgcccggcttcttcggcctgccattggaagcgcagcagacacacctggcctcggtgctcaaccagcggcgcgatgtgctggcgctcaccgtgttcgacgccaaccgccagcggctgccgggactccaggccttctccaagcacgacgtgccgcccaccgcgctggccgggcatgaggagcgcgcgcgggcgctgctcgagaacatcgagggcgtgcgctacgcggacgtggtgaaggacccgcagggtagcgagccggtgctgacgctggccttcccgctgggcgagcccgtccgggggtacatcgcggcggacctgtccctggccgacctgcggaagatgctggagcaggagcgcgtgggcagcaccggcttcgcgtatctggcggaccgtcacggtcacctcgtggcgggcggtggcggcgtcgccggcctgggcgaggacgtggcgcagcgcggcccggtggcgcacctgctgaagcagttggtgggcaagtcggacatggagctgttccacgtcggcaacttcggcgagggccgggacgcggtggtggccgcgtacacggtgctgcccgagacgggctgggccatcgtctccgagcaacccgtggagcacgcctaccgtcaggtggacaccatggaacagcgcatcctcctgggtttgggggcggccatcctggtggcggtggtgctggcggcgctcttctcgcggaacctcacccggccgctcaagggattcatcagcggcgcgctggagctggcacacggcaagttcggcgtcgaggtggacatcaagcagaagaacgagctgggcgagctggcgcagacgttcaactacatgagcaagcagctgctcgcgtacgacatggagaaccgcggcctctacgagagcctggagaagggctacctggagaccatcgtcgcgctggcgaactccatcgattcgaaggacgcgtacacccgtggccacagccagcgcgtgggcgacgtctcggtgcagattggccgggagatgaagctcaccgagcgcgagctgcggcagttgcagtacggcggcatcctccacgacatcgggaagattggcatcgtggagtccatcctctgcaagcagacgcggctgacggaccaggagatggacatcatgcgcgagcaccccgccatcggtgacgccatcatcggtccggtgagcttcctgggcgcggtgcgcgcgtgcgtccgccaccaccatgagcgctgggacggcaccggctacccggacaagctcaagggcgaggacattcccctgctggcccgcatcgtcgcgtgtgcggataccttcgacgcctgcacctccacccgcccgtaccagaaggccatgccgctggagaaggcgatggaaatcctcgacaacctcagcggcgcccagttggacccgaaggtcgtccaggccctgaagcaggtgctggcgaagcagggcgtgcggctggagggccaccggctgcccgtgaagctcgcctcctgacggccgaaggatggtagggagggcgcaagactgttgagactctggaaggtgaaacgttgagcttctgggaccgcatcaagcccgcccccccagccgtcaccgcgacggacgcacagttgtcctcggatggcgtgcgcctggacctgacgtgggacgacggggtgaagacggacgccaccgcacaggtgctgcgccagcagtgcccctgcgccgcgtgcgtggacgaatggacgaacaagcggacgctggacccgtcgaaggtccccgccgaccttcgcatcaagcaggtgcagcccgtgggcaactacgcgctggccttcagcttcagcgacggccacaccaccggcatctatccctggaagctgctgcgcgacatcacccagcccgccgcctgagcgccccgtgaacgaacgctaccggctcgttcgtccgctggcctctggaggcatggcggagctcttcctcggcgtcgcgcgcggcgcggagggattcgagcggccggtggccatcaagcgggtgctcccccacctggctcgcgagccggacatcgcgcgcatgttcctggccgaggcccggctggccacgctgctgcaacaccagaacatcgccaccgtccatgacgtgggccagggccccgaagggctcttcctggtgatggagctggtggacgggtgggatttgggcgtgctgctacgctcggccgcgcgcctgggcgtgcgcttccctccgcacctggccgccttcatcgtccatcaggccctggcggggctcggtcatgcataccggaaggtgcatgacgggcggccagtgatggtggcccaccgcgacgtgtcgccctccaacgtactggtgtctcgcgagggcgaggtgaagctgacggacttcggcatcgcgcggatggccggcccggcccacaccgcgcccggcgtcttccgagggaaggaggcgtacaccgcgcccgaggtgctgcaaggcgctcccgccaccgccgcgagcgaccagttctccctgggcatcgtgttctacgagctgctcacggggcagcatccgttccacaccgagaaggacgcgagcgcggtgacctacgccatcctgacgcggccggtggagccaccacagggcgtgcccacacccctggcgggcgccgtcatgcgcatgctggcgagggcgccccaggagcgcttccactcgccggagtcactggccgaaggctttgcccggtggttggcccaagtcggcgagcccgcgacgtctcagacgctggccgcgttccttcgcgggctgggattgccgccgcccctgagtgaacaggcagcggcttccaggcgccccgtgacgcaggcacaggctgacgcgggttcgctggcgatggccgtgcatgcgccgtcgcccgccgaggccgctgcgtcggaagaagagcctctctccatgccgggcggcgcggcgctcagcgtcagtgggcggatggtgcatcactgccctcgatgcaaccacgtgctctcctcgccccaagcccggtgctcacactgcgcgatgtggccggatgcctcgaccggcgcggcggcaacgcctcgcacgcccaccgctccgggcgccttcgctccatccgagggcgtcgagctcaccgcgcatcagacgctcgcggagagtgtcccccagacgcacgtcacgccgggcgcgaagagcgtgctccagaccgacgcagatgcactggagctggcggagcgcccgccctcgccagcgagcgactggcccgatgaggcggccctcctccggcgctcgcgcctgaaacgggcactggggctgctgctcgtggcgctgctggtgggcaccggcatctggctgtggcctcagcgctccaccctgctcattcgggtgatgtcggcgacggggctccgcctgtcggccccgatgctgcgcatcgacagcgacccgcctggagccaccgtctgggtccgagacgcggagctggggacgacgcccctgctgctcgagaaccgctatccagcggggcgcgtccccatccaggtccggctcaaaggccaccgcacatggaaggggacgttctccggcggcgaggccgctcacatcgaggcgaagctgaagcgctgaacgcgcctcacttcaccaggcgcagatgaccacgacgcggcggcggctcgtccggcggtccgtccgcgggcggaacatcggcgggcggctcatcgcgccgttcgccctgcacttcccggaggaaggtgcgcgggcgctccgcggccaccggcacgggagcgacgggcaagggctgcgccggacgtgacgcggccgtctgctggagcaactccggcggcatgtcctccgggtacatccagaactccttcgtcacgtggctggcgatggcgaacaacgccgaccacggcaccgcgatggtgaagcgcgagccggagaagctcagcgtggagcgcacgccccactcgcccaccgtgaggtccggtgggtcgaaccggtacgagagattgaggcgcaggtgcgcctccgtcttgacggaggctgggacgagcacgcccggacgacgcgcgtccaggtgaatcatcaccatgccctggtcgagcgcggccagcagccgctccttcttgtcgagaaccttcttgtcgtccatcggtgtacggcgaaagaacttcgggcgcccctctcaacgtcggcgcatcgcccggtccatctcccgcttcgtctcccgctccttgatgtcgtggcgccggtcctcatgcgtcttgccccggcagagccccagctccaccttggcacggccgttcctgaagtacagcacaagcgggatgatcgaataaccccgctcacgcaccttcgccgtccaacggtcgatttctcctcggtgcatcaacaacttgcgaccccgagtgggaaggtggtcgaagaagctcgccgccttgtaggagccgatgttcgcgttgagcaggaagagctcgtcccccttggggagcgcgtaggcgtccgacagattggcgattccgtctcgcagagacttcacctcgcttcccgtgagcgccagcccggcctccaccttttcgtcgaccgtgtagtcgaaacgcgcacgacggttttccgcgatgactctcacgccgggctcactgcccactccctttgacttccctccggatgtcatacgcgtcccgcgttctcctcaccacccaactgcatgttgtcgatgaggcgcgtcgtgccactgaaggccgcgacgagcaaccgggcaggctgcccgggcgccaccgaagccagaggcgtcagccgttccgcatccaccagttccacgtagtcttcccgaagccccgccgcctccaattcgcgccggacggccgccaccaggggctccgactcccgcgtgccctcgcgcagcagcgcctgggcggccttgagcccccgggacagggccagcgcccgctgccgctcctcgggggacaagtaggcattgcggctgctcatcgccaggccgtccggctcgcgcaccgtcggcatgccgacgatgtccgcgcccaggtgcaggtcctggttgagcgcccggatgacctggagctgctggtagtccttctccccgaagagcgccacctccgggcggaacagcgtcagcagcttcgtgacgacggtggccaccccgcggaagtgccccggacgccgggccccgcacaggccctggctgacgtccgtcacctccacgtacgtctggtagccctgcgggtacatcacctccgggcccgcgggcgcgaagatggcctgcgcgcccgcgctgatgcacttggcgacgtcaccctcgaagtcgcgggggtagcgggacaagtcctccttcggcccgaactgcgtggggttcacgaagatggacacggccaccacgtccgcgcggcgccgcccctcgcgaatgagcgagaggtgaccttcatgcaggaagcccatggtgggcaccagcgcgagccggtgcccctcccggagcagccccgccgtccagtccttcacgtccgcaacggttttcaggacggcgggagccatgactaggcgggtattccgt

SEQ ID NO: 774 - DNA, 5175 bp, Myxococcus xanthus
gagctgggacacccctttgcgtatcgtctcgctcgcgccccggcggagtggaggcttcatcgcggggacggagcggggcctggccttctacgagccccggagcgcgcggctggagcggctgctggatccggagcctgaacacccccacaaccgctgcaatgacgggaaggtggacccacaaggccgattctgggtgggcaccatggatgaccacgaggaggcgcccaccggcgggctctaccggttcgacgcccagggacacctcgctcgaatcgatgagggctacaccgtgacgaacggccccgccttcagccccgatgggcggaccctctacgtgaatgactcgccccggcgcgtcacctacgccttcgacctgagcccggacggcgcggcctctcgtcgccgggagttcctccgcttcgacgagccccacggcttccccgacggaatgacggccgacgcggagggcggattgtggattgccttctatggagggggctgcgtgcgccgcttctctccggacggcgcgtggctggccgagtaccggctgcccgtggcgaagacgaccagtgtcgccttcgccggggacgcgttggaccggctgttcgtcaccaccgggcgagatgggctcagcgcggaggagctcgaggcccagccgctggccggtgggctcttcgagctgacaccgggcgtccgcggcgtcgcgccggtgcccttcgcgggctgacccggctcagccttcctcttcgacggcttcttcgtactgccgcgggggcagctcggcggcgcgagccgcgcgcaggtgctgcactgcgaggaagcccaccgcgcccaggccgaagacgaagacgaagggcccggggagcaggcgcatgttgagccccgcgaacgcgagcgacagggccaccgcgcccgcgggcaggtagcgcgtccaggacgggcgctccacctccggccgcagcgccagcagggcaagcactgccagcagcgccagctccaccaccaccgacgccggcaaatcccagccccgcaggtgggtgacgccgccaccgtagctgtagagcatgtcgtcggtgggccgctgcgtggcgatgacgcgcagctccggcgggccctggggcaccggcgcgttgtccggcaggcccaggtccagcttcaccgtgccccacggcgcgaacagcgccagcaggcacaccgccacgccacccaggcccaccaactggggcatcgccaggagctgccggggctcgaagtacacgcccacgccgtcctctcccgcgatggccttgcggtactgatcatgggccaccagcccccacgcccgccaccatcaggagcggtagcacgcccaggctgagtgagcgcagcgccagcgccaccatcaccgcggtggcggcggcggcggcctccggcgtcatcagcaccgcgggcattcgctcggtgaagccaggcgactgctccgcggcgcgcagctcgcgtgcgaccagcaccgtgccactcaccaccgccagcagcgtcccgaggaggcccacgccagaggaggagagcaggccggacaggaagacggcgcagcccaccacgatgacgcccagcaccgtgggcgagtgggccggcacgtgcgccagccacttcggcccgtcgtaggccggggcggactggcccgggtccgtcttgtcctcgggcggaagctcgggcgcgttacccacgacatagggccgcgagtgctcatccgcctcctcgagaatgtccgccgcataggcgggctccgccaggtcgcgctggggccgcgagggacggagcgcggcccgggcgcccgttcccttgggcggctcgggcatggtcgccccgcagttctcgcagtaccgcaaccgggaattggagtcttcaccacactccaggcaccgcataccgccacctcattgggacgacaggggctacttccgcgcggcctcggtgggggcggagggcgtggacagctcctggatgcgcagggccagcgtctgcgggtcgatagggcccacatgcttgccccggatgatgccgttggggtcgatgaagtatgtctccggtacgcccgccacgccgtagtccagcgccatccgcgagcgcggatccaccaactgcgggaagctggcaccgtactgctggaggaagccgcgcgcgttgtcgtcggtgtcctggaacaccacacccaggaacaccgcctgcgagccgtactgccgcgcaccccactccagcacggggtgttcgacgcggcaggggccgcaccaggacgcccagaagttgatgaccaccggccggcccttcaggtccgccaggctcaccttctctccgctgtccagcgcgcgcagcccgaagtccggggccggcttgcccttcatcatgaaggggacttcgtgcgggttgcgcccgaagcccttgaacaacacgaagagcaggcccgcgcagaggaccacgaagcccagcgtgtagcgccagcccttcatcaggcggcccctcgctcggcgtcaccacccgtgagcggggacgtgcccaccgccggcgcgcccgccatggccacggcggtcttccggcgcggccacagcgcgatgagggtgcccagcaccagcagggggatgctccaccagatccacccgacgagcgggaagacccagatgttgatgctcgccgtgccggcctgctcggagaaggccatcagcgacacgtagaggtcctcggccggcgtctcccggacaccgggggtgccaatggggtccgtgctgcgctcgtagtagttgagccgcggcttcagttcggagaccttgccgcccggggacgtcacttcaatgcgcgccgccacgtaggtgcggtggggctcctcgccgctgaccaggcccaggtacttcatctggtagccgcccagctcgatgacctgccccttcttcagtgtgccggaggtgtgcttcacgtacgcggaggacgcggccaccgcgacgatgatgagcacgatgcccaggtgcaccacgtagccgccgaagcggcgctgggccttgagcgcgctggtggtcagcgcggcgacgaagccttccttgcgctcggacatgcgcacccgcaccggcgccaccaactcccgcacagtgacgacggtgacgaagcccgccagcccgaaggtcatcagcgggtacacgccgcgcaggcccaccgcgaagcacgccgccgtcaccaccagccccaccacggaggggatgatgaactgccggcgcagcgtggccggatccggcttgccccagggaagcaccgggcccacgcccatcaggaagagcaccgcgatgccgcccggcaccgccatcttgttgaagtacggctcgcccacgctcacgcgcacgccgtggaccgcctcggagatgagcgggtacagcgtgcccagcagcaccgtgaaggtgatggcgacgaacaccaggttgttcaccaggatgctcgcctcgcgagacagcggtgaggccaactggccttccggcaccagcagcggaccgcgcaccgccagcaggcccacgcacagcaccagcaggaagcccaggaacaccaggaaggtgggcccgatgtcggactgggtgaacgagtgcaccgagttgaagatgcccgagcgcgtcatgaacgtgcccaggatggtgagcacgaaggatgcgagcgcgaggctgagcgtccacagcttcagcatccgcttgcgctcctgcaccatggtggagtgcatgaacgccgtcgccgtcagccagggtaggaaggacgcgttctccaccggatcccacgcccagtagccgccccagcccagcacggcataggcccaccaggcgcccaggatgatgccaatggacaggaagagccacgccaccagcgtccagcgccgcaggggcgccatccacgcttcgccaatctcgccgcgcagcaggcccgccaccgcgacgccgaagggcaccgtcatgccgacgtagcccaggtagagcatgggcgggtggatgaccatcaggatgtggttctgcagcagcgggttggggccggggccgtccgctggcacgggggacaccgcgccccagggattggccgggcccgcgatgaggaaggcgaagaagacgcccaccgccagcatggtgcccagcgccagttgcatgtaccgcgcgtgctcgcgccggtggatgtaggcgaagacggcgatgtagccgcccatgatgagaccccaaaagaggatggacccctccagggcgctccacagcgagacgatggtgtagaccagcggcgtggcccggctgcccacctgcgccacgtagcgcacgctgaagtcgtgcgtgacgagcgcgtggaccatcaccaggttggagcccaccatgcaggcggcgaagccccacaccgcgcgcagcacccacgggaagcctgcgtcacttcgacgcaggccgctcaccaggcctacgagtgcgccgaaggtcgcgaacgcgagccctccgagcacgaggccgtagccaacggttccgttcacttcgcacccatggcggtggcgtcggagagcgtctcctgccactgacgaggatcctcaccctccttgggggcgcggtactcgttggagtggttcaccatcagccggttggagctgaagacgccggacttgtcgtaggtgccttccacgacgacgccaatcttgtcgcggaacatctgcggaggcgtctccgtggcgcgcaccagcacgctgggcgcgccttccttgacgtcatccgccacgcggaattgcagggtggtgtgctccgcgttccactggatgctgcctgcctccaccacgccccccaggcggatggtggccgagtacgccttgtcaccctggcccagcatctccgacgggctccagtagtagacgaggttctcaccgatgttgccgaaggccacgaatcccaggccagcccccgcgacgagcagggcccccagggcaatcagacggttgcgagcgacgggggacatggcgactcactccttggcgtcggtgggggctttgggccgacgaacccacagggacacagcgtagagaacgagcatggcgactgtaatgccgtagcaggcccagacatagccccagccgccaacgatgcggccgctgcccacctgtccgggcgccgccgcgaggatccacagcatctgcgtggcaagcgccatcat

SEQ ID NO: 775 - DNA, 4978 bp, Myxococcus xanthus
gagttggtggcggcccagggcttgtccccgctggaggtggtggccacggcgacgcctctttttcttttatccgccggcggatggtgctcttcaccgccatggctgggctcaacccgtccttcttcatcctctacgcgacggtgacacgggcgatggacgcggtggatgcgatggtgggtgcgccggcccatgtgcagctcgacgtggccggacgggccagtgagacgagcgggctcgcggtggctggattggtcgcggtgctggtgatgatgacggcctatgtgggcggcgccgtcatcgccgagccgctgcgctccatcaccgaggacgccacgcgcatcgcccagggcgatttccgcccgccgcggcatcatcgccgcggaggacgaggtgtgggccacctccgccgccttcgcgcagatgcagacgcagttggggcaggcgctggcacaactgcggcgcgcgggcctccagatttccactaccactgagcagttggtggccacgtccggtgagcaggagtccggcgcggatgagcagtccgcgtcgctcaacgtgacgagcgccaccacggaggagctggcacgctcggcgcagcagattgctggcaatgcggagtcggtgtccgccatagccgagacgaccttcgccgccgcgcaaacgggacagcgaggcgccgccgccttcctgggcgcgatgcagcgcatgaaggaggacaaccaggccatcgcggacgcggtggttcggctcaacaagcgcgtgcagcagattggcaaggtggtggagttcatcaacgagattgccgacaagtccgacctgctggcgctcaacgccgagttggaaggcaccaaggcgggcgaggtgggccgcggcttctcattggtggccgcggagatgcggcgcctggcggagaacgtcatccgttccacgaaggcgattgagcagctcatcgcggagattcgcgatgcgacgcacgccgcggtcatggccaccgaggcggggctgaagacgacggacgcgggcacggtgctggccgcgcaggtggacgaaagcctgagcctcatcctggagctggcccggcagacgtcccacgcggtgcgcagcatctccctggccacgcagcagcagcagaccggaacggaccagttggcggccgccatgggcgacatccttcgcgtcaccgagcagaacttcgcggccaccaagcaaatggcggcggccaacgccgacctgtccaccctggcgcgtgatttgaaagacgcggtggagcgcttccacgtcgggccgggaggtgacgcgtgagcgcgcagaagggccccaggcgggcctccttcagccggcacctcatggcgcccgtcccgctggccaacctggtgggcgcggcgctcagcctgcgcttcgcctcgctcaccctcgccgagccgctggcggggcggatggggttgatgggcatcctgggcggcgcgctctgcgcgacggcgttggtgtcgggggccgctgtgtccctgggacggcagcgcaccctgcgcgggctggagcgtggggatgtgcccaccacgccgcagacgctggcgtcggcggtggcggaggtgacgcgcgcgccggacgaggccttcctgggctcgctgggactgtggctggtcaccaccctgacgctgggcgcgtgcatgtggctgggcgtgggcgtggagttggcggtggccgctcgcatcgccgcgttgggcctgctcttcgggccgttgaccgcgctgctcgtgtactgcctcgtcgtgcttcggtcgcgcaaggtggtgctgtggctggcggagctgggtatgacacacgcgcagctcatcgaggccatgccccggcgcgcggagctgcgtgcgcggctggcggccttcgccttcgtggcggtgatgacgcccgcggtgctgtccgcgcagctcgcgtcggcgctgagcaaccacatcttcacccggctcatggcggagcgggacgtcagccgtcagctgatgttggcgcaggagcttcgagtcgaggcgctgacgcagggcggagggctggtgctgctcgtcttcgcgctggcgctgacggccgcctacctgggcggcaccatgctggggcggcccctccgggagctgtcgcgcgaggcgaagcgcatcgccgagggggacctggccagcccgcgcgtggtgcccgcggaggacgaggtctgggacgtctccgcggcgttcaccaccatgcgcgtgcatctggcggacgtgatgtcgcagttgcagcgcgcgggcgcgcagatttcggcgaccacggaggagattctcaccacgtcgggacgctacgaagcgggcgcgacggagcaggccagctcgctggacgagacgagcgccaccacggaggagctggcgcgttcggcgcggcagatcgccgagaacgcgggctcggtggcggagattgcccagcgcacgctgggcgcggcgcagcaggggcaggggagcgcggaggccttcctgggctccatggcgcgtatgcgccaggacaacggcgccatctcctccgccgtagtgcggctcaacaagcgcgtgcagcagattggcaagatcgtcgagttcatcaacggcgtcgccgacaagtcggagttgctggcgctcaacgccgagttggagggcaccaaggccagtgaggtgggccggggcttctcgctggtagccgcggagatgcggcggctggcggagaacgtgctggagtccacgaaggagattgagggcctcatcgaggaggtgcgggaagcctccgccgcggccgtgtccgccaccgagggcggcgtgcgtgcggtggagacgggcaccacgctggcgcagcaggtgtccgagtcgctgcggcagattgtcgacctggccgggcagacgtcctacgcggtgcgcagcatctccctggccacgcagcagcagcagatgggcaccgaccaactcgccgacacgatggcggacatcctccgcatcacccagcagagcctcaacgccaccaagcaggtgacgacggcgaacacggacctgctcgtgctcgccagggacctgcagggcgtggtggagcgcttccagattggccaggagccgctgggggaggagggcgggtgaccccgagcgagcgcctgctcaggcagttccgggacctggtgacggtgcgcctggagcgcatcacccggtccttgatggaactggagtctggcgccagcgcggaggcggggcggggcgtgctgcgagagctgcacggcttgaagggcgaagcccggatgatgggcttcgatgacgtcaacgtgctggtgcacgaaatggaggagctggtccgctgcactgagcccttgcgctacgcgctctcacccgcgtccacggatgcgttgctgaccacggcggacgccgtgctcgtgttctccgggacgcaggccgccgatgagccgccgcccgcggtggagcggctcgtcgcgtggttgcaggagtgcgtccgctccgagtcggtgcggctgccgcctggacgtctcgtgcccgcagaaggagcccccgcgacttcggaggccgctggccgcgtaggagcccaaggtggtccccactccgccgtgcagacgaacccgggggcttctccggggcggctgttgacgatccccgtcgcggaggggagccggcctcacgtgccttcaccgggccggagcgcgatgccgagcttcgtctctccgcaagcctctggcgccgaggcgtcctccggtgcgggagcccgggcggcctcctcggctccgacggtgcagggttccaacggcctcacggcgccccggcagcccgagtcacgtccggacactgcggtgcgcatcggcgtggagagcctggacctgctcaccagtgccgtcaccaacctcacgcaagtggcgcgtcgccgggagctggccaatgcccgacgcctggccctggcccgtgagctgagccagcttgcccgcgaggcggaagacctggggcccgcgggcgccgcgttggcggcacggttgggctcggccaaggagatggccgcggtcctccaccgcgagtcgaagctgctttccaatgcggagctgcgcgacctgggcatgttggtggaggaggtgcagacgctgcgcatgctgccgctctccgtcctcttcgagccttacccccgcatggtgcgcgacctgtcccgcgcgctgggcaaggaggtggagctggtcgtcgacggcgaggacactcgcgccgaccgcgccgtcgtggaggcgcttcgcgagccgttgatgcacctggtccgcaacgccctggaccacggactggagacgcgggtggaccgcgtcacggcggacaagaagccgcgtggctgtctcacgctgcgtgccgctcgagagggcaaccgcatcaacctccgtgtcgaggacgacggcatgggcgtggaccccgtccaactccgcaaggtggccgtgcgcagggggctgttcgacgagagcgccgccaacgccctgtcggacgccgcggcccgcgagctcatcttcctgccgggcttcacctcgcgggacgtcgtcaccgacctgtcgggccggggcgtggggttggacgcggtgcgcacctccatccaggccctgggcggtgacgtcggggtggagtctgcgccgggctggggcaccatcttcgagctgcgcgtccccgtctccctcaccgtggccccgctgctcttcatccaggtggggacggagacgctggccctgagcgccacccatgtctcgcgggcgctgaaggtggactcggcggagcaatgcgaggtggccggccgcccgtcgctcctggtggaaggccgggtcctgccgctggccccgctgtcgtcactgttggggctggagcctccgcggcccgctcgcgagggtgagctggccctggtggtgaagagccagaacggcgcggcggcgctggtggtggaccgcgtcctggaggagcgggttcaggccatcctcccc

SEQ ID NO: 776 - DNA, 5717 bp, Myxococcus xanthus
ggccgccggggcaccatcaccaggacggacaccgactccagggcctcgcctgtttgtgtgaggtcgatggggggcagttgcagggactcgtcgaggatggcgccgagctcgtcctcggctaccaccgtcagctcgacgtccacttcgggcgggaagtagaactccgtgaggctgcccgcctcgatggccgccgcgggcagggtccccgcggcgggcagcgtgaagaagtgctcgctcgcgaggaaccgctcgctctggcccgccgcgcgacgcgcctggagcacctccttcaggtgctgctgatattgaagcgcgtgagcttcacgcagctcgcgtggtgccacgccgaagcccaccacgctgcgctgttcggcgcccacctcacgtcgcaccaggaaggtgtccagccagcggagggtgcctcggtccagtgccagcatcgccagcggcagcgcgtccacggggaggttccgcatccccgcaccggcgaagacttcatgggccgcgcggctgcggcgcgtctcgaaggtgccgccgctcaccgggtctgggtaggggatgagcgtcagcgctaccgcctcgatgatgtcgccgtcctgcgtggtccgcgcggcgcccatcgacgtgggatacgacgccaccgggttcgccgtgtactccacggggcgcagcaccagcacgtacaacccagagcggctccgtgccagctcgcgcggcacgggggcgagtccgaaggccgcgtccagccgttgaatctccgggatgtcgtccaggcggatgcccgtcaagtcacggggcacgaccaccagttcgccgccgggtgtcagcccatggcccaggcggacggtgagcgtcgtgcggtcctggctgggcgtgacggtcagcccgtgcatcaccccggtgccattggcgcgtgagaggtcggcctgtcgcgtgaggaagtagttctgctcccgcgtgaggtccttcgcggtgaggaagcgcccgtcgaagaagaaagagcgcacgcgccggtcgtcgtgcaccattgcccgggcggtctccagcgcttgtgccgtctcccaggtgagcttctcccgggcgggtccactggttgggttgaacacggttatcccccttcgagagagtcgggcctagaagacgcccatccaccgggcgagcgctgcggtcgagaggctgaagggcctcaggtcattgtcgacgtagacattcccctgccgcgtgggccgcacctccgtgccgcgcacgtcctcaacggcctgttgctccgatgacgacgcgggcgaggaagacccacgcgggatccctcatcttgaggtcgggctgggtcgggtccgtcagcagcgaggccgggatgaaggtgtcactccacagcttcgccagctcctgttcgcggctgcctcgccaggcgttgaagacggcctgccgcagcttgatgcgtcgctgcaccgggtctggttcgtccacggggtccgggaaggggctcttggggacctccggagggggatacgccgtggagcgcggcaccagtcgcagctcgtagccgtcgcgaatgcgcgaagcgaccacggcgtccattgcgtcgaagggccccgccgcgaaggcaggcgtcttgccgcgctcgcactggaggaaacgcaggaagaggtccgccaccacccccgtgggcggaaatcccgcggcatcggggctcagccggtactcggcgggcgtgaagacgccgaagtcggccatctccagcggctcctgccagtaccagcggtccagcttgagacacgcgtcagtgggtacttccaccaagcggccgaaggggtccaacgcgagcccggcggacacccggagctcctcatgctccggctcggcgccctcgtggtgactcaccttgagcccagccaccgtcccgacgccgtggaggtacgccagggcccgggtgagccggcctcggtgataggtctgctcggcggtgaagtctcccgcgtccaggagcacgccggtgtcgtagtggagccggtctcgcgtctccgcgtcgagcaaggcgtcattcgggggcgacatggtcatcaacctccttccaatctggggtccaggctcgacgggcgttcaatgacgtccgcgagccccagcacgctgtggcccactcgcaccgaggtgggggcgggggcgggtccgacgtaggtgtccacgcccaccagcgacgcgactccgacgagcagcggacggctcgcggtgatgacggagacctgcacgtgcgcgggggcctcctgctccgccaccttccggatgaggcccagggtccgcgtgtccgtgccctggtgcaccagcaccgtgagccggtgtgccagccgctccaggagctgctccaccgcctccgcctccgcccggctctgcagcgtttcgtccccgaagacggccaggaactccttgcgcgcctcatccccgaggaagagcgtgtcgcccacgtaggagttcccgctccgggccaggcccggtagcaacgggtcctccgtgtccgcgaggtccgcgccgaggatggtcgccagcgtgcgccgaagccggaagtcctccaccaccaccaccgcgcctcggttcaccgcgccgtcggtgacgaggtccagcgccaggcgcaggccctcgacgcagccgcgccgccgggcgagcgcgggcgcggaccggagcatcgcgcgccgctggctctcacccaccacggggtcgaaggagaggcctacccagctcgcgagccactccagcgaatcaccaggcacgtgccccgggtcggtgagcacgtgcgcatgggcgatgcggtcctcgatgggcgtcagcacaccctcgacgatgccgaggaaacgctccaggaagtccgcgggagtcgcccggccggtggtgtccgcgtcctcgccgaagagctcctcgcgatagagggacggcaggtagttgtccacgtaggagaagcgcgatgcatacgcgcgcagcgctcccacttcgggcgtccggcggccgtcgccgaacagctccacccgcacccacaggtaccgtccggagagcgcacgcaccttcgcgtgggcgcgctggatgaggacggtgaacaggccactctcgcccggggccggcggcgcgggcagcattcccggttggaacggcacctccgacggaagaggcacccagctcccgtgcgggacgtctggatgaacaggggcttccgggatgaggcccaggcgatgctcgtgccagtgcggcgagtcgctcggcggagccaggggctcgtcggtggcggcaagccagacgcgcaccccggtgcgtgggggcagcagcgcctccacgtacaggcggtgccacaccgtgcgcccgtcgcccgagtcgaagggccggttcggcgggttggcggcgctgccccgctcggcgcaccggggcagcgacagggcttgaagcggcactggcgccatgtcggccagccccgggttgacggcgtggtgcggaggcttcgctccctggagaaagggacccccgtcatggccgggcaggggaaagtagtctccctggggaatcgcctccgacgcaccagccgggagcgcgtaggccaccgcctccaccttgccgtcgtcgagcagcgacagcaccgcggcgcggccgtccggaaggatggcgagactgaagggccccagcacgcccgggagcgcgacgggcgtggagaaccggcccgagtagaagcgcagtcgcgcgtgccccgcgtttgggggcacacccgcgagcgccgggtccatgacccagctcagcaccgccagccgtccctcggtgtcacaggcgagcgccaccggcacttcgccaggccacgcgagcgtctccagcacccgggtccgaggcgggtccgggttctcttccatcgggcggaacaaaccagcgccggagggaatggacaggacgtccagaagcggctgcccgtccatccggccgagtacggcgggaggcgcgttgggcgcgaaggaaggcggaccgctcaggacgtaggcgccaccccgcgggtccgcggcgatacggtgcgcggcgagcccctcggccgggaacaccacggcggaccacaccttacgcaggtggagcgccactacgcgctgggccaccgcgacgtagaggatgccgccagctccaggcgacaggtccgtcaccgcgccggacagccctacctgggcgggctcgaatcgcagggtggtgccagcgcctccgcccgccgcgcgcacctgcccggccacgtcgtcccaccaggcccacgtgccgaaagcatccaccgcgcccggtacgcgagcgagcctgggctccagcaccgcgaggtcgagtgcttcatcgaaggtgcggctctctcccaggcttcccagccggagcgtcctgcgcttcgcgtcgtagagacacacctcgcccgcggagaccgagctctccgtgacccagtccggcgcatccgccagcatgtagaaccggaggcggttggcgtccatcagcagacctcggggaccatgggcaccgccacgcccgcctgcgaggagtccatgccaccgcttccctcatcgccgatgccgtggagcatcgtcggcacctctccgtcggcattcaccgccaccttgagcagctccgggagctgccagtccgcgatggacagctccaccggtgtcgtcgcggtgcttcccttgagctggagccagctcgggttgaccgggccctcggcctgccggacggacggagcagggggctccaccgtgaagcgcgccacgtcggccgtggctccggcgcggcgagggtctctcagcacgcgcgttaccgttccccaggcgaagaggttcaccccggcgatgctggccaccccggggacctgcgccaccgcgacatagagctcccggtcctggacatcccggcccagcggccagccctctccggtggggcctcccgccggcagcgggaagatgaagcggcgcacggcctgccgcaccgcctgcaccaccgtctccctgccaaagccctcacgcacggtgatgcccacgccgagccccagtgggacgtattcgcagccaatcacgtagagctcggtggtgagcggccggcgcgcatccaggtaggcatggacggcttccagcagcggccggtccgcccgcgggtagggcggctccagccgcgtggccgtgggcaacaccatgacggagacgacaccgggaacaccgtctcgccgtcgccttggctcgaagcggggcagcacctccacgcgccccaactgcacgccgggggtgctggccgcgagccgccgatagtcctcctccgtcacggcccggtccacgtggcgcagcagcgcggggatgcggcgctcggcctccgccagcgtctccgcgtcccggccacccagcgtgggctccggctgttgcacccgcagccccggcgcggggcttccatcgacccggaaggcgctgatgtccttcaagctgccaggcgggaggtttcccgcggcgccgccaccgctgcgcatccgggccaccagcacctgggcacccgcgggaggcacgcgtccgcgcacgccgtctccacagcgggcggcgcctgcctcggagtccagggcgtagacgggctcgtcgcggcgggccagcgcgaggtcttcgatgagccgccactcgcggtagcccgcccctggctcttcgatgaagagctggaacgttgcgcgctccacggagccggagggcaggcgaaac

SEQ ID NO: 777 - DNA, 6655 bp, Myxococcus xanthus
tgtccaaagcgggagaacttcgaggcggcgattacgccgaagacgaagatggtgtgggtggagtcccccaccaacccgatgctcaagctcatcgacctggcgcgcatcgccgaggtcgccaagaagcggaacatcctctccgtcgccgacaacacgttcatgacgccgtacttccagcgcccgctggacctcggcttcgacgtggtggcgcactccaccaccaagtacatcaacggccacagcgacgtggtgggcggcttcgtctgcaccagccgtgaggacgtggcagagaagatgtacttcctccagaacgcggtgggcggcgtgtccggcgccttcgacagcttcatggtactgcgcggcgtgaagacgctgcacgtgcgcatggaccgccacgcctccaacgcgatgaaggtggcgcagttcctggcgtcccacccgaaggtgaagaaggtcacctacccgggtctggaggcgcacccgcagcacgcgctggcgaagcagcagatgtccggctttggcggcatggtgaccttcgacatccaggggggcctggaggccgcccgcaccttcctcaagacggtgaaggtgttcgcctgcgccgagtcgctcggcggcgtcgagtccctcatcgagcacccggccatcatgacccacgcctccattcccaaggagacgcgcgagcagctcggcatcaccgacggcttcatccgcctgtcggtgggcatcgaggacgcgcgggacctggtggacgacctgtcccaggcgctcgacgccgcgaagtagccgtcagggcctcgcgccccttcggtctccagggcctccccgcgctcgcctttccggaagcgcgcggaggcccttgtcatgtggaggcggcgtgctgatttgctaggctgcccgctcaggcagtgcccgcccctggagaccgacccccatgacccgagaagaagcgcagatgctggcgcaggcgttcctcgccgccaacggcagccccaacagcgtcgggcatcaacccgcagggcttcggcggcgtcgccctgggcgatgcgcagctctacttcgagtggcacgacaaggagcaggcgctggagtgcagtgccctcatccaccggttccgggacacccccaagccgggcatcctggagggcttccaagacgagcagaagaagggcaccgacactggcggcggcaccgtggacttcgagccggagaacaagtccctgttcctcagccgcacctacaccacggcgccgcagatccccatcttcaacgacgacatgaagcggctgatgaaggccagcctcgagtggagcagcaccgtcctgaaccgggtggcggaccgcgtcttcggacgctgatcctttgtcgcagtgcggcaaaatgaggggcgtcgcaacttccaggaccctgggacgataattccctcactggtagtccactccttccaaatcgcctggagccccccatgaaccccatcgagcgcggccggaaactcatcaacacggtccgtaccggtgccgagaaggccattgaccgtacgcaggacgccgtgggcaacgccgtcgacaacgtgaaggacgccgcggctgccggtggccgcaaggtcggccagttcgtggacggcttcgagaacgccgtctccggcaccgcccggggcgtgggcaacgtcgtcggcggcgccgcgcggggcgtgcaggagttcttcggcggtggcaaccagccggaccgcgtgcacgacggcaagctgctgggcgcggacggcgcgacgttcccgccgggtaccccgctggcggacatcccgggcgtgacgccggccaacaacccgaatccgcagtcgacgatcctctacgtcaacggcatcctgacgacgaaggaggcccagtcggagagcctgcaggccatcgccaacgcgacgggctcgcgcgtcgtcggcatccacaacgccaccgagggcatgggcgcggacctggcccagtccgtgaaggacaagctggacaagggtaccaaccccgccgtggacaccctggcggacgcgctctacaccgaaatcaaggccggccgtgacgtgcacctgatggcgcacagccagggtggcctcgtctccagccgcgcgctgaacgacgtgtacaaccggctgcgcatcgaagatgggatgtccaagcaggacgccaaggcgctgatggggaagatcaacgtggagacgttcggcggcgccgccgccacgtacccggacggcccgaactacgtgcactacgtgaaccgtggcgacccggtccccagcatgttcggcctgggccccatcccggacaagtggaaccccatcgcggacggtggcaagggctccaaggtccaccagttcaacgagttccacctgaacccgttcgacggccacagcttcgaggacgtctacctcaagaaccgcgtgccgttcgaccaggcccgcgaaggcaacttcaacaagtaagcaacccatggctaccgctccccgcagtggcctcgctggcctgctcaggtcctggatttcgggcctgggccccgctgctccggcggatacgccgctgacgcgggagtctgcccagcgactggtccagggcttcctccacgaagagggcacgccgcccagcccgggcatcaatccccagggcttcggcgggctctccgcggggggcgcgtcgctgtacttcgagtggttggaggacacccaggcgctgaagtgcagcgccttggtgtaccgcttccgcgagccccccaagcccggcgtcatcgagggcttccaggcggaggagcgggagggcacggatgccggtggcggcaccgtggactacgagcgggagaaccggggcctctacctggcccgcacgtacacccgcatgccgtccgagcgcgccttcgccaaggagatgcgccggctgatgaaggtcagcatcaagtggaactccgaagtgttggaccgcgtcgcttcgcgcgtgttccacccggaggaactggaatccaaggacacgtcgcgttgaagtagcgcccatgcgctactttgaggacttccagcccggggacgtgagcgaacacggcccccacgtggtgtctcgcgaggaaatcatcgccttcgcgacgcagttcgacccgcagcccttccacctgagcgacgaagccgcccgcgacagcatcttcggcgggctggtggccagcggttggcacaccgcttccctgtgtcaccggctgttggtggacagcttcctgggacagacgtccagcatgggctcgcccggcttggatgagctgcgctggctcaagcccgtgcgtccgggggacacgttgcacgtgcgggtggaggtcgtctccgccacgccgtcgcgcagcaagccggaccggggcgccatcaagctccgcatggaggtgcgcaaccagaaggacgaggtggtgatgacggagctggccaacgtgctcttcggccggcgtccgtgaacacgaagggcctcccgtttccactgcggaaacgtggaggccctcggtgcttccctggcgcgagcgcgccggggactacgccgccgtgcggtgcaggtagtcgatgaggtcgatcttggtgacgatgccgaccaccttctcgccgtccttcaccaccgccacgttgtcctgagcgaagacttcgcgcaggcgggcgatgctggtgtcgagcgacagcgcgccctgcagcggcgcgatgatgctgtcgatggtgtcggagaacttcgccttgccggcgaccagcgcgttgagcaggtcgtactcgtgcaccatgcccaccgtgcggccgtcgtcgcccaccaccggcatctggctgatgccgtggccgcgcatcgtctcgaccacctggtcgaccttgtcaccgcggcgcgccgtcttcacgtccttgcgcttgtcgcccaggatgtcgcggatggtgccggcgcccttctcctccaggaagccgttgtcgcgcatccactcgtcggagtggaacttgctgatgtagctgctgcccgagtccggcagcacgacgacaatcgtcttgcccttgcccacttccttggccagctgcaccgcgacgtgaatcgccgcgcccgaggagccgccggcgaagatgccttcctcacgcgccaggcggcgcgcggcgatgaagcactggcggtcatcgacctggcgcacgtcgtccaggtgggtgaagtccatggcgccgcacagcatgtcctcgccgatgccttccaccttgtagacgtgcggctcggtcagcttgcccgtcttgaagtagccctcgtagacggagccctccgggtccacgcccacgttcttgaggccgggaatcttctccttcaggaacttgccggcgccgctcatggtgccgccggtgcccaggcccgcgacgaagtagtcgaacttgccctcggtctgcttgtagatctcaggaccggtggtgttgtagtgcgcctcgatgttgtcggggttgtggtactggttgagcatgaacgcgcccggcgtctcgcggtgcaggcgcttggccgtctcgtagtagctgcgcgggtcctcggccggcacgttcgtcggcgtcaccaccacctgcgcgcccagcgccttgaggcggttgatcttctccagggacatcttgtccggcatggtgaagatgcacttgtagcctttgacggccgcggccagcgccacgcccatgccggtgttgccggacgtgttctcgacgatggtgccgccgggcttgagcttcccctcccgctcggccttctcgaggatgtagagcgccatgcggtccttgatggacgcgcccgggttcatgaactcgcacttgaccagcacggtcgcgtcgttcggcccgacaagcttgttgagcttgaccagcggcgtgttgccaatggcggtgaggatgttctcgtggatgtccatcgcggcttccgtaagttaatgagggttcgcggcgcgtcttatatgccgccgcactggcccggtcgacagcgtgtggcctcttgcgaccccggagagcgttgaacccgccccggagggcggggagttccgacgcacccggacgaggggggaggatggctggccgcccgtcgggttggcgacagcccggggggcatccggccatccgcccggacaggcctttgacccggatgggcgcgcctccgatactcgtgtgcgacttgcgtcaaccccctccggagaaccccgtcgatatggaactcgaggccgccctgcgcgaccaggtgggacaggccatgggccgtcccgttcccaacgcccccatcacgaagctgaagggcgaggcgagcagccgctcgtactaccgcgttggcgcgccgcccgagagctgggtggtgatggtgatgccgcccgactcgacgaagaagagcgacgaggccaccaagggcgagccgcccaaggagctgcccttcatcaacgtgcaccgctacctggagaagctgggcgtgcgggtgccgcgcatcctccgctacgacgagccggccgggatgatggtgattgaagatttgagtgacatcaccttcgagtccgcgctggagggcggcaagcaccacgaggcgctctacacccgcgccggtggacctgctggcgcgcctgcgcccggcggcggagaaggcggaggacccggactgcctggccttcacccgcgccttcgacgaggacctctacgactgggagctgcaccacttccgcgagtggggcctggaggcgtggagtggcaagaagcccacggacgccgagcgcgccgaactggacgccaccttccgcgacatcgcccggcagctggccgccgcgccgcgtggcttcacgcaccgcgactaccagagccgcaacatcatgatgaaggagggcgagctggtcgtcatcgacttccaggacgcactgcagggcccgcgccagtacgacctggtggcgctcttgcgcgacagctacgtggagctggatcgcgacttcgtggacgcgatgctggaccgctacatcgccaccttccaggaggtgagcggcgagcgcatcgacgcggcgtccttcaaggccttcttcgacctgctcaccatccagcgaaagctgaaggacgcgggccgcttcgagttcatcaaccgtgtgaagggcaacccgggcttcctggtgtccatccccgcgtcgctgcgctacgtgcgtgacggcttcgcgcggcggccggagctgcgcaagctgcaggacctggtggcgaagtacgtcccggagctggcggcctgagatgaaggccatggtcctctgcgcgggcctgggcacgcgcctgcgcccgctcaccgaacgctggcccaagccggcgatgccattcttgggacagccgctgctgcgctaccacctggcagtgctgaaggccgcgggcgtgacggcggtgggcatcaacacccaccacctgccagacaccatggaggcggtggcccgcgccgagtgcgctcgcgcggggctgccgctgcacgtggtgaacgagcccgtcatccagggcaccggcggcggcatccgcggcctgcgggacttcctgtcggacggcgacttcatcgtcttcaacggcgacatcctctacccggtggacctgcggccggtggtggccctgcaccaggcgtccggcgcgctggccaccatggtgctgcagcccatgccagcgggg

SEQ ID NO: 778 - DNA, 4779 bp, Myxococcus xanthus
gggtgtggacacccaaacaacagggcccaccgccaaccccgcgaaaccgcgggcctgagtgcccggcccgctacgtgctaccgccggagccaccgagtcccttttcgctccgaggtccacgctccatgtcgcccttcgcgcttcgcccctcctcgcgctccctgcgggccgcgctcctgttcctgaccgcgctgctgcttccccaggccccggcccgggcggagcccggcatccgcatcctgaactcgctccgcgccgaggagctggccttcaacgcgctcaccagcaaccgggccgcgctggacgccctcaccgagatgccactgcactcgaagacgttcgtcttagacggtcggctcaagcacgcgctggagcacccacctgcccggaacgtgatggcgtacctcaccgagtgcgcgctgccgcccggcgccgccgtggagtggaccagccgcgccggcgacacgtacaccttccaaggcgaggtggggctgtgccccgggtgggagaaggacaagccgagccaggcctgcctgggctacgtgacggcctgtctcctggcgcgcaacaacgccttcggccgccgcgtgatggtgtccatgcgcggcgaggacccgagcgagccccggcgcttcaacccctcgggcgcccgcgaggagtggagccccatgttcctgccctgcgcgtcgggtgaggcgggcctccatgccgagtgcggctggctgggggagaacgtgggcacctgcaacccgggcgacaaggtgacggtggccgcgggcgcgcctcacccggccacatgcacgggccagttgggccgcatcttcggagaccgggtgctgcgcgtgtgcgaggacccgcggggctgctcctgggaggaccgtctggcggacacgctcagcaacccctgcggcggaatcgagcccagcgtcgagttcaagtgccccgagagcggccgctacagcgtcatgtccgcgccctacagccgcgccgcgattccgggttcgtgggtggccccggtggccacctccggcacctacccggccgggcccttcggcgcgtacacgttccgggagggcgccttctacgggaacatgttcgactcgcgcggcctgacggtggaggtcctcctcaaccaggacaccttccagcccaagctcatcaacctgcgcttcaagggcgtggtccacgacaacgtccacgcctgccacggccgggactgggtggacggcgacagccacctgcgctcccgcatctgcgccaacgccgacatcggcggcgagcccatcgccggctgcgtggcccgcgcggcgggcccctgcgagccgggcagctacaacccccgccccgcccgctgcaaggtgaacgacggcaccgcggtgtggggggacggcgacttcgagggttgcgcggacgcgcgcggcatcctgcacccggagcccatcaccgtgttcctgcgctccccctgcgaggtgatttcccccaaggagcagaccacctgtggggtgacgtgtgactactccgagttccctcccaagtgctcggacacgtgcaagctcaagaagtccccgggccagtgcctccagacggacgcgtgcctgaacgaccccgcaaagtgcccggcgccaccgcaacagtgacgcggattgaataaagcaggccgccaggcgtccaggtctccggcggccgcatccccggcccatcgtcaggagctgacccgtgttcccaatccggaccctgctgtgtgcccttctcgcgctcgcgctgggcctgggtcccacggcggcggaggcccgcttcggcaagcgctcgcggccgtcccagagcgactcgaaccgggacagggacagggatgacaaggagcacggggcctccgccatcggctcggacgacgacgacgacgatgacgacgcgccccgccgcccctcccggcggcgctcctcgagcaaccggcggcacgtgagtggcggctcgagcacggtgacggtgagctggctctcctacctcttcatcaccggcaaccatcggatgggcgtgtcgccggagctgcgcggggagcgccacgcggcggcggtgtccttccgcgtgggcatccagggaggaccgctcaacgaagggggcggcggcgccgacctgttcctcggactggagggccggcgcttcggcgtggacctgcggctgacgggcctgggcctgcccacggatgacggaacgagcggttcggattccatcaccctgacgcagtcgcacctcacctgggcgctcatctcccacgagcgtgcccgcctgcgcgcggaggccggtgtcagcaccgcgcacgcgccggacatcaccttcgtcggccccagcttcggcgcctccctggaggcctgcatcatcggccccctggacctggaggcgcgcctgcaggtgacgcccttcccctaccggcaggtggacgcgaacgccgcgctggcgttgaagctgggcgcggtggtgctgcgcggcggctaccgcggcatggtgctggacgacgccggctacgtggatggcgtctccaacgtcgacaccttccacggccccttcctgggcctgggcctcacctactgacgtccgctgaaatcctcacgcccgcgtgagcgcgcagccgcgctcacgcgggcgtcttcaccgcgccgctggccaccgggcagtgccgccgcgtcgcatccagcagcatctccagcctcacgggcttgcgcagcacacccgccgcgccaggcggcaacggaccggcctccgccgtcatcaccaccacccgcgtcccggcgaagcgctcatcggaccgcagccgctcgagcagacctcgcccgtccacgcgcggaatctcccagtcgagcagcaccaggcaggcggactccaacgccgcgagcacgcgaagcgcctccacggcgttgatggccatggacacctcgaagccctcgtcatgcagcgcttccgccatggccccccgaacgtccgggtcatcctccacaatcaggacctgcggctgcaccacgggatgagtcacacccggcaccctagttcctccttcgcgcccaggcacgagcgacttctccgcattccgctctctgtcaaagcatgagcatctgccgggcccgcgcatgcagatattacagcacgggcaatgccgccgcggcccctccggcaccgcgagccacacggcatcccagacaagcgcgcggcgtgagctttcaccgggtggcattcgcagcgacggcgaaccggcgcggtgtccggcgccacacagcacgcgctggtggacgacacctcgcgcctggaggcccatggtccctggggagggaaggcggttgtatccacccgcccccgaaattcccacgaggagtggaccttgcccgtatccaaggccgtgctgtgcgccgcgctcgcggtcagtgccctgctgggcaccgcccccgcgcaggcgcgcttcggcaagcgagacacctcctcggattcatcctcgtcacggagcacgtcacgtcaggcctcctcgtcccaggagtcgcgcggcgcccgggcccatcccgcgtctgccattggccagccccgcgagggcccggttggcaaccgccgcacgcacccggcctccgccgtgggccgcgagtacacgcctcggggtgacgacgcgcctcggcggcgcgccacgcgcgtgcgccggccgccaccgggctccatcgtcgcgggggccgtcatcggcgcaacccacccgggcttcgcctccgtgcggcccgcccagcgggtgatgcgcgagccagaggacacagtgccgctgctggtgcgcatgggcgtgcagggagacttgctgggcgacgccggagccatggggctcttcatggccatggatggccgccgcctgggcctggacgcgcgcatcaccgggatgtcgctgcccgcgacggatggctcggatgccaccgaccgcatcaccctgctgagcgcgcacgcctccgcggcgctgtgggcgggggagcggggccggctgcgattggagggcggcgtcgccagcgcgcatgcgccggacatcctcttcgtgggccccagcttcgccgcgtccgtggaggcttgcatcggcccctcgccggtggacctcgaggcccgcatccaggcggtgcccttcccgcaccgtcaggtggatgcccaggccggcctggccgtgcacgtgggttcgctccacctgcgcggcggctggcgggccctctacctcaacgacgccgggcacacgaccggggagaagcaagtcgaacggctcaccggcccgtacctggggctgggcctcacgttctgacgcctcgggtgatgctggccggagccccttctctcacgggccccagccagccggccgtcgcgcgctactcctcggacgcggcggccatgggcgccgaaccgccgcccagttccgccacgttggacgtcgcgggcgcggtgccacgcttggcgccgcgccgcttgggcggaggcgccagccgcggctgcgtgccgaacaggcgctcgtacgtctccggcgtgttgatgttcaccaccacgcccgggtccttcaccggcacgcggcgcaccttcatcgtcgccagcgcgggctccagttgctggccctccgcggcgcgcagccgctccgccccgctccgcgagagcaccagtggccagccaggcgcgccctcgaactccgggcgcagcagctcatccacgtcccccgccatcttcaggagcgacttgagcgtggacgcgcgcagcgccggcatgtccaccggatgcagaagcaccacg

SEQ ID NO: 779 - DNA, 7650 bp, Myxococcus xanthus
gcgggagagggggccgaccacttccgacagttcctcgtgctcgcgtccgtcgcactgaaggcccagcacgaggtccgtctggccggtcagcttccagagctccgcgctccaggtggcgatcagcagtgcatcgagggagcaccccagctcgcgcgccgccgcgtcgagccgcgacagccgctcgcctctcagcgtcaactcgagcgacgccgggtcgaacacctgcgccgcgttcgcgggcctttcaaagggcagtgtcaccgccgcgcccgcggtggtcccgtgcttctcccaaaaggtggccgcggggtggtctcgctccgtcagctcctcgcgcagctcgttctgccattcagagaaagagaggtgagaggcaggctctccgtcctgatcctgttcctgggcttgccctgcaaggtctcgttgcagctccgagcagaagcgccgcagggtggcggcgtcggcgcacagggctggcgccaccagccccagcaggtgctgcccggtgtccaacgtcatcaggctcacgcggaggacggggccggtgccgagctcgaaagggcgctggctcacctgttggaagtgggcgagggcgcgttcctcgcgcgtggtggcggggaacgcgcggaaatccacccggtcccactccacctctccgctcgccgtcacctcctgcacgggggcgtccagtcccggcaggctcgggaagcgggttcggagcggctcatgtcgcgcgacaagccgcgccaccgcgtgctcgagggcaccgggttgaggggagccctcgagccgcatcaatgcctggacccggagcgtctggtgcttgccgtgcaaccgccacagacggagctgctgaggagagagccgatacgcttcgatgctcaattgcgaactcccatcatcttccggccagcaccgcttgggaggatgcgccgttccattgacgcaccagcgcttccatctgccccacgtagttccgctgctgggcgcgcttcgtctccgaagagacggaggcgatctccagcgcaaggagctggtgggcaagccgcatcagcgccttgaactgctccgtctggagccccctcccgagcaggtaggggatgatccagaagtcgaatgaccactgcggcaaccaaacggagtccttcaccgtgaggaacatccggtcgatgtgatccatcgcctccaggctctccatggtgtcgtgccgccagatgaacccctggccggtaatcccatactgctgccgctttgcatccacggcagtaccgggttcgcagtaccaaagctgtgtgcggtagtagtccggccgcgtctcctggatgaacgcgagggtctcctcgaccgtctcttccgtctcgccggggaagcccaggatgaatgacgcgaaggtgaggatgccgtgggcatgcagccgcttcatgccgctcacgtatttctcgaccgtcgcggccttgttcatgttggcaaggattcgcggcgagccggattcaatcccaaggaagacgccgcggcacccgctctgcgccgccaggtccacggcctcgtcgtccgagttgctgcaccggaaataggagaaccagttgaagccgtagcggcgctcgatcagcaaccggcacagttccttgaagcgcttcagcggcacgttgaacgtatcgtcaatgaagacgacgttctgggtgcccagctcggccatcgcgtccagttcgcgtgccaccgcatccatgcccgccaaggtcaggctgccagcacgcatgggataggcacagaacgagcaactgtatgcacagctccgggcggtgcgggtctggagcgtggggcccagggggctctccgccatgccgcgccagtcgatgatgttctcatcgagggagttgctttccgcctgcggtgggttgatgcggtagcgcccggcgcggacgggccctccctcggcggggtagatgaggttggggacgtcgctcagctcctggcccgccttcagccggtcgagtacccgcgagagcgtgagttcgccctggctctcgacgacgtagatgtccgcgccgaggtcgtcgagcaccaccgcgagctcattcccctcgtagcgccggtgatggttggaaaccagcggaccgccgacgatgatccggacgtcggggttgtgctggcggatgaactgcaccatctcgatgacgggatcattgaggacgtagaaggtggtggtgatggcctccgtgcgagggttttgagcgagcaggtgggccaggcgctccttctcgtgctggaacaggttgaggtacgtcacgtcgtggccgcgccggcccaggaaaacacaaacatagacgggatagaggctagggatgcttccagagcggaacgccgcgtgtggcgtccccgaggggagggctctgcagtacacgtggttcagcaagtccacgtagttgagccgcttgccttcgagctcgatgaagctgaacttcagatcccgatacgcttcggagtcctcgccaaagcgcctgattccggcttcgtactcgtcgaacggggtctcgttgtacccgatgacgatgcaatcgcgacgtgtcgactccgccatgaccgctcccctgtgcttcggccgctgccgccggatccgcctcgccacggtgagctggggctgcttccggggtgggccgggagcgctcccctctaccgctacctgtgaattgcggattttgcggaattctctcagacgccgctacctgattcaacccgcgccgggggcgcccactcctggagtccctccatcaacgcacagagtctctgtccggggtccccgaggagacgctcgagcacgtactgcatttgcgccagcgcacgggtggccgtgtcttcgtcaatccgatcgcgctgccagccgagttcgagcctcagtggtgggcccgggactgccacgagtgacagcgggtagggccagcgatcgatgattcgcatggcctctaccgtgaaccccggcgccgtgcgctcgaggacgaagcggatggggtagttctcgaagcggaggacactgtcgaacaaggggctgtcgtccggcagcccggtccaacgcctcaacgtcgagagtggaacgtggccgaactggcgctgctcggcctgttgcgcttgcaactggaccagccactcgaggacgggagtgcccggtacgagccggacgcgcgtgggaagcgtgttgatcaggtgcccgaccatgtcctccacacccgggaggtccacggggcgcacggccgcggtcaccccgaagacaacctcctcggtgcgggggccattggccaggaccagtgcccacgcaccttggaccagggtgttcagcgtgagccggtgtgtcctcgccagttcctggagcgccattgtggtggccggcgccatctcgagcgttcgttccgcataccgcgcatgctccagcggtcgctgcccgccggctggggcgagggaggtcgccggtggtccggccaaacccgccaactcgcgccgccagtattcctcggcgcgccagggctgctggcgctgcaaccaggcgacgagttcccggaagggggggcgcggtggcagctccacggggacaccgcgcgagaggcttccgtagaccgtgaacacctcttctagcagcagggacatgctccaaccgtcgagcatgccgtggtggctgctccacacgaggtggcacgcctgaggcgcgagctggatgaacgtgaaccgtagcagtggcggccggtctgtgctgaagccggcctcgcggtccgcctcgaggaattgctccagcaggatgtgcgcctcactgtccgttcgcttcgtccagtcgagccgctcgacggggagcgagggggcgcggtggacgagctggtggggctccgccatcgactccatcgccaccgagccacggagcgccgggtgccgctccatcacacgctggcaggccgcgacgaaggcttctggcgagaaggtgcccaccacctggcacgagagctgggtgaagtaagcccacgccccggggtgggctcgcgtgtgttcgaacatctcgcgctggccaagcacgagtggatacacgtcttccgtgccaggcgcctccgccagcaggcgctcaagagacaccggtgccagccgtgcaagcgggaatcgggccacgcgctcccggtgcccgcccgcgcgcgcgagcgcgacgagctcccggaggacctggaggaagcgctccgcgagtcgggcgattgtcgaggcgtggtggcgggcctcgctgtaagcccagccgatcctcaaccgaccggcgtggatgagtccgttgacttcgagcgcgtgggtgcgcggcgccaaagggctgacggtcgggccaggggactcttccgcgggttgaaagaggccgtcgcccgcgaacacctgatcgaattgccccaggtagttgaacagcacctgcgctttgtccgcgggggggccaccggcgtcatcctggcgcaggtagcgcaagacgccgaagtcgatgccctggttcgggatgcgctggagctgggccttcacggactccagcagctccaggaggccgtcacccgcgggggcttcgagcaggacagggaagatggaggtgaaccaccccaccgtgcgagagaggtccacgtcatcgaacagcggctcccggccatggccctccaggtccacgagccaccttcggccccccgtccagttcgccagcacggaggtgagcgcggtgagcaggacatcgttcatcccgcagcggaacgcttcaggcacctcgcggaggagcgcggacgtctcctcctcgccgagttccacggtgtacgtccgggcgtccgcggcggtgtcgctggcggccgatgctccgggcaggtcctccgggagtcttgccacgttggagcaatccatccgccgccagtagtcgaaggcgggggcggcggaggctgcgtactcgcgcagccgtttggaccagtgctggtacgaggtggtcttcgcggggagatggatttcgcgtccctgaaggagggactggtgcgccgcttgaagatcctccagcaggacgcgccaggagaagccgtccacggccaggtgatgggcgaggagcagcaggcgccccggcttcccttggccgaggtcgaaccacacggcccgcagcaatgggccctgttggagatccaggcgctcttgcaggcttgccgcagtggcctccagctcgcggcgctgatgttccggggacaagccagagagattgaacgtgctcacgactggcgcgcgctccagctcggcgcagcgctggagccagccatgcccggtttcttcaaagcgcagccggagcgcgtcgtgatgggccaggagcgccaggagcgccggcttgaggaggtccgagcggaaggacgcgtgggtttccagcagcacagcctggttgaagtggtggggggcgggttggggctgccggaagaaccagcactggatcggggtgagtgggacgtcgccattgaccagtccctgctccgcgatgatggacccaccggtacccgacgccgcagcgagttcatcgaacgtctggtgatcgaagagttgcttcggggtcaggtgcaggccagcccggttcgcccggccgataagctgcacgcccaggatggagtcgccgccgaggtcgaagaagttgtcgcggatgccgacccgttccaggcgcaggagctcggctccgagggagcacagcagggcttgcgcacgggtccgaggcgcgacgtacccgtcgtgggactcgcgtgcgatcgcctcaggcgcggggagcgccctgcggtccaccttgccgttcggcgacaggggcagtgcgtccagtggcaccaccaccgaggggaccaggtgctcggggagcttcgcgcgagcgagctggcgcagcacctctggctccacgtccgcgccttcgttcggtaccacgtaggccaccagccgcttgctgccctcgatgtcctcgcgcgcgaccaccaccacttcgcggacgccgggggcctggccgagcaccccctcaatctcgcccagctcgatgcgatatcctcgcaccttgacctgctcgtccctgcggccgaggaagtccagcactccatccgggaagcggcgcacccgatccccagtccggtacagcctggcgccagggacgtcgccgaacggatccggcacgaagcgctccgcggtcagctccggccggtcgaggtagccgcgggccacgccgtccccgccgatatagagctccccatgcactcccaccggtacgaggcgcaggtgctcgtcgagcacgtagagccgcgtgttcgcgatcggccggccgatcgctactgaccccgtgcgggcgtcatctggcgttgcctcgtggacgcagcagcccaccaccgtctcggtcggcccgtactcattgatgagccgtgtccctggtgcgtggctcctccagggctccagcgcttcggcactcaaggtctccccgccaatgacgagcgctcgcgcctgtccggccagcgccgccgcgtcgagctgccgcgcgagcagcctcaggtgtgtcggcgtcagcttgaccaggctgaaatctggcttcgagcggagtgccttggccagtccctccagccggtcgtcctctgggaccagcgtcaccgtctttcctgccaccagcggcgcgaggaggctcgtcaccgtcaggtcgaaggagatggaggaatgcaccggagcccccgagccctccgccacgcggtacgcgccggtgctccagctcaggtagttcaccaccccccggtgttcaatcatcgcccccttcggcgtgccggtagagcccgaggtgtagaggacatacgccaggtttccggcggtgacagggacctccagattcgacgtcgcctcgcgcgccagcggctcttggtccgcgtccaggcacagcagttgctctccctgcgaggggagcctatcggcgattcgttcgagggtgaccagcactggaacgcgggcgtcccggagcatgaaaccgagccgctcggaggggtaggtggggtcgagcgggaggtacgcaccgcccgccttgaggataccgaacaggcccaccaccaactccggaccgcgctcgaggcacaggccgaccaccgtctcggggccaacgcccatcgcctgtaggcgcctggcgagctggttcgcccgctcgttcagctcgcggtagcggagcgtgaagccttcgtgaaggaccgcgagggactcgggcgtccggcggacctgttcctcgaagagcgtatgaacgcaggctgcgtgggggtactccgtccgggtgtcgttccagacggcgagtaattgctgctcctcgtccgcggacaggagcgggagcgcggagatgcggcagccaggggatgccaccgcgcccgccaggagccgctggtagtgcgccaccatccggcgaatggtgcctgcatcgaacagctccgtgctgtactcccacttgcactccagcccccgcggcgtctccgccacgaagacggtgaggtccaatttcgcggaggcctgttccacctccaccggctgaatcgtgagcccgggcagcgacagctccgagagcgccacgtcctggagcaggagtttgacttgaaagatggacgcatggcccccgctccgctcgggattgagcaccttgac

SEQ ID NO: 780 - DNA, 5147 bp, Myxococcus xanthus
ccccggggcgccgacagtggcctcgcgggtgacccggaacgtgttctggcattttgtgcaccggaccttgacccccttctcggccaccttctcgtcggggatcttgaaccgcgtctggcaccgctcacacttgacgatcattcagcaggcccggctggaagcacgagtataggacgacggggtaggcaccgcgagccgggttcacgttgcttgctcgcccccaccccctctgctacgagaaacgcccctgcgagactcaggcggggcacgtggcttgatgtcgagcccaaaaggggcggagagacacatgagcgaggctgagcaagcaggcgctccgagcaaggagccgaagatcatcaagcggtacacgaaccggaagctctacgacaccgtggagagccggtacgtcacccttgatgagatcgcagcgatgatcaaggagggcaccgaggtacggattgtcgacaatcgtaccaaggaggacctgacctccgtcaccctcgcgcagatcatcttcgaagaggagaagaagaagaaccagatgccgctgtcggtgctgcgggaaatcatccgccaccccggcgagtccatctccgggttcatccagaaggaggtctccccgcgagtcgcctccatccgcgaggaggccgagtcccgcctcgacaagctcctgcgccgggacgagaacgccccccgggcagagggagagcccgaggcccccgtcgccgccgccgaggacaccgccgccgcggacaccgctgccgccgcggggctcagcccggccgacctgctcaaggccagccagcgcgccttcgaggagtggcagcgccgaatcgacgagcgcgtgaagcacgtcgtggagaacctgaccggcaacctgcccgcgctcggccgcgacatggcctcgctcacccagcgcctcgatgagctggagaagaagctggagcaggccgagcagcagaagggcccgccgacgcaggagtagccgcgcggcttcaggccttctgtgacgcccgcctccgcttgggggcgggctctccgtgcaactccgcggcgatggcggccagcatctgcgcgcctcggctgcgcggcgcgtactcccagatggtctgcccgtggctctgggcctcgtcgaccttcacgtcgtagcccagcggcgtggccgccagcgcgtccgggaagtaggccttcaggcgctccagaatcgccgtggccagcgccgtcttccggtacagcgtgggcaccaccttcgtgacgcggaggtccggccgcccttccgcctcgcccacctggcgcacggtgtccgctacctccgcgcagccatccagcgccaggtacgtcagcgccaccggcaccaccacctcggtggcggccaccaggatgttgcgcgtggtggtccccatggagggtggcgcgtcgaagacgatggcgtcatagcccgccgcttccgccgcgcgcaggcggtccgccagccggtgggcccgacgttcatccgcggccaccacgacgggaaagtccgccatctccttgtacgcgggcagcacgtcaaggccctcgagggccgagcgctggacgacgtcctcgaagcgcaccgacgtgtccgtcagcaggtgaaacacgttgcgcggcaaggtgcgcacgtccacgcccagggccttgcccgcgtggccctgcgtgtccaggtccaccagcagcacccgcaggccacgctccttggccagccaggcggcggtgttcaccgccagggtcgtcttgcaggtcccacccttctcattgatgaacgcgatgcgcctcatgcgtgggcactcctcatccaccgagaaggtggcggcttccgacgtgcggactacttcttcggggacttcgccgccagcagcgtgtcgaccttgccctcgacggacgagagcagacgctccaagtcgtccaccttcgaacgaagctgctccaggtccgcggtggacggcaggttcgcggcggacagggccgtgcgcagcgcgctgtccagggtgcccttcgccgccagggagcgcgacaccagcgtctgcaccgccgccacgaacttctcgttcgagagcagttgctgcgccagcttgccgatgcgctcctcgcccgtttccacgagcttcttcatcaccgggttgttcttgagcatgaaaacgcgcgtcctcgcgagcaaagccctaccgggccatctggaagtcttgaagaaaacgccgcactctgcgagggggcaacgcgacgtgtcaagcagcgcaacaagccgaggccaaacgcgttgactcccgtgaacacgattcctacggttcgccgctctcaacctatggccggactactcgacaagcgcctgtggatcgtctccggcaagggcggagtcggcaaaagcaccgtcgcagcggccctggccctgcgctcggcgcgcgcgggcaagcgcaccctggtgtgcgaagtgaacacccaggagcgcgtcagccgcttcctggagcgccccgaagccgggcccgaagtggcccaactggagcagaacctctgggccgtcaacgtgcggccccaggaggccatgcgcgagtacggcctcatggtcctccgcttcgagaccctctacaagacggtcttcgagaaccggctggtgcgccagttcctccgcttcatcccgtccctgcaggagctggtgctgctgggaaaaatcatgttccacctgcaggagaagctcccggacgggcgctggcggttcgacaccgtcatcatggacgcgccggccacgggccacgccatctccttcctcagcgtgccgcaggtgctgattcagacggtgccgccggggcccatggcccgcgaggcccagaagatgcgcgacctcctcgtggacccggcggtgacggccgccgtgctggtggcgctccccgaggagatgccggtgaacgaggcgctggagctgcacgcggcgctgcgggacaaggtgagcctgcgaacgcacgcggcggtgctcaaccaatcctttccggagcgcttcaccgaagcggacctggaggccctggggggccatccggagctgctcgccgtggcccaggcgcaccacgaccgcgcggcacaggcggtgctcgccgggacgaagctggagcgcaacctgcacgcgcccgtctaccccgtcccccggctcttcacgcccgagttcgggcgcaaggcgattgaacaggtcatggagcacctcgaacctctcgtgacgggggcggcgtgagcacgacggccctgtcgcccgcgctggcgggcaagcgcgtcctcatctgcgtgggctccggcggcgtgggcaagacgacggcggcggccgcgttggccctgcgcgcgtcggtggatgggcgctccagcctggtgtgcaccatcgacccggcgcggcggctggccaactcgctgggcctcacggcgctgggcaacgcggagacgcgcgtccccgccaccgcgctggagcccctgggcgtccagccccgcgcgtcgctgtacgcgatgatgctggacatgaagcagacgtgggacgagctcatcacccgcgtcgctccgcccgagcagcgcgagcgcatcctgtccaaccgcttctaccagtcgctctccacggccctggcgggcagccaggaatacatctccatggagaagctgtgggagctgcgccgcagcagcaactacgagctcatcgtcctggacacgccgcccaccgcgcacgcgctggacttcctggatgcgcccaaccgcgtgctggacttcctggacaacgacgcggcgaagtggctcctcaccccggcgctcaaggccggcaagctggggatgtccctgttcaaccgcggcggctatgtcatgcggggcctggccaagttcaccggcacggagatgctccaggagctctccaacttcatgctcgccatctcctcgctcaacgagggctttcgcgagcgcgccaggggcgtgcgccaactgctggaggacccgaacaccggcttcgtgctggtgacgagcccccaccccgagcgcatggaagaagccatccacttccacaagatgctcaagcagcaccgcatggaggtggtgtcgctggtggtcaaccgcgtgcaccccatgcccacggaggcgctgtgggcggacgcggccacgctgacgcccagccgccgcgccaaggtggaagagacgctgcgcgagcagcaaatcctggccgagcaggaccgcaccggcatcgaccagctccaggccgcctgtccgggtgtccccatcgtccaggtgccccgcttcgcgatggatgtgcacgatatctccgccctgtggcgtaccggacgctacctggtaggcgacgagacactcggctgaccacggcctggggcccacacgcttcgggcccaccgccgcgtttccctgtttcgcacggtgcttgtgcgaaatcgccgcacttcttcagtccagccgtccgcgggaagcagccggccagggaagcgcgcacgggtcgggcgcattaagctggcgggcccgatgacggtggtgggaaccccgcggtgcccggtgctgtccgggagggggtgccggtccaggaggatgatgtggtgaacgggagagcgctgaagcagaagcctgtcagccgatggtggtggatggccgcgctgggcgtcgtcgtgtccgggtgccggacgacgggctccgccgcgcgggaggagccgcaggcgaagtcgcccaagcaggagttccacttcgacgcggtgacggtgacggcggacctggagctggacaagctcaacgacgaggagctcttcgcgggcggcacgtcggccttcgccgcgaacgatttccaacaggcggcgcgctacttcggccggctcgtggacttcttccccgacagccgccaccgccgcgcggcgctctacaacgcgggccttgcccaccagcgcatcaaggagtgggaggaagccggtcaccgcttctccgagctgtcggacccggccaggggccagggggacgcgttggacgcggccttccgcgtggcggaggtggactaccacctggagcgctacgaacaggcctcgaagctgctgggcatcatcgccgcgcgcgaggacctgcccctcaatcgccgcctcgaagcgcaagtgcagcagggcatctgccagttggagagc

SEQ ID NO: 781 - DNA, 6260 bp, Myxococcus xanthus
cgcggacgtggtggacttcaccgtgcccaagggcacatccgggcgtggcctgggcacgctgctcgaatcgcattggctgatccgcgacgcgcgggtgtggcgctggcacctgtaccggcgcggcagcttcgcccccaaggcgggccgccatgacgtcagcgcctccatgacgctggccgagctgtccacggagctggaaggcaaccccattcccgaggacgttccgttcgtcgtcgtcgagggctggcgcctgcgcgacacggacgcggcgctcgtggccgcgggcttcatcaagccgggcgcgtacatcgccgcggccagcaagcccaagaacttcaccgcgcccttccccctgccctccacgggcacgctggagggctacctctacccggagacctacggcgtgattccgggcaagttcgatgtcgaggcgctcatccagcgtcagctggacgccttcgcgcagcgcttcttcgcgcccaaccgcgataccatcacgaagagcggtcgcacgctgcacgaggtggtggtgatggcctccatgctggagcgcgaggagccgctgcccgaccagcgccccctggtcgccggcatcctgtggaagcgcgtggacaagggattcccgctcggcgtggacgccacgtcgcgctacgagctggcgcagtggaatgaccgcgtcgccttcctcaagcgcctgcgggatccgcaggacccgtacaacacgcggcacaagaagggcctgcctcccggccccatcggcgcgcccaccgtgtcctcgctccaggccgcgatgttacccaagccgagcgagtactggtactacctgcacgacgcgcagcgcatcctccgcccgtcgcgaaacgcggaggagcacgaggcgctccgccgcaagtacaacgtgtactgaggcatgaactcagcgcccctggaacacgggggcgcgccgcgcggctgccgcggccagtccctcgcccaggtcctggctgccgtagctctccgcctgaaagcgcgcctcctcctccagcgcgcgctgaagctccgccctgtcgagccccagccgctgcttgagcgcacgcatggcgagcggcgcgttcgcggcaatccgtcccgcgagttccctggcgcgagtgagcacctgtcccgccggcgccgcctccaacgccagtcccagcttcaccgcttccttgccatcgaagcggcggccggtgagcagcagctccgcggcggcctgcgcccccgcgcggcgtggcgccaggtacgtggcgcccatgcccggatgcaggcccagttgcacgaagttgagcgccagcttcgagtcctcggccacgaggcacacgtcacacgccagcgccacgcacagccccgcgccaatcgcgggcccatccaccgccgcgatgacgggcaccggcaggtccagcacgctgaggtaacgcgcgtagaagccgagcatgaacgcgcgcgcatcctcgaaggacacctggcgcagccgctccagcatcttcaggtccccaccggcggagaacgcgcctcccgccccggtgagcaccaccgcccggacatcgtcacgccccttcagctcggcgacgcgcgcgcacagcgcgtctcccagctcgggcgtcatcacgttgcgtcgggcggtatcgttgagggtgagcgtggcgacggcaccctccacctcgagaaggacctctgcggctggagcggacatggccgcgcactgtagcggccccggccgctacggcaccacgagcctgaggaaggcgtcctgattccaggtgtcgcccgccccgtcgcgctgccagccggtgacggcgagcccgcggcccggcaccgtggccacacccgcggtggtcagcgagcacaccccgctggcgcagggctgcgcctccagcgtctgctcccccagccacgcccccgaagccgcgtagcgcgtcagcacgctgccacacgtcaccgcgacgccgcccgcatcctccaccgcgacggacgcgcccagctccgtcaccggcccgcacaggggctggcgcacccaacccacgctgccatccgcgcccgccgtcagcacgaaggccccggaggaaccgagcgacgcatccccccacaccagcagaccgatgaagtcacccgccgccacgagcgtgccatccgcgcccaccgtcaccgaggtgatgcggcccttcacgcccggcagctccttgccccacagcaagcgcccggacgcatcgaacgtcagcaccacgaagccgcgcacaccgggcgcgccgaacgtctggccgtccacctccagcgcgtccacgagctgtccggccagaatcgactgtcccgaaggcgccagcgccgccgcgtgcagcgcggtgtccatgttggcgccgtggaagcgccgcgaccacagcacggagccatccgcggcgtagcgcgtgagcacggggtcctcgatgaactccccctcccactcctcacccgcggccagcacgccgccctgcgcgtccgcggcgatggcgtagaccttctgtcccacgcggtgctgccagacaggggaacccgccgtgtcgaacttcaccaggaagccgtcctgcgcctcacccagtccgaagtccgccgagtagaggaacgcattgcccgacaggaacgtcgccgcctcgctcgccgccacgcgcgtgtcggagaagcggttacgcgcccactcacgcgaccagcgcggcgccccatccgccgcgtagcgcgccagcgtcagcgccagcttctcgccctccacgggctcgcgttcttcgtcctggcgcggcgtgctgtacaccaccaccgccacatccccagagggagccgtggccacgcccgtcccgacgtcgtcctggggcccccccaccacctggttccacggcgaggccgccgccggcaccggacgctgcgggagcccgccgttggagtcctgcggcgccgtgggtgccacgaccacccccggcgtggcttcgtcgccgccacgcggcgcttcggccagagtccccccgtccccgctgctaccgccgcacccgcccgacacccacagcagggcaactggaagaagccctgtccagaggttgccacgcccaccacgccgaaatgaccccatgacacgctccaaggagcctgctcccgtccaccggaagcgaggccctgggaacctaagcagcgtgtccagcccccggcattcccccccagcccaggggcactgtcacatggcaggggggcgtgcaggcgattagcgcgcccatgtgccccagcgtgccggggtgtgcggcagcggaataggtctccccccgaacggttggcagcgcacgccttggcgcaggggtggcggaatcctttggtcccagcgccgcccacgaattaagagaacccttccatggaaagcgccgcccccgactctctgcccgtgcccgacgcctcaggcgacgacctccgtgccgtcgaggagctcgcccaggcccgcaacgaaatcgtcgcccagattgaaaagcgcgtcgtcggtcagcgcgaggtggtggagcacctcctcatctccctcttcagccgcggccactgcctcttcgtgggtgtgccgggcctcgccaagacgctgctcatctccacgctggcggacgtcctcaacctgtccttcaaccgcatccagttcacgccggacctgatgccgtcggacatcaccggcacggacatcctggaagaggaccgcaccaccggccggcgcaccttccgcttcctccagggtccgctgttcgcgaacatcatcctggcggacgaggtgaaccgcaccccgccgaagacgcaggccgcgctgctgcaagccatgcaggagtaccgcatcaccgccggtggccgcacgtacccgctggagctgcccttcctcgtcttcgccacgcagaaccccatcgagcaggagggcacctatccgctgcccgaggcccagctcgaccgcttcatgttcctggtggacgtgggctaccccaccgccgacgaagaggtgcaaatcgtcaagagcaccaccggcggtccgcagccgaagctggagaagattctgtctcccgagcgcatcctcgcgcttcaagagctggtgcgccgcgtgccggtgccggaccacgtggtgcgctacgccgtggagctggtgcgccacacgcggcccaaggagccgggcgcgctggacttcatcgcgaagaacacgtcctggggcgcgggcccccgcgccagccagtacctggtggtggccgccaaggcgcgcgccatcctccacggccgcttcgtcgccaccgtcgaggacgtgcgcgccctggcccgtcccgtgctgcgccaccgcgtgctgcccaacttcaccgcggagagcgagggcatcacctccgtgaagctcatcgatcagctcctcacggtggtgaagggctagccaggcccgcgccatgctgctcgacgcacagacgctggcccgcctccagggagtgaagctgcgcgcccgcgcggtgatggagggcgtgttgtccggcctccacaaaagcccgcatcaggggcagagcgtggagttcgcggagcacaaggagtacgcccccggcgacgagctccgccacctggactggaaggcctacggcaagttcgacaagtactacgtcaagcgcttcgagcacgagacgaacctgcgcgccgtcatggtggtggatgcgtccgcctccatgggctaccgcagcggcgcgctgagcaagctggacgtggccaccacgctggcgggcgcgctgtgctacctgctggtgcgccagcaggacgcggcgggcctggcgctgatggcgggcggcaagtggaaggacgtgccgccgcgcgcgtcggccgggcacctcaacgtgctgctggacacgctggagcacaccgagcccaccggcaccacggacctgggcagcgcggcggaccacctggcggaggtgttgcctcggcgctccagcgtcatcgtcctgtcggacctgctggatgagaatcaggacgccctgcgccgcatcctcgcgctgcggcagcggaagaacgacgtgtccgtgttccacctggtggacccggcggagctgacgttccccttcgacgaccccacgctcttcatcgacatggagggccagggccgcatcgaggtgaacccgcgcgaaatcaaggagagctacctggaggagttcaacgccttcctggcgaacgtgaaggccgcgtgcgccgaggcggacgtggactacgacctggtgcgcacggacgacaagctggatgacgtgctgctgcggtacctgtcgcggcgcgggaggcgccggtgaccttcggcaatccgtggatgctgctgggcgcgctgggcgccctcatccccctgctggtgcacctgttcgaccggcgccgtccccggccgcaccccttcgggccgctggccttcgtgatgcgcagccagaagcgcaccgccagccgcctcaagctcaagcgcctgctgctgtacgcgctgcgcacgctcatcctgctggccatccccattgccctggcgcgccccgagctgacgcgggacgcggccgccgcgcaggtggtgaagggccccgcggccaccgccatcatcctggacgcgtcgctgtccatgcgctggtcggacggcacgccgctcttcgagcgcgcccgcgacgaggcccgcgacgcgctgaaggacctgctgcccgaagagcccgccaccgtgctggtgtgcacacagtcccccgccgcgccgccgccgccgggcttcgaccgcggccgtctgcgctcgctggtggatgaagcgaaggccacccacggcaccgcggacctgtcgcgctgcctggacatggcggcccgcgcgctggaggagaaccccatgccagccaagcggctggtgctggtctccgacatgacagccgcggccttccgcctggaggcgccgccgcccacggtgaagggccccacgggcgcgcccgtgaagccggaagtcgtcctgcgcgacgcggccgagggccacgaggtgctgaacaaccgcgccatcgtcgacctcaaggtggagcccgctctgcaggccggtccgcgcacgttccagttcaccttcacggtgcgcaacttcggcacggaagccgtgaaggacctggacgccgcggtgcgcgtgggcgagttcacgctggccaagggcttcgtggacatccccccgggcggcacgacgcagaagacgctcaccgtgcgcttcccgctgggcggcacggtgctggggcaggtgacgctggcgccggacg

SEQ ID NO: 782 - DNA, 5761 bp, Myxococcus xanthus
gtgctctatggcgctcttcaccagcaggcccgacaggcccaggatgtccggctggtgctcgcgcacggccagcaccaactgctcggggggcaccttgatgcccaggttcacgatgtggaagccgttgttggccaggatgatttccaccaggttcttcccgatgtcgtgcacgtcgcccttcaccgtggcgagcaccaccttgccgcgcatggccgcctgggccttgctcatgtgcggctccaggaagctcaccgccgccttcatggactcggcgctctggagcacctccgcgacaatcagctcgttggcgccgaagaggcggcccacctcgtccatgcccttcatcagcgggccgttgatgatctccagcggcgtgtacttctgcatggccgcttccaggtccgcggtgaggccgtcacgcgtgccttcgatgatgtagcgctggagccgctcctccagtggcagcgtgctcacctggacccgcgcggccttgcgctcacggaaggccgccgcgaagggcgtcaccgggtccgcgccgcggttgtagagcaggtcctcggacagcttgcgctcttcctcggggagcgacgggtagcgctccagcttctccgagttgaccagcgccatgtccaggcccgcctggacgttgtggtacaggaagacggagttgagcacctcgcggcccgcggcgggcaaaccgaaggacacgttggagatgcccagcaccgtcttgctgcgcgggaagcgctgcttgatgaggcgcacgccttcaatcgtctccacgccgctgccgatgtactgcgcgtcccccgtggcacaggggaacacgagcgggtcgaagtacaggtcctccggcttcatgccgtacttcttcgtcagcaactcgtacgagcgctccgccacctccagcttgcgctggcgcgtgacggccatgcccacctcgtcgatgcagcccaccaccagggccgcgccgaagcggcgcgccagcggcaccaccttctcgaagcgctcctcgccgtcctccaggttgaccgaattgatgatggccttgccctggctgtaggtgagcgccatctcgatgacgcgctcgtcggtggagtcaatcatcaagggcacgcgcaccttcttgatgaccgcctccaggaagttgcgcatgtcctcgagttcgtcgcggtccgggttggccaggcagatgtcgatgacctgcgcgccccgcttcacctgcgcgcgcgcaatctccgacgcgtcgtcgaactggccggcgacgatgagctccttgaactttttgctgccaatgacgttggtgcgctcgcccacgatgagggggcgctgctcgtccgtcacctccaggtagtccacgccggacagcgaggcccggggacgcggcgagcccgcgcgcggcttcagcccctgcaccgccttggccatcgtctcgatgtgccccgcgtgcgtgccacagcatccccccaccacgttgagccagccctgctcacagaagcgccgcacggagcgcgccagcatctccggcgtctccaggtagttgccgttctcgtccggcaggcccgcgttgggcacacatgccacggggaacgcgctcatcgacgccagcgagcgcaggtggtccgtcatgaagtccgggcccgtggcgcagttgaggcccaggtacagcaggtccgtgtgctccagcgacgcggccaggctctccacgctctgcccggccagcatggtgcccatgggctcaatcgtgccggacaccgccaccggcagcgcgtagcccagtttctggaacgcgcgctcggcgcccaacagcgccgccttcacgttgcgggtgtcctgcgccgtctcaatcagcaggtagtccgagccccccagcgcgagcccttcggcctgcaccgcgaagttgtccaccagctcctcgaaggtgacgccgccggtgacgctgatggccttggtggtggggccaatggagcccgccacccagcgcatgcggccgtccttcgcctcggcggcggcggcggcgttgcgcgccagccgggcggagacctcgttgatttcgagcgccttgtggcccaggccgaactccgccagcaccagcggcgtgccgccgaagctgtccgtctccgtcacgtccgcgccggccgcgaagtagcgcgcgtggatgctctccaccagctcggggcgcgtgaggacgaggtgctcgttgcacccctcgtactccgggccgccgaagtccgccgccttgaggtcctcgttctggagcagcgtgcccatggcaccatccagcaccagcactcgctcacgcatcgcggcgcgcagggcctccacgcgacggccattctcaccaggaggcagcgggagggcagcggggacagggctcgtcatgacggtttgactccagtcagcaggaagacacgaaagggactggccccgtcccgggcgtgtgtctcccgggtcagggacgtgaagccggcctcgcgcagcgcggcttcgagggattcaggcgcgaagcccaggtgccggtggcccagccgttccagtacccagcgctcctcgtgcggcatcaactccaacagcaccagccggccgcccggcttgagcaggcgggcggactcggacagcaccgactgcggctcctccacgtggtggaggctctgcgaaatcaccaccaggtccaggctgccggacgcgagcgacagccggtgcaggtcctcgcggaggaagcggatgttctccaatccctcgcggcccgcccgctcccgcgcctgttccagcgcgtccgcgttctggtcaatggcccagacgcgccgcgcccagcgggcaatggccacgctcagcacgccggtgccgcagccgaagtcggccacctccagcggcggcagcagcgacgccagcgcgcctgcccacaggaaccacgactgccccggctccagcagccgttcgttgagggcctgccggtcctcgcgcgcccgcagcaaatccttcagccgcgccgagtcccccgccgcgtcctccgcctgccgtgccatctggatgagcggccagcgcccgtccgcctgctccaaggccagcgagtagtagctgtagcccgcgtggcgctcctcgcgcagcaggcccaggcccttcagcttgcccaggtgatgggacacggacgactgcgccacgcccaccagggacaccagctccgtcacgttcaacggggcctctgccaccaaccggaggatgcgcagccgcgtcgggtctccgagcaccctgaatgactgagacagctcttccatatcgccgcatcaacatatgtcgatgccgggcacaaggccagtactctctagacgcgacgcgttgcctgtgccccaacagtcgcgtacagggcgaagcatggcgactcccacccacaccccgacccttcacgagctgctcgccggcaagcgcttcggactcgtcctctctgctggatatttcggcttctacggtcacgcgggcttcctcaagggactggccgccgcgggcctcagtcctcatgcctacgcgggcacatccgcgggcggaatggtggcggcctacgccgccgcgggcacgccggtgcgtgatgtggaggagctggtgctgcgccagacgcgcgccaacttctgggacccggaccccattggcgcggtgctcaacgcggacgcggcgggacacggcctgacgggcctgctcaagggtgagcgcttccgcaagctgctggatgccacgctgccggtgcgcaccttcgaggagctgccacacccactgctgctggtgggcgccaacctcacgctgggcagccacgacgtgttcacctcgggcgagctggccccgcgcgtccacgcgacgtgcgcctaccccggcctgttccgcgcggtccccctggagggcagcctgtactgggacggtggcctggtggacaaggcccccgcgttgtcgctgcacgagagcgccgtgggcgcggagctggacgccatcctcgtgcactacctgcccagcaagacgcgcaaggtggtgggcggccccatggcatacgcgcaggggctggccgcgggctcggcggcgctgcgccaggaccacttccgcctccagctcaccgtgctggagcagaagcaggtgcccgtctacgtcgtcgtctccaatctgccgcccgtgtctcccaccaccatggagcgtggcttcgacgcgctggaccaggcgaagctgggcgccgagcgcgccctggcgcggcctccggtgcccttcgcgcaggcggagtggtgagcctcagcgcagccacaccatgagcagcgcgggcgtggccgccacgagcacgcccgccccgaaggccagcagcacctggaggaagaagaggtcctccagcgactccaccagcatcatctccacgcgctcgatgcccagcgtctccaggttccgcaccgcggtggcggtgtccggcgcggagacgacggcgcgcagcgccagcacgcccaggacgcggcgggactgctccatgaggaagcgctccacctccgccatgcgcgaggacggcgcttcaccccgggcctgctcggcctgccgcagatgctcgctcatcgactcgttcacgacgcgcgacaactcctcgcgcgacagtgagcccgagccttggagccgccgcgccacctgcgccgtgacgggcttgagcacggaatagacgcgggccaccacgccccgcgacttggccgcctcggccagccgccctgacacggcctgcagcatgaacgcgtagccgcccgccaccgacagggccagcggcggcaacaccgcgcccagaatgacgagccacgtgggcgcgggcggaacgcccagccaccggggcaacgcgtaggtggccgcgcccaccgccaaccccaccagaccgaagagcgctccgcctttcagcgcgccccaaagccccacgcccatcaaccggaaggccaccagcagcccctgccccaacgcgcctgcgacccgcatcgaccgatgctcccaggacggaagaccgcccttgtcccccaccgcggcgaaaagccggttccagggcagagccacaattccatgagagacgttcccgcgccagtgacgcaccccgtcgacgcgggcgcgcgtctcctccaacagggcacaccgatgtcggcttccggacggacacggaggctggctcctcatttcgcgacagaccagaaatgcaagatgcccgtgtgaacccgtccactgtgcaagtggacccgggccacggccgtcccctcttccgatgtggaggctgtccatgccgatgtcgtcgctcctgtcgatgcgccccctgcggtacgcaatgctgtccctgtccgtgctcgccttcgccccctcggcggtagcggcgccgcccgcgaagtccctgaagccgcgcgcactcgccgccaagcccaccggccgcgagctggccggggacgcctacgtggagcgcatcgtggtgaaattccacgaaggcagccgggtgcgcctgcgcgaccagcagttggtggccctgtcgtcggaccgggacgccgcggagcgctcgctgctggccggacgtgggctgggcgacgcgcgcctggaggcggacctgggccatgtgacgtcactgctggagcgcgcgccccgcattggcgccatggcccgcttgttcgacgaagccgagtccaccctggaggcgcgcaaggcctccggggagcggaagagcggtgagcaactggcggacctgaacatggactttcaagtccccctgatgccgggcaccacg

SEQ ID NO: 783 - DNA, 5692 bp, Myxococcus xanthus
ttctcgttctctaaaggcccggcggcgcgcggcgggagtgaggggagaggacgcgggctgtcgttgactttcgtggccatggtggaggaatcccggtgcgcgtgggggtggcgcgtcttggaattatccgccccagccgtccggaagttgtgcgccttcttttcccctgagattgccgggggttgttgaaggccggacgtcgctccgccccgccggtcaatacctgcacctggaagccggtgacacgttgcaagtccggaaagcaccgggctgcgagtggcccgggtcgaccggcccaggacggggggtccggatgatcgacgaagtcgatcaacgtttgaaggcgtgggtgggccgcattgccggtgatgtcccggtgttcctgggcgtgccggaccgcgaatcgctcgagcgaggcgtctgtctgtacctgttggagctggggcccgcgcctccggtccggagcgggggcggggggcgcgcgtcgctgcagatttcggtctgctacctcatcaccgcgggggcggagtccccggagcgagcgcaccggctgctgggtgagctcgtcttcgcggccatggaggaggcggacttcgaggtggagctcacgccggtgcccaccacggtgtgggccgggctgaggaccgcgccgcgtccctgcttccgcctgcgcgtcccggtgcggcgggagcgctcgatgcccgtcatccaccgggtgctctttcccgccacgccccaggccacgctgacgcccgcgaaggcgctgttgggctgtgtcgtcggcccgggggacgtgccgattccgggcgcgctcgtcgaactgcccacgctgaagctcaccacgcgcacggatgccaagggctgcttccgttttcccagcgtgccccccgtgcccacgctgggacggctggaagtgcgcgcgaagggtgcgctgctcgagatgggcctggaggtgcttgccgccgagccccagccgctgctcatccgcctgccgttgaaggaggagtgacatgccgcaaagccacccatcgcctgtcacctccgaggagacgctacgcggcgccgagcgcgttcccgcgtcaccgagtgccaccgcgccgaaccctgctcacggggcgctggagacgtcctggattgatgagtggggcatggcgcccgaggcgtccttccccgatgcgtggagcgcgcggctgaaggcgtccgtcgccggtgcgcccgatgcgtggagcgttggccccgtggcttccattcccggcgtctccgatgcgtggggcgcagggctggaggagactgtctctgctgtgctcgacgagtgggacgcagggcgggtgtcgattgtccctgctgcgcttgctgcgcggagcccggggccggagacgacagcgcctgatgcgtggggcgtggggcccgagctgttcgcggttcatgcgctgagcccggcggctcggggccttcgggcggccacgtcggagacctgggaacggagcgagcctccccccgtggccaccgcaaggaagcgacgccaaggcgaatgatggaacggacagccttccgcgacaggccgggcgatgggggaaccaccgggcctgaggcgggagcgctggcctgactcgctcaatgccgcacggtcctccaagagagcaggtcgatgtctcgcgtcttcgatgtctccgcagtcacggacacccttcgtctgtcccccaacgggacgggggaggccgtcttccacgtcatcaacgcctcgcgtgcccccgtgcgcgcgcgcctctcggtggtgcctgacgcaggcgcccggcgcgagtggctcttcatcgacggcgatacccagcgcgactttcctccgacaggcgcgcagcgaatcctcatccggctccgcgtgccagcggggacgccaccgggccacttcaccttccacctgcgagtggaggactgcgacggccccgacactcggttcgcgcaggggcccgccgtcaccgtcgaggtggtctcctcgccgcccgccgcgagggcgttccccaggaactgggctgtcatggcggtggcgacgttcatcctgctggggacggtggcctccctgctcgccgcgggcagggcgaggcagcccagccctggggcgccctgtccggatgggcattgtggcaaggggctgacgtgcgcgaagcagctcgatgggggcgtgtgcctggcctcgcaaggccagccctgtgaggcgggctcccagtgcatcaccggcttctgtgagcccggcgtggggtgcacggtgccgctgggaaaggactgcgtctccccggaggactgcccgggcgcgctgacgtgtgccgacgtgctgggctcgtccgtctgtctcctcgagccgggagaggactgcgagcacgaccgcgactgcgccagcttcttctgcaacgcggagcgcaaatgcaaccgcgatgacggacgctgtgacagcaacgccgaatgtcattcgcccacgcagtgtggcgcgacgaagctgtgccagcttccagatggacagccgtgcatgcggcacgaggcctgcctctccggttactgctcggagacctgccagatatcgccggagtccttccagtgcgagtcaccgtgccccgcgtacaccgcatgtgtgtcgggaagctgcacccccgtggacggcaagctcctcaaccagaacatgctgctgacggcgcctcgaatcctcaagggcatccgggagctgcgcatccagcagggcacccagccgtagccggtgtgtgtcactgcagtgccggccgcaccgtcttgccgatgtccaccagccgccgcacctgttcttcgctcaagcccaggtgccgcgcggcgcccgggatgtcccccggaatgaaggcgcgcatggcccggggactgaaccagttgaagagcgtcacgacgccgcggaccagtggggactcggtgaacaccgccgtgggcggaatgacgtagtccttgggcacctggttgagcgcctgttgccgctgggtggcattgggcccgggcccttcggccaggacgagctgcccggtggccgtgtcctggtgacgcgcgatgagctcgcagtagcgcgcccagtcgtcgggggccggtggctgcgcgttgtgcgccaccaccagcaccgtgccgacatatgccagccccaacgtccggctctgcaccacatcctggatgtcgggcgcgtcgagctggacgggagctgtcatcgccgcgtctctccgttggattgcgagcatgccggagtgttcctccgcatgactccatgtgcaacctgtattccttggaatacttgccgctccggcgcccaatgtggggcgcaggaggagcggcttggagctaccgggcagggacgcggaggaccaggcccggcggaggtaggctcgaggcggaggtggtgtctccccaggccgcgatggtgccgttgtgccggagcgccaggctcttgttgaaggcctggcccgcgacggtggcgacatccgtcaatcccggggggagcgtcgtctggccaaaggcgctattcccccatgcgacgacggtgccgttggaccggagcgccatgtagtggtgttcgcctgccgcgacatccacgacgtcgctgaggtccggggtgagcgcgaggtcgtagtacgccgcgccaaatccccagacggccgcggtcccgtccgcccgcagcgccagtgcgctgctgctcgtgttggagatggccacgacgtcgtccaggtccgccgggacgacgaggaggtcgaacacgtcctgcccccagacggtgacggtgccgtccgccttgagcgccatgccgtggtacgcccccgcggacaccgcgactacgtcctgaagcccttcagggacatgcgtctgcgggtcgatttccgcaccgatggccacgaccgtcccatcccgcttgagcgcgagggccaggactccgctcgctctgatgtccacgacgtccgacaggcccgcgggcaccgggacggggtcggggcctccccacttgaccacggttccatccgcctgcagggccacagcgaaggtcatccccgcgcccacgctcacgacatcggaaagccccgctggaatcggagtgacatcattcagggggtcggccgagccccagacggtgacggtgttgttcggcaggacgccaatgccccagtgggccgcatacgcgagggtccgctgtcggagcactcgcagcgacgcggtggcggcgggcttccaatccacgccaagcgtgacgacgacctcctgctcgccgggcacaacgctccccggcacgcgcaccaccacctccgtgtccgaccaggacaggtactcctcggcgtccacgccgccgatggagacgcgggaggtgccacgcatctcgccgaagccggagccggtgagcttcaggtggcctcgctgcacggtgagggcgggcgcctcaagcaccagggcatcctggcggcggctcagtgacaggtcgaccgacgtcgtctgacccggctggacctccagcgtgtccccggcccgctggtagtggctccgatgggcctccacggtgtgcgttcccgtggggacgttgtcgaacgtgaagcggccttgcgcgtccgtggtcacgctgtcgcgcacgccggagaggatgacggtggcgccctcatggtggctctccccttcgaggagggcctgtcccgtcacgcggccgagctgtgtccctgagtcgtgtggctgtgtgccggcgtcgggcgtggaggcgggactgtctggggtgcaggcggaaaggaccaggaggagggcccagagccatgaggttcttgcgagacgcatcatcggatttccagtgtgtgcgggggaggcgctcctcgggcgggaggagtccttcgacgaggaataaagcctgtggcagccacctgtcgcccactgggaattgttattcaaaatgcgtctggcgttgccagcgtctgcgtctagtcgaggataagttccaacatcaggtcgtcctcggggtcctcctggatggatgcgtccgagtcgtccacgtcgtatcccttgagggagaagcccaggggcgtctgtgcgccgatgcagggaatcgtgcggggcgaggtgcccacgccgtcgccatccatgtcggggtagagaaccgtccaacgatagcgcgcggcgtccgagtcatcgcagtcattgcccgtggcctgggtgaagtagggctcggggagtgacgcaccggtgcacacggttcctgcttcggggtgggtgtgcccatccgcgtcccggtccacatgcgcgtaggccgcctgtcgccagcgcgccgcgtcttccgccgcgcagtccgtcccccgggccgaccacggcgcgggcaccgtgccatccgtgcacagcgcgaccgcgtctcccgcgcccacgccgtccccgtccgcatccgtccacgcctggacggtggtgtggatgctcgggtccgcgtcgtcgcagtcgttccctcgtggtgtggtggcatggccgggcggcagcgccatgcccgagcacaccgtgcccacctccggcgcggtgaagctgtcaccgtccgcatcccggtgcgagtaggccaggagcctccagaggaggggggccgtgtcgtcgcagtcggtgttcaccaccgagtacccaacggggaatctgccgggccgcacagaaagtctgccgcgtgcctgcccccgaagcggtccccgtcatc

SEQ ID NO: 784 - DNA, 5589 bp, Myxococcus xanthus
gcgtcgaagaaagccgtgcacgcggccgttgggagtccgcgatgtactggtactcctccgcgctcatgtcgcgcaggcccacctggaccagcgtcttcacgccggggatgcgctccgcgacgttgtacatgatggacgcgtgggaccaggtgaagccctcgtaggccacgcgcaggtcggcgtgcgcgtccaggtgcagcacgcccaggccggggtacttctccgcgtgcgcgcggatgatgccgtaggagatggagtggtcaccgcccaccgcggccacgcgcttgccctggtccaaccagtgcttggtggtgcggtagacgtgctcgttcatctggtcgcagaggacattcacgtcctgcgcggcctgaatcagcgcggcctcgccggagtggatgccaccggcctcgatgacgacctgggcgcgctccttggcgcgggtgttccagtcgcgcagctcctggggctcggggagcatggcgatgccacgctcgtagggacgacccgtctccacgtcgaagaggtcgacctgccggctggcttccaggacggcggttggcccctcggacgtgccaccgccgtaactggtggtggcctcgaagggaacggggatgaggatgacgtgcgcctcttccggggagtgggggaggccgaacacgccggagtccggctgggcggcggcgctggggtcgaagtgggtagccatggcggcgcaggataaaggcccggtgtcggggcgcaatggtctgttacttctcgatgcgttccttgacgtcgaaacgcccggccagcacctgatgtttctcaatcaccagccggtccgccgtcagcacgccccggacgtccaggctgtagtcgttgtagaaggcgtcgacggtcgaggccttgaggttccctccaatgatgacggggccctcggtctggaaggtgtcgcattcgaagtcaccgcccacgaagagctggcacccttcgaagttggacgccttgcccttcaccgtcaggttccccgtcaccaggagcgacagcaccttcagggggccctccaccacgaggtcgccgtggtggacgaaggggttcttggacaccttcttgagtgtcttgctcgcgggggcccgcgtggcgacctgcctgatgaggtcgatggtggcgaacacaagcggggcgttcgtgttgccgtgctctgcgatgcccgcgtccagctggtcgatggtgaccgagtactcttcgactaagacactctccatgaacgcgcggagctgctcccacttgttgaggttgccccccgcgagagcgtcccctgacaggtattgggtgacgcgctcctccgagagctcctttaccttcttgggcggagggcctcgctggtcctgggtcttcttcaggagctccacgagcagggggcccacgttcttgctgtgccgcgaggcgcgggcgacggagagcaccgacctgcccccctccgtgttcagccgagggtcgatgccctggtcgatgaagaaccgcacgacgcggtcagcgccgaactccgcagcccggtgaatcgggaactcgtagttcgaacccgcccggatgtcgtgcgccgtactccatgagcaactggatgacgtcgacgttgttctggggcacggcgatcatcatcggcgagtgcccgttgatggtcttgaagtccaggctgacgccgctggcgagcagtgcccggatttgagtcaccacctcggcgttcttgcgctccgccttggccaggctctgccggtactcggcctccggcatttcgacccggtgataggtctggatgtagtggaggtcgttgatctgccggaatagcttttcgagctcttgctgctgctccgtcatcgaatccgttccttcagtgcgcgatgcggctcacgcccagcgcaccaccagcttgcccaccgagtcattgccggccatgcgctccagcgcctgccggatgtccgcgcgcggcaccaccgcgtctatcacgggccgcagcgcccctgtgcggaacagcggcaacagatgccgctccgcgctctgcgccagcgcgatcttctcttccagcggacggctgcgcagcacggtgccggtgatgcgcagccgcttcgtcagcaccgtgcccaggttcacctcggtggccgcgcccgccaccagccccaccagcatcagccgcccccggggcgccagggcgttcagcgtctccggcacgtagccgccgcccaccaggtccaggcacaggtccgcgccccggccgcctgtctcctcgcgcaccgcgtcggcgaagcgcggcggcctggtgtcacacaggaccgtgcgcgccacgccccaggcggccgcgcgggccagcttcgccgcgttgcggcccgtgcccaccacgcgcgcgcccatggcctggcagatgagcgccgccgccgagcccacgccactggccaccgcgtggacgagcaccgtctcgccgggcttgagctcgccctggagcaccagcgcgtcgaacgcggtgaggtacgcctccggaatggccgccgcgtcggtgaagtccatgccgtcggggatgggcatcgcctctcgctcgtgggtgacgagcaggtccgaccacgcgcccccgcccaccagtcccatgacgcggtcgccgggctggaagcgccgtgcgcgcgggcccacggccaccacctcgcccgcgtactccaggcctggaatgtccggtgcgacgtccggcggcgcggggtagtggccacgaagctgcagaaggtccgctcggttgagcgcggacgcccgcacccggaccagaatctcccctgggcctgggacgggctcggggcgttcttcctcggcgaggacctcggggcctcccggacgggtgatgcgaaggaccttcatggcaggcgcctcctatggaaaggcgagcacgaaacatcctggctcgcgagagcgtcaacgcttatctagaacaccgtccaccatgagcaccctgacgtgtcccatctgccagaagcccgttcccccgcgcggggagaacgctgcctttcccttctgttccaagcgctgccgcgccgtggacctcggccggtggctcggcgaggagtaccgcgtccccgaccggcaggcggatgagcaggaagacgagctgcccgccgacagccacccggcacgccagcacggcgacgcatgagcggctttgtcgacctgcattgccatctgctgcccggcgtggatgacggggcacgcacgctggaagacgcgctggagatggcgcgtgcgctggtcgacctcggcttctccaccgtcgcccccagtccgcacgcgcgccccgagtacgcccccgtggaggtggtggacgtgcgccgtgcggagctggcggaggccctggagcgcgagcgcatcccgctggcattggggcgcaacgcggagaacgtgctcgacgatgccttcctgcgcggcctcagcacaccccaggcccgcaagttgggcccgggccgctacgtgctcgtggagctgccctacaccgcgcccgtccccgcgctgccggacatcctcttccgcatccgtaccaagggcgtggtgccgctgctggcgcatcccgagcgctgcctggagttcgagcggaagggccgcgccgcggaggccgtgcgagctggggcattgttgcaactggatatcggtgcgctcatcggccgctatggcggcacggcgaagaagctgtcccgcgccttcctggacgacgggctctatgcggtgggcgccacggacctgcatgggcccgtgggggcccgggactgggtgggacgctcgctggcggagctgcggagcagggcaggggaggcgagcttcgcccgtctcatgagggacaatcccgcgactttgttggccggggagtcactggagtccgacccggactgacggtatacccggcccctgtgaaacgtgccgtcaaactcctggccagcctcctggtcaccttcctcttcatgtggtgggccttccgggacacggattgggcgacgcagctggccagcctgaagtcggccaactacgcgtggctggtgccgtacttcggctgcctgttggccatccacgtcttccgcaccctgcgctggggctgccttctgtcgggcctggagcaggtcccgttccgaaagctgaatgaggcgtccggcatcggcttcatgatgctgctggtgctgcccttccgcttgggcgagttcgcgcggcccttcctcatcgcgcagcgcagtggcatccgccgcagcgcggccatgacgtccgtggtgctggagcgcatcgtggacggcctcttcgtggcggcgatgctgcgagcgctgctcttcttcgtgcccacggagacgccggagattcgctacgtcaagctgggctcgtggctgatgttcgcggtgttcggcggcggtctggcgttcctccttttcggcctctggcagcagcagcgcacggtgaatctggtgcgcgccaccgtgggccggctggcgccgcaggtggcggacaaggtggcggacatcgtcgacaccttcgtgggtgccatgcggcagttgccgaaggggcggcaggtcgcgctcttcttcctctacacggggctgtactggggcgtgaatggcgcggggatgtccatgttggccaacgccttcgactgctcgggcgcggcgcccggcaccgtctgcgagcccatggacctgacgctcttccaggcctacgtcgtgctgggcgtgctggtggtggggctgatgattccggcggcgccggggatgatgggcaccttccaggcggccacgaaggtgggcctgagcctcttccttccggccgccgcggtgaatgcgagcgggctggcttacgccaacgtcatgtggctgagccagacggtgcagcaggtgggcctgggcctcatcctgctgtcgatggggcacctgtcgttcaaggacatcgccggcaagctggacgacaaggacggcgaggcggcggcaccttccgcctgacgccggggccgcatcccggccccgggtgccgtgtcgatgcggcttcttacggggtgggcgtcgacgcctgctccgtctccgcgggagcggctcccgtcttcgcgggggcggtgtcaccgctcttgcccgtcaccacacccttcaccttctccatggcggccttcgggtcgatgttgcccttgagggtgccgaacggcgtgtcgatgacctgctcccgcttctccgaggaggcgtagccctctggcgcgcacagggccttcgaggtgtcgcgcacggagacgacgggggtgttgatggtggtggagtcctcggacgtggccttggcgacgagcttgtcgtcgcgcatcagcacgcagcggtcctcgccgtagtaccaggcggtggagctgtccgggaactcctgcgcgcgcgtgggtcctgagcccatggcatcgacgacctgatgggacgacatgcccgggtagagcttgtcgaagccaggggtggcacagccggcggcggcgagcgcgagtgcggcgctgacaatcgggagacgcatggggtgtggggctccttccgaaaaggaatcgcggagcctaccccggcgccacgtccgggctccatgtggggg

SEQ ID NO: 785 - DNA, 5125 bp, Myxococcus xanthus
cgtgctctaaggcgccgtcgttgacgttgaggatgagcgcggaagtgggaggcatacggaagtgtgcgggtcaggctctttcgtagccgcgcctccgcctgaacgccagatgttacgggcaccaacgggcgcgctgtcggggcaggcacacaagcgactgtccaggaacccagcaaaaagttcatggccagtgccgaacgagccgtttcgcgatagggaaggccgcatgcgtcctccctgtcgccctcttcccgcggacggccgcttcctccaggccgtgggtcccactccgctcgtccccgtacgtctccacgaggagggccccaccatctggtgcaagctggagttcctcaaccccagcggctccaccaaggaccgcatcgcgcgctacatgctggagaaggcgtggcgccagggggagctcgtccccggcggcgaggtcatcgaggcgtccagcggctccacgagcatcgcccttgcgctggcttgcgcccagatgggcctgcgcttcacggcggtgatgccggagggcgtcaccggggagcgcatcctcaccatccgcgcctatggtggtgacgtggtgctggtgccgcgcgaagccggcgtgcacggcgccatcgtgaaggcggaggagctggcgcgtgagcgcaaggccttcgcgccgcgtcagttcgagaacctggacaacgccgaggcccaccgggtgtggacgggccaggagattctgtcgcaaatcccgggcgggctggtgcacggcgtggtcagcggcgtaggcacgggcggcaccgtggtgggcctgtaccaggccttcgcggaagcaggctgtccggtgacggccttcgtggcgcgccccatcgccggcctgggctgcgacatcgaatgttgcagcttcagcccccgcgtcccgggcgtggtggatggcatgtcccggctgtaccgcgaggccgacatgccgggccgcgttgaaatcgacgtgtcggacgacgtcgccatgagcaccgccagggcgctcatccgccgcggcttcccggtgggaccgtcgtccggcctcaactacgtcgccgcggtggaagccgcgaagcgactgggcccgggggcgcaggtggtgacggtgttccccgaccgcatggagcgctacttctccaccgagctcatccagcctaagcccgtgccagcacgcggcgcggcatgagttgaaagggaatgacgtggcgcgtgcggagttgcacgcgccgtcccgccgcgctatctgctgggcaagcccacgttcatgctcgtccgagtcctgacagtactggtggtcctggggctgcctcccatcgcgggggcggtcgaggggctgttccatttctgtcagggcacggtgaagctggacctgacgtgtgtctgcccccagtcgaagcggaccaaggccgcgcccgacactcaggaagcaggcatccgtggcaaccaccacgactgctgcggcgaactcgccgtgcagctcccggcgccggagcccgtcaccgcgagttcacgccatgcgtgggcgctgacacctctggcagtgcttccccaggctgtccccgtggtgccgccagcgcccgaggccctgcccacgtcgtgggtgcgcatccggggcgtgcatcacgccaccgcgccaccgctgtacctgcagcactgctcctacctcatttgagacgtccggcccgcaagcgctgaggcctggcgggtggacgtgtgtccaccggccggattccgcccgccgccggtgacgtccttctcccggcgacaggctcgtatcccgtcatctggagcaggaagtcatgtcaccccatggaacctggaggcggtccgccacgcgggccgtgctcgctaccggcgtcgccgtgtggctgggccccggcgcggccggagccaatgagcagcggtatcaatcccaactcgaagccgttgcccggcaggcaccggaggcacaggcaccagagcccttcacgagcgcctccgtgctggagcgcgcggagctggtgcggcaggtgctcgcgcgcaacccctcgctggaagcagcgcgtgaggcgtggcgcgccagtctcgaacgctacccgcgtgagacggcgctcgaagacccgatgctgacctatgaggtcgcgccgctgagcatcactggcagcgtgcccttcggacaggtcgtggggctgagccaacagctccccttccccggcaagcgcggcctgcgaggggagatggcgctggcggaagcgcaagcgatgcgtgaggaccgcgaggccctgcgtctgcgcctggcgctcatggcctccacgctcttcgatgacttgttcgtcgtggagcgctcgctcgacgtcacggcggagcacctgcggctgctcgggcagctcaagaagagcgcggaggcccaatacgtcaccggccgtgcctcgcagcaggatccgctccaggcggaggtggagctgagcgaggtgctgcgcgaacaggtgatgttcgaagccgaacgcgagaggcttcgcgcccagctcaacggcctgctgcaccgcgccccccaggcaccgctgccgccgctgccggaagccatgcccgcgcataccgcggagtccgtgcccgccgaacggctgcaagacgaagcgctgcgcctgcgcccggagctggagggcctgcgggcccggctcggtggtggcgaggccgccgtccggctcgcgaagcgcgactactacccggatgtcatggtgatgggtgagtacaactccatgtggatggacacgccccaccagttcatggcgggcgtcaccatcaacatcccgctcgacttcggcaagcggaaggccgctgtgcgggaggccgaatccggcctgaagcgcctgcgccgggaggaagagcagctcatctccgacatccgcgtcgaggtggagcaggcgcgctcgcgtgccgaggaggcgcggcgcgtggtggcgctcttccaggagcgtctcatccccgcggcgaaggaccaggtgtccgccgcccgcgcgggtttcgagagcggcaagaacagcttccaggtcctcatcgaggcggagcgcggcctgcgccgcgtggagctgcgtgaacagacggccctggcggacgtgcagcgccgccgggcggagttggacaaggccatgggccacaccccgggactgccccggaacggagagacgcgatgagccccccgaaccgccgccgcatcgccccctggatgggagtgctggcactcgtcgtaatcgtcgccgtggcctggaaacccctcgcgggctggttcttcggctccacgtcccacaccggcaccgcgcccgcgacgcatgaggcccacagcggcgcgggcacgccgctgcccgacgccgccctggagtacgcgcgcgcggccttcgagtcctacgaaaccgcacgggccttgctcgcgcaggacaccctggaaggactcgaggccagggcgggagccctgaaggccgcgctccagcaggccgccgaggccacacagggggatggcacgccgctgaaggcctggctccagcagggcgcggacggcgcctcgcaactcgcttcggcgaaggacgccgaggcagcgcgccagcacttcgcacgcgtgagtgaagcgctcatcgccctggcgtccgccgatccgcggctccaggaaggctggcacgtcttcgaatgccccatggtggagggggtgaatcagtggctccagcgcgagcccaagctggagaacccgtacatgggccggcgcatgctggcgtgtggcaccaccagcgagtggcgctcggccgctcccgcgggtgctcacggcgagggcgatatcgcgcactacacctgccccatgcacccgtccgtgaagcagcacggcccgggcgcgtgccccatctgcggcatggacctgacacccgtcagccgcgccgagctgcagagcggcatcatccgggtggacgacctgcggcggcagcgcatcggcgtgaagacggcgaaggtggagcagtcctccatggacctgtccctgcgcgcgctcggccgcgtcaccttcgacgagaagtcactggtggacgtcaccctcaagctggacggctacatccacgagctgcgcgtcaacgccacgggcgagccggtgaagaagggcgacgtcctcttcaccctctacagcccggagctctacgccgcgcagcaggagtacctgctggcgcgtcagagccagagcgcggccaacgcgtcgctcgtgggcgcggcgcgcaagcggctggaactatggggcctgtccgcggcgcaaatcgagcgcgtcgcccagcgtggccagccggtggagaacatgcccttcctggcgcccgccagcggctacgtgctggagaagaacgtggtggagggcgcggcggtgaaggccggtgagcgcctgttccgcatcgccccgctggcgaaggtgtgggtggaagcggatgtgtacgagcaggacctggcgcgcgtgaagccgggccatccagtggaagtcaccctgccctacctgcctgggaagaaatacgcgggcagcgtcggctacgtgtacccgtccctacaaggcgccacgcgcaccgggcgcatccgcatcgagctgcccaacccggagctggagctgaagccggacatgtacgcggacgtccgcttcctcctgcagggcggcgcgccgcgactccagattcccgactcggccgtcatctacaccggcccgcggcggctggtgttcgtggacctgggcgagggacggctgcggccccaggaggtgaagctcggcatcaagggcaacggcacctacgaggtgctggagggcctgtcgcccggcgacgtcgtcgtcaccagcggcaacttcctcatcgcggcggagagccgcatccgctccgccacggatgacttcggaggcagccatgcagcccactgagaacggcgaacagggcttcatcggccgcatcatcggcgcgtgcgcgcgcaacccgttcctcaccatcctgctggtgggcggcctggcggcgtgggccgtccacgcggttcgcaacaccaagctggacgccatccccgacctgtccgacacgcaggtcatcgtcttcaccgaatggatgggacgtgggccggatctggtcgaggaccagatcaccta

SEQ ID NO: 786 - DNA, 5863 bp, Myxococcus xanthus
cgtccgcgccgctcgagcgggagctgctggtccgcatccatgacctcatggtgaagacgcgcgtcctcgaggagcgcctcatccagatgtacaagcaaggccacggatacttctggattggcggccccggcgaggaggcgttcaacgtctccctgggcctgctcatgaagaagggccagggccccgacttcgactatctgcatgcgcactaccggcagtccggcaccctgctcgcgctgggtgaggagcccatcggctccctgcggcagatgaagaacacggccacggacccgtattcgggcggccgcaacttcgcgggccactactccgcccggaagtacaacgtggcgccggtgtcctcgcccatcgaggtccagtacgccatcgccccgggcacggccatggtgcagaagcgccacggcggtgacggcatcaccatcgtcaccggtggcgacgccggcacggccgagggcgatttcgcctcgtgcctggtgtggagcagccgccccgccaacccgctgcccatcctcatcatcgtcaccaacaacaagtggggcatctccacggcggcggagggccagcacggcgagcagcgcatcagcgaccgcggcaaggcctttggcatccgcagcaagaccatcaacggcaacgacgccgtggaggcctacaccgagctgcgcgaggccatggcctacgtgcgcacggagcgcaagcccttcctcctggaggccaacgtgtcgcgcctgtacggccactcgtccgcctccggagccaactacgtgagcaacgaagtcgactgcctcacggacttcgaggcgaagctggagaaggacggcgtcctgacgcgagagcagatggacgcgctgcgcaacagctacaccgaggagatggccgccgccgcccgacaggtgcgcgacgagccacagcccgaccccgaatccatctggaagcacatctacgcggaggacaagtaacccatggcgaacatggcacaggccatccgcatggccctgcactacgccgaggagcacctgggcgtcaccgacatcttcggcgaggacgtgggcgcccccctgggcggcgtcttcacctgcacgcagggcctgaagacgacgtggaactctcccctggacgagcgcggcatcatcggcgcggccatgggcatcgccatggccggcggacggccggtggcggagatccagttctgcgactacgtctacaacaccatcgacctgctgaagctggcgggcaacaccagctggtccaccttcggtgactggaacctgcccatggtggtgcgcacgccggtgggcagcggcatccgcgggtccatctacctctggcactcgttcgacgcgacgatgacccacatcgccgggtggaaggtggtcatgccctccacgccgctggacgcgtacgggctgctcatcaccgcgtgccaggagaagaaccccgtcatgttcctggagcccaaggcgctcctgcgcgtgaagggcgaggagcggattccgggcgagccggaggatgaccgcgcgctgtcgaagctcatcgacgcgccgctgggagaccgctcccagtggaagccgcagtggcccacgggcctggaggcgtacgcggtgcccttcggcaagggcaagatcgtgcgcgagggcacgcagctcaccgtggtgagctacggccgcaccctgcccctgtgcacgaaggccgcggagacgctggccgcggacggaatcagcgcggaggtcatcgacctgcgctcgctgtggccgtacgactgggagctcatcaaggcctccgtccagaagacgggccgcgtcctcttcgtcaacgaggacaccgaagtgacgaacttcggcgagcacctggtgcgccgcacggtggaggagctgttctactcgctgctggccccgccgcggctgctggccggcaagttcctgccgggcatcggcctggcggacgcgctggagatggcgtcggtgccgcaactgggtgacatcaccaccgccatccggtcgctcgcgggcgagcagccgtaagagcggcacccacaatcccctgctcgtgagccccttgtctcacgggagaagcaccccgggccgccattcctctttgaagggatggcggcccattcgttagactccaaaagctttgtcacagccaatcttccggacagccactcccgtcgctggcgctgatgcgccggccttccgtatccgccgcgcccgccggggtgacgccgaagccatggcgtcgctcctcaaggagctgggctacccccaggggacggaccagcagacggtccactgggtcgtcagccatccggagattgaaatcttcgtggccggcgacccgcaggaccggcccgtgggcatggtgtccttctcccaccgtccccagctccggctgcgcggacgcgtgggcaccatcgacgaattggtggtgacggagacctggcgtcgtcgcggcgtgggccgcgcgctcatccggcagattctggagcgctgcaaggtgctgagcgcgaagcagctccagctcgtctcacccatgacgacgacgccggagacgcgcaacttctacacggcgtgtggcttcaccgaaatcgactcgggcgtgttccgccacgtcgatacggaatcccagcgctgaccgcggcgaggcggcgggcaccgtcattcgaggtgcccccgtccgctatcgcttgaagctgtccaccacgcgctgaagccgggcccggtcctcgtcgctcatgtccgtgaagcgcacgccaatggcctcggcctcgtcgcgcacccaggcgatgacgccggtgaggtggaactcctcgccttcaatggccatggacagccggacgtgggagcccacgtcgtaggacttccgcgtcagcaggcacaggccgcccgcggagatgttgatggagtacgcacgcagcgcccgcgccgcgtcctgcgtctggttgaagcgaacctcgaaccgcgccgccacacgctcatccgcccgccggttcgcgtatgcggctggatccccgttctccatgtcatccgccgccttggttgtcatacgcacccgatagcccccacgttcgacgctcctggcgaacaccacgctgcttcccacacccacagtcccacagggtgacgcgccaggccaacctccaggccccgggcgccagccaagtgtccgctgctttccacgcctgattcaagaggccccctctatcgaattcgggtgcctatgtcctcggagacttccccgggagagctctggaatgcgtgtagaccgccgctatgtgttgactggaaccctggctttggccctctgggccgtggcctgcaacggcggcaacgggccgggccccggcgccccgcgggacgcgggcaccgatggaggcagaacgcccaccgtggacggtggcgggacggacgcggacggcggcgcgcgggacttcgcctgcaacgtggcacggcaggaaggctgtgccgacggccaggactgctacttcgcggacctggcggacggcggcaccggcagccgctgcttcgaagcggagtgcgacgtggtggcccaggactgcgcccagggccagcgctgcacgtatgcgatggagaatgacgtcacccagcggcgctgcgtggccccgggcaccgcggacgaaggcgcgccctgcacgctggcgcccagtgacgggcgcctggcctacgacacctgccggcaaggattgttctgccgcgaggcgcctgacggcgcaggaagtggatttacttgccagcgcctgtgccatgccacgacccaatgtgggaacacgagcgagtgcaacaccgtgctccgcctggatggcaccaaggagctgccgctggtctgcggcccgccgtccacggcgtgcaccccctttggcgatgactgcgaggcgccactgagctgctacccgtccacgtccggtccgctgtgcgcgggcagcggcaatcggacggaggggcagtcgtgcgacttcagcaatcaatgcgcgccgggaagcgcgtgtgtgaatgcaggaggcggcctcacctgccgcccgctctgtcagcccggtggcacgcccgcctgctctacgggcggctgccgggcattggatggcaacccaggcgtgggggcttgcgtcccctagacagcaggccggtcgctgtggcgggcggccaggcagacgaggcttcggaggcggagggttcccagacggccggctggcagggcacggtgtggtgtgcatcctgcaaagccgggaggaatgggaatgggaatgaagccggggtggcggagcgtcgtcgtgtgcgcgagcagcgcgctgctggcgtgtactggcagcgtggtggagccacccgacggggacctgccacccgacgacgacagccgcgcttccacgatggaacagaacgcgccggacgcgtcactggaagtcgcgcccgtgttggtgctgaacgacgggcgggaggtgcaggccgtgccgcctttcgcgccgccggcgacttcgttccaaccgggcttccatcaagcgctccgcgcgtcccactcaacgggaagcgtgacgaccttccgcatgcgcgtgccggtggcgcgtgacggcgggcgcatccgcgtgacgttccgcgcgggcaacggaagcatgacgctggtgcgcgccaccgtggcccaggcgggcgccaatggagcgctggcgtccacgccggtgaagctctccttcgatggcgcggagggcttcaccgtggacgcgcgctcgcggaagacgtcggacccggtggacttcccggtggcgttccgggacgaactggccatcacgttcgaggcccgtggcgcgctggcggccagcaccatcagcgccttcccaggcagcttcgcgcgcgtggggaaccatgcgctggtgacgggcgcgctgggcggcaccctgttcgaccgcgccgtcggagtggccaccgtcgacgtggaaggttccacgggccgtgccttcgtggccattggcgacagcatcaccgagggctacgtcgacacgaagaacgacacgcgcaacgcctggcccgccaaggtggaggccgcgctgggcgtgcccgtggtgaacgcgggcgtgagtggccagggcttctacgacgcgctggcgcacctcgacggcgaggtgctggcgctccagggcatcaccgactgcatcgtcctgctgggcaccaacgacctgggcgacaaggactccctgtccctcatccaggcgcggatgaacacgatgctgggccggctcgcgcctttctgccgcacctgggtcagcaccctgctgcccaaggagaagtcgaactacgcgccctacgaagtggtgaagagccagcggccggagctcaacacgtggctccgcagcggcgccgccggcccggacatcatcgacctggaggcggtgacgcgccagccagcgaacgtgcacttgttcctcgacgggctggatgtggacggcatccaccccagcgtcgaaggccaccgggtgatggcggacgaagtcacgcgcgtgctgcgcgaagagggcggcctctagccgcgcccccgcgctcagcccttgcgcgagccgagcacgccgtggagcaccagcagctccgcgagccccggcggcgccagaatccagtcgtcctccgtgggcacccagcgcaccggggccccggccccctccagcaggcggttcacctggaggagcagcggctcgaaggtggagacgggggcctcccggctcccctccggcgccgacacgtcgtgtccaccgggctccaggcggaaggcggcgcggcctggctggggcgtcacctcgaaaccgggcaggtacggctgcatggcggcctggacccgctccaactttagagcacac

SEQ ID NO: 787 - DNA, 8614 bp, Myxococcus xanthus
ccagcgggctctaaagcgcacccgcctgttcgtcggcgtcacgggcagctacgtggccggcgtcgtcgcggatacggtgctgggtctgcgccgcattcccgtggcggacatcctccctccgcccctgggcggcgacgccgcggccgagcacctgctgggcgtggtgcaggccagcggcaatcaggaggccatcaacctcctcaacttctccaagctgctccagacggcacggcagcgggcggtggcgcggtgaacgacgacgccttccatgagaaggaggaggaggtggacctcctcttcttcgacatcggcgccacgctctacggcacggatgcatcccaggtgctgcgcatcgaccgcgcgctgccggaggacctcacgctggcggagctgggcctgcctcaccgaggcaaccgcgccatcgtcttcgacaccccggagggtgaagcccacctcaaggtggacgccgtgcacggcgtgcgctccatccccgtcaattccttgcgccggatgcctcccacggccggcgccgcagcctacgcagtcggtgtgtgcctggaagaggcccgcaccgtgttgctcatcgatctggtcgaaaccgcaaggactcaaggaaggcactgagacacatgtccctggacacccccaacgagaagcccgctggcaaggctcgcgcccggaaggcccccgcctccaaggccggcgccacgaacgcggcgtcgacctcttcctccaccaaggccatcaccgacacgctgctgacggtgctgtccggcaacctgcaggcccgcgtgcccaaggagctggtcggtgagtccggcgtggagctggcgcacctgctcaaccaggtgctggaccagttcgcggcctccgagcaccgcaagcatgtggcggcgcaggagatcgaccaggcgttggatgcgctcatcggcctggtgcgcgagggcgacctgtcccggtggaacaccaccaccgaagacccgcagctcgggcccctgctggagggctttggcaaggtcatcgagacgctgcgcaccttcgtgcgggagatcaacgaggcggcgttgaggctgtcctcgtccgccaaccaggtgctggcggcctccacgcagcatgagacgtcctccacggagcaggcggcggccatccacgagacgaccgccaccatggaggagctgaagcacgcgtcggcgcagatcgccgagaacgcgggcagcgtggcgcgcgtggcggaagagacgctgggcgcggcgcgcgcgggccggggcgccattggcgagttcatccaggccatgcagcagatccgcagcgacggcgtcgcggtggcggactccatcgcgaagctgtccaagcgcgtggagcgcatcggcacggtggtggaggtcatcgacgagatcgcggaccgctccgacctgctggcgctgaacgcggcgctggaaggcagccgcgcgggtgaggccggcaagggcttctccatcgtcgcggcggagatgcggcgtctggcggagaacgtcctggactccaccaaggagatcaagaacctcatcaccgagattcgcgaggccacggccgccgcggccggcgccgccgaggcgtccaagtccgccacggagtctggtgagaagctgggcgcggtggcggcgcaggcggtggaaggcatcctcgccggcgtccaggagacgagcgacgcggcccgcgtcatcaacctcgccacgcagcagcagcgcacggccaccgagcaggtggtggcctccatggcggagatcgaggacgtgacgcgccagacgacgcaggcctcgaagcaggccacgggcgcggccgcggagctgacgcagttggccggacggctggccgagctcatcaagcggttcaaggccgactagcgcttcctggaaggggaggggcgtacgccggccatggacaccgaggctctcaagaaatccctcctgaagaagttccaggaggtcaccgccgaccgcctccagaagattcagctgggggtattggacctggagaaggagaccgcggaccaggccgcggaggacgtcgcgcgcgagctgcacacgatgaagggcgaggcccgcatgttgggtctggccgccatcgggcagctggcgcacgccgccgaggacgtcctgcgcgcagagcgcgagggcaagacggccaccgaggtggccaccgacgtcctgctcagggcgtgcgacgtcctctccgatctcaacgaagacctgtccggcgccaacacgggcaacccggccagcgaggagatggtccgcatgctcgcggaagtctccggacagacgccgcccgccatcgctggcgcacggcccgtggcgccgcctcctgcaccgccgccggcccctgtcgccgcgcccgtggtgacaccggcagccgtcgccgcgccgcccgcgccggtgcaggctccggtggctccgcccccgacgcaggcccccgtggccgagccgggggcgcacgccgccgcagccgcgcctcacccggctgccgcgcatggccgtgacgaggaggccccgagcgccgcgaagtccgcggtggccgaccggagcatccgcgtcaacgtggaggtgctcgacgcgttggggttgctcgcgggcgacctgctggtggagagcgcccgcggccggctgcgcagctcggagacggaggcgttgttcgagcgcttcagccgcctgggggaccgcttcctccggctggcggaagagatcgacatctcgaacgaggtgcgtgagcagttggaccgcgtggagagcgacctccacatgctgcgcgacgacgcgttccgcttcgtgcgccgcaacgacgacggcatcaacacgctgcacggcaacctggcgaagatggcggaccacgtggccgaggcccggctggtgccgctgtccaccgtgttcgacgccttcccgcgcgccgttcgcgagatgtcgcgcacgcagggcaaggaagtggacctggtcatcgagaacgccgacatcggcgtggaccggtccatgctgggcgacgtgcgagacgcgctggtgcacctgctgcgcaactcggtggaccacggcgtggagtccccggacacgcgccagcagttgggcaagccgctcaacggccgcatccgcatccgcgtgcgcgtggacggcgacatgctccacatcgaggtggaggacgacggccgcggcatcgacccggagcggctgcgtcaggcggccatctccaagcgcctcatcaacgcggtgcaggccgccgcgctgtcggagcgcgaggccatcgagctcatcttccgccccggcttctccacccgcgaccaggtcagcgagctgtctggccgtggcgtgggcatggacgtggtgaagcgcaaggtggagacgctgggcggctcggtgggcgtgagcagccgaatcggccgtggctccaccatcaccctgcgcctgccgcagtcgctggcgttgatgaaggtgctgctggtgcgcctgggggacgacgtctacggcatgcccgccgcggacgtggaagccgtcatgcgcgtcaagccggatgaccggctggagatcttcggcacgctggccgtgcggcaccgtggcaagcccacggcgctggtggcgctggggccgctgttgggcctcaacggcggcaatcgcttcgacaagccacccgcggtggtggtgcgtcacggcgaggaccacgcggcgctggtggtggacggcttcgtggacgagcgcgaagtggccgtgaagccttgcggcggcgagttcctcaaggccgcgcccttcatcgccggcaccgcggcgctggaggacgggcgcatcgccgtgctgctccatgtcccggacatcatggcggaggtgcgacggatggcccgccccgtcacccaggcccccgccgccaagcgcctccgggtgctgctggtggacgactcgcccattgcccgcgctacggaaggggcgctggtgaaggcgctggggcactcggtggaggaagcccaggacggcgaagaggcctacgtgaaggtgcagaacaacacctacgacctcatcctcacggacgtgcagatgcccaagctggacgggttctcgctggcgcggcggctcaagtcgacgcccgcggtggctcgcattccggtcatcatcctgtcgtcgctcgcctcgcccgaggacaagcggcgcgggttggatgccggcgcggacgcgtacctcgtcaagggcgagctgggcgtggaggttctcgcgcaggccatcgaccggctgacctgaggagccaggcttgggcggtggcgcggtagtcgcaggaatggcgtttcgggtgctcatggtgggcaaggggctgcgtgcgctcgcggcccggggcctgttcgatggggaatccctggtgcccgtggggccggcggaggtggacttcgccggcgccctggtggccgtgcagcggcacttcccggacgtggtgctggtggacctgagcgcgctggacgcgctgcccgccatcgagcacgtcatggtggagcggcccgtgccggtgctggcgttgcaccccggcgtgttgtccggccaggaggccttccaggcgatggtggcgggcgcgctggacgtgctggagcgtccggcgaaccccgggcccgagttctggacgcacgtgtcgcgcaagctggtgctgctggcgcaggtgaaggcggtgcggcaggtgcagacgcggccgccaccgcaagcggcgcgtgaggcgaagccgcctcctccgtatccgctggtggccatcgccgcgtccctgggtggccccaaggcggtggcgcaggtgctgcggatgattccgcgcgccttcccggcgcccatcgcctactgccagcacatcagcgacggtttcacggaagggctggcgcactggttgtccaatgaaacggcgctgcgcgtgctggagcccgagcatgacgtgctcatggcgccgggcacggtgtacatcgctccgtcgggcagtcacctcttggtccgacccgagggcaggttggagctggacgcgggccccgcgcttcgcggtttccggccgtcctgtgacatgctgctgacttcagcgggtgagtcgttcggcccgcgctgcatcggggtcatcctgacgggcatggggcgcgacggggcgcgagggttgaaggagattcgagagcgcggcggtcggaccattgcccaggacgaagcgtcgagcgtcgtctggggcatgccgcgcgaggcggtgttgatgggcgcggcgcacgaggtgctgccactgagccggattggcgcggcgctgatgcagtgggtggatgtgtgttgacggcgagccagaaagtcttgcaacaactcgcggcgctgctgctggagcgcgcggggctgaaaatcacgccggatggcttccacagcctccgactggcgctgtccgcgcggatgcccgtgctggggctggaagagcccgagcactacatccagcgactgacgggcgccggtggcgaagaggagctgcgctcgctgttgccgctggtgacggtggggcacacggagttcttccgcgacgcgaagcagttccgcgcgctggagaagagcgtgctgccggacctggtgtcccgttcgcggcgcgagatgcgcaaggtgtccatctggtccgcgggctgcgcgacgggggaggagccctacagcctggccatggtgctggcggagctgggcgcgctgtcgctggaggtggacctgtgggccaccgacctcaacctggccgcggtggaggccgcgaagcaggggcgcttcacctcgcggcgggccatcagcatcaaccaggcgcggctgacgcgcttcttcaagcccgtggaagagggctatgaggcgctgcccgcgctgcgtgagtacatccgcttcgatggacagaacctggcggttcccgtcttcgacaaggtggccctgtcgtcgctggacctcatcctctgccgcaacgtcatcatctacttcgacctgcccaccatccgcgggttgatggaccgcttcctcgccgcgctgcggccgggcgggctgttgttcctggggtactcggagagcctcttcaaggtctacgaccgcttcgagatgatcgaagtcgatggggcgttcgtgtaccgccgcccgctgaacgacaagagcatgcgggcgccgccgctgcgcatcaccccgtatcctggcgagcccgatgtcgccgcgcgcaggcccgtgcctgcggacgcgttcaccgcggacctgcgcaagcggatgctgcccgaggacgtcccgttgacgacgcggctgcccgcggtgtcagcgtcgtcggtggcggcgcctggctcgcccagcgtgacgctgccggcgctgggggcctcttcgagtccgcgttccgtggtgccggggcggctgcccgcggtgtcgcctcactcgccgctgccggccatcgccgcgcgctcgcgtgtcaccgcggagttgcccacggtgggaagcgtggactccgcccgtccgcgcatcaccaccgagctgccggccgtggccaccacgccgcgcgcgcccaccgtggaggtgcccgcctggcccacgctgctgcctccggcggagcggctggccatggcggtgcggaagatggcgcagggggatttctcggcggccatcgctggcgtgcagcggctgctcgcggacgagcccagtgacttggatgggctgctgacgctgggcaacctgttctcgctcaccggccgcatccccgaggcgcgcgaggccttcgcgcaggccattcagcgcgagccgctgtgcgtggaggcgcgggtgttcggcggggtcgccgcgttgcaagcaggggagttgagcgaggcgcgctccgagctgagcaaggccctgttcctggagcccacgctggccattggccactacctgctggcgcaggtgcacgagcgcacgcaggaccatgaggcggcccgccgcagctaccgcaacgccattgcccagcttcgcttcccgcagcgtcccctcgcggggcactacccggagatgccggactcggcggatgccatctctcgcgcggcgcgttacgccctggccgcgctggaggagcagcccctgcgctgaggcaggggccgcgtcccaggcttcacgtcagtccaggctgctcttcacctggtccaggctcttgctcgggtcgagcacggagccgaacttcttctgcaggtagctcttggcctggccgcgcagcaacatgccagggtcggtgccctcaccctcgacggccttgtcggtgatgacgaacgaggcgtccatttggatgcccatcaccttgccgacgattttcgcgccttccccctgccagtccgccttcacgccgtacttgccgccccagtactggagcagctgatcgacgcgctgcttgacctcctccttggggagggagtgggggatatcgaacttcatcattcccatggctggctcctgatctcggtgtcccgcttcgtgcgtttatccgtgcccgagcgggaatggaaccgccgtgtcacttttgggcgcgcggatgtcaacaggcttgctcacgggcctgccgtcttgcgaacgcgcttgagcttcaccggtgggtcctccgggcggccccagcgctccaggtagggtgccaggttgtacctggccgccgtgcgcagggagctcatgggccgcaccttgcccagcacctgccgctcctggaaagggcggtcatgcagtcccagcacccacatgaagttggcgacgctcgcggggtccctgccatccaccgcgtacttgtcgttgaggaacgcgatgcgttgcagcgcttcctggggggatggagtccactccaggattttcttcccccacagcatgcgcaggtagttgtggatgcggccacgctccaccaactcgcgctgggccgcgttccacaagccgtccgcggtccgcgctgtctccaattgcttcaacgaatagcggtgctcgcgcgcgtccttctggtggcgggtgagtgtctccttcgcccacggaggcagggaggccacggagagctgctgcggccccggcgtgtggaagcagtagttgaaacccagctcacggcggacgagcagctcctccaggaagccctgcaccgaagcatcctgcgcgccgcgtgcgcggatggcggcgcgcgcggcctctcccgcgaagaggttgccccagtggaagaagggggacaggttggactgtcgcgccaggcccgggtcgttgcggccttcgtcatagccctccaaccgttggtgcacgaaggcctggagcgcatcgaggcccgccttgcgtcctccgcgctcctggatgggcgccaccgaatggtcgaagtcaaaggcgtccagggactcgcgggactcgcgtgcgtctgacgtggcgaagtccggctccagcttgcgtccggccgcggcggccttcaccgagcggttgggcacggcgcggtccaggtactccggccacagcttcttcagcttgggccgcaaggtataggcgccaatctgccgcgtggcgatgcgctgcatgggcaccacgcatgacgcatccacggcgaacagcggcacgttcaggggccttggcggcgcccgcgcaggtgggcccgggatgatgtacgtggggaacaggttcgacacgatggc

SEQ ID NO: 788 - DNA, 6196 bp, Myxococcus xanthus
cacgcccacgcccaggcgcagaccccggcggcgccacgtcttgatgcgctgggcgcgctggatgcccttgaggagcgccagtgcccgcgcgttggtggtgtccagcgccagcacctggttgagactggccagggcgcgcggggtgcgcttctccgcgagctgccgctcgctgcgctccagcagggtggcgacgatgcgctgacgggccagcttccggtacgacggcgggtccgcgaagtacgacaccagctcctcgcccacgcgggcgaagcccaggccggccaggtagtccgccagggcgtcccgcagccgggccgcgtcggggtagcgccgctccgggtcgcgctgcaggcagatggcgcagatgtccgccagctcgtccgacagcgcgggcacgcgccggcgtgcgtcctcgtagtccccgtccaggatacgcttgagcgtggcggtggtgttcggcgcgctgaagggcagccgtcccgtcatcgccgcgtagaacatgatgcccacgctgaagacgtccgccgtggggcccgcctccaggccttcgatgatctccggggccatgtgggccggcgagcccaccagcgtgccggtgacggtcatccgctcctcgatgtccatcagccgcgcgatgccgaagtccatgagcttgaggacgccgtcctcgcgcaccatgacgttctccggcttgaggtcgcggtggatgacgccggactcgtgcgcgtgcgccagcgccgcggccaactcgtggatgaccatggccgccagctccggcgggtccatggggccctcgtccatgaacgccttcagcgtctggccgcggatgtactcggtgacgatgaacgcgtcctgggcgtccgcggcggagaagtcgaagacctccaggatgttggggtggtgcagcttggccaccgcgcgggcctcgcgggccagccgccggcgggactcgtccttgccggccaggtgcgggtgcagcaccttcaccgcgacttcacggtccagggcggtgtcgagccctttgtacacgacgctcatgccccccgagcccagttgctcgaggatgcggtagcgaccgatatggcggccgacgagcgtcgtcatggcggtttggcggtcccctcagtccccgaagctgatgcccatgctcttggtgaagcgcaccagctcacccgccggatccacgcggcgctccttgcgcgactcgctcaaggggaccgcgatgatttcgcccgcacgcagggccaccatgtggtcccactggcccgcgctcaccaggtccagcaccttgcagccgtagcgagtggccagtacccggtccgccgcgctggggctgcccccgcgctggaggtggcccagcaccgtcacgcgaatctccgcctcgatgtgccgggccagcaggtccgccagcgccttccccgagccgccgagccgcaccacgccccggccgggaatggcctccgccgtgtccagcacggccagctcgccgccctgggggaacgcgccttcggagatggcgatgatggagaagctgcgacggcgggtggagcggcggcggatcttctccaccacggactccacgctgtacggaatctccggaatcaggatgacgtccgcgcccccggcgatgccgctctccagggtgaggaagccggcgtggcggcccatgatctccacgaccatcacccggtcgtgggcctcggcggtggagtgcaggcggtcgagcgcctcggtgacgatgagccgcgcggtgtcgaagccgaaggtctgatccgtcccggacaggtcgttgtcgatggtcttcggacagccgacgaccttgagccccttctccacgagccggtgggcgatggacagcgtcccgtcgccgcccacggcgatgagcccgtccaggcccagctcctcgcagcggagcaggacctgatcggacacgtcccgctccacccagtgcccatcctcacgggtcgcgtagctgaaggggttggccttgttggacgtgcccaggatggtgccgcccttggggaggatgccgcgggtgtcctcctcggtgagcgggtgggcgagccctggctccaccagccccatgtagccgttctcgatgcccacgaactcgtagccgaattcgtgcgtgcctcgcttcacgaggccgcgaatgagtgcgttgaggccggggcagtcgccaccgccggtcaggactccaagtctcatgggacggggcatacaggtcggacgcgggtgtcagagggagggtgcttcaccatgacagaaacgtcggacctgattgtagggggggccccccgggggtgcaacgcgtgaatcaccggccagggctgattcgtgagtggaaacgggcgttttcctcagtcccgcttcaggcggcggcgcgaggccacccggtccagcagggcctggagccgaggctccggcttgtcggggagtgccctatctgtcggtgactgtaggggcatggccttcgcgaggccatagagctcgatcagccgctccttgagcagctcgctgtccgggcgttcctggaccgcgcgccggtagcaagcagcggcgcccgcatagtcgcccagcgcgaagaggcgctcgccttcctggacgggggaggaagggcccacggggagggggatgctggcctcggcccgggcggcttcgagcacctccaactccgcgggttggagcaattcgcgcgcgttggcgagcttgagggcgagcccctcgtccgccgggaaggcccgcacgagcgactcgtacaggcggagcgcttcggtgagttcgccgcggcgcagggcgcgatcggcacgtgactccatgtcggccctggcggcggggttcatctcccgggcaggttacccgcgctgcgcggggatgtcacaacgaacacgcagggagacgccgcgacaaggctcggattccgggaggccgcacgctgtgtcggggtggctggcactcaggcgcggatttcaggaggctgtctgtgcggtgcatgtcgcgcgcgcggacgctcgaggccagggcgcggtgcgagggtggccgccgcgattgcgaggagacgtggtgtcccgggctatttcgcctcggtgcggcggaagaacacgtcggtgttttcgttggccaggtcttccagccaggccacgtagccatgcgatccgccgctggaggcgaagacacgcggcgcggaagagcgcgtcggcgtgttgctcaggttcgtcacgggcgtgaacgacgcgcccaggtcaccgctggcccggtagaagatgtcgaccgagccggcggtggtgttttcccacgcgacgcgcagatgcgattgggccgcggagaggctgacggagccggagtatcccggggtgaggctcaggttgcgtggcgcggagaacgtggccccgtggtcgttgctggcgcgcaggaggatgtcgaagttgccggggctgtcgtcctgccacgccacgaagacgtgctgacccgagatttcgaggtccggagcgagcgcgaagccctggctcccactcatggcttgggtggggccaaagctctccccccggtcggtgctgcggcggtagaggatggtgcaggtgtccgggaagaggtcgttgcattcctcccagaccacgtggaccttctgagccttgacggctatgcggtcgagcagcgacggctgacccggtccctctgcggcactgaggttgagacgccgagcgaaggccgttccctcgatcggggctggtcctcaggtacacgtcgggccggtcatccgcgtcgatgtcgtcgcccaccatgtagacgcgattgttggacgcggtcatctctgtcaccccggtgccatgacggtcatccagcgccagtgtggggccgaaggtcagccccttgtcgtgactcgcccggaagtgctgggtcgctgaccgcgcgcccgtgagctcggtccatgtcacgtacacatcgctgttctcggccgcgagccggggcgaaatgccgtgcgcggccagggtcaccgcgggagcgaagtttcttccgttgtcgtggctcacgcggaactggatgccctgttcgtgccaggcgacgtagaccttctttccctccgcgaccacggtggggaggtaggcggacccggtgtcgttgctcagcctctggggaggctcgaagctctttccctggtccgagctcctgcgcaggtagacgtgggtgacgtccagggacgatgtatcactccacacgatgtagacgttgctgtcggcgacggctgtctggaattcgaagttgaaggtgggcgtcccgctcaaattcagcaccggaccgaaggtctcctggagtcgtgccggaacttcctgagccgccgcactcctggagagcagcacggttccgaacagcacgcccctgagacatcggctcatcgtgttcgccatgttccgcgtcccccctcaccaaaggcgacgcggaggaataggcgctggccgcgtgtggtgtcactgatcgggggcgctgttcgcatgggaatggcgaacagggagacgccctggaaaacgagggccccggctcgtccgcgtgcctgtgctccttcaggacggcggagcccgtgcgcggccgagtcgcccgaagggaggtccggcgttcctaccctcgtggctgagcccattcagcagagggattcgtcatgttccacccaacacgacaccggcactccattcactgcatcctgccgccatacctggctcgctccatcgcggagaacggcaccagcgaacaacgtgagcgcgtcctgcggacgctttccacggattcgacgttccgtgcgctccggctcgcggggagcagaacgaccccgtcgacgctcgtcacccgtcccagggcgatgatggtggaatccgcgctgcatcggaccatctacgacttgaggaacagtgaggcgtttcctggcacgcctgttcgcttcgagggacaggaggcgacggacgacatcgccgtcactgaggcctatgacggcctgggagacacctacaacttcttctgggagattttcgggcgcagttccatcgacggagatgggatgccgctgcaggccttcgtccattacgggaacacctacgacaacgccttctgggatggccggcgcatggtgttcggggatggggacggcgacctcttcaaccgcttcaccatctgcctggacatcatcgcgcacgaactcgcgcacggtgtcaccgaggacgaggggccgctctggtacttccgccaggcgggcgcgctcaacgagtccatgtccgacgtcttcggctcgctggtgcgccagatgaagctcaagcagaaggcggatgcggcggactggctcatcggcaaggaactcctcaccggcaacgtggagggagtcgcgctgcgctccatgaagaatccggggacggccttcgatgacgacgtgctgggcaaggaccctcagcccgggcacatgaaggactacgtccatacgtgggaggacaacgggggggggcacatcaactccggtatccccaaccgggcgttctacctggttgcgtcgcacctgggcggctacgcctgggagcgggcggggcgcatctggtacgacgccattcgcgactcacacatcaagcccgacatgggcttcctcgactttgcgcgcatcaccgtgatgtccgcgacgcgcttgttcggcgcgggagaggaggaagacgcggtccgggaggcctgggagcaggtgggcatccgcgtcgcccggtctggtgtccgcatgcccgcgttcgtcggcgccgtcacccagccttcgccacaagcggggcgcgcccccagggcgtgagggctgcgccgcggctgccatgcgcatcgaactcaagcgtgaaggcgggccggcctacttccctgggctggctcggccaagagtggtggacctgacgagcctgccaccagagcaggcggaggcgctgcggcacagtgtccaggccgcccgcttcttcgaactgcctcccgttgtgggcaccctgcctccaggcgccgcggatgcccgccggttcaccgtgaccgtggaggaggaggggcggcggcataccgtccagttcatcgagcccgtggaggagccacggctccatgacctgctggagcaggtgacgaaggcggagagggcgcagcgccgcggcgctcggccaggcacgcctgggtgaggcaccgtgcctggtcgaagacagcg

SEQ ID NO: 789 - DNA, 5228 bp, Myxococcus xanthus
gtcaggacaagcgacccctacaccggaagtcgtacgtcatgtcctgaattctactcgtcatcgcggggttgctccaggtcggttgggccatcggtctcaagtacaccgaggacttcacccggctggtaccaagcgtcctcacgggcggcgccatcgtcgccagcatggtgcttctggggatcgccacgaagaacctgcccattggcacggcctatggtgtttgggtcggcattggcgccgtgggcgcggccatcatgggcatcgtgctcttcaatgagccggccacgcccgcgcgcgtgttcttcctggtgctgctcctcacctccatcgtgggcttgaaggtcaccagcggccggtaggtggcccttcggtgctgatttcccaggcgctgccttgtaggcagcgctacacgtgggagtcatgcgcgatgcgttcctgggtggaggtcgtccgaagcggcggggcctgtggcggtatgccctgggcgtgatggggctgggcgcgggcgtgggtgccctcctcacgtggacgacgacggacggcctccagtctttcggggcgcgggcagatggggcgcgcctggagcggatgaaggcatcgtcgcgctaccaggccggcatcttcatcaacaccgccggtgccaggctgccgcagaatgggccggactggggcacgttgaaggagatgctcttcggcacccagcagcgtacgccgccgtccgcgctgcccatggaacgggacgtggccgcggcgctggcgaagccgccggagagcggcctgcgcgtgacgtggctgggccactcctcgctgctggtggagattgacggcttccgcattctcacagaccccatctggggcgagcgcgcgtcgccgtccaccattgctgggcccaagcggttccatccgcctccgcttccgctggaggcgctgccggacgtggacgcggtgctgctgtcgcatgaccactacgaccacctggacatgcccaccattcgggcgctggtgccgcgtcaggtgacgttctacgcgccgctgggcgtgggagcgcacctggagaagtggggcgttccggcggagcgcgtggtggagctggactggtggcaggaggtgtcactgggggagggggagggccgcctgcgcatggtggccacgcccgcgcagcacttctccggccggggcctgacggaccgcaacagcacgtcctggacgtcgtggacgctgctgggctcgcagcatcgggtcttcttcagcggggacacggggctgacggaggagttcgcggaggtagggcgccgcttcggtccgttcgacgtcaccatgttcgaggtgggcgccttccatccatcttggggaagcatccacctggggccgcagcaggcgctgaaggcgcatgagatggtgcgggggcgcaccttgctgcccatccactgggggacgttcagcctggcgctgcacgcctgggatgcgcccgcgaacgagctggcggccggggcgcgcgagcggggcgtgagtctgctcacgcccgtcttgggccgccccgtggaaccgacgcgggagcgcgcggacacggcgtggtggagcacggtgcaggccgctgctgtcgttggcgacgcgccttgatgtatcgccgaggccccgacgtcacccggagtcagtcggtaccctgacaatcacgtcctgaacaatcggtggccgcgtatgactgctttgtcgtgcttcggccggtatgcaaggtctcccgacgatgcattgagatgtctgtcgttgggtatgggacgtgcagtgcggccgggtatgattcgaacagtactcgtggcgatgctcctgttcgcaggcaccgggaaggctcatggcgtggaggccgcgtcggtgccgcaggcacctcgcgcggagcgtgccgggctggccatctggacggcctccgtcatcgattggagcctgcttctggtggggccaatcctgggcgtgggcctcaatgtcgcgctgccagtgggcatgaacgtgcctttgacggatacaacggatggcgttttcgaactccgacccatgctggcgcgcaagaggtgcaccaacatccacggagacgccatgccccgttgcggcaccctgcaagcccttcgggccacggtgggcctggcgtggacgccctggccgggcgagcggggcgatggcttcttcatccagcccaagctgagtggcatggtgacgcatcagaccgtgcgtgggacggaaatcccagtgacggcggagggcacgaggatggagacgggcggacaggtctccctcgggttcgacgtggggtaccggaagacgtcccgccgctcgcgttctttcctggctccggtgataggcgttggcgtgggctatagctggaaccagcagcgcgggcgggtcgacccgggatggctctttgctcgggagcaggcacgtggctggaaagacaagttcatcgtggacctgaacctggacctcttgcggttcggggccacgttctaacgaccgcggggctgcgtcagtcggcgtcgtcggtgatgtcgaagtgcagcacgtcttcgcgcgtggccagttgcggcaggtgaagtccatgcccggcgtgaatttgcgctgggaaagcagtcgcccgtgtccgcggagtaaggggttcccgagggattgcacccccgcacgctggcgcccacaatgcgacgcgtctggattgtcagatggagcatcatttcccgttttgagcccggatcgggcacggccggatgcgactctcactcacccataaaatcaccctggcgcccatcatcgtggcgctcctgttcgtccttctctctcagggctacaccgtgcctcgcctccaggaggccttcgaggcgcaggggcgggagctgagcggcgcgctgcctgcggtgctcgccgccgcggtggcggacggcatgaagcggagcgcgcacgacgaggtccagcagacgctggaggccgtggctcggcatggtggggcggcctacgtcgccgcgttcgacgcgggggggacgttggtgggcgtggccggtgagaaggcccagatgctacgggatgcccgcgagcagttgaggtcctccgagggagggctcgtcctgcgggatggggacacggagctgcaggacctggtggcgccggtaccaggtgacgccggctgggtccacgtgggcttcgaccgcacccatgcgcgtgggctcgtggaaggggcgctggcgaacgtgggcatcaccgtgctggtcgcgctgctcgtcttcaccgcggcggccttcctggtcagccgcgccatcgtgtcgcccctgaaccagctctcctccgcggtccgccatatcgccgagcgcggcgacctgcggcagactattcgcatcgactcggatgacgaggtggggcagctcgcgcgggccgtgggcatgctggtgggcaagctgaaggagctgctgcatcagctccagtcctcgacggagctgctgagtgactcggtgtcggggctgacggagtcggcggatcagcagaatgagatggtgacgcgccacgcggccgcactccaggagacgcaggtgacggctcaggagattcgccagacggcgatgctggcgtcgggctccgcggagtccgtcatccaggtggccgagcgcgccgagcaactgagccgcaccggcgaggaggccgtctcggcgagcatcgacggcatggaggaggtgcgcaatcaggtggcagagatcgccgcgcgcatcacctccctgggcgagcggaccaggcagatcagcggcatcaccgagacggtgaaggacctggcggaccagtcccacctgctggccgtcaacgccgccatcgaagcggcgcgctccggggagcacggcaagggcttcgtcgtggtggcgaaggagattcgtgcgctggcggaccagtccatccgggccaccaaccaggtgcggcgcatcctccaggacatcaatcaggccatcatcggcacggtggagatcaccgtcgaaggcaccgagcgcatggaggcggggctggcgcaggtccgcacgtccggcgagacgctgaaggagctcaccgccatcgtcgaggacagcaccgcggcggcgcggcagatcgcgcggacggtcagccagcaggccacgggcatcgagcagatcttcaccgcggtcaacgagctgaacaccctgatgacggacaccgtgtcccgcatctccacgaccagtgactccgccatgtccctgaagatgctctccgagcgcgtctcccaggtcgtccgcgcctacaacgtctgacgccgccgcaggagaagcggtgagcttcttcggccgctacgacgcggacggagcggccttcttccgtgacgcgtgtttcgtggcgtgggggcgcttcgcttccaccccgtcttcaggaggctgctgcgcggaagggtaagcacgaccccgggggacggcgagtcacctccgtcagcgggactccgccttcttgtagcgcaggcgcttcatggcctcgaagcgggccctgtccttgggcggcgtggtggccaccagcccgtcgagcatgcgcttcgagctctggaagatttcctcgacggcgacctcgaaggcgtcggtgttctgcttcgacggcgtccgcgtcccggcaatcttccggacgaattgaagcgccgccgcgcggatgtcggcatcggtggcgggaggcgcgaagttgaacaggggcttgatgttccggcacatgccctcagggtaaagcgagtccggagaacaggccattgcgcatcacggagtcctcgtcatgggcgtgtccttcccggcaccgaagaccgagtagaggactgggagcaccacgagggtgagcagggtggacgacaggacgcctccaatgacgaccgtggccaggggccgctggacctccgcgccgacgccggtgttgagcgccatgggcacgaagccgatggcggccaccgcggcggtcatcagcacgggccgcagccgggacacggccgcctggcgaatggcttcgcccagggcctgaccttgctccagcaaggcgcggacccgtgagacgagcaccatgtcccccaggaccgagacgcccgacagggcgatgaagcccacggcggcggagatggagaagggcaggccccgcagcagaagcgcgagcacgccgcccacgagcgcgaaggggacgcccgcgaagatgcgcacggcgtccaggacgcgctgataggtgaggtagagcgg

SEQ ID NO: 790 - DNA, 4793 bp, Myxococcus xanthus
  unsure (1)..(4793): unsure at all n locations
ctaacagggcggcgggccaggcgcagggctccgcacagggccacagttgcaggggaccgggctccgtgcgaaggcggaagctgcccgtgcacctcgaccttcagcccgcaccgccggccggtgccttccgcaagctcgccctggggacatggcgttcgccgggagaccccagcgcctatgcggcggtggaggtgcgcatggagcgggcggtggccttcctcgaagccttccgtgcccggacgggacagcgcctcacggtgacgcatctggtggccaaggccgccgcggatgcgctgcgccgccatcccgaagtgaatgtcctgatgcgctggaatcgcccctggcggcgcaaggaggttggcgtctgcgtgttggtggtgcagccctcggagacggggcgcgcggacctgacgacggccacggtgcatcgcgcggactcgctgtcactgggggctttcgcggagacgatggcctcgcgcatcgcagcggtccgagcgcgccgggatgccgtcatcgagcgtggcaagcggcgctcctcgctcatccctggcttcctgatgggattggcgctgcggatgttgtccttcgtttggttcacgttgaacgtggacctgcgctgggtgggcatgccgtgggacccgttcggctcggtggcggtaacgagtctgggctcgttggggctggagcggggctatgtggccctggtgccgtacacgcgcgtgcccttcctgctggccccgggcgcggtgcggacggagcccgtggtggatgcgggcgcgctggtgcctggacaggtgatgacgctcacttgcacctgggacgcccggctcatcggtgtggaggatgccgcgcgtgtcttgcgcgacatcggcgccgcgctggaggatccggaggggacgtggggctcggcttcgccagaagggggcggggctgcgagcggtgcggaggtggggtagcatcgggccgctgcttcgaaaggggccttcatgtccgtggatacgaaccgccgtgtcattgcttcgcgccccgtggggcgcgcgctcggtgggcaggaccgcttcgagaaggaggggctggaagggcccgcggagggcggcctcgcgatggctcggcggcagcggatggcgggcgggacgctgcgggctggggaggagagcccgttcgccgcgaagctgcggaagctcgcgggcggcgcttcggatgacgagcgttgaatccgcttgagcctcacgccgcgtgaggccgtacccatctcatcacgccacactgccgtggcgggatgaggtgtgaatcatgttcgagaagcactacacgccggagcagctccagcagttgaaggcccgccgcgaggcactgggcgaggaggccatccgccaggtcgaggccgagtggccccaactcatcgctcgcgtccgcgcggagatggaccagggcacggaccccacgagcgagccggtgcgctcgctggccatgcgctggcgggagctgctgaaggcgttcacggggggcgaccctggcatcgaaggggcgctgaatgcgacgcatcagcaggaacccgaggtcgcggtgaagcacgggttggaccccgcgctcttcgcgtacatcggcaaggcaatggccagtctggaggagcaggcgtagccgtggtgaggctgcttgcttctttgtcttcgctggattcagtcacggcgctccaggcgcgtccctggggccctgtgtcaccgaacgcgaggcgtggatgccatgaaggtctatctggatgacgagcgggccactcccgacggctgggtgcgtgtgcggtggcccgaagaggcgatttcgctgctggcgtccgggcaggtgacggagctgagcctggaccatgacctgggcgatgacacgcatggcaccggatacgacgtcttgctgtggctggaagaggccgtggcgacccgtggcttcgtgccgccacgggtcgtccaggtgcattcggcgaacagctccgcgcgacagaagatgacgctggccatcgcccgcatcgagcgcttcgtccaggatgggcagggtggttgagctcgtcccctggtgaaggggcggggcttcagcgcctgcggccgggataggcccgaatctgcgtggcgtaggtgtcaccatccgcgatgtagttgaacgcggcctgcacgggcgtgccctcggagagttgctgtggtgagacgcgcttgccgttggcgctgatgcgggtggtgttggtcacaaagaggttgaaggtgtctccggactccgcgtcgcggaccacgacgtggtcctttccgacggaggccacccgcccttgcatgacgacgctggccagcaccgtggtccccgtgtccgcgtcagacgccgtggcctgcgtccccgagccgcccgtccccgtgccctcgcgccgcaaggtgttcacctcggcttcgagtcgctggacctggtcgcgaagccgcgcgacctcttgctcgaggttctcgggccgcgcgctgctggctgcctgagtctttgctgcgccgccgctggccgcgccgcccgtgggcgcgccagccggtgtttcactgccacccgtcgaactgcccgggcccgtcgtagagggctgggttcccatcgtgctgctgccggccgcgccgtccgtcgcggagccggtcgtcatgccactgccgccggtcgccgtaccgccgacatcggagctggagtctgtcgacatgccactgccgccggtcgccgtaccgccgacattggagctggagcctgtcgacatgccactgccgccggtcgccgtaccgccgacatcggagctggagtctgtcgacatgccactgccgccagtcgccgtaccgccgacatcggagctggagtccgtcgacatgccactgccgcccgtcgccgtatcgccgacatcggagctggagcctgtcgtcaagccgccgccggtcgccgtaccgccgacatcggagctggagcctgtcgtcaggccgctgccgccggtcgccgtaccgctaacgccggagttcgcgcctgccgtgttcgtgcttccgctggtcgtgcccgttccaccggtgccactcacgcccgacccacctgtgccggtcgtgctcgtggaaggagcgttcattccagttccccaggtgccgtcggcggcgttcgcggatgtgtcaggttgtccgctcccgccaatacccggttgtggggtgtacccgcgtgtcgcgcccgccggtggcgcggcaacgggctccgcgccggtgttggtctcaatcgtgtccatcgagtttcttcccgagtcgccgggagccgtttgcggcggaggtgagaagttgcctggttcgtaggcgtcctgtggctggaagatgcccggcgctccgccagacgccgcgcctccggccgagccaccgcctgctgactgggcgagcccggccgacgacgtgaggaggctgaaggtcagggcggcatgggtaatggcgcgtcgcatggtcggttcctttcccttttctttgaaaaggtgcggtccgggggcgaggcggcaagcgcgggaacaggcgaacagccaggaggatggccgcatgtagggagcgttgacgtcaggaagccactgtcgagtccacccttcgggcctctcagcgccggggacatgacggctcacgagcgggggagctcagtgccggtagcgacgtgcgcgctgcttcagcttcagccgcactgacgacgccggcgtcggacaggtgccccagcagtctgtctcgccgctgtcgaagccggtctggagcgcacccgacgtctcgagggttctcggcaacggcgaggagcaacgctgcgtctgtcgcgtcgagctgtgcccactccttgcgcagcagcacaggcgcggcggcatgtgcgccgataaggtcacgacccaaccagaggtgcctcgcttcgaaagcaagcaactcctccgcggtccagtttcgggtgagccagatggtcagggcaagtgttccaaagacgcgtatccgcctttcgccagccccgtcctgaatgcgtgaccatgtgtgagccacactgccggcaagcctgaacccgtgaggcattgtgccgcgcattcctcctgccgcggggcgactcagcgtgaccttcatcagggtgaagaggagggtggtcggccagaccggttgcacgcgaagcgccgacgtgtgttcgctctgcgcccaccgcacctgattccaggaggccgggggcgacgggccctccaccttctggggaagggagggcacccgcgcgagcatggcctggtagacgcactccacagtggccagcggcaccacaagcccgaggctcaacagccacatcatcaccttgaaagcccgtctccagcgcatggcccaggtgcatgagcaaccttcaggccagcgaagccacccgtgagcaccgctgcctctgtcctggccacattcccatggggactccggtgcccaagcgaatgcgcgcgtggcgagcccggccctggacgggcttcagagcttgctgttcggaaatgnnacagcggccgcggcgcttccacatctggcatggcgatgtcctcctcttggagaacataggcagtcgccagtcatgcgatggtcgcgcccatatgacgctccaccgattccttggcaccgctcgggggctgctgcggaatgccgtcggcattcccctgacgctgtacatggcgctccgccccgggaagaaggaggcggaacgcgcgcaacgcaacgccgagacgctcattgnggnctgncgcgcctaccaagcccggcacggacagctacccgacaccctgg

SEQ ID NO: 791 - DNA, 5105 bp, Myxococcus xanthus
atctggttgtctgcgtccagcacactgtgggtgagcgtgccgtcgaacaccaccagccggttgggctggggcgtcaccaggtcgctggtgtccagccgcgtggcagccaggcacggattggccgggtctggcaactcgggcgtcaccaccagcgcgccgccgcgcacccggttgaggaacagcacggaggagatgctcgggtgcaccaattcgccggtgcgcagcgccagcttctcgtcgcggtcctggtggaagtccacgcgcacgtccgtcgggtacatgcgtgacagccaccactccacgccggccacgcggcgtttgccggcgatgtgcgggcgcagcgtgaggatgatgtcctccaccacgttggccgcggggccgaagtcgtaccagaaggtcgtctggtaggtctgacgcaggcgctccgtgcccacggcacccaagcgtcgcagcaggcggcggaagagcagggggggcacggcgttctcagtgagtcgaacgagggtttccacgaggaggacagcatgccatcttcgcctaccgcccggtggcgcggaccattctcctccggcgaggagggctcggagattcgatgaaagcgcaccagaagatgctcgttggcattgcctccggcgcggtggcgggcctcgtcgccaacgtcgtcgcgggcggcgcgccctggctggccttcgtcgtggacaacgtggcctcgccggtggggcagatcttcatccgcctgctgctgatgctcgtggtgccgctgctgttctccgccatcgtcgtggccgtggcggagctggacctcaagcaggtggggcggctgggggctcgcacgctgggctacaccgtcgtcctgtcctccatctccgtcctcatcgggctggtgctggtcaacacgctggagcccggcgcgggcctgagcgacgaggcccgggcgttggcccagggcgggatgaccatccaggcggccgccgcgccaggggcgtcctcgttcggcgcggtgctcgtctccatggtgcccaccaaccccatcaaggccgcggcggatggagacttcattggcctcatcgtcttctcgctcatcttcggcatgggcgtggcgctcacgccgagcgagcctgtccagcgcctgcgcgagtccatccagggcctctatgacgtgatgatgaagctcatcgacggtgtgctgagcctggcgcccttcggtgtggccgcgctgctgttcgccatgacggcgcggctgggcttcggcatcttcgtgcagctcgcctcctacatgggcacggtgttgctggcgctgggcctgcacatgttcgtcgtctactcgctgtcggtgcgcttcctgggcgggcgcagccccatcgagttcttccgcagcagccggctggccatcgtcaccgccttctccacgtcgtcgtccagcgctacgctgcccaccgcgctcaaggtggcggaggagcacctcaagctgccgcgcagcgtgtcgcgcttcgtgctcaccgccggctcggccatgaaccagaacggcaccgcgctcttcgaaggcgtcacggtgctcttcctcgcccaggtctacggcgtgccgctcagcctgtccgaccaggcgctcatcatgttcatctgcatcctggcgggcatcggcaccgcgggcgtgccggcgggctccattcccgtcatcgcgatgattctgggcatgttcaagattccggtggagggcctggggctcatcctgggcgtggatcgcttcctggacatgtgccgcaccacgctcaacgtcaccggcgacctggccgccgccgtctacgtggcgcgcggagagtcggccgacagcccggccgaagagggggccgtggacccctctgcttcctgacgccgggcatttcccgccgcaccttcctcacagcaaacgcagtcccaccgcagtcatcggcaaggagccccgcatgagggtcgccaaggattccgtcgtctcgctcgaataccggctgcacctgggagacggccaggtcatcgaccagagcgcgcccgagcagccgctctcctacctgcacgggcaccggcagatcgttccggggctcgaaggggccctggagggcatgagcttcggggagagcaagcaggtggtggtggcgcccggccagggctacggcgagcacgacccagcgggcgtgcgcaccgtgcctcgcagcatgctgccgcccggcttctcgccgcaggccggccagtcgctgatggcgcagacggaccagggcgacatcccgctgcgcatccaggaagtgcgcgatgacggcgtcgtggtggacctcaaccacccgctggccggcaagacgctgcacttcgacgtcaccgtgaagggcgtgcgtgccgccacgcaggaagaactctcccacggccacgtccacgggccgggcgggcatgcgcacggctgacgtaggctcctgacgcggcgcggccagccttccaggttggcccgccccgtcaaacgcggtgctcgccggggggcgtgggggtgaactatcttcgccgcccccatgagccagtccccctcccagacgcccagtcccagcggcctccgcatccaaccgtccgactcaccgggtgacgcgggcgcctccgcggcgcaggatccggaacgttactggctggagcacgtctatcagggtggggtgcgtcagctcacggtgcgcgccgtcatcgccggcatggtgattggcgcggtgatgtgcctgtccaacctgtacgtcatcctcaagacgggctggagcctgggcgtcaccatcaccgcctgcatcctggccttcgcggtgttcggcacgctgcgctcgattcgggtgctgaagacggagttcaccgacctggagaacaacgccatgggctcggtggcgtcggccgccggctacatgacgggcggtggcaacatggccgcggtgcccgcgctgctgatgctgacgggcacgctgccgtcctcgggctggctgatggtgtggttcgccgtcatctccgcgctgggcgtcttcgcggccatccccatcaagcgccagctcatcaacgtggaggcgctgccgttccccacgggcacggcgaccgcggagaccatccgcgcgctgcacggccatggcgaggtggcccgccgcaagtcgcggctcctgggcatcgcgggcggcatcggcgcgctcgtggtggcgctgcgggacgcgcgcttcacgtggctggccaacatcccggagaaggtgagcctgcccttcacgatgttgggcaaaaaggcgtcggcgtggtcgctgtccttcgagttcagcctgctgctggtgggcgcgggcgcgctggtgagcttccgcacgggctggtccatgctgctgggcgccgtgctcacctacggcttcctcgcgccggccatggtgagccagggcgccatcggcgaggtgacctaccgcgccatcaacagctggatggtgtggacgggctcggcggtgctggtgtcctcgggcctgctctccttcgccttccagtggcgcagcgtggcgcgctccttcaagtcgctgtccggcctgttcaaggggaagaacgcgaaggaggaggatgccgacccgctggccggcatcgagtgcccgcccgcgtggttccccctgggcttcgcgattctcggcccggtggccgtgttcctcatggcctacctgttccagattccgtggtgggcgggcgtgctggccatgccgctggccgtcgtcatgggcgtcatcgccagccgggtgacgggtgagacggacaccacgcccaccaaggcgctgggccccgtcacgcagctcatcttcggcggcctggcgccgggcaacatccccgccaacgtcatgagcgccaacgcgacgggcggcgtggggctccactcggcggacctgctgacggacctcaagtccgggtggctgctgggcgccaatccgcgccagcagttcgtcgcgcagctcttcggcgtggtggccggcgcggccgtggtggtgcccgtgttcaagattctggtgccagacgccagcatgctgggcacggaggagttccccgcgcccgcctccatggtgtgggccggcgtgtcgaagctgctcgccacgggcgtggccgcgctgccgggctcggcgcgcatgggcgcgctgtgcggcgcggcgctgggcatcttcctggtgctgctggagcgctgggccccggcgaaggccaaggcctacgtgccgtcccccgcgggcttcgggctggccatcgtgattccgggctccagctccatcgccttcttcctgggctcggccatcgccgagctgctgcgccgcacgaagccgaagctggcggaggacatggtgctgccggtgtcctccggcttcatcgccggggagagcctgctgggcatcggcatcgcgatggcgaaggccttcggcgtgatgcccaagtaggccgccgcggggcggggcgtctcagtccacccggaaggtggagaacgaggcgcccgccacgaagcggaaggtgggcgtgtccatgccggcgcccacgcccggcccgcccaggacgtagaggtccagccaggacagcgcgtgcttgcggatggccagcagcaactcgccgcccggacggccaccttgcagcggcagccccgccaccaagctcacctcgccgcgcgtgctctccccggcccgcgacgtcaccgtggcgcccagccgcagctcgctgccgatgacgtcctgggagaagccggacacgctggagagctcgtgtttcttgcgcaccagcacgccggcctcgccgcccacctgccacgtctccgccaggaagccgacctgcaggcgggggtgcaccgtgtagtcgtcccgggccagcagcgccgtgctgcccaccgggagcgcgggcgacacgtccgccgccatctggaagccaaagtcctgacgcttcagcgccgcgcgcaggcccagccacggcgttcccattcccgagccttccggagcgttgaagtcccggaagcgcgtgcccccctgggtgacgatgaagggcacctccgcggagacctggagccaccgcaggacgcctgtggcggtcggcaggaccatggtgaagcggggctacaccaggccacggtc

SEQ ID NO: 792 - DNA, 5895 bp, Myxococcus xanthus
taagcagggcgcgaaggccgccgccggcacccccgccaaggcgctgggccggttcgccccgggcgtcaacgtggccatcgccgcggtcgacgtggccaacgctggcgcgacgctgatggacaagaacgcgagcacgggcaagaaggtgacgtccgtcatcaccgcggtgggctcggtcgccgcggccaccaacatcccgattgtcagccaggtgggcgccgcggtctccacggtgtccagcatcgtgggcgccttcttctagagcagagccccacccttcggggtttgtcagagcggctcggctggactatgccctggtccatgccgagccgtcgcttttccccccattggcgcgggcgctggcaagcctatctcccgggagcattcgtgagccgcaagcaagggacgcaaggaccaggtcatggagtcgagcgcctcctgaagatgagcccggtggtgagcctcggctccgccagggccctcgagcttcccaccgtacaggcgccctccctggaaggagtctcggtgcgggtccccaccccggacgacctgaccgaggaggacctgctgcgcgccttccacgagaagcgccgcgccctggcgacctcgcgcgagcgtcaacccggcgagtcgctggagctgggcgacgaggtgcggctcaacatcgtgggctactgcgacgggaagctcatccccttctccgcgcgcttcggcatgacgacggagctggcccccatcgaggccctgcccggcttcagcgaggccgtggccgagggtgccaaggtgggcgagtccctgcagattgccctggagctgccggagacgtaccccgtggaggcgctccaggggaagcccgcgcgcttcctggtggacgtcctcgccgcccacgaggtgacgctgccatcggagagcgcccccgagttcctcgagaagctcgggctgggcagcacgctgggcgagatgatgacccacctgcgcgacgagttggaggacgcggcggcggcacagctctgggtccaggcgcgggacatggtgctggatgagctggtccgacgtgctccggtggagctgcctcgcgcgctggtggacgaggagctgcgccgccgctgggtccaggccgagggccagggcatgctcgagcaccagttcgacgtcgacgagcagcgggaagcgctccagggctggctcacggaccccaccacgcgcgcggacgtcgagcgtcggctgcacatcggcatcgtgctgaaggccatcaccgaggagcagaagcttcagctcaccccggagaagctcgagcagttggtgcgcgaccagttggagcccttcgggctcaccgccgcggatgcgcacgccgccctgcgcgagtcgcccgagacgacgaaacaactcgccgagatgggttggtacctgctcgcggtggagcacgtcatgaacaaggcgaaggtcaccttcgagggctccgagcaggagggctgagggcgccctcgcaaggaacgcgagctcagccctcgctgaaccacaggcccgcgccacccgcgaggcccatgcccaggaacagcgcggcgagcccccacgtctgagcgcgcgaccaccggagcgactcaccataccggtagccgcacaccaggatgagcagggcgaaccccagacaaatcgacgcgggccccagcgcgaccagcaccttgcgcggcgtcccgctcacgtcgaggacagccagcagcaacaacggccagaagccgatgacgagcaggccgagcacgagccccagcccccagcgcccttcgggagaggacagctccatgaagtccaggaagcgcgtccaccaggagcggggcggctctcgatgacgttggggggctgagggctgcacgtggggcggctccagggacggggtgcggtgcacctggcagcctcttctagtgcagcccggggcggttcgcggctactttccttccgtcaagtcggacaccctccctgtctcggccagggtgtccactgaagcggagaggagcccggctccttacgccttcttcacgaactccgacttgagccccatcgcaccgatgccgtcgatcttgcagtcgatgtcgtggtcgccgtcgacgaggcggatgctccggaccttggtgccgaccttgaccaccgtcgacgagcctttgaccttcaaatccttgatgacagtgacgctatcgccgtcctgaagcaggttgccgtaggcgtcgcgcacctcgcgcttctcttcccccggcgctgcggcggcgactgtcgaccactcatgcgcgcactccgggcagacgtagaggctgccgtcttcgtacgtgtaggcggagttgcacttcgggcacgagggcagggcgctcatatcggctccagaggaaggaggagcggaggcatatacacgagcggcgagcagaagggctcccgttccaccaacagcgctcctgatggaacggaagacctgcgtgcaccgcaccgggctgttgagccaccaagctcagcagccagcagggcccctcgcggctcgcctggaggtagcgcagcaagtcgcgcgcggcgttgaagccgagttgctcctccaggcactcgaaacggagcctcgccaggtcttctcgcccgccggaactcccgcacggaaagaagacgcgccggcgtgcttccgtgggcatcgagaaaaccatgcgccgtctcctttgcttcctgctcctgcgtgcgctcgccctggtgcagggagcgtgtgaccgcgatgaccgccccggcacgccggtgccggagaccctgcgggccgaagcgtctaggggaggagccccgcacagcggccgcccgcgatgacctccagtccttgccagagggaggtcagggattgctcacccacgcggcgcgccacctcctggcccgcggcgtccaggaagaggaacgtgggaacgccgcgaacgccatattggaccgcggcccgccggcccgccgcggtccccacatcgaggcggaggacctcaacgccctttcccgagcagtgttgctcggccagggccaccgtgggctccatccgctggcagacggggcagctctggctcacgaactccaccatcgtcgggcgttcaacccgggccagcgcggacggaccgatgaaggatgggacacccccctcctccgggagcgcgcacgtgccatcgccgccttcctcggaagtgcacgcagtctccgaggcggccggcgaggacgaggcgcgacgctccatcacgggggcggaagcctctcccccttccgccgagggcacgagcaactccaacgagtcggtgaagagcagcacccccaacccggcgagcagcacccccgtggcgacctcgaacttgcgcaggtgccgcttcgcgcgctccatccaccgcagcgcaagcggagcggcggcggccacaagtagcagcggaacggagagacccgcggcataggtgccgaggtagagcgcccccatgaggggctccgacgtggaggaggcggtataggtgagcactccaccgagcaccggcccgatgcacggcgtccaccccagggcgaaggcggctccgaagaggaaggcgcccagcaggctgcccccccgccgcacccgcccgagcaggggccgcacctcaccgtccatccagggaatctggatgaacccaagctgcttgagccccaacaggaagagcgcgagccctccgaactggaggagcccgctccgatgctccgcgagcagcccgcccatggcggtggccgccatgccgagcgcgacgaacacggagccgagccccagcgagaacgccagcgccacaccccatggccgccgcacgccgctgcccgcctcccgcagctgcgacagggacacacccgcgaggaaggacaggtagagcgggacgagtggaaggacacagggcgacaggaatgtcagcaggcccgcgaggaagatgccggggaggccaagactcatgtcctcgaggacacggcctcgaacctcgaaagttcccggcttcgcgccttcaaggagccaggcgggccagggcgtcgacgagtatcggcgccgccatttcggagtcggcccatgcggccaggccgcccctgctcgaagcaacgccaatgcgctcaccgacaggggctaggacgcttcgcgaacgagccattcacgaaacgccaccaacttcgcgagagtggcgcactcgggtcggtagacgacgtagtaggcgagtctggacgggaactcgacctccgggaacaggcgcaccagccgcccggccgcaaggtcgtcatgcgccatgatgctgcgggccagcgccacgccctgcccgtcgattgctgcctgaaggaccgcagcggagttgttgatacgaaggcctcgcttcgtctcgacgtcctttacccccgccttctcaagccaggcatcccacgtggcgaatcccgcccgggaatccacggagcggtcgtggatgagtcgtacgccgcccaggtccgaaggccgacgcagacggcggccctgccgaagaagcacaggggaacagacgggatagacctcttcgtcgagaagcttctccgagaccaacccgggccagtcccccgctccatagcgcacgccgatatccacaccgcgcgcggcaaagtcgagcaggtcgatggacgcatcgagccgaacgtccagctctggccatgcggattggaaacgctccaggcgcggtagtagccacttggccgcgaaggcggggctaaccgtcaccgtcagcaccccgaccggtgagccttctttcagcctcgcgactccaacgctcagccgctcgaaccccgcgcggatatctggcagcgcccgctgggccgcttcggtgaggaccagccgcttgcgcccactcgtgccccgatggaagagcggcgtgccgagcgcctcctcgaggcttcgcacgagttgtccgaccgccgccggagtcacatgaagctcggtggccgcggcagagaagctctcgtgcctggcactcgcctcgaaggcgcgcagggcgttgaggtgttcgggcacattcatgggcggtaaagatttcctttgctggatgccaagaacatctcgattgccgcgacgaggccccgggagcatgaatccttcgtcgtcccaatgtgaggagcgtctgacgcgccggcgttggctcggagtggagcccagagccgacgtcgaggcaaccccacaatggatagttgttctttcacgtaacacagacatcaagacggaggaaaccaatggtctacctgcagatcaccctgcaaatttctcccgccaaccggcccgcggccgccgacgtgtacaagcgctacaaggcgccattcctcgagaaggtcgtcggcgcaaagtcgaaggagttgctcgtgcgtgacgaggacgtgcaggtgctccatgggttcgacacggcgcagcaggccaacgcctacctcaaaagcgacttgttcaccgccgacgtggtgagcgcgctgaagcccctcctcgacgccgccccggaagtccgcatctaccaagccgcctgacgccttccgtggggggcctcgcactaccaacggctcctggaaggcgtcctggcccggccggacgagcgtgtcgccgcgctgccgatgatgcctcctgaggagcgtcaggccgtgctcgaagccgcgagcggcgctcgggagacgcttccgaaggacgcgcacatccacgcgctcttcgaggcgcaggtggctcgcacgcccgacgcgctggccgtggtggcgggcgctgagtccgtgacgtaccgggagctggatgcgcgggcgaatgcgctcgccctccgtctgcgcgcggcgggcgtgggactggagcaacccgtcgcggtgtgcgtggagcgctcggtggagctgctggtcgcgctgctgggggtactc

SEQ ID NO: 793 - DNA, 6713 bp, Myxococcus xanthus
aaggtgatgcggcgcccctgacgcagcgggaacttccggcaggcgtccagcaaggccgcgatgttccacttgcggttgacgggcatcgtcttgctgcgctgctcgtctgtgctggcgttgagggagatggccagcttgacgtccgtctccttgccgaaacgctcaatcatcggcaccagccccacggtggagacggtgatgtgccggtggctgaagttcggcccgtcctcggactggaggatggagagcgccgtcttcaggttctcgaagttgtggagaggctcccccatccccatgaacaccaggttggagagcgggcggagcgtctcgtgcccctcgttcttgcgaacctcgcggttcaccgcgtggacctgggccacaatctcgctgggggtcaggttgcgcttgagccccatggtgcccgtcatgcagaagccgcaggccatggcgcagcccacctgcgtggacacgcacaacgtcctgcggtcctcggtgggcatgtagacggattcgatgtagcgcccgtcccgcgtcttccaccggtacttgatggtgccgtcggtgctgcgcagctcgcagtccttcaccagggggacgatctccgcgcgcgccctgagcttctcacgcaggaccttggagaggtccgtcatctcgtcgaacgaggtggcgcctcgctggtgcagccagcggtagatctgcggggcacggaaggcgcgctcacccagttcctcggtgacgaagcgcgacagcgcctccaacgacaggctggccacgtccaccagcttggcgggcgcgggagccggcaatggctcggtgactggcagggaggtggcggaggtctctgacatcgtcgttgcgcttaacggtgggcccaggggcgtcccttcccacacctgggcacggcaagtcaaaggagcccatgctcccctgcccgcctcgtggacactacccggtagtgtctcctggaagaacagcggcccgggcccgcgccttctgagagcacggacaccgggcctggaacggcggccccataggcggccggccggctacttctggtacgggtaggagtggatctccgtctcccggaagaagtacgcgatctcgatcttcgcgttctccaggctgtcggagccgtgcaccgtgttcttgtcgatgctggtggcgaagtccttgcggatggtgccctcggccgcctgcgcggggttggtggcgcccatgatgtcccggttggccaggaccgcgttctcaccttccagcaccatcaggaccaccgggccggagatcatgaactgcaccaggtccttgaagaagggccgggccttgtggaccgcgtagaagccctcggcctgcgcctgggacaggtgctgcaggcggatggcgaccggcttcagccccttctcctcgaagcggctgatgatcttcccgatgacgcccttctccaggccgtccggcttgatgatggacagcgtacgctcgatagccatgtgactggctccttctcgtgtttccgttggggtttagcgcttcttcggagcgccccgcttgagggcctcctgaagggtggtgcccagctcggcggggctggcggccatcaggatgcccgcggcctccatggccttgatcttctcggtcgccgtgcccttgccgccggagatgatggcgccggcgtggcccatgcgcttgcccgggggcgcggactggcccgcgatgaacccggcgatgggcttggtgaactcgcgcgccacgtactcggcgccgcgctcctcggcgtcaccgccgatttcgccaatcatgatgacggcgtcggtgtccgggtccgcgttgaagagcttcagcacgtccacgaagtccgtgccgttgaccgggtcaccgccgatgcccacggcggtggactggcccaggcccagctgggtgagctggtgcacggcctcgtaggtcagcgtgccggagcgggacaccacgccgatgcggcccggcttgtggatgtggcccggcatgatgccgatcttgcacagcgcgcccggggtgatgacgcccggacagttggggccgaccagccggatgcccggcttgccctgcaggtagcgcttggcgcgcaccatgtcgttgaccgggatgccctcggtgatgacgatgatgagggccacgcccgcgtccgcagcctccatgatggagtcagcggcgaaggggggcggcacgaagaccacggacgtgttcgcgcccgtctccttcaccgcctcggccaccgtgttgaacacggggaccttgccttcgaacgtggtgccgcccttgcccggagtcacgccggcaacgagcttcgtgccgtactcgagcatctgcttcgcgtggaacgagcccgccgagccggtgatgccctggcagaggaccttcgtgttttcgttgacgaggatggccatggcgttctttcaggaaagagtgcgcgggattacttcaccgcagcgacggccttctccgccgcctgacgcaggttgtccgccggggtgatggcgaggccggagttgctcagcagctccttgcccttctcaacgttggtgccttccagccgcaccacgagcggaaccttgagctggacctccttcgccgcggcgatgatgccctcggcgatgacgtcgcacttcatgatgccgccaaagatgttgaccagcaccgccttcacggccgggtccgccaggatgagcttgaaggccgcggtgaccttctccttgttggcgccgccgcccacgtccaggaagttggccggactgccgcccaccagcttgatggtgtccatggtggccatcgccaggccggcgccgttcaccatgcagccgatgttgccatccagcgcgatgtaggccagatcccactccttggcctggatctcacggggctcctcttcggccaggtcgcggtactccagcaggtccttgtgccggtagagcgcgttctcgtcgaaggtcaccttcgcgtcgagcgccaccacgccgccatccttcaggatgaccagcgggttgatctccacgagcgaggcgtccgtgtccatgaacatccggtacagcgccgagcagaattgggtgaacttgttcaccgtggggcccgtcaggcccagcccgaaggccagcttgcggccctggaagtcctggaagcccacggccgggtccaccgactcgcggaggatcttctccgggtgcttctccgccacctcttcaatctccacgccgccctcgcgggaggccatgaaggtgatgcggctggtggcgcggtccagcgtcacgcccaggtacagctcctggccaatggcgagaccttcttcgatgtagaccttgtggaccgtctggccttccggcccggtctggatggtcttgagcttcatgccaagcatctgcttggccagctccttggcttccgcggggctcttggccagcttcacgccgccgcccttgccacggccacctgcgtggatctgggccttcacgacgaccacagaagtgccgagctccttcgcggcggcctccgcgtcgttggcggaaacggcgaggatgcccttcggcgtgggcacgccgtacttccggaagatttccttgccctggtactcgtggatcttcatcgaggctccggtggagacgagggagacagcctgaacagaggcgtcagcgccgggccctcattgcgcagaaaaggacggagtgcaagaccgtttgaccccggtacacctgcatcgtccgacagggtgcacggcagataatcagggatgtccgcgaagatgagcctgccttcaccgcagggttttccacggacacccaaacagcggcggccccgcccggcgtctcgaatggacgccggcccggggccgcttgaagccagagaacgccgggaagtcgctggcgagcgccctaccccggaccgctgccgtggcccttgggggcctcgtcctggaagaagatgtccttgatggtgagcttggtcacctcgcggttcatcaccgcgatggacgtgacgagcggaatctccttcgggcagaccttcacgcagttctgcgccttgccgcagtcctggatgccgccgggccccatgagcgagcgcacgcgctcctcggagttcatcttgcccgtggggttcatgttgaacaggcgggcctggctgatggccgccgcgcccacgaagtcgttctcctgcgtcacctgggggcacgcctccaggcagctgccgcaggtgatgcacgtggacagcacgtacatcaccgactggtccacgggcgcctggcgcggccccggccccaggttgtgcgtgccgtcgatgggcacccagcccttgatgcgcttgagcgcgtcgaacatgcggtcgcggttcaccgtgaggtcacgcaccacggggaacttgctcatgggctccagcgtgatcggctgctccagcttgtcgatcagcgccgagcaggccatgcgcacgcggccgttgatgttcatggcgcagctgccacagacctcttccagacatgcggcgtcccagatcaccggggccacgcgcttgccctccacggtgacggggttgcgctggatctccatcaggcacgagatgacgttggcgcccttcgcatagggaaccttgaactcatcgaagtggcctggcttcgcgggatcatcctgccgccagatgcggaaggtgatggtcttggtggtgacagcggatgcttgtgcagtgtccatgtggctcgacccttcacttccaaatcggttgagtggttcccgtctcaggcgtaccagcgcggctcggggtccagcacgggcgtagggatgtcctcgtagtggatcttcgggccggcctcgctgtacgtcgcgacggtcgtcttcgcccacttctcgtggcgcgcacgccacaggctcatccactccgggtcctgcgtcgggtccttcgtcttcggttcgggcagcgagaagtccggcttgtagtgggcgccgcggctctcgtcgcggagcagcgcgctggtcgcgatgacctcgcccagctcgaacatgttccacagctggttggtgtacgacagcgcgcggttggccacattgcccgtgtccagcacgttgacgttcttccagcgctccttgagctcgcggatcttctcgatcgtcttcttcagacggtcgttgtagcgcacgacggtgcagttctccgtcatggtgtcgcccagctccttggcgagcccgtacgggttctccgtgccactcatcttgagcatggtggcgaaacggtcctgccagtactgccgggcggcctggaagtgcttctccggcatcgccgcggcgctggtgccctggctcttggcgaaggagaccatggccgggccgccgatcatgccggagtagatgcacgacagcagcgagttggcgcccaggcggttcgcgccgtggaaggcgtagtccgcctcgcccgcggcgtagaggccggggatggtggtggactggttcttcgggctgccctcggccggcgtctgcgtcttcgggtcggcctcgaagttcacgtacaggccgcccatggagtagtgcatgcccgggaagatgaccatgggcaccttgcgcgggtcgtcaccgacgaacttctcgtagatctccatgacgcccttgatcttggcgtccagcaccggcgcggggatgtgcgtgacgtccaggtacacgccgtcccggccgttgatgcccatgcccagctcgcggcagaccatgaagatctcgcgggtggccacgtcgcgcggcaccaggttcttgtacttggggtacttctcttccaggaagtaccagcgctccgcctccgggatctgctgaggcgcccgcgtgtcgcccttcttgcggggcacccagacgcggccgccctcgccacgcaccgactcgctcatcaggcggagcttgtcctcgcccggaatcgacgtcgggtgcacctggatgaactcaccgttggcgtagtgcgcgccctccatgtaggcgcggcccgcggcggtgccggtgttgatgatggagttggtggagcgtccgaagacgatgcccggaccacccgtggccaggcagacggcctcggccgggaaggtgcggatctccatggtgcgcaggtcgacggccacgctgccgatgcagcgcccgctgtcgtccttcaccgtgccgagccactcccagtactcgtacttggtgaccttgccctcggcctcatagcggcggacctgctcgtccagcgcgtagagcagctgctggccggtggtggcgccggcgaaggccgtgcggtggtgcagcgtgccgccgaagcggcggaagtccaacagaccttccggcgtgcggttgaacgtcacgcccatgcggtccaacaggtagatgatgccgggcgcggcatgacacatgcccttcaccgaaacctgctccgcgaggaagtcgccgccgcgcagcgtgtccttcacgtggatatccgggtggtcgccttcgcccttggtgttcaccgcgccgttgatgccgccctgggcacaaacggagtgggaacgcttcaccgggacgagcgagagcacatccacctggtggcccgcctccgcgagcttgatcgtcgtcatcagcccggcgaggccgccgcccaccaccgtgaaccgcgctgctggtgccatcatcgtctccttgactgccggacgtcggacactgctcggttgagccggcccgccaggtggcgcgccagggcccggacgtcccgtgcga

SEQ ID NO: 794 - DNA, 5808 bp, Myxococcus xanthus
acacgctctacacggcccaccgtgtgcgcttcccggtggagaaggtgcgcgcctcgctcgtgtacctcaacgagggcaaggagcaggacgtcgcggtggacccggaggccatggcctccttccaccggcacttcgagcagagcgtggcgaagatgcgctcgctgctgaaggacgcggccaccaacacgccgctggacgcgtccgcgtttccgcccacggagtcgctgacgtcctgcgcacggtgcgtcttccgccgtccctgcggacgcgagggcgccgcgcccgaagcgccccaaccgcagcaggtggtctgagcgcctagcgcgccgacgcgagccgccgcaccaccacgcccgccgcgttcatcccgaagcaggacgtgacgaaggccacgctgccgtcaatctgcgtgcggtggtcgcaggtgtggaactcgttgtcctgcgggcacacgcacaggaagccgtcggtggcgtcgtcgtactggagcgtcaccggcagccgccgcgcttcgatggagtacacggcggtgattcccgtgtgcttgtccgtctccaccgcgtacttgcgcttgagcagcttgcggatgtccttggcgaaggggtccatgtgcgtctcggacaggtcctccacgcggatggcggtggggtccaaccggcccgcggcgcccatggagctgaccaccggcacgcccagcgtcacgcagcggtgcagcaggtgcagcttcgccttcacgttgtcgatggcgtccacgacgaagtcgtactggcccggctggagcatctgctcggccacgtccgcgcggtagaactcgcgcaccgcctccaccttcgccgccggattgatttcctggcagcgctgcgccatcagctccgccttgggcttgcccacggccttcaccgtcgcgtggagctggcggttggtgttggtgacgcacacgtcgtcatggtccaccagcgtcaggtggccaatgccgctgcgcaccaggccctccgccgcgaagctgcccacgccgcccaggccgaacaccaccacgcgcgcgttggccagccgctccatcgcggagtcgcccagcaggcggccggtccggtcgaagcgccgggagagcttgaagggacgggcgagcgagtccggggcggtgggcggagtctcaggggcaggggcggggagcggctgcggattcatggcggtcctctataacgcgaccgctcgcctaccgcgaaggtgcagggaaagcttcccggaagaagcggcgggcattctcggtcgtctgccgggcgacctcctcgacgggctccccccggacgcgggccatgccctccaggatgcggggaaggtagcccggctcggagcgcgtcccccggtggggcatgggggcctggtccggggcgtccgtctccgccatcagccggtccagggggatggcccggagcgcatccaggggcttgcgggcctccgcccaggtgacggggcccgcgaaggagaagtggcagcccttctggagatagaagcgcgccaactccacgccgccgctgtagctgtgcatgagcaggccggcctcggggaggggctcctccttcagtagttcgatgagggctgggtgcagccggtggcagtgcatcagcacgggcaggccgtgcttgcgcgccagcgcgaggtgccgcttcagcaccatcacctgccgttccagcggcgcgcccgggaggctggggccatccaatccgcactcacccacggccgccgcgccgcccttcgcgagcaacgcgtccaggtgctcgagcacggcgtcgtcctctgccgggggcatgtcggggaggagctgcgggtggatgcccaggcccacctggaggcgggcatcctggcgggacatctccagcaagggctcccagtcatgcgggcccacgccagggatgacgatgccgtggaggcccgcggcccaggcgcgcgagaggacttcattcctgtcggcgtcgaagcgggacgcatccaggtggcagtgggtgtctatcatcgagcaggctgctcccttgggccgttcattcaggaacacgctgcgtgctcctgcgcatccgggtgcgcgcgcccggaaaggccgacggtatacgcgccctctatcctccggagggtttccatgaccaagcgtgtcgttatcagcgcgctgtgtggcgtgctgctggtgctgtcgacggggtgcggtgacgagtgtgtcgatgtattcgactgccgcagcgacaaagggccccctccggcggggaaggattggacgtgccgctcgggcaactgtgagctgcgcgatgtccagcggccgcccgagggggacgctgggacggaagaggacgctggcaccgagggagacgcgggcaccgaacaggacgcgggcactgaagaggatgccggcacggacgcgggcacggccgacggcggtggcgtggtcgtcatcggcacgggggccaagggtgatgcttgcacgtcgtccgccgactgtgccgcgggcctgcgctgtgagggcacgaccgaggccatgacgtgtcaggcgctgcacgtggccttcacggccatggacgacaccgacgaaatggctgcggtggtgacgcgcttcgatgcgccggagcccacgcggctgtcagacgccgaggagaacagcctctacccgcgctggaacccggccggcaaccggattgccttcgtccagggcgccaccgagacgggcacctcgacggggaacctggccggtgagctggtggcgcgcgacgtgccgctggtggcgggtgcgcccacgatgctcgccaacggcaccacgggcagcaccgagggcttcctctacctggagtgggagccgggggattctctcctgtacgtgcgccgcgcgggcgacagcatctccggcatctcccgcgtcccggccgagggcggcacggtggagcaggtcaccgcgttgggctcctccccggcctggcgcaatggcaacacgttcgcgttcagcaccgccaccgtcggcatctccacggccaccgtgggcggcgcgcccacgccgctggccatcgcgggcaccacggcggagcagccgcactacaaccgcgtcaatgaccagctcctgttcctccgtccggatgacacgcggccggtggggctgaacgccgcgctctacatcgtccccgtgcgcggcgccgccgtgcaaacgattgccgagttcaccacggcggccgtcgagggtggctcggtggattcctacatcgccaaccccacctgggcgccggatggcagctgggtggcgtacgtgcgcgcctacttcttcaaccccaccacgggggagccggagctctgcggcgccggtgactcgccctgtgccggcgacccgggcaacatcattttcctgcgccgcatcaacccggcggatggcaccccggtgggggatgaggtcagcttcgccgagggcgccacgctcccgtcgttctctccggatggccactacgtggcctacatccagacggggcagctctacgtccagcagattgatccggcggcgggcgcgaaggtaggtgaccccatcgtccacccgctggggggctacactctccagacgtcgcgcggcgatgaccaccgtccgcgctggcagccccggtagccccaggctgttgacggcgtgaagtcccaggcccgcgtctccccaggggacgcgggctttcttcgtttccgggatggtgcgcggcgccttgtctccgcgcgagatgcggcatagggaggggcgcgcgggcccacccctgggtccgtccaccggaggacccgcatgaggcgctctcttgttcctggcttcctgctcttcaccgcctgcgccaccgcgccggctcaccgcctggacgagggcagtggtggcaccgcggccgaggagccacagtcgctggccgcgcctgtgcgcctggagacacgctccggcagcttcctggtacacccgaacaacgcggcagacttcgagaagctgctcgcgggagagcccacgcggcagcgctactccgccggcatcctgatggcgggagactgacgtccacgccagccgggacaggggcggagggctcagccctccacgacgatgcgacgccccagcgcccgggtcatctgcggcgaggtgagctgggccagcacatccaccagctccccgccggaggtctcgaaggccgccgcgatgacctcgcccaccgtcaggtggaccttgcccgctgccgcccgggcccgctgagccgttcgccggagcgcgggcatcacccgccggccctgcctgggaaccgcgccacttctacgagtcgtccgcttgcccatgggttcctcccaccgcaccgtgctacgcgggtgagtacaccgtgggtctgacacatgcagttgaggtgccagccgtctgactacctgtccggtgggacaatgcccctcatttcccaggcagaaagcggggttaagcagacagtcggctcgctgggttcacggtgctgcccgggtatgaatcgtttcatcgagcgttttcgttcactccgagcgcaatctcgacgtttcgttcaacggccccgtttcgtcacgtggcttacaattcttggcacccaggtccaatctgaccccgatgtcagagtcaagccttcccgcagaagtccgtctttcccggcggaaagccagaacatcctgacgcaaatgtcgcggcctcgtgggcggcgcgggcagtgcggtatacgccggggggcatgccccagactctctgtccgaactgcggccatagccccattccgcgcggtgccagtgcgtgcccctcgtgtggggagccgttcgaccatctccagtcccacaagaaggttggccggatgcggctggaccggcccatggtggaggcggacgacgacgccacggtgttcggcggggaccttgtcaccagcgcggtgtccgcccatccgggccctgctgcgggggtgttgctggcgagcgccgcggcctggttcgtccgcgccgcgggcctgttgggctcgctggaggaccccgcgtggacatacggcctggtgtgcctgggcgcggtgctcgcgctggtgctggtgctcaaccgcggccccgcgaaggggatggcgcaggtgggcgtggtggtgcaactgctggccacggggtggctggcgcgtgaggcaccgctggcccccgtccacgtggcctacttcatcctcggggtgctcgccttggtcatggtggtgggcgagccggggcccatgcggcgctacctggggctgggtttgggcctgggagcggcggtcgcttcggcggggttgttggcgcttcccatcgcggggacgtcgggcgcgggtgtgcgtcagtccctggtgggcagcgagctggggtatcggctggagctgcccccggggtggggacagttgacgcgcgagcagctcgcaccgcacctggtcctgcccgcgtccaccctgcagggcggcggcgtgggcttcggcgacgcggcgcaggaacgctacggcctgctctgggtggagcgcggcacgggcaaggcggcggccgcggggtgcaaggggttgttccaggcgctgggcggtgcgctgggggaggcgctgtcacttcccgcgcctccggcgttggggagcgcggccaccgtgcatccgctgcgcacgccgggtggcgcggaaggcacgctggcgtgcggggtgctggcggacgggcggctcgtggggctggtggtggtggccgcccaggcgagtggcggcgcggacgaggcggccttccctcccgcgcagcacgggctccacggcgtcggccatggcttccagctggaccgat

SEQ ID NO: 795 - DNA, 5613 bp, Myxococcus xanthus
  unsure (1)..(5613): unsure at all n locations
aggtccacaccgccggcggcctcttcatcatcggcaccgagcgccacgagtcgcgccgcgtggacaaccagctgcgtggccgcgccggccgccagggtgacccgggtggcagccgcttcttcctgtcgctcgaggacgacctgatgcgcatcttcgggtccgagcgcatccagggcctgatggagcggctgggcatggaggagggcgaggtcatcgagcacgtgtggctgtcacgtgccatcgagggcgcccagaagcgggtcgaaggccacaacttcgacatccgcaagaacctcctcgagtacgacgacgtgatgaaccagcagcgccgcaccatctacaagctgcgtcgccaggtgctggccgcgggcgcgggcgtgccgctggtggagtacgacgaggatccgaagacgcgcatcaagacgcgctccgagcggaccgtcagctgggcggacttccgcgagctgatcctggactcgatggaggacgtcatcgtgtccctcaccgacacctacgcgcccacccggggcgtggagggctgggacatcgccgcgctccagcagggcgtgaaggagaccttcaacctcgagatgaacttcgagggcgtgggcaaccgcgaggagctccaggagcacatctacaaggcggcggagaaggtcttccaggcacgcgatgaggagttcggcgagaacttcatgcgcttcctccagtacaactacctggcgaccatcgaccggctctggaaggaccacctgctggccatggaccacctgcgccagggcatcggcctgcgcggctacggccagaaggacccgaagcaggagtacaagaaggagggctaccagggcttcatccagatgctctccgccatcaaggcgcagttcgtcacccagctcatgcacgtgcagccccgctccgcctccagcgcggcggaagaggccgcccgcatccagcgccagctcgcgcagcagcagaagaaggcggtggagggacgcgccacggcggacggcaagctggatgagggctcggtggccgcggcggcgcgtccggcggcggccagcaggccggcggtgggccgcaacgacccctgcccctgcggcagcggccggaagtacaagaagtgccacggtgcctcggaggccagcgtctaggacgcgggctgactgacaggctcatcgtggaagacgccggcgcggcgccaaccctctgggggggcaccgcgccggtgctgtcttggcggggcgaaggggcctcgctgggacgataggagggcgggggagcggcatgtgccgtccctgcccggacgggcggtgcggcgaagcttgcgcggcccggaggggttctgttaaggacgccccgccccacggtatggggtcggggggcagtcgaccccaggcagtacccactacacacacgtccgtgccggtcgccggtgcttccgtgggtgagggcctctcctcggagaggagctcctccgcggtcgtttcggccggaaggtttgctcgggcgtggcggaacaaccggagagacgacatggaaacgcaggacacgcagacgcagcagcaggcgatggccgccgccggtggcatcacgatgaggcagctcctggaggccggtgttcacttcggccaccagacgaagcgctggaacccgaagatgaagccgttcatcttcggcgcgcgcaacggcatctacatcatcgacctgcagaagacggtcgtgatggcccgctcggcgttccgcttcgtggcggacatcaccgcgcgcggtggctcggtgctcttcgtcggcaccaagaagcaggcgcaggacgtggtccgcgaggaggcctcgcgcgccggtcagttcttcgtcaccagccgctggctgggtggcacgctgaccaacttcaagaccatcaagcagggcatcgaccgcctgaagacgctggagaagatggccgaggacggcaccttcgagcgccttcccaagaaggaagtcgcccagctcgagcgtgagcgcgagaagctggagaagaacctgggtggcgtgaaggagatgtcgaagctgccccgctgcgtcttcgtcatcgacccgaagaaggagcacatcgccatccacgaggcgggccgcctgggcatcccggtcatcggcctggtggacaccaactgcgatccggacggcatcgacttcgtcatccccggcaacgacgacgccatccgctccatcaagctgttcacctccaagatcgccgaggcctgcctcgagggcgccgcgcgttaccgcgcctcgggcgccgccgagcgcgacgagcaggaggagcgcgagggccgtgacgaccgtggcgaccgccgcgatgaccgccgtggcccgcgccgcggtgaccgccgcgacgaccgtcgcgaccggggtggtgaccgtggcggcgaccgccgtggccccctcgttgagatgaagggcgcggcccctgtcgcgtccgccgagccggccgccgaggccgctcccgagggtgaggcggcggccgagtagccgtccctttctcacgtcagtgccgaagcggccgggtggcatcagttcgccagctccccggccgcctctgtttccctggtgccgcagtatccccttgaacttacaatgctccgcccggcgcagtgcgccttggagtggcggaggcaggagacgacgatggccgaagttagcgcccagatggtgaaggagctccgcgagcggaccaacgcgggcatgatggactgcaagaaggcgctcgccgagtcgggtggcgacttcgccaaggccgaggagtggctgcgcaagaagggcatcgccaaggccgctggcaaggaaggccgcgttgcctccgaaggcatcatcggcacctacgttcacagtggccgcatcggcgtcatcgtcgaggtgaactgcgagacggacttcgttgctcgcaaccccgacttccaggagctggtgaaggacgtggccatgcagattgccgcggccggccccaagttcgtccgtcgtgaggaggtccccacggacaacctggacaaggagaaggacatccagcgcgagatcctcaagcagcagggcaagcctgaggcgatgctggagaagatcctcgtcgggaagatggagaagtactacgagggcgtgtgcctcgtggaccagctctgggtgaaggacgacaagaagaaggtcggcgagatgatctccgagcgcgccgcgaagattggcgagaaggtctccgtgcgccgcttcgtccgctacgagctgggtgagggcatcgagaagaagaaggacgacctcgccgccgaagtcgccaagacgctgggccaggcgtaaggcctccgcggtccccacggggccgcgagcctggacgcagggctgacaagggccgcgcgcgccggaaacaccccccacggggcgtccgggcgacgcggccctcgctttttgcgggtctgattggcccctccccgtgcgaccgccagcggacgatgtggggccggcccaccgactccagcgttgatccctcgcggagcgggggatagaagcggtggcgcatgtcctccgacacgaagaagccgctcccgtatcagcgcattctcctcaagctctcgggcgaggccctgatgggggaggggaagtacggcatccatccgcccacgctgatgggcatcgccgaggaagtcatcgagttggcgcaggccggcgtggaggtcgcgctggtgattggcggcggcaacatcttccggggggtcgcgggcgccacggagggcatggaccgcgccagcgccgactacatgggcatgctggccacctgcatcaactccatggccatgcaggacgcgctggagaagaagggtctgcacacgcgcgtgctgtccgccatcaagatggagcagattgccgagccgtacatccgccggcgcgccgtgcgccacctggagaaggcccgcgtggtgattttcgcggcgggcaccggcaacccgtacttcaccaccgacaccggcgcctccctgcgcgccatggaaatcaacgcgcaggtcatcctgaaggcaaccaaggtggacggggtgtacagcgcggacccgaaaaaggaccccaccgcacggcgctatcggtcgctgacttacatggacgtgttgaagcagaatctcaacgtcatggactccacggccatctcgctgtgcatggacaacaaagctgccccatcatcggtgttcgaacctggacggcagcggggcaacatcccccgcgcggtgctgggtgaagggnacattggtacgttggtgggtggcagcgagacggtctgggcctgagtcccgaccccccggcaagcactcaaggagagaacgcaatgagtggagacgtcgtcgccgaactgaagggccgtatcgacaaatcgctcgagggcctgcgcacggacctgacgagggtccgcacgggccgcgccagcatcgccatcctggagggcgtccgggtggactactacggcacgccgacgccgctgtcgggcgtggccagcgtgaacgcgcccgagccccggctcatcaccatcaagccgtgggagaagagcgtcctcaaggacatcgagaaggcgctgcgcgaggcgaacctgggcatcaacccgatgaacgacggcgagatgattcgcctgcccttcccgccgctcactgaagagcgccgcaaggacatcgccaagcaggtgaagaccaagggcgaggagttcaaggtcaccatccgcaacctccgccgcgacgcgaacgaggtgctgaagacgcagctgaaggacaagaagatcaccgaggacgaccacaagcgcatcaccgaggtcgtgcagaagcagaccgacgcgggcatcacgcaggtggatgaaatcgtgaagaagaaggagaaggaggtcatggaggtttgatgtcctccatcgtcctcgccgagccctccgcaccggtggcgggcgttctgcgccgctatctcgaatccgccggtcatgaagtgtcctgggtgagcagcgtcgacgaggcgctgcgcacggtgagggaacgaatgcccaccgtcctgctggcgtccggaacgggcgccctggacggtgaggcgctgtgccggagcatgcgggccgaaggcctcgccgcgccggtgttgctgttgtattcgccggacgaggagcaggcagacacgcgggccgcccaggcgggcgcggacgggtgcctggtggggccgctgaagcgccccacggtgttgacgtgcgtgtccctgcttgtccagcgcgaggaggcgctgcggcgggtgggttccgtgggcgtacggccgccgccacccccgttcgatggggcgtctcacgcgggtgggccccctccgcttccgggcgcgttgggcgggcggatggttccgcctcctcctccgccgctcgacggcgtggatgcacctgtcgagagtgtggatgcgcggggcatgccccctccgccgccgctcgacgaagaggcaccggaagcggagagcgcacaggcgcgggtggtgccaccgccgcgcgaggcggaagcgccgttgtccgagggccacggcgcgaagtccgcgtcgctgccacctgagctggacgaagagcccatcacgtcgccgtcctcagaagcggacagcacg

SEQ ID NO: 796 - DNA, 6603 bp, Myxococcus xanthus
tgtgctctaaaggcgacttcgtcctcaagtcgaagggcgtctacaacggctcgcacgtgaactggaagggcacccggcgcctgcgctgccgcaccctgcgcgccgagcccgtggacggcggcgacgtgttcctggacgtggacggcgagacgccgggccgcctcccgtgcaccatgacgctgctgcccggggccatccgcctcaaggtgctgtagcgctcacgcgccccgattcgtcgcccggtcgcctgtcgagcgacatggcacttgggacgtggggctggactgaggcaacctcctgcatccagtggcgtccggcgttaggtgcgctggacgctcggcaccgtgcccgcggtgcctgctgtattggcccaggagacgcgccatgcctcaagagcgaggacccgcacagctcgacctcttcaccggcgccgccgtggagccgcccgccaagggccgcaagggcgcgcagcccgtggagcccgcggccgtgccggagtcgctggccacgctggggcgggagctgccgcagggcgtgttcctcgggacgtcctcgtggacgttcccgggctggtccggcatcgtctatgaccatgaggcctccgcctcgcagctcgcgcgggagggcctggccgcgtacgcgcaccacccggtgctgcgcacggtgggcatcgaccggaccttctacggccccatcgcctccagcgccttcgccgagtacgccgcccaggtaccggacaccttccgcttcctggtgaaggcccatgaggtctgcaccctggcgcgcttcccgctgcacgagcgctacggcgcgcagcggggacaaaccaacgagcgcttcctccatgccgcctacgccacggaggccgtcgtcatgcccttcgtggaggggctgggggagaaggcggggccgctcgtcttccagttcccgccgcaggacccgcaggcgctcggcgggcccgcgcgcttcgtggagcggctgcacgccttcttcgccgcgctgccgaaggggccgctgtacgcggtggagctgcgcaacgaggagctgctcacggaggggctggcacaggcgctggcggacgtgggcgtcagtccggtgctggcggtgtgggcgcacatgccgcccgtgggccggcaggcgaagctcactcgcgccttcgaatcccgcgcgctggtggtgcggtggatgctcccgccggacctcggctacgaggaggcgcgcgcgcgttacgcgccgttcaacaagctggtggacgaggacgtccccacgcgcgatgtcctggcccgggtgtgcctggcggcgctgcgccgggacaagcccaccttcatcaccatcaacaacaaggccgagggcagcgcgccactgtccgctatcaaactggccgagcgcgttgtcctgggcaggcgggaagaggccgagcgtcacgccgccacccgttgagtgtcacttgccactcagcacgcgtcttgcttacctgttgggccatgacagtcatgacggttgcggcactggtggtccagctgatgtccgcagggggcgcaggcgcccagggcgagcaagcagccggccgccagcaaggcgacccgggcagcatctccacgaacctctccgcgctgaagggcgaagtctcatcgctgtccgagcgcttcaaggccgcccgcgagcggcgccgcttgcaggcggagaaggagaagcaggagtgggagcgtgagccgaaggcgcctgccggtcctcgacgcgaatgagccgccgctcccgcccgaagggccggagccgccgccttccgaggatgaggctgtagaaattcccattgatgggaacctggacctgcacctcttccacccgcgcgacgtgaaggacctggtggtggagtacctctgggcgtgccggcagaagtgcgtcctggacgtgcgcatcatccacggcaagggcaccggcgcgctgaggcgcacggtgcagtcgctgcttcccaggctgccagaggtggagtcgttccgttccgcgggcgaaggggacggaggctggggcgcgacgtgggtgcgcctgcgcccagcggactacgacagccagaagtaggcggaggcgatgagggcgcgcttctccatcaccttcgccttgttggccagctccgccaactgccggtccttggaggcgtaccgcttctcctcctcgttgcggagcgaggacagcttgcggcggtactcgcgctccatccggtcggagtgcgcgcgggccttggccttgtcggcgatgtcctcggccagccccacctgcttgcgcgcttcaatccacgtctgccgcgcggcttccacggcctcacgcgactccatgaggcagtcctcgacgtagcggtccgcgcgctccttggccttgtccagctcctgggcgttgcgccgctccgcggcccggacgatttcgtccttcgccgccatcagcgcctgctcctgcatcagttgcacggacaccggcgcgggctgacgccgccgctccggcttcgccgccagcttcacgaagtgcgcgctgtccgccatgggcagggcgcggaagccgtccctgtcacgcacgagcaccaggtgggccagcttctcctcgggcttgaggccggtcgtctcgaacttgtacgcgaaccaccagccctcgctgcccgcgagccgcgccagccgtgacggcagtcccgccgcgtccagttgcaggtagctcaccgcgtcctgggtgcgctccttgacggcataggcggccttggccacctccagccgccccgagttgcggctgcccagcacggaggcggtgagggcacgcgcctcctgctggcgcttggccagggcctccttcgtctgctcgttctgtccgcgcagccggcgccgcacgtcgccgtcgaagcgctccagcaccaccgagcgcatctccgtcatgcgctggctgatgcggccttccaactcctcacggagcttgtcgaaggcgatgttgatgtcctcgggcttccggcaggactggtagatgtccaggatgcgccgctcgaagtcgacgccgctctccagcgcgcccaggatttcgtcggacgcgccgaacacgccgtcgaagaggttcagcttcttctccagcagttcgaagaggcgggcgtccgccgcgttcatccggttgaggaagttgatgaccagcacgtcccgctgctggccgtaccggtggcagcggccgatgcgctgctccacgcgctgcgggttccagggcaggtcgtagttcaccaccaggttgcagaactggaggttgaggccctcggcgcccgcctcggtgcagatgaggatctgcgtgcggtggcggaactcctccaccagcgcgcgccggtcctcgggcgtgcccgcgtctccggacagcagggagatcttcccctggtagccgctctccgacaggaggttggagaggtactgctgcgtgcgcttggactcggtgaagatgagcgccttctccggccagccgtgcgacttcatcacggcgaaggtccggtccaggccgcgcttgagcgcctcgcccttggcgttgaccttgatggagtccgccaggtccgcgtactggcgcagctcccagacctcctgctccagcgcgcggacgttgggcgccttggcggggtcgtccgaccactcctcgccctcctcgacgaactgcttggcctcctcgggctcgaacatcgccagggcctgctggcccagcttcgccgcctggagccgcttctccaggttgtcggacagccggcgcagggtgggggcgatggcgtacgtggaggacgccagcagcttgcggtagcagagcgtcagcagcgtcttcttgccgggttcaatcgccgcggcctcggagcgctggaggtactcgctgaccttttcgtagaggtcgtgctcctccggggagggggtgaagtcctccacgatggagcggcggttggtgtagcggacgtattcgcgcacctgccggcgcagggtgcgctgcaccacgggggccagccgctccttcagctcgatggcggcggcctccggcattccaccggcctcgtccgcccggtagcggctgcggaaggcgtgctcggggccgaggatctgctcgtccagcagcgacatcagcccgaacagctccatcaagtcattctggagcggggtggcggtgagcagcagcttgggcttgccggccagggacgccttcagcgcctggcccatcttgttgttggggcggtgggcgttgcgcaggcggtgggcctcgtcgatgaccaccaggtcccagggaatctccgccgtcaggtgcgccttgttggccgcgaaggggtgcgagcagatgacggggaagggctggtcgaagcagttcccggtggcgcgcacggtgcggccgtccaccaggacgctgtccaggtcgaacttctcccgcaattcgctgttccactgcgcgcgcagcgtggcgggcgccaggatgaggatgcgcgacttcccctcggccatgagctgggcgatgacgagccccgcctcaatggtcttccccaggccgacctcgtcgcccagcatgcagccgccgcgcgacagcgagtcgagcgcgaacatggcgccttcgacctggtgcgggttgaggtccaccttcgcttctgacagcgctcccgccagccgttgctgcgtgtcaccgctgcgcgccagcagttcctctgccagcagccgctcatggaagggcgtcaacgccgtgggggccgccgccgactcggactccatccgtgccgccaccgccgccgccgcgtccgcctcaacctccaccctgaatcccctcgcgacctccgccaagaccttctccatccgtggtgttttcgaggtcgcccaccgtcacggcgggcgaggaccggccattttgttgacgcgcgcctatctgtaaagggggtcgtgtccgaggccgaaaaatcggcctccgcgcgattggcatgcttctttgcgagcggcgtcgatacacgttgactgcacactgcgtacaaaactttcgctggacttgacgcagaggcctagagcagtccgcgcgccttcacgtccaggtaggcgttgagcgtggccgcgccgaagccgcgcgcgggggctcggatgaccagcgcgcccgcgtcccgcagggtggtggccgtccgccggtactccgtttccagccgtgccgcggcctggcgcgcgtaggcatcctgcgtctgcgcgggcacaccgtgggcggccgcctggacgtcctcgtccagcagtgaggcgacgacgggcaggtgccgggggcgcagcgccagcgtgcgagtgaggaggctggcggaggcgtccgggtccaccaggtccgtgaacagcaccaccagggcgcgccgcgtctggcgtgcaaaggcgaagtcgaaggcgcggccgtagtcgctctcctcgagcgcggcctcggtgcggtagagcgattcggtgatgagccgcaggtgctcgcggcccttgcgtggcggcaggtaggcccgcacgccgctggcgaacgccagcacgccgaccacgtccccggcctccaggcccacgcgcgccagccgcagcgccgcgtccaccgcatggtccagcttgcgccgctcctggatgcggcccgccatgtgccggccgcagtcgagcagcaggagcaccggctggtgctgctccggctgccacgtgcgcaccagggtgtgggcgtggcgcgcggacgccttccagtcgatgtggcggtagtcgtcgccggggcggtactcgcgcagcgactcgaactcccggccctccgaggcgcgccgccgctgtgtgcgcgcggaaggggcgtccgaggcgtgggccagcgccagtgcttcgcgggtgagcgcggtgaggtccgggtacaccttgacgtccatcgtcgcggggacgcggacctgtcgcgcgcacaggcccagggggcctcgcagccgcaggtgcacgtccccgaagcgggcgtcaccccgcgaaggcggcgtgacgaagtaggtgagctcctggggcgtggaccgtgccgcgggcagggtgagggattgccggtgcccgctgctggccatgtcctcgggcggctcgtcgcggacctccacgtgcagcggcgcggtgccggtgtcctggcgctccagcgccacgtgcacggcgttgcgcgtgccggaggagaggacgggctccacgcgccgccagacgcggacgctctgggcgcgcggggcccggaggaagtccacggcgcagagggccagcacggctacgtccgtcgccagcgcgagccagccgaacgcggggctggccaccgcgagcgccgccgggaggagccccgccgccagcagggccacggcgaggccggtggggacggggcgcccggcgctcaccggggcactcggacccgttcgagcgtctgcttcagcacgtcatccgcggtgatgccttccacctcggcgttggcattgaggagcagccggtggttgaggacgcctgaaggtgccggccttgacgtcatccggggtgacgaagtctgtgcccatcagcgcggcgcgagccttggaggccgcgagcagcgcatgggccgagcgaggggtggcacccaggcgcacgagcgggatggtctttagagcac

SEQ ID NO: 797 - DNA, 7994 bp, Myxococcus xanthus
tctccgggttcttgctcgtctccgcggccagctgccgctgctcgtcctccagcagcgagcggcgcgacagcaccacgttgcgctcgcggacctcgctcacgcggaactggagcttctcaccgatgaactggtccggcttctccacgtagcgcaggtccaactggctgatggggcagaacgcgcggatgtcaccgatggcgacctccacaccgcccttgttcacgctcagcaccaggccttcgacgggcatgccggaagcgcgggcctcggccagcagggccaggttcgcgctgcccttggccagcgcgcggctgagcaggatgcccttggcccccacctccaccacgtgcgcgtcgatggtgtcacccacgccgaagcgcaggatgccctcgtcgtccttcagctcgcgaagctcgatcatcgcctcgctcttggccgcgccttccacggacacgaacgcggtgtccgcgccgagctggaagatggtgccacggaccttctcgcccacgcgcaggcccttgcggctgggcgtccccccctccttcgcctgagcctcgaacatctcggcgaaggactgggcctcgggaacttcctcatacagcgcgctggtcggcgccggcgtcggaatgaccggacgcggcgtgggggccggcgtcgcggcggaggattcggcggcggcggtcgtctcctcggccgtcgcggtcgcctcggcgggagcatcccccaccgggccgcgcgtctcgatggcacccgacgcccgcttcacgacgaccatgggacccgacggacgacggtcgcctccgccacggcgctcgcccccgccacggggcccccgctcgtcgcgcggcgaaccacccgccggacgcggctgggcctcgcgctcaccacggccaccgccgctgcgctcgcctcctcggccaccgccacgctgttcgccccgaccgccctcgctgcgagctcccccggaagggatgccgagcatcacgtcaccgaaggtggccttcggcttcttgggacccatcccgccagaattggaaccgttcttctcgtcgctcactgcgagaccttcctgaagcgaattcgaccctggcttcccgagaagccgggccccggtgaaaaaggcggggcactctacacgcgcgccatgtccggaggaagccagatgacgcacatgccgttgacgccaacgctccgaccataacggaggcaccccgtcagagcatgccggacccgatgcttgcaacaccaaatagcggccgtttaccaggcacggagccaagcaatcccatgtggttagcgcaccagacgcagcttccgccccaccttgcgcaacaccgttcccgcctctgggatgcccaaggccgctgacatcccgaaataaacagcaccgaacgggagcgccaccgccgcgaagcccagaacggggtgcaggcgcggcggcatcaggaagccccccccccactccgccgacacaccgggcatcggcccgagcagcgaggtgaggcccaccttgatgcccaccgccaccaatccagccaccaccgcggcgccccacaagcgaggcagcagtccagacgggacgccgaccggcccgagctgcttcaccagcttgcggcgcagcagtcccgcctccagccaggccaccaggccgctggccagggtgaggcccaacgcgcccaggtgctgcggcacccccagccatcccggcagccacaggcccagcacccatgcgcccagggtacccaccagcacgcgcaccaccgcgaagcgcagcggcgtcttcggatccttcagcgcatagaaggcggaggcatagagacgccccaccgtggaggccaccaatcccagcgccgcccccatcagcaggtaccagaggtagcgcgagtccgccgcatcgaagcgccctgtctgcagcaacgccgccgccaccatgtcccccaggaagaggaaggccgccgccgacgggacgacccagaagcagatgcggcgtgcgcctccgtcgatgcgttggcgcaacctggcggccacgtccgcgccctcccccgtggcgcgcgacatctccggcaactccgccgcggacaccgccatcccaaagaggctcaccgggatgaggtagatggtctgcgcgtagagcagcgaggacagcgcgcgattggagatgagtgacgcgaaggccgtgtccacccacgcgctgaactggaccacgccgcgccccagcacgaccggcccgaagttcttcaacacctgccgcaccggctccgccgccagcgacagcgtcgggcggaagcggcccatcaacttgaggacggagggcacctgcaccgcgaactggaggaagctgcccagcaccacggcgtaggccagcaccgaaaccaacgcctcttcctcgtagcggcctcccgcggccaccaacgcggcgatgatgaccaggttccagacgacgggcgccaggtacgaaaggaggaagcgccggtggctgttgaggatgcccaggcaccaggcgctcagcaccagcatgcctgtgccggggaagaggatgcgcaccaggtggacggccagctcccgctcctgtccctggaaaccgggcgcgatggcatccaccagcagcggggtgaacaccatgcccagcgccaccaccaccgccgtgaccagggacaggatgccgaagacggcgcccgcgacccggtccgccgtctccgtgtccttgcggcccaagagctgcgcgtagacgggaatgaacgagccggagaggacgccctcgccgaacaggttctgcaggaagttgggaatgcgcagcgccgccttgaagacggccgcgacctccgtattacccaggtagtgggcgaagacgcgctcgcgcaccaggcccatcagccgggaagcaaggatgccggccgcgaccagcgcggcgccacctccagagcgctcgggacgaggaggcgcaaccggcgcaatcggcgggggcggagactcgggcgaagacgtggtcacgagagcggcggactctacgcgggccgttcggtgtcatgaagctcgaaaccccgtccccctgtttcgcttgacgccgaaccccctggattgcaagggtccattccaatggccggccctcccgacagtgacttggacgacgtggcgcgcatccgcctcgtgctggcacgtgagctggagaccatcaacgagtacgaagcctacgctcgtgcctcctcgaaccccgaggtccgcgcgttcttccagcacctggccgccgaggagaaggagcacgtctccgaggccgtccacatgcttcgcatgttggacagtggtcagaacgaccacttcgccaagcccttcgtccccggtcatttccaggccgccgaggcccctgcccccgccaccgtccatgtgcccacaccggacggcccggcgttctccgtcaacggccgcaacggccggctcccctccgagccgccaacgtccctgccgccccagcggctgctgtacggcctgcccgcgccgccgcccgccgtggagtcgcacccgctcaccgtgggttcactgcgccggggtggcggtggttccggcagcggtcgctgaagcattcttcccccttctctagtcgatgcctctggagccacatttcatgcctgacttccttggacatgccgagaacccgctccgcgaagaggagtgggcgcgtctgaacgagactgtcatccaggtcgcccggcgttcgctggtgggccggcgcatcctggacatctacgggccgctgggcgccggggtgcagacggttccctacgacgagttccaaaacgtttcacccggcgccgtggacatcgtcggcgagcaggagaccgcgatggtcttcaccgatgctcgcaagttcaagaccatccccatcatctacaaggacttcctgctgcactggcgcgacatcgaggccgcgcgcacgcacaacatgccactggacgtgtcggccgccgcaggcgccgccgcgctgtgcgcgcagcaggaagacgaactcatcttctacggcgacgcgcgcctgggctacgaaggcctgatgacggccaacggccggctcacggtgccgctgggtgactggacgtcgccgggtggcggtttccaggccatcgtcgaggccacgcgcaagctcaacgagcagggccacttcggcccctacgccgtcgtgctctcgccgcggctgtactcgcagctgcaccgcatctacgagaagacgggcgtactggagattgagaccatccgccagctcgcgtcggacggcgtctaccagtccaaccgcctgcgcggggagtccggcgtggtggtgtccaccggccgggagaacatggacctcgcagtgtccatggacatggtggcggcgtacctgtgcgcgtcgaggatgaaccacccgttccgcgtgctggaggcgctgctgctgcgcatcaagcacccggacgccatctgcacgctggagggcgccggcgccacggaacgtcgctagttccggtcgcccgcggtcacgacttccaccatggccaaggtcctggtcatcgacgacgaggcgaacctccgcaaggtgctcgccgcgatgctgcgccgggacggcttcgacgtcaccgtggcggagaacggcgagcaagggctcgccgagttccacaagaacggcgcggacatcgtggtaacggacctggtgatgcccaaggtgggcggcatggaggtgctcggaaccatccgcgccgccaacccggacgtccccgtcatcatcatcaccgcgcatggcacggtggactccgccgtggacgccatcaaggcgggcgcgttcgactacatcaccaagcccttcgatcaagcggagctgtcctccgtcgtcgccaaggccgcgaagacgaacgagagcgcccgccgctccgtgcgcccggacgtgaaggcgcgcgcggccatcatcggcgactcgtcgacgatccaggaggtctacaagatcatcgacaaggtggcggacacgccgtccacggtgctcatcaccggggagagcggcaccggcaaggagctcatcgccaccgcgctgcacggcgcctccagccgccgcgacaagccgttcatcaagatcaactgcgccgccattccccacacgctgctggagagcgagctcttcggctacgagcgcggggccttcaccggcgccgtcacgtccaagcccggtcgcttcgagctggccgacgagggcaccctcttcctggacgagatcggcgagattccggtggagatgcaggtgaagctgctgcgcgcgatccaggagggcgagttcgaacgcgtgggcggcatcaagacgacgcgcgtggacgtgcggctcgtggccgccaccaaccgcgacctccaggcggagattgaagccggccgcttccgcgaggacctctactaccgcctgcacatcgttccggtggtactgccgcccctgcgcgagcgtcccgaggacatctccctgctggcccgacacttcgtggccaagcacgccatgcgcgtgaaccgacgtgtgatgggcttggacgacagcgcgctgcgcgccctggcccgccacgcgtggcccggcaacgtgcgcgagctggagaacgtcatcgaacaggcgctcgtcttcgccgaaggtgagcagctcaccgacctggacctgccctcacacctcaccgccagtggcaccccgcgcgtcgaggcgggcctgccagtgctccagggcgaccgccccctgcccgacatcctggaggatttggagcgtcagctcatcgcccgggcctatgagaaggccagcggcgtgaagacggagacggcccgcctgctaggtatcaagacgtccgcgctgtactacaagctggagaagtacggcttcctccccaaggggacgcctcccgaggagagctgaacctcgaaaatctgtcatccgcccccgccccccatgacttttcaccggtatcccacctccgcccctgtccccctggatgctccaggtgtccggaattgttgggcgccgagtggccgcgaaccctggggatgggcagacaggctggcactcaccttgctctggggctgtcgctgatgaatctccgctccctcgccctcctgctgagcctgctgctggccatgcccggtcaggccgcgtctgggctggaggcggtgcggggaagggctcagtcggctcgcgcggagacgcgctcgctgcggggtcagcagcaggccctgcgcgacgagctcaacgggctggccgcacgcatcgaaacgctgaaggcgcagcgccagggccggctgatggcggggacggagctggaggacgcgctgcggcgttcgcaggagctgagcggtcagctcaccgggctggcgcaggccgtcgtcgcggcggagggcgaagcggagcgcgcccacctcgccctgcacacggcgctgtcggacgagctgacgcggctgctcgcggcgtgggaaggcacggcggaccggggccagcgggagaagctgttggaggcggtgcgctccgttcgcgcccgagcgggaagccatccgcgccgccctgcccgcgtcccaggtgccctcgctggacaaagccaccgcgggcggtgatgaccccgaggatttgctggcccaggcggacacgctccgcgatacccgggacaaggtgcgcgagcggctgaaggcgctccgcggccgcatcaccgaggtgcgcgaggagcgcgacctggaccggcgcatgaacgacttcctcggcgaggagtcgatgttcgacgaccaggaccggcggctgcgcctgcgaatggggagcgaccggacgctgcaggtggagcgctccgtgccaggccccagtgcgccgaccttccagggtgacagccccgacgatccgacccccaacgtgggcggacgccccggtgaaggtgtcgacccgagccgccccccctatccgacgcagttgtcatcccgggccacggaccggcggccccaggtcgaaacgcagcgcgcccaggacctggcgtcgggcggccccgtggacctggcggcgatggaggcagaggccacgcggctggagacgctggccagggaactggagggccgcgccacgaagctggagcgccgcgcccaggagatgggcgtcccctgagggacgcgcctcccggcaccggactacaagagcccggtctccacctggagcttcaccaccgcctgcagccgcacctcgcgcgccggcatgatgccgcggccgcggatgatgatgctcatggacggcgcggagacgaagggctgcaactccacgttgtccacgcgcagcgacagcacggggttgggcggcctcaggtccagcgcggacacgtcctggcgcgccgcgatgcgcgcctcccggtctcccgcgcgggcatagaactccactgagtccaggaaacggaggtcctggtcattggggctgaggaccttgagcgtgagggactccaccttgacggacgtcacctcgcccttgtgaatcccctggttcttgaagtcctggttcttgtcgaagtccatccccgcgaagctgctgatggcgggaaggccgttgaggggcgtgtcgacgccaggcgggcccgcgggcacggtcgactcccccttcacctcggtggtgaaggaggaggaggcgcaggcggacaggcccaggcaggccaccgcgagaagggacacaaagcgcattcgcccaatgtaacgggccgccgggggcgtcgtcaccggtgggagcgattggacggccgcccctgccctccggcgacggagtatggtcgcgcgccgtggtccgctcctttgcgccgctcctgctcgtcctcgccatgctcgccgccggccgtgcgcccgcggccgagtgggaaggggcactgaggggaaccggccgcctgctgctggacaccaacgcgccccgggacttatccgaccagctcacccccagcccggagcgggacttcgccctcagcctgttgggctccgccgaggggcgcggctccttcgaaccgtagagc

SEQ ID NO: 798 - DNA, 8241 bp, Myxococcus xanthus
gtctctaaatcacctttcgacgagcactcatcacgtgttgtcctccgactggaagccgtagcgcctcaccgactctacactgccaccgtgccgcccttcattaccaccactcgcaccctggtgatgcccttccatggatctcccttcaccgacaccaagtccgcgagcagccccgccttcacctggcccaactggtcctcgcggtggagcatcgccgcgttgttggaggtgccaacctggagcgcctgcgcgggcgtcatgccgtaggccaccatcagctcgagttcgcgcgcgttctctccgtgggggaagacgccggagtctccccccgcgcacatggggacgccggcgctgagggccgcgcggaaggtggcgcgcttctgttggaggtgggtgggctccgggtccacgccgcgcttgtagccgcggtgttcgaacatcgcttcgctggcggccagggtggggcagaggtagacgccccgctgggccatgaggcggaacacctcggcggtgccttcgtccccgtgctcgatgctctccgcgcccgccagcaccgcgcggcggatgccctccggtgtggtcgcatggacggacaccgggcggccactgcttcgggcggtgtcgacgatgcgcttcagctcctccagggagaaggtggggcgggcttcgtggttggggccccagcggtagtcgccgtacaccttcacccagtccgcgccctggccgatttgcgcgcgcaccacccgggtgagggtctccacgccgtccgcctcttccgctccctgggggacgtgccactccgaggcgaagcccttggggccatagctgccggtggcgacgatggcgcgcgtggccaccagtaggcgcgggccggggatgatgccctggtggatggcctgcttgaggccgacgtccgcgtcggccgcgccctcggtgcccaggtccctggcggtggtgaagcccgccgccagcgtggcgcgggcgtggttggtggcgcgggccacccgaagcgccagcgactccttcagcacctggtcgttccaggaggcctcgttgtacggatggaggagcaggtgggagtggccctcgatgaggccgggcagcagcgtggtgccgctcaagtcaacggacgtggtgccctgggggaccttcaccttggcttccggccccgcggcggcgatgcggtcgcccgtcaccaggacgacccagcccgtgtgcggcttggaggtgacaccttcgaagacgcggtcgggacgcaacagataggacgctggtggggcggtgtgcgtcggttcggcagcggtcgccacggtggtggcgaacagcgagacgaagaggaaggcgcgcatgggcaggggagcgggcaagctcgggcggcgagaaggcctgggtgttaaatcgacgggcatggctttccaagaccgctcgaacgcactgcaggcgctagaggccgagttccaggcggagaaggcctcctcgctccggaaattggaagtgaagctggaggagacgctgcgggagctgtccgaggtcgaacgtcaactgcggtccctccggaccgccgaccggcgcgcgcagattgcccgccaccaggccctgcgcaaggaagccgagcaccagcgctggtgcttcatggtgcagcgggaggcgtgtggcttcgtcaaccacgacgacctcgaccggtactacccactccccccgtcctggagggagtgagcggagctcacttcgtggtgcgccaggcctccaccgtgaacaggagccacccttcgaggaaacccaggccctccagcgtggtgatggctcccagcacgcgcacgccggagagggcgagcgcgtaaaggctggcatagaacaggacgatgcccaccatcatcgcccagccggcgccgttgagcagggacgaggggcggaagtgccccagcaggcccacggccagcaggcccagcgcgtggtacatgtgataccgcgcccccgtctcgaagatgacctggaggtcctggggcagccggctcttcagggcatgcgcgccgaaggcccccgcgctgacggagaggaaagcgttcacggcacccaggacgagccaccaccgcatcatcgttcgcctttcatcggaagtcggactggtgcacgctacaccgccgcagccggagcgtcctggccgacatcaacacctggggcgctcacaacagaatgacctcacccaacttcattccttcaacgaagccgcttcccttcgagctgcacccgtcctccatccagggccagggtgccttcgccatccgccgcatccgcaagggcacgcgcatcatcgagtacctcggtgagcgcatcacgcaggcggaagcggacgtccgctacgacgacgaatcgatggcgcggcaccacacgttcctgttcaacctcgacaagaggacggtgctggacgcggggacgattcacaacgaggcgcgctacatcaaccactcgtgcgcgcccaactgcgaagccctcatcgaaaagggccacatctacatctacgcgctcacctccatcgagcccggtgaggagctggtgtacgactacggctacgagcgcaccgaggacatggggcccgaagccgaggcgctctacgtctgccgctgcggcgcgcccaattgccggggcaccatcctggccccggcgaagaaggcgccggcccggaagacgtcggccaagaaggcgaagacttcgtcgacgtcgagaaagaagtctgcgtcgaaatcccggggcaacaagggcgcggggggcaagaaggcggcggggaagaagtcatccgccggtacccgcaagtccacccagcgggcgaagtcgcccagccgtaagcgcgcgagctgaactgtgcacaggttccggcgccctcccaaggagggcgccgcttaccggctgttcgtgccgtgatggtgctgggcacgtatggggctgctcattgacggtgcgctcgtggtcgtttgcgttctctgccgaaacattttccgagcttgattaacggagccaattgcatgcgggccgtcgtattcgctttcgttgtagcgttgatgtcatccggatgtgggagcggcgctctgagtgccatccgagggaaggctgcgcaggacatggcctgtccggagaaagacctggcagtcaatcctgtccatgattacgccggggctccgaacgagtcgggcgcgtactatgcggaaggctgtcagaagcttcggcgctacgaggttggctgcaacgcctttgggtattgccctgatcctcatggggtcgacatccaggagctcatccttcgtcaggcggccttcgacctgaaatgtgagcaggactcgatatcaacccagcggctgaatcgtgacacgtttggcgcgagaggctgtgaccagcaggccagctacatcctgctgtgcagtcgcagcagctgccgcgtggttcagaatacccagagtcagtaatacagccctgagaggtcctgaggcggagggagcggtggccgctcaaccattcattcaagaactggtggacgagccggcgagggccgccaatagactcccctcgtgaacgacgtcctccatttcctgctcactgcaccctccgagccccaggtcctcgattctgtcgacgcttggtggcgccagcacctggggctgtcctcccgcttctcctcgcccgcggacctggcgctggccgggggcttcctcgccgaccggttggggttcgccttcgcttctggctaccacgccgcgcaccggcgcctgtttccggagctcccggcggagcggaccatcgcgctctgcgccacggagccgggtggcgcgcatcccaatgccatcgagacgcggctgacggatacaggcgcgggcccgcgcctgtctggcaccaagacgttcgtcaccctgggcacgcacgcggagctgctgctggtggtggcgtcggaggggcaggacgcacagggccgcaaccgcctgcgcatggtggcggtggacgcgaagcggcccggtgtgcggctgagcgcgctcccggagctgcccttcatccctgaggttccccacgcggagctggctctggaggatgtggcggtcgcctcggaggacgtgcttccgggagacggctacgcgcgctacctcaagcccttccgcaccgtggaggactgccacgtccagctcgcgatgctgggctggctgctccaggtcgggcgccgcagtggctggccggacgacgtgcgcgaggagctgtccgccctggcggtgatgatgcggggcctgtcccagttggacccgacggcggcgtccacgcacgtggccctgggcggagggctggcgctcaccaagcgcgcggtgctggagcggtgtgaacccctctgggccgccacggatgccatcacgcgagagcgctgggctcgggaccgcgtgctgctgggcgtcgctggcaaggtgcgcgcgaagcggctggatgcggcccggcagcgcatccacgaggaaactcgtcgaagcggctgaaggttgggacgcgcccgccgccgggcattgcgcacacggctctggcggagcgcttcgatgcggcccggccgcgcgagccaggccgtggggcagggcgcctgaaaggcgaagggccgggcctccgcgcaggaggacccggccccggtgctcaccgcgacgcggtggcggtactcagtaccggccgccgcccacggcggagacgatggcggagaggacgcggttctccacgccccacacggccttgttcaggcccttgatgcccgcgccgcgcaggtagtcggtgaagtcgtgtagcgcggtggagcgctgcatgccctcgcccttggccgcgtagagcagcggcgtgttgggggcgcccgtcaggcccaggtccggcacggcctcggacagcttctgcgggtcgatgcccgtcgcggcggacatcatcgccacggtgaacttgtgcaccggcaggtcgcgcacgttcgggaccttcttgtagaccttcgccttcgtcttctcgtcgctggcgagctggtccagcgacacgttcgccatggcgatgagctgctcgttcgtcacgtgcttgctgtcgaggatggcccggctgaacaggctggccgcggtgtcacccttgatggtgatgttgttcgcgtccgggttcgcctggagccgcgagacgatggactgcaccgccttgcccacctcggtatccggaccgccgcgccacgcaccgggaatcggctgggccgccgcggccggacgggcccgggccgcgccctcgaaggagttcacctgcgtgtgacccacggcggtggcccgggccacgttggcggcctgctgagctgccggctgggcccgcgcaggcgcggtggtggggttcgagatgacgcgggggcggctgtcgatgcgggacatggcctggggggctccgggaaaaatcagcttgtcggtgattatcgcaagacagctgtaaaggttgcgtggggcgatatgttccgccgcaatgaaggcctttcccaaagagttcgctgactggctgaccccccggggtcgccgcatcctcgacggcagggagcgtgacgtggtgggcgcgctgctcgacccggcgcgtccctttgtgtcactgcaaggtgtcatcgacccacgccgtgccgccgcatgccgcgatgcgttggacgcggcgatgcgcgagacgatggtgcccatggaggacccgattccagcggactccatctccgggcagacgatgaactacatggagttgctgcccaaaacggtgagggtgagcacggcgctgctggagggccgccgctcccgctcgtggcgcgcggcggagtccgtggggctcacggacatgctgcgctcggacaccttcgccgggttcgccgccgcggtgacgggccgggcgctgcggcgcaagtggggcatccaggccctgtgctacgggccgggggactactccgggccgcacaacgaccaccacccggaggagcccgaggcccgggacggctacgtggacatgcacgtcagcctcacgctgcccggggtggaccaccagtacctcatctatgcccaggacgggcacttcacgcagatgacccccgtcagcaccgtgggcggcatcaccgtgtaccggctgcccttctggcactacacgacgccgctgctggcccggaaggggaaggaggagacctcccgccgctgggtcctgttgggcaccttcctggacgcggccccgggggcccggcccgcgaccaccattctccccgcacagcctcccgcgaaacgcctgcccgcccggtaggctggtgactttcgggagtggcggcggggccggacggcgttagcttggggcgccctatgagccccatcgacaccgacgccctggctggagacctcctcgagtacatcgacgcctcgcccacgccgtaccacgcggtgcgcgagtcggcccgccgtctgacgcaggcgggctaccgccagttggacgagcgcgagccctgggcgccggagcctggcgcgcgcgtgttcatcacccgcggcgacacgagcatcgcggccttccacctcggcacccagcccgtggaccgggcgggcttccggctggtgggctcgcacacggactcgccgaacctgcgcgtgaagccgaacgcggcggtgacgaagaacggctaccagcagctcggcgtggagatttacggtggggtgttgctgcacacctggacggaccgggacttgtcgctcgccggccgcgtcatggtgatggtggagggccgcccccagcggcacttggtgcatttccgccgtcagctgtggcgcgtgctcaacctggccattcacctcagccgcggggtgaactcggatgggctcaagctgaacgtgcaggagcacatggtgcgcgttctgggcctggagcgtcgtgttgtccgtgagctgcacggtctgctgttggaggagttggtcaaggccggtgtataggcgcaggcggggcacatcctcggataggacttgtgcctgtatggcttgcacccgtccatctggtcgggcgcgcacggcgagttcctccacgcgccgcgcctggacaacctggccagttgtcacgccagcctgtccgcgctgctctccagcagcgagccgcgtgaggccaccagcggcgtcatcctgttcgaccacgaagaggtgggtagccgcagcgcgcagggcgccgcgtcacccttcctgcgcacgctgctggagcgcctgacgctggcgcactcggacggcaagccggacgcgttccaccgcgccatcgcgcactcgttcctggtgagcgcggacatggcgcacgccatccatcccaactacccgtccctgcacgagcccaagcaccagccgcacatgggcgcgggcccggtcatcaagtcgaacgtgaatcagtcctacgccacggatggcgagtcgtgggccttcttcacggcgctgtgccgcgaggcccggcgtgacgctgcagctcttggtcatccgcaccgacctgggctgtgacagcaccattggccccatctcagcgggccagctcggcatccgcacggtggacgtggggcaaccccatgctgtccatgcactccatccgggagatggcctgcgccaccgacgtggcgcagatggtggccgtgctcagccgcctcttcgcgtcgtagtcccgcgggggctcaggagaccgcgagcgtcagccggcgctcgcgggcttccgtcagcgtgggcgcgtccatcagcaccgccgtcttctccggcggggacagtggctccacgttgtcacccagcagcttgcgccgcgcggaggccagcgccatggggacggcggccggcgagggctgggactccagcagcgccaggtgcagcgcgtgcgccttggcatcggagatgacgtggtccaccgcgtccttcaccggctccagcgcgtgctcctcggccacctcttgcgcccgctccaacacgcgcgggggctctgtctcctcggggatgacgagcagcccgcgccgctccagccagaggcccagcgacgcgcgggacgtgaagacggagagggggatggacagcagcaggccggccacgacgggcgacagccacagcagcagcccgggcgacaggaagaacgccaccgccgccagcaccacgcccacggtggtgtgaacggcatgccgccgggtcgcctcggcccagggcaggtcggcgtcgtcgcgttgctggctggaccacgtcaccttgtagccaagcagcg

SEQ ID NO: 799 - DNA, 6488 bp, Myxococcus xanthus
cagaccggccagacggtccagttgcgcgccgtccgcggggccgggggagaagtgcgtggtgtccacgccgttgtagacgacgtgcacgggcactcggaacagcacctggcgcgtgtcgtcgcccaccgcccgcgagttggcgatggccgccgatgccaggggcgacagcagcctcagcgcgcggcggaccagaggccgttcgcccaggaagtcgtgaatgtgccagacccgcttcaagggcaggcccgcggtggcggcgctgagcaggtgcgtcttgatgccgttggaatgcaccaggtcggggctgatgtcggcgacgtcccggcggagcgcgcgtccatggtccaccagcagtccggatgtgggcgccagccgacgggcgaagcgcagcgcttccagcggaccgtggcctcgcaatgcggagtcgcccagcgtggacaggtgctctggcaatggcagcagccgagcatccacgcccaacgcgcgcgcttcgtcgagcagcggccccgccgttccggccagcaggtggagcgacagcgctgagtcctgctgcttcaggcacgccatcaaatcgaggagcgcgcgctcggctccaccaaggatgcccacgggattgaggaagaggatgcgcacggcggacggaccgaagcaaacacctctcctagggtcaaggcacgttgctggggcttgaggcactggcaacgccgccgcgcacggtgttcgcgcgatgaccatgggcatgtgcgtatcgccaagggcgagcggaacgctccgggtcgggtggagcctgccgacctcacggcgtggaggcaccgagcagccgcaggtaggcgtccagcaccgtccgcgcatgcgcggaccaggtgaagcgcgaggcgcgggtcagccgtgcctcgcgcgagggctgtgtgtcatggccggcgagcagcgcggtcacggactccacccacgccggcacgtcccccacggggcagtaggtgcaggcttctgctccgacctcccgaagcacgggcaggtcgctggccaccacgggagcaccacaggccagcgcctcgatgacggggagtccaaagccctccgcctcgctcgtcaccagcacggccgtcgcgcgccggtagaggcccgccagcgtggcacgttcctgccgaggcggctgaagcaacgcatcgccaatacccaacgcctccacctgcgcgcgctgtgtgccgttcagcgcgccgccctgctgcaccaaccgaagctccgggtagcgcgcgcgaagcgcggcgaacacggcgaagagcacgtccaggcgtttgcgaggaatcgcgctgccgacgtggagcaggtagggccggccccccagcggtgcgagcacggcttcgctggcatcgggcgctccgggtgtggggaccgggcggtattcgggggacacgccatacggcgcccagacgagccgcgactccggcaccaggccatgcgcgagcagctccatgcgcaccgcctgggtgctgtggaacacgatggccgcgcgctccagtcccgcgagctgggcacgggccatggcgcggaaccacgctggacgcggctcgcgccgaggctccagcacggagcggaacgcatccaggtcatggcaatagacaccggtgcgcgacgcgggcaacgcgtggacgagctgcgcgtaggtgtggtccaccacatggaaggcgtcgtgccgcccccgggcgagcagcgcgcggcccgggtagagaccgaagcgggtgaggagccggtccgcgttgaacgccgcgttgcgcgcgcctgctcggggaagtcgtcgcagcaccgcgggcatgtctggccgcacggccgtcgcgtggacctcggagggatgcgcggcaagtcccgccaggagggcctcgcccaccaggtccatgctgggccagccctcctcgcgcgggtccatcagcagcgccagccgggccgcggtctggggtgtcgcgtggcggggcgtcatgtcgggccgacgcgcagcagcgcttccaccgtgcgctccagcgcgaagtgctcgcggtagattcgggccgcgtgctggcctagctcccgccgcgtgtccgcgctcgacagcaaggcctccgcgcgctccaccaacgcagcgggcgccgtgccttcggccaatgcggcggcgccgtgttcgcgccacaccggttccgtgaggtgcccggtgttcgtgacgacaggaagccccagggccaggcccgccatgaccgtggtgcgtcttgtgctcacgccgtccggatagggctgcaggagcacgtcacacgtcgtcagatgcaccgcgatgtcgtccagcgcgagcgagtccctggccacgagccggcctcgcagctcggggtggcgcgtctccacgccttcgacgaaggcgcggctgcctctgcccagcatcaacgcccggcgcgttccctcaccgcgcagcaacggcaccagcgcggcctccaggggctcagcggtgaggcgtccgaaggtgccgaagtgtcccagccagggcccctcacccaactccgcgcggagcgcgtccacggcggcacgggagacatcgacgggcagattgctgggaaccggcagccaggccgcgtggggccggacgcgagcgggcaggtgctccgcccactggggaatggagacgaacacgcggttggcggcgctcgccaccaggcgcaccatcagccgcgtggtgcccgccaggatgtggtggcgccaggggccgcgcgggctccacggatgcaccgcctcgtggatgtagacccagcgcgcgtcgtgccgccgcgcggcgaaccaggcgcagaaggggacgttcatcgccctcagccccagggcatgggggacgtactggagcagcaggcgccggggccctgggcacgcatccagcccgcgcgacaggccgggcagtcccctgggcgtcaggaggtcgggggcacggtgcacggtgacgccgtcctcgtcgcgtacaccgccttcaccaggagcccagacatggacctcctgtccggcacgggcgagcgcgcggctcagttgccgggtgtagtcaccgacgccgccgggctgcggcgggtactcgccggtgaggacatgccaggcaggagcggtgcgcgaaggaggcatggcgcggcgtcaggacacttccatgtcgcggatggcgaggagctggaaggcgtgacggggccagcgcgtggcgaagggctcggtgaggatggacaggcggctgcccagccggaagggccggatgcgcggcagggcgtagtcaccgcgcaggggcttccagccgctcatgccggtgacgtggtagccgcgcagctcgaagtcgtagacctcccagccggagcggtgcacctggtggacgttgttgtcccactcgtcctgggggaggaagccattgggcgtgaagatgatgacgcgcttgcgcgccagcgactccatcatctccagcagccggaatccgcctggcttgtcgaagtgctcgatgacgtccagcgcgacgacggcgtcgaagctcttcggaccgaagcgctggcccgcttccatcaggtccatgcagtggtactcgcggtggatgcccgcggcccggctgcgctcgatgctggtggggtggccatccacgcccaccgtgtgtgggagcaggttcgagaagctgtggagcggcgagcgcgagccacagccgatgtccagcacgctgtcgcaggtgccgaccagcgcctccttcagcgtgcggtggagcacctcgtgctcgcccacgaggacttcgcgcttcaggaactggaagatgtttccaccgggacgcatgtgggcggaccgtagccccggcgcttcgggaagggcaaccctggcgcggtgtccaggcaggcgagcggggcatcccgccgtgcggggaacgcgcgttgcttgtaggccctgcgcgctgtcgctagcatttccgttcccgcgcgttcccgcgcgctggccctccccaggacacccggagcgggccgctccgcaccatgaacgcgaccccagcgcccgaagccaccgccgtcgaagtcaaggcgcgtgccctgaagggcatgttcgtcctggcggcgcggaccgtggcgtcccaggggctgcgcgtggtgagcgcgctgttcctctcccggctgctcttcccgtcagattacggcctgttcggaatcgtgtcctacgcggcctccctgggcgtgttcctgggtgacctgggcctgagcgcggcgctggtccgccagccgcacgagcccacgcgggatgagacgttcaccatcttctggtgccaccaggcgctcaccgccgtcgtggtggcctccgtctgtctgctggccccccagttgacgcgcggctatgcgctgggcgacggcgcggtgcccatggtgtgggcgctggcgctgggcctgttcttgtcctcgctgcgcgtgattccgttgatggcgctggagcgccagctcgccttccccgtcatcgcccgcgccgagttgattgaaaacgtggtgcaggtcatcaccaccatctccctggcggcgctgggcttcggagcctgggcgctggcgctgggcggcctggtgcgcggcggggtggggctggtgtgcatctggtgggcgtccccctggcgtccccaggggcgcttccgcgtggacgtgttgcggcggctcctgggcttcgggctggcgttccagcttccgcccctggtggcggcgatggtggcgggctgggtgccgctggtggtggggcacgtgttgggcaaggaggcggtggggctggtcaactgggcctgggcgctggcctccacgccgatgatgctgagcgtggtgctcaaccgcgtggccttccccgcctactgccggttgcaggatgacccggagggcttcgccgagtacctgcgcacgtcgctgcgccggctggcctcggtgttgctgctcgccattcccctggcggtgctggccgtccccgtggcggtgcccctcttcttcggcacgcggtggctgcccgcggtggtgctggtgcagtggttcagcatggagtgcatcctcaccaccctggtggggctgctggccacggcgcagaacgcgggcggcaggccctgggagcggctggccgtcgtcgtgtgcgtgggtgcggcgaagtgggggctggggacgtgggccatccaacgcttcggcctggagggcatgggccccgcgggcgtggtggtgggactggccgaggtgtgggtgacggcgtggctggtggagcggctcaacccgtcgatgcgagggctgacgcggcaggtggtggagcccttcgtcaccctggggctggtgctgctgggggcgtgtctggcggcgctgcggctggtggaggagggtgtggtggcgcaggcgctggtgggcgcggtgctgttcgccatcctggtgtgggcccgtgagcggctgccgggaacgctgccactcctgggcgagctgaggcagattctcgaattcatccgggcacggagggccgcgaggccaactccggcgagtccggcgtcgacgtgagcagacacgcggaggtcccgatgaagaagcccgacctggtcatctccatcgtcaatcacagcaatccggagttgctgcacgactgtctgcgcacgctgtacgcgacgacgcgcgacagctccttcgaggtctggattgtcgacaacgccacgggcggtcgcggcgtggacgccatgcggcgcgactttccccaggtgcgctggctcttcaacacggagcgcaagggcttctccgccaaccacaaccaggtgttgcgccaggcccggggccgtcacttctgtatcttcaatgacgacaccatcgtccacgagggcgccttcgacgcgctggtgcgcttcatggatgacaacccgcgcgtgggcatggcgggcgcgcggctgttgaacgcggacggcaccatccagaactgcaccttccggcccatgtcgctggccgggcagctcttcgacatcgtcttcctgccgcgtcccctccacttcctcaaggcgatggccatcgacccggcgcagtacggccacgacgaggcccgcgtgagctgggtgctgggcgcctgcatcgtggtgcgcgaggaggcgctcgcggaggtgggcctgctcgacgagcagatgtccccgctgggcaacaccgaggacaccgactggtgcgtgcgggcctggaaggcgggctgggaggtggccttctgcccggaggcggtgattacgcacctgaccagccgctcgttccgtccgtccgacaccggggcggacaaggtgcgcatcgagctgtggcgcacgcgcctggcgtacttccgaaagcaccacggccggctgcacgagacggccatgcgggccatcctggtggggacgttgccgtacaactcggcggtgctgacgcagacgctgctgcgcgggcgcatgagcctgccggagtaccgcaagcaactggccaccttcctgggcatctcccagatgggcctgcgcgcccgcgtgtgacatg

SEQ ID NO: 800 - DNA, 6037 bp, Myxococcus xanthus
  unsure (1)..(6037): unsure at all n locations
cagcgcttcgtccgcgatgcgcacgcggtggtgggactcgtagcggtccttgaggcctcgcagaatctcaatggcctgctcggccgtcggctccgggacgaccacgggctggaagcggcgttcgagcgcagcatccttctcgatgcgcttgcggtattcatccaacgtcgtcgcgccgatgacgtgcagctcgccgcgcgccagggatggcttgagcatgttgcccgcatccatggccccctccgccgcgcccgccccgacgatggtgtgaatctcgtcgatgaagaggacgatgtcctcgctgtgcgacttcacctcgtccatgaccttcttcagccgctcctcgaactcaccgcggtacttgctgcccgcgagcaggccggacaggtccagttgcagcacgcgtttgtcgcgcagcgtgtccgggaccgcggcggagatgatgcgctgggcaatgccctccacgatggccgtcttgcccacgcccggctcaccaatgagcacggggttgttcttcgtacgacgcgagaggatttcgagcgtggtctcgatttcgttggcccgccccaccaccgggtccagcttcccttccgaggccaggctcgtcaggtcgcggcagtactcgtccagcgtgggcgtgggcgaccggcgtgcctcggatgaaggtgccagcgcttccgcgacggccgcgcgcgccttgccgtgctgggccccttgctcgcgcagaatctccgacgccaggccttccccttcgtgcagcaaccccagcagcacgtgttcgggccccacataggaatgtcccagctcgtaggcctcctggtacgcgagttccagggcgcgcttcgcatgcggcgacagctcgggacgctccatggggcgcttcccacggcgcatctcggactcggcgcgctcggcgacgcgggccgggtccagcttcatgcggctgagcgcggtccggcccagcgggtccttcgcgagcgccaccagcaggtgctccgtgtcgatggaagccgcccccgcgcttcgcgccgcctggaaggccgcttccaatacgcgccgcgtctcatcggagaaggcctcggtgatgtcgtagcgctccaccggctgctggagtgaacgcgacagccccccgaagtcctcgtctccgaagtcactgaagaactggtcgaagagcgacgtgcccaggcccatgcggccgaagcgcgagcgctggctgctacagacgtcacacagggactcggtggtccgccggttccccatgacgcgggtgactcgggtggtcgccgggcgctggtggcagaggtcgcagacattggccatggtttcgggtcccccgaacgacggttcaatgccaacgctagggacggccggtgcgcctcacctcggccccagggcagggccgggcgtccaaggtggcccaccgttgcaggggacgctaacctgccggaagagccgtttttctatgccctccgggagtccccgacatgtccgagcagaagccccgcctgaagcgccccgtggagaacgtccgcgccgaactgctcgcggacccagacacccagcgcatcgcgaagtccctggatatggagctggaggcctacgtcgagctggtcctcgactacgcccagaacccggacaaggagccaacgctcatcgttgcgccggacgaggagctgcgcgccgccggctacaacccgccgaccacccaggacgtcgccaacttcttcatcgccgccgccaatggcgagctgggcattggcccgcccaagtcctattacagcggcttcgaagggaagcaggacgacgcgaacaagccgtcactccggggggatgagggccaggagcccgtgaaggtggacgaggagaccagccagaagctccgccagcacgtccccaagggcgggcctgatcgcgtttaggcggatttgacgcaactttctcccacgctccccgacaatccgtacattcaccccctttcatagaggtttcccccatgtccgttggcggcgcaggtggttcgaacggtagccgtggctcgaatggcgcgagcaatgctggccggagcgccgctgcaggtgcggccaacgcggcgggcaaggcggcgggcggtatcgcgggcgcgctgggcggtatcggcaaggcgctgggcggcatcggcaaggcggtaggcggcctggcgaacagcatcggcggcatcgccggcaagattggcagcgcgctgagccaggtatccggcctcgtcgacaaggcgatgagcgccatcaccggccccctcaagagcatgattggcggcctgctggacaagatgcccttcggcatcggccagctcgccaagccgttcgtcgacaagttcatcgacaacgggctggccatggtcgccggcggtccgctgggtggcgttgcctcgatgttcggcaaggccggcaccgtgggcaagctggcggacatggtggagacggtccgcacgggcgcgaagacggtgggcgacatcgccgagggccgcttcaacgcccagcagatggcggccttcgcccaggcccagctgatgcgcggcctgtaatcccgaatcgacgggtgaagcccccagggccagctcccacgcacgtgggggttggcccttcgttcgtttccgagtccgtgtgcgcccgcacgctgagtgaccacccggggcgcgaggccgcttgttgctggcgacccccgcccgcagccgttaaggagggcctctcccgcgtcggcgtcttcatgcgaaccactcatcgtcccctcaccaccttggccctggccttgagcctcttcatggccgccttggaagccactgtcgtttccacggccatgcccacggtggtgggcgagttgggcggcatccagcactacgcgtgggtcttcaccgcgtacatgttgtcctccaccatcaccgtgcccatctacgggaagctggcggacctctacggccgcaagcccgtgctcgtgttcggcatcgtgctgttcctcgtgggctccatcgccagtggcctgtccacgtccatggccatgttgatcggcttccggacgctccagggcctgggcgcgggcgccatgcagccggtggcgctcaccgtcatcggggacatctacacgctggaggagcgcgcgaaggtccagggcgcgttcagcgcggtgtggggcatcgcgggactgatcgggcccatcaccggtggcttcctcgtgaagtacctcacgtggcactgggtcttcttcatcaacgtcccggtgggcgtgggctgcctcgtcctgctcctgagctacttccatgagcgcgtggagcggaagccccagaagctggactacgcgggcgccgcgctgctcaccggctgggtggtggcgctgctcgtcggcgtgcaaggtgtgggcgtgaatctgtggggcttgcccgtggcggccgtgctgctcgcggccttcgtcgcggtggagcgcaaggtggccgagcccatcatccccatgtccatcttcaaggtgccggccatcgtcatctcctccatcgcgggagcgctcttctccgcggcgatgttcggggccaccacctacgttccgctcttcgtccagggcgtcctgggcggaacgcccaccgaggccggcgggatgattacgccgatgattgtcggctggccgctggcggccctcgtggccgggaagctgctgctcaagacgggcttccgccccctcatcgtgggcgggctgggattgacggtggtgggcacgtcgctgatggcgctgctcctggggccccaggcgcccaggctgctgccggaggtggccatgggcctgttcggcatcggcatgggcttcgcgtccaccgcgctgctcatcgccgtgcagaccagcgtgggctgggagctgcgcggagtggccaccgccagcaacatgttcttccgcaccatcggcggcgccattggcgtggggctgatgggcggcgtcatggtgtcgcagctcctcaaggacccgacggtgccgatttcggcggccaacgccttgatgagccccgaccacggccaggacttgcccgcggatctgctggcgacgctgagcggcgcgctgggcaccgggctgagcatcaacttctggctgatctgcgccttcaccgtggccgccttcgccgcagggctgttcttccccaaggtgtcgcgcaccacgacggtgtcctccaccgaggtggtggcgccgcactgacgtccgtgcggcgccccgtgcgtcgctcagaggccgtcaatcatccgcagggccacgtccggcacgaacgtgcctgcgggtgtgttgggcgcgacgccgcactggccatcggagtccccggggaccttgatccacagggtcatctccgcgccgcccacgcccacctggttcgtcgtgccaatcttccggccggcggggttgcaccactcaccgttggagccattgccgttacggctggtgtccaccacgaagggcttggtgtagccgtaccggctgctcagcgagctgttgacggagcccgcgtacgaggccgactgcgcggtggtgtagaagttcgacacgttgagcgcgaagccacgcacgttgcgcacgcccatgttctccagccgctgggccatggtgtccgcgttgatccacaaggcgttgcccgcgtccaggtaggcccacgtgttcggcgcgcgatcccggaactgctcggtggcgtagcgaatgaggctgatgcgcgtctgacgctcggcgtcgttcgccaggcagtcgagctgggcgacggcgtccggctcgatgatgacgacggcgggacggttgccaatggcggcggcgaaggacgaaatccacgtccggtacgcctctggcgaccccgcgcctccgcccgagtggcttccgcagtcccggccagggatgttgtacgccaccagcaccggcagcttgtccgccgcgtccgcggccgagacgaagctggacaccgccgtggtgatgtctccgctccaagcggcgaaccaacgtgcggccaggttgttcgcgacggaggactggatgcgcgcagcgcgcgagtccccgctgttggcccggacccagttggcggggttggagttcgggtcgatgtagaagccgttcgtcatcgacagcggcccgccgcctccgccgccgtcctccgtggtgagcgagatgtcatcgatgaacgcgctgaaccccgtcgcgcggcctcccatctggaaggtgacctgtcctgcctgcgtggccagcgtcgacgtgaaggggaacgtgaagcgccgtgacgtgccgtccaacgtaatctgccggtccagcggcgcggtgtacggcgcgctctccaactgcaccgtcacacggaccgtcgtcgacactgaagcagaagcggtgaaggacagcgtgtacgcccggccattcaccagcggaatgtcatcctggccaatcagcgcgtcccaggggttggccgtcccgccccccacatccacgcgcaggcgggcgttctccacgcgggactgcgtattggggccgctccaccagggcgacacggtgccgccgttgaaggtgccattggagacgagctcggtcagcgcgtcggtgcgactgccgagcgcctcggcctccgccggggcgggtggctccgagggaccacaggcagtcgtgagggccgccgcgagcatcagcgcggccggagcggtgaagcgacgaaacggcgaaccggcggagttactgggttgcacgaagccattcctcccgcccgcgcgaggacgccagggagcggcgcccggagtgacgcgggctgtgtcgagtgcgtggcccgtgggtggcctcnnnancacncnnngccccacttacactgtttactcctttttgattccttcaatcttccaaaactcaccctactgtccacatacttaacacgccgtacgccgtacttggaggcgtgcttcaccactcggcccaggcgcattagcaggtgcttctcataggggcgacctgtgagctggacacccaccgggagcccctcttcatgaagccggctggccccgacagggaggggaagccc

SEQ ID NO: 801 - DNA, 7546 bp, Myxococcus xanthus
tgtccatgctgctcatggaaatctgcgtcaccatcagcctgctggggcgcatgggcaaggcggccttcgacgcgcgcctggtgtccatgatggccaagacggccgtcatctgcgcggccatcgccgtgctggaccagacgctgctggccttcctgaacccgtgggtgcgcatcaccgtggaagccgtgctgtacatcgtcgcggtgctggccaccggcgcggtgcgccccggcgaggtgctccaggtggtgcgcatcgcccgccgccgtggaaaccccgcgcccgaagccgcgcccaccccgtgaggagagttccaccgctcatgccgtccacgcaccgccagccgccttccgccccgcgccgtccctggcgctcgttcgcctgcgccgcgctgctgctgctggcgcccgcttgccggggcctgggcaagtacacctgggtggatgactaccaggagaagccgcccccggtggactcggcgtaccgcatcgccgcgggcgacctgctcaacatccgcgtgtggaaccaggagtcgctcaccacgcaggcccgcgtgcgcgaggacggccgcatcagcctgctcttcctggacgacgtggaggcagcgggccacacaccggccttgctgtcgcagcaaatccagacgcggctgaaggactacatcaaccaccccgtcgtcaccgtggcgctggagatggcgcgccccatcaaggtgaccatggtgggcgaggtcaaccgcatcggtccgctggaaatcgacccgggcgccagcctgctgcaggccctggccggcgcgggcggcttcaccgagtacgcccacaaggaccgcatcttcgtcatgcgccaggaagagggcgccgcgcccgagcgcatccgcttccgctacgacgacctcatccacgccgaggggcgcgcgcccaccttccgcctgcgccccggtgacgtggtggtggtggaataacccgtgctggggacggtcctcaccgtcgcgttgctggaggtgtcctccgcctccgtcagctacgccacggccgcgcgcgtcgactcgcgcctgcgctccaacgaggaccccgcccccgaggccccccgtgtcgcgggcgacaccgacgtcaccccgctcctgggcctggaaattcgcgacggcaacaccgcgctccaggtggagtacgccccgcgcatcagcctgcgcgaagtcaccgcccgcgcgcgcaccgaaatccagcacatgggccgcctggccggcctgtggcgccccgagcgcggcctgtccctgcgcctgtccgaggagctggtgctgggcagcgtcaacctcctcaccacggacctgggctccctgcccggcgacacaccgggtacccccgacgggccgctgcggccccccggaaacggcgggcccctgcagcccctgccccaggcggacaccgtctacttcctctcctccgcgacgacgctgacggcggacaccggctggctggggcggcggtggaaccttaccggctccggcggcttctccatcagcggcggcctggacgggcccgcccgcgaagcggtgcccatgcagtatggcccgcgcgcggatgtgtccctcagccacgcgctgtcacccctgagcgccatcaccacctccgtggccttcaactacgcgcgcttctccaccggggcgaacaacaccatcgtcacgctgcgagaggcctgggggcaccgggtggacaggcgcacctccctggaggccggagcgggcgtgagcgtggtgcacaccatccccgtgccccccggcgaaggtgagcccgagcccggcccgctggacgcgccccggacggagctgctccccaacctgaatgtcggggtgagccaccggattccctcgcgcaccgcggacttcaacggccgggcggacctgcggctcgtccccttcacggaccggctcacggcgcgcgtctacccccgggcggacctgacgctgacggggacctgggccctggggccccgcgtgcgcgtgtccgccattggcggcggcgccgcggccgtgggcggaagtcgtggggacagcatcctttccggaggcttcaccggttcctggattctcacacggtgggtgtccgtggataccgacctccgcgggacgtggagccgctcgcccgaactgccggcggcccggctgacgtgggccgcaacgctgggcctctccgtgcggcaaactggtattctctgagggccggcgccatggcgaagctcatcttgatgtccgtcctcatcctcaccatcgccctgccagccaaggcggcgagggatccgcatccgatgcgggggctgaagaaggccatcctctggttcgtcctcttcaacgcggcatacacgtatggcgtcctcgtctgggtgccacggctcgggttcggctgagcgagtttcagaaaggttgacgacggatggagtccgacctgcacacggtcctcttggtggaggacgcccccttcttccggaagatgctgggcgactacctgcgggacatggggttcaaggaggtcgtggagctgcccagtggccgcgccgcgctcaagcacatggagacggccgcgcgtcccgacctcgtgtgtctggacctgacgctgccggacatctccggctatgacctctgcgagcacatccgccgctcggcgacgatggcggacgtgcccgtgctggtggtgagcgcccgggacttgccggaggacaaggcgcacgccgaggaggccggcgccaacggctacctgggcaagcccttcacccaggaggagttcacccggcgggtgcagtcgctcctcaagagcactggggccaggagggcaccgtgacggtccccgcgcccggggctcccgggccgcgcccccagttggtgccgccgcggcccgcgttcactccggagcgcccggagacgaacgcgcccgcggacctcatcgactggggcttcgccatcgacgcggtcttctttttgaagaacgcggtgctgcggcactggttcctcgccctggtggtgatgggcgcggtgtccgccatggcggtgggcgtcagcaaaatcatgccgcgcaagtaccgcgtggagacgcggatgctgacgcagcgcaacttcatcatctcctcgctggccaaccccgggcgctccatccccgtggacgcggaccagcccacgcgcgccgcgtgggagatggtgatgaagcacgacaacctcaagtccatcgtcgcgcaggcgaagctggtggagtactgggagctgcagcgctcgccgctgaaccggctgaaggagaaggtgctgcgcaagccgccggtggccatgtcggacgacgacaagcgcgacgcgctcaccgccatgctggagcaggcaatgattgtcggcgtggagggtggcacgggcaccgtctccatcggcgtggagtggaccgacccgcagctggcgctcaacatcgtgcaggccgcgcagcagaacttcctcgacatgcgccaggcggcggagatgggcgcggtgcaggaggccatcaccatcctggagaagcaggtggtggaggaggccgcgggcatccagcaggccattggccagctcaacgcggcggtgaagcgcgtggaggcccggcagaagaaggaggaggagaagaagggacggcggggcggtgccgcggccgcggccaacgccgcgctgggcatcaacaccgaccacctgctggcgcagatgcgcttcatgattcagacgaagcgccgggccattggcgacgtggaggatttccgctcgcggcggctgacggagctgcgcaaccagttgtccgagcagcgcgtcatctattcgccgcagcaccccatcatcaccgacctggagcagcgcatctcctcgctccaggaggattcgccgcagttgattgcgctgcgctcggagatgacggagctcatcaacgagtacgtgcgcaacggcggtgacccgggtgagctggagtccgggctggcgacggcggccatgggcggcgcgacgttcggcgggccggccacgtcggatgacccggaggtgtcggtggcggcggaccgggtgcgcatgctggtgatgcggcaccaggagaagatgcggcggttggaccaggcgcgcacggagctggagatttcccgcgcgtccatgaagcaccgcttcagtgtcctgtcgccgcctaccttcccggagcggccgtccaagccgaaggtgaagctcatcgtcgccgcgggcgtggtgggcggaatcggcatgggcatcttcgcggcgctggcgctggacatcatccgccggcgcattctggagaagtggcaggtcgagcggattctgaagctacccgtgctggcggagctggagcggcgctgaacagcgcgctcgggggtgcatgtcgtgacatcgtggacgtggctgcacgtggcgctgtgcgtgggcgcagcttcccgtggcggtggcgtgtggctatctgctgtccctgacgctgctctcctatcggccccagccgccgacgacgcgcatcgggccgcggaagttcgacatcatcatccccgcgcacaacgaggagctgggcatcgcccggacggtgaagaacctgtccgaggtggactacccggcacacctgcggcgcatcatcgtggtggcggacaactgttccgacgcgacggcgcagaaggcgcgcgaggcgggcgccttcgtcctggagcggcaggacacgacgaagcggggcaagggctacgcgctggcccacgccttcgagttcagccagcaggacggcttcgccgaggcggtggtggtggtggacgcggacacggtggtgtcgcccaacctgctgaccgccttcgcgaagcgcatcgagggtgtcgagggttcgaaggccggagccgaaggggcgcacgccatgcaggcgcactacggggtgatgaaccccacggcgtcctggcgcacgcggctgatgaccattgccctgggcatgttccacaaggtgcgctcacagggccgcgaggccctgggcgtgtcgtgcggcctgcgcggcaacggcatgtgcttcacgcaccacgcgctggccaaggtgccgcatgacgccttcagcgtggtggaggacctggagtacggcatccgcctggcccgcaacggcttccgcgtgcactacgtctgggaggcggacgtgctgggggagatggtgtccgcggagaagcagagccgctcgcagcgtcagcgctgggagggtggccgcgcgcagatgcgcaagctgcacgggtggccgctgctgaaggacggcctgcggaagagggatggcacgctgttggacatcgccatggacgtgctggtgccgccgctgagccagttggtgctggcggcggtgggttgcgcggtgatggccggggcgttcgcctggtggtcccacaacccgatgccatgggcgctgggcgtggcgggcttcagcgtggccagcctgggggcgtatgtcctgcgcggctggtgggtgtctggcgtgggcgttcgcggcctgctggacctggcctgggcgcctgtctacgtggtgtggaaggtgtggctcatgctgcgcggccccggcgcggagaagcgcggcgagtgggtgcggacctcgcgtgagggcgagaaccggtagcgggcggcgtacacgaaactcaagttggacttgagtttcgtgcagtcgagcgtggcgacttgcacgaaactcaaattggactttagtttcgtgcgtgggaacggcacgacgcggccagccagattgggaccggctcttcgacatcgtcgcggggcaatcgggcctgttcacggcgcagcaggcactggaggcggggtattcgccgcaggtgctcgcccaccatgtgggggccgggaggttccaccgtgtgcgccgtggcatctaccggctggtgcattttccggccggtgagcatgaggacttggtcgccgtctggctctggtccgagcagcaaggtgtgttctcccaccagacggccctggcgctccacaacctgtcggacgtcctgccttcacggatgcacctgacgctgccagccgcgtggagacaacgccggttccgcgcccccgcgggcaccgtgctccaccatgccgacgttggcgaaacggagcgcgtctggttcggtcccatcccagggacttcgccgcgcagaacgctgctggactgcgcagcggcgcaggtctcacccgacctgctgaatcaggccatcgcgcaggccctgtcacgcgggctcattctcacgtcagacctggcgggtattcagagtgcggcccaacgtccctaggacgcctccgcatgccccctcgcaggtacacgaacgccgcgggcttcaagcacgcgctcgaacagcgccaccggcaccgccagccgtcgcgatgcgtacgcgctcgcgacctgctctgacaccgtgtcgtgctgcatccagcgcaaccctggcgtccccgaagcgtgcggcctcacggcgagcgaagccgccatgtacatggcaggcgtcaagacagccatggacgaggccgccaaggaagaagaggcacccgtcatctgggacgacgcccacaacggggaccttcccgaatggcggcgcgagtgcattcggttctacggcgactgcaagacggagcctgggtggacgggcccttgctacgagtgcctacgccgctgcgaggcccaagaagagtggcccgtgtcgatgtgcaagcccggaagaaagacgcggaggaagtaatggacgacagccccgactgggacccggtgcgcgccctcgcacatggcgtgttgaaccaaggcatcccgctggagttgacggatgacgtgcggagcttgctcaggcgcaccgcgcgagaggttgccatcagcgacgcggacaccgcgctacagacccaagcgggcgcaacggaacttctgcgggaagccatgcgccgaatcaaggatggctcctggcgcctgatgcgtgcgcttcaccgcatgtaccagcataagcgcgcgggtgacttcgacagcgcccgccaggaaatgagagaggtgctcgccgaagaagtggtgcccttctaccgcgacgttgcagccgggcaactcgaagacctcgacgacgagccgtaacgacgacgggagcgagactgaagccgcgccaccgtcgtgctcaggaaccaccgccaccaacacggggcggcgccaccctgccgcacgccgcggcaggccgctccgagtcccgcgccaccgtcaaggccgcgcacaacgtcagcgatggaaggacgggcgcagttgcgcaggctgtcttgcatgagactcgagttggactttagtttcgtgtgtaggaatggcgcggcgcgggcagccgatgcggcttgagaggaggcaacgcggatgggcgtgcgtagcaagggacgacgtatgctccaccgggaaggccgcctcttcatctggtgggtggacgcagcggatggaccggaaaaagtcctgcacgtcatcgcggacgacaagcggttccacgtccagtatccgctggagcaacccgccgaggagggcgtcctgaccgtcccgtgccgggagttttc

SEQ ID NO: 802 - DNA, 6377 bp, Myxococcus xanthus
ggacgggtgcggcgcgggtgtccgcgcgtcagctccgctagtgccctgcggagccgtgggcgcctgcgcgccagggttctcgagcgccgaacgcggcacggatgtccgagcgtcagcgccagttgcactcgcgccagccgccgtacccggcgcggacgccaaggtccctgtgccagctccagccgggcgcggcaccgccgtcgtggcgaccgcggcggatggcgcatctccagcagcactccgcggcccaggcactacgccagttgccggctgcctcgcggcaggactcgtcgcggcacccacagcaggaatcgcaggcagcgtcgtgggcgtgcctcgcggcgcactccccgaacccggcgcagacggcaccgcacccgacgccggacgtgccggtgccgccgcaggactcgcacccggcgccgtcgcacgtccgggagtggaaggcgcaccctctccagcgcccgtgcgcaccgtgggaatccccgtcgtcgtggcccggggcggcaccgggggcgtcacgccggtgggacgtgcgagaggtgttccctggggccgaggcggcggagtcggcgcgctggcggcgggcgacgacggaatcgtcccgggcgtgacggggccggggacggcggccgtcacgcgcgggactgccggccgggcgggcgtggccggtgtcccgggcgttgctcccggcggtttgccggcgctggggtctgaaggctcggacatcggcgtggtcgagtcgcggccttactgcgccgcggcgggcaggtcgtcgctgttgtggccagcaagccgaatgttccggttggcctggatggactgctggatatcggcctcgctcatgccggaggacagggtgatggaggtcgacgtcttctgacccgtcgccgtgtcgcacgcggacacgtgcaccagaccatccgtgttgatttcgaaggtgacctcaatcttcacctcgccgcggtagccgatgcggaagcccgcgaactcgaactcgccgagcatctcgcactcgtcggcgcggttggactcgccctggtacacgcgaatcttcaccttctcctggccgtcgcggctggtggtgaacgtcttcgagcggtcgatgggaaccggcgtgttcttgtcgatgatcttctcggtgtacccacccaccgtgccgatgcgcagcgacagcggcgtgacgtccaccaggaacgtctgcgtcttgctgtccagcagcgcgtgcgactggagcgccgcgcccatggccacgacctggtccgggttgatgccttccagcggttccttctggaagtagtgcttcaccgaattgcggatgatgggcagccgcgtcggcccgcccacgaggatgaccgcgtcgatgtctgcagccgtcaggcgcgcgctctgcagcgcctcgtcgcacaccttgaaggtgcgctgcaccaggtccatcaccatgcggttgaactggtcctggttgagctgcccacgcaggtccatgacgttgccgtcggcgtcctggcagatgccctggcagagaatctccgcggagcccgtctggcccacgtcgatcttcgccttctccgcggcctccttgagcatctgcaggcagaacttgttctgccgcacgtccaggcgcgtgcgggccaggaagtcatccgccagccacgtcatgatgcggtcgtcgaagtcgtcgccgcccaggtacgtgtcgccagcggtggccagcacctcgaagacgtccttgccaatctccaggatggagacgtcgaaggtgccgccgcccaggtcgtagaccaccacgcgctggttgacgtcacgcccgaagccgtacgcgagcgccgcggcggtgggctcgttgaggatgcgcagcacctccatgccggcgatgcggcccgcgtccttggtggcctggcgctggttgtcgttgaagtacgcgggcacggtgaccacggccttggtcacctcctggcccaggtacgtctccgccaccgccttcagctccttgagcaccagcgcgctgatctccgggagcgaataggagtgctcgttcatcgcgatgcgcaccgagttgttgtcgccctcgacgatgcggtacggcatcaccgcctgcgccttcttcacctcgtcggagaagtagtagcggccgatgaggcgcttggcggaatagacggtctgctcggggttggtgatgatgttcttcttggccgcgttaccgaccaggaccgagccatcctcgaggaacgagacgcaggaggcgtgagtcgtctctccccactcgttggggatgacggtgggctggccgtcctggacaaccgccacgcacgagaatgacgtgcccaggtcgatgccgattgcgatgtcgtccgccattccgtctccggtgaggaccttcatcagaggtccgtcggtgaagggcacggaggttaggcacccccagaagcgggtgtcaacgttcccgtgtcaataaagcccagccatttcaagggcttagcgagggtgcaagggagcacgcccactggcttgagggggcgctccgaggccattatctctcatggcgaagggggtttactcatccatgtccgtcatcctcgccgctctgacgtccgacccgaacctgctgcgctgtgagctgcaccgcctccaaggccaggtcctgctccagggagagccgagggcgaacgccgtgggggtgggagcctaacgcccaggaggaggtcctgttgcggcgcttctccagtggcgaggagctgaccctggactcgctcgtgcccccgcatgaatcggaggcgctgctgttccacgccggccaactgcccgtgggcttgtcgctggaggagaacacccagcccttccgctcccggcgctggttgttcgcccttcatggcggcgtacagggtttcgagctgcttcgcgccccgttgctggcgtcgctgccggaccacctgcggcgtcaggtgcgtggcggaaccgaaggggagctgctgttcgccgtcttcctcaggcgcctgcgcgacctgggccgcacggaggatcctcggctggaggccgaggtcgctggacgcgtgctggcggacacggcgcgcgaggtggcccaggccgcgacccaggccggcgtgacacgcacgcccacgctcaacctggtggccaccaacggcatcctcctggcggcgacccggtacggcgagcaccccttgtactgcacgcggctggagggggcggccgaatgcgaattgtgcgaggtgacgccctcgacacccgatacgcagcccgcggtgggagcgcaccgccgccgtcgcaccgtggtggtggccagcgcgctcaagcgcaccacgggatgggtggagctggctcatggccacacgctggcggtggggccggatctgcagatgcacgagctgtccggcacgtgagcgacgtgcgcgaggcaggcgcccggaggccgctcccgaaggggatgcgggtctcggcgccacctcgtggaagtcccggcggtcccgccatgaagggctgaactcccgaccgcgcttcacgaacacccctcattcacacccaggctttcccgagatgggcgctccgggtccaggatgactgcgggccgctttacatccccggaggggaagtgcttccattgagggtgcttcattgaaatattgaagaatcgctggatttttggtgctcgtgtctcccatgctctcagaagttgagccgatgttcagcatcgagatccgcttgaggtcggatgcggcggtcgccgccgcgttgagccgccgctacgcccgtgagcatggcctgacggcgcaagccagcgccgaggtggcggtggtggtgagcgagctggccaccaatctggcgcgccacgcgggtggccggggctgggtggagctgtggctcgaggctgagtggctcttcatccgctcccgcgaccgcggccctggcatggaggacccatcccggttctttgctggcagggaagggcgtccaagcccgctgcccggagacagcctgggggaaggcggggccgcggtgcgacggctcaccgacgacgtccaggtggccaaccgcgaaggtggagggttcgaggtgctggcgcgcaagcgggtggtggtccaggcgaaaaggaggcacgggtgagcggtggttgggtgtgctcggcgctgttgcgcgtcttgcagcagttcatgtcggagacggcggcgtggttggtgctgcgaggcaccgtggagtccctcggactgtccctggacacggcgaccgcggcggacctgccgcgcatcatcgaggcgctggaacccgccacccgccacttcgtggacccttctcgccggccgcagatgatggcgcagcttcgcgcgcagcgcgcgccctcggcggggccggagggcacggccacttccgcctcggcggaggttcgggcgaccacctatctggtgcgcacggaagcggacgccagtcacgcgcggcttgccgcccggatgctgtgcgaatccctgggcgggcgcggctacgagtgccagaaggtggccacggcggtgagtgaactggcgcgcaaccagatttcgtatgcgggtggcggcaccatccagctcgcgccgcagcttgcgcccaagcggctgctgcgtgtcagcgccgaggactccgggcaaggcatcccggacctggagcgcgtcctgtcggggacgtacaagagcaagacgggcatgggcctgggcttgttgggcgtgaagcggttggcggaccgcttcgacgtgcgcaccggcccgacgggcacgcaggtggacttcgaggtgtggctgtgaggctcgcggtcgcccaccgctcccgtccgaaggtgggggcgttggagaatggcgacggcttcatggtgcgccaggaatgcgcccggacgctggtggcggtggtggacgcgctggggcacgggcccgtggccgcgcagatgctggcggaggagatgctcggcctggtgttgcccgcgcccacgaagtcctctgtttgatcgcccggggagtggggtgtgccggcgcgtgccgcgaggtgtgagggcactgctctcgctctcaagcgcggcgcgtcgacgactgtgtgtccataccgcacagtcggggcattgtacgaagatgggccatgggaactacgctatggctccgtcccacgtgggggctgtgtccacctccgcgcagatgctcgccgttgacgaatcgccgtagtggcattccattgggtgaggtctgatggtgcggcttaatcgggaccggatggaatcaaggagcgggtcgatggccggcaactcaggggaagacaacgccaacccgggaaacgcccgggaggtggccccagagcgccctgacgagggcgattcgcccgtgttggatggcgtgtcggatgcggagctggatgccatcgtgggccagctgcgcacggacaagagccttcgtacccggcccagcgcgcagccgcgctaccgcgaggccacgcagtcggagcgactgcaccggggcgcgggccgttcacgggcgtccaccttgggcgaagaggaggcgccgccgaaggaagccgcgcccgtcgtgaagcatgcctggtacttcgttgcgggcggcgcggcctacggtcctcacgacctcgcggacctgaaggcccacgtggagcggggttttctgggctttgattccctgtgctggcgcgaggggttcagtgagtggctgcccctggggcacatcccggaactcgcttccgcgctgctgccgccagccgtgcccgcgggacctccgcccattccgccggaagcgtccggggccttcatgcccccggttgcgcgcgcggtggacgtgtccgaggccaccacggagcgggtgatcctgaacgcaccgggcacggtggtgccccccttcgcggccattgcccctgccgccgtcgtggccactcccgcggtgagcgctgccgccatgccgcagacgcaggcctacggcgcatcactttctgtggatgcgccaagggctccggccgagggcgctgtcgtcgggcctgctccggaagctgatgtcgcggcgctcgcaccagaacctgtcaccgtgccggccgagagtgacttcgccgcgcacggagcccctgcgccggacccgatgcccgtggcggagcccgtgggaacccacgcggtgctagcgttgcctgtccccgaggaacgcgcgcgtcgcaagcgccagctgggtttcatcctgccggggggtgccatacaaggcgttctacctgctaatcaactgaggagccatgcgcgcgtgcgctgtcgaagtgaagtacgccatcggcgatggacaagggcctgaagaattactaccgggccctggctcactacatgacgccgaacaccacgtttgcccaggcccgaaccgcgacca

SEQ ID NO: 803 - DNA, 5536 bp, Myxococcus xanthus
aaaaccttctgtaaggccgtgaatcgcgttggccggattccgacaagcctaagcggaacgcggactgctgtgtaccttgggctgatggggtagccttccgggcaaccgcgcgtccaagcaccacctggaggccacggttcgcgcggtccactcggtaggcacgcatcgtaccgcgcacgtccagtaccaggcgaaccttgtctgcatgcgcgcccacacgaacatcgcgcagcgcccccgacttcacgcgaggagcacgcgtcgcgaggccgacgccaaacaggtcgaccgcgagccgaggcgggtcggcaagctccagcacctcgtagcgggcgatgtcaccatccgcacgaatgctgagggtatcgtccgcgaacgacatggcagtgatgtgctgggccggattcgacacctcccgctcatcagcctcggcagccaccacgttttccgggagcgcggccttggggactgccgctgattctgccttcaccactttggccggagcctgggcggcgaccgggtgtggcttcgcctccaccgacgcggtcatgcgttctgtcctggccggcgtctcggcgcgcttcgcgtcaacggactgcgaggtgccatccacggagatgacgacccggtttccgtccgcgcgcacgtcatactgagacgccttgtccagcgccagcagcacccggccaacgctcgcgcgctgatcagagaactgggacgccacgacaccggaaaccggtccagagccctcgtggtgtcccttgatgccggtcgcatccgccgacgacaggtccacgaccaggcgctccggcccgctcagccggaacacggtaaaggtcggtggccgggtgccggtcaccaccacctgggcacccgagcccgtgcgggacacatcaagtccccgcagcgtattcagctcggcaccatgcaccctggcgcccacaagaacgaccgcccatgcggccgccaacatccacttgcccctcgtcacagcgctctcctcgagcatgcgtcccctcaacaagttggaagcgggccaccgcccgcgggagcgccttggagggcgctactctccgtagttcctgcccgtcatcatgttgtaggcggggtcctgcttcgcatcaggcttcaactgcagtgtcaccggattcttgatgatctctccgttgccggagaacacctctgtcaccgtcaccgagtcacgaagaatctgagtgaccttgccgccctgacgtcccatgcgagtgttgcgacgcacgatgtgcccacgtccggccgggtcttcgaccatcgcgacggggcttgcatcccctgtcaccacggcaacgagcttcagctgatccaagtcgaacgagcagaggggctcgttgcaggctgccacggggttggcgttcaccggccccagctcgtcgatcggactccggaaagggtcgcgcttccccaccgggttgtacacatagctgtaggagggcgccgcctgcgcaccagtctcggtgggggccgccttcacagggactgccgccgcagccttgggctttgcaggcgggggcgcaggagccggcggctcctcgcacgcagcaagcaccagtgcgagcatcgcggtggtcatggtggccttgaacgtcttcatcctcactccccttgtcgccctacttcttgagcggatcaagtttctatttcttcgagttcgagttgcccgcggtcgacgcagcggccttctgttcgacgaaccggaacgtcgtggcctggaactcgctctgcaagacgaccttctcgttcttgagtttggccgagtcgaacttgatgttgttgacgttgacgatgcggcgcatgttggccatctcctgaaggaagagcgcaatctcgtggtagttgccgctcaccgtcatcttgatggggatgcgtgcgaagaactcccctcccccgacagactccttgccaggggtcacgctggagagttccagaccgctcttcttcccgatgtcgttgatctgcgcgagcagctcctcgatgtcacgctgctccggaagttccgtgagcgcctccgagagcttctgctccagcacgtccatctcgcgccgacgctcattcaggttctgagcaatctcactcttgtccgccagttccaggtccagcttgcggcgctcggccaccgcccaaccgatttcttcctccgtgggctggatgaccatgaagaagttggcggccgtgagggcaccgacgacgaacgccaggcccccgaatttgatggctggcggcgccttgacgaattgatccaggtacttgtccatgacgggcagccttgtcagatggcgtagttggaagtcatcgtgatcttgaactcgaccaggatcgggaccccgacctgcgcaccgccaacctgcttggcagtctgcagatcgatgttcttgaagaacggggacacctgcgcctccgggaactcttcgatcgtggcatccgaggtgagcatctcgactcgtgctgtcttgctgtcccggcgacggtccaccaggcgccccatgcccttgggtgtccacaccacaccgttgagcccgcgcatgaactcggcgacttcgtcatgactgacggccgagccatcaatggagaccgcgttgttgttctccgagaacgtcttcacccacaccttcttgggtgtcgcagacgcgagtgcgtccatcatgcgaacaggcccgctacggcccttgcgcagcgcatccaagacggccagcttcttctccacttcggccttccgggtgttgatgttcttgacctcgccgatgatcttctccagctcggcaatcctcgccttggttgaagcgacgcccgcttggtgcgcctcaagctcgctctgtcggtcgtcgtaccagaggtagttggcaacgccagcgccaatcaggaccaccgcgaagaggaccagcacctgccggcccatctcacgcttcttcaccgcccggacgggcagcaggttgatgcgaatcatcatgtgcgtcgtctccagagggtggtccggtcaggccagcttgtcgcccgggcgccgcagcgccagtcccacggccaccgccgccatgggcgccacgtccatgacgaacgcggggtcgaacttccggttatccacttcgatcttgcggaaggggttgaggatctccaccggtacacccgtgcgcgcttcgatggtcttgaacagcgcgggaatcttcgccgtgccgcccgacaggtagaccttgctgaagttcgagtcggccgcggtacccgcgtagaagtccagcgagcgctggatttcgcccgcgacctgttcggcgacgctggagagcacccgctccacgtcctgcggtaccaccgcgtccgcgtcagcgccgttgccaccgatcttcagcgcctcggcctcctcgtaggagacgttcagctgcttctggatctcctcggtgaactggttgccgccgatggtgacgtcgcgcgtgaacaccgtcgcgccgttggagatgatgttgatgttcaccaccgaggcgcccgcgttgatgagcaccaccgtctcgcgctccggcacgtcatagttgacggagaacatgttctggacggcgaaggcatccacgtccaccaccaccggggccaggcccgcctcggagaccaccgtggtgtagtcgttgatcatgtccttcttggccgcgaccagcagcacgtccatctgtcccgtggcgtcgttgccgccgccgtcgaggatctgcgtgtcgatgttgacgtccttcacatcgaacgggatgtactgctccgcctcccactggatgctctcctcgagctcatcctgggacatgcgaggcatctgaatcttcttgatgatgaccgagtggccggacacgccgatggccacgtccttgcccttcaccttcagctcggacatcaggtcctgcacggcctggacaatggccgtggagttcatcagcgcgccgtcgacgatggcctccggaggcagcggcttcatcccgaagctctgcagcgcatagatgacctcgccgcgcttgcgctgctccttgaggagaatcatcttgatggacgtcgatccgatatccaggccgagtaccagtttgcccttcgccatgcgtgactccgtcgagaggcagccagcgtagcactggccgtcaacccctcctaaaaagtgcctggagcccgcctgccctccggacggacgggagcctcgcaccaccccaactgcgccgggcccctcaacaccgtcgcggaggcccgattttccggcctccggcgcgttccgtcaaatgccagccggcagtccggttcctggaccggccccgcacgtcacccgcgctccgcctcggcgtccggatcgatgccgtactccttgattttgtagaggagcgcccggtgactgatgtccagcaactccgcagcccgggtgcggttgcccttcgtctttcgcaaggcggctcggatgtaggactcttccagctcccggatggctcgcttgagcgacaggtcaccaccaccctgtagcaccggatctccatgtggcttctcgccatgagggccaggtggggacgcggcccacagcctttcgggcaggttcgcaggaaggatgtgcggctcgtccgccaacaacacggcacgctccatggcgttttccaactcacggacgtttccaggccatgcgtaggacttcaggagcgcctcggcctctgcggtgagcccggcgacgggaggctctcggttcagctcgcggttgaaccgagcgatgaaggctcgcgccagcagtggcacgtcctcacggcgctcccgcaggggagggacgcggaggttcaccacgttgaggcggtagtacaggtcctcacgaaaatcccccttcgcgaccaggcgagacaggtcgcgcaaggtggctgccaccacgcgcacgttgaccttctcgacgcgattctcccctaccggccggatttctccctcctggaggacacgcagcagcttcacctgggcggccaagggaagctcccccacctcatccaggaagagggtgcccccatcggcctccgcgaagaggcctctcttggcggtgcgtgcgtccgtgaaggcgcccttcgcgtggccaaacagctcactctcgatgaggccggagggaatggcaccacagttgaccgcgacgaaagacatgggcgcgcggggactgcgaacatgaagctcccgcgcgatgagctccttcccggtgccgctctcgccactgatgagcacggtggtgtccaccggcgcgagccgcgcgacctggcgcagcaacgcatgcagcgccgggctctctccgaggatgtgccccccgggcgttgaaggcaggctggcctgcttcagccgccggttctcgcgaaccagccgctcccgctcctccgcctttcggaggacgaagacgatttcgtccggcctgcatgtcctgtgcacgtagtcgcactcggcgcgggcaacggcttggaccccctggtcctgggaaccgcaggcggtcatcactaataccgtcagagccgggtgcgcatgcaggacctcccgcagc

SEQ ID NO: 804 - DNA, 6429 bp, Myxococcus xanthus
actacaacgacagtgatctggacaagaaggtccgcaccgtgaaggcgtccatccaatccatgctgcaccagggcctcaaggagcgtcagggcgtgttctggtgagcgccagacgcggcggtgctaaagaggggagttccatgaaaccggccgtcgtcgtcacgggcatcagcggcaacctcggccgcaccctcgcgaagctgctgcacaagcacgagcgcatcatcggcatcgaccggcggcccttcgcgggacgtccgaaggacgtcgagatgtatgagctcgacctccgcaagaagaaggcggaggacgtcttccggaagaacgaaatccgcgccgtcatccacatgggcatcatgcatgacccccggatgagcgaggaggagcaccactccttcaacgtcgtgggcaccacgcgcctgttggagtactgcgcgaagtacggcgtgaagaaggtcgtcgtcctgtcctcggccaacgtctatgggcccagtccggacaactccaacttcctcacggaagacgcgccgctcatggccgccagccgcttctccggcgtgcgtgacctcatcgaagtggacatgctggcgcacagcttcttctggaagcacccgcacatcgagacggtcatcctccggcccgtccacatcgtcgggccgaccatcaagaacgcgccgtccaactacctgcgcatgcgccgaccctggatgatggcgggcttcgaccccatggtgcagctcatccatgtggaggacgtcgcgcgcgccatggtggaggcgctccgccccgagcccaagggcgtctacaacgtcgtgggccccggcgaggtgcccctgtccgcggtgatgcgcgagctgggcaatacccccatccccgtgccgcaccccgtggcccgcccgctgctgggcatgctcttcaagtaccggctggccaacttcccgccgccggagttggaccacatccagttcctgtgcgcggtggacggcagccgctgggtgaaggacgtggcctggaagccgcgccactccatgcgcgacaccatccgctccgtccagggcgactagctgctggaaagtccgaggccccctgacactgttgtcaggcccagcgtgacgtctggcccaggggcccctgacagacatgtcagaggcctaccccgggggcagggcggcgtcaggcggccagtcgttgcaaccccttgaatctccagccattcgccagcgcccgctccaagcgcggtgcttggcactcccgttgctctagtggctgcccgtcacggcgcggcgacatgggcccggcaacggtgtcgccccgtcaaactgtagggcactccatgggggagttcccgacgccctccgtctcggccggccccgggacggtgggcggtttcttgtagggcgctccataggggagctcccgacgcccaccgcctcggccggccccgagacggtgggcggtttcttttcagggggatgggggctgctcggggctggtgctcgggctcggcagctcgccctcgaaggggccgtcgtcctggctctccaggagccacgtcccgtcccggaagacgaactccgaggtgacgacggcggtgcgctcggaggccgagggcaggcgcatccactggatgcggctctgcaccgtggcccggtgcccgtcatcggacagcttcacgtcctcgatttcgtagtccgtgatggacaggtccttgtcgtcgttgagcgtcaggcgcgccttctggaagtccttgcgccgctcggggacgaggatgtgggaagcgctccggaagtccttccaccggagggcctggtggaagcgctccacggtgggcttgagtgcttccagattggatttcttggacgtggttgcgcacgccccgaggacgagcgcgaggagcagggcaggcaggcgattcacggtggggagggtaccacccggcagcagcgtcggacgagagagcggtggtatggtccggctccccgcccgagcaccggagtcgcgagcgcaatggccaagtcgatggtggagcgttacgagcagctcctccggcaggaccccacctcttccgttttcgtcgaactcgccaaggccctgctggaaaagggggatgccgcgcgtgccatcgaggtctgcgggcaaggcatttcccaccacccagcatccgtcgtcgggcgcgtgctgtggggcaaagccctcatcaagcaggggcggcccgcggaggcgatggaccagttcgagcaggccatctccatcgagaaggacaacccctacgcctacaacctgattggcgaggtgctgctccagcaccggttgtaccggtccgcgctccccattcttcgcaaggccctggcgctgcagccgaacgatggccgcgtgaagcagtggctggagcagacagagcaggcgttcgcgggtggcccggctcctgtgttcgcgaacctgatggggctggagaagccctcgtcggatgaggacgcgtcgtcggaggaggcgtcgaaggacgaggcttcgagccccacggtggcgcccatggccgctgcccggctgcgcgccgccgcgctgggtgacgcggcgaagctgaagcccgcgagcgccggtgcggcgccggagggagacgccaaggttgcggcgcgcgcggatgtggcatccgaagcctccgcgaaggacgcggggcaggggcgcacgaacgcggacgcggacgggaacgctcgggcgggcacggacattggcgcggcggagcagggcggggcggtggtcccttcaggtgacgcggctccggacggtgctgatgggggccgtgacgcgagcgcctcgctgggcctgttgaaccggccggtgccggtgtcgtccgtcctgggagcggagcttccgagcctggacctggggctgggtgatgacgatggcgcccctccgcgtggcgaggacgaagcggcttccgaggcccaagcgccctcggaggactccgcgctcgagcagcgcgctgacgcagagcaggactccggcgctgtcgcggacccgccgacgcagcaggtgtccatcgcggaggagcccgccgcggcctcggagcccgaggcgagcggtgacgtggatgaaccgcaggccggggccgctccggccgaggacgccggggcctctggcgcgggcggtctcctgggcgaccttcctcctcccgcgtcggcggcgccgaggcccgtcgtggcgagcacgcccgcgacgccgcgaggctccgggggcaagcgctccttgctggaggacatcccggacgcggcgcccgcacccgcggccaccgccgcgaaggccactgcgcgcaagccggacaccgaagcgctcaccgccgagtacgagaaggagctgcgggcgaagctggcgcgtgaggcggcgaagacgtcgttcatcgcccggcatggcgtgaaggtcgctggggccgtggtcggcgtggtggtgctggccatcgtcgtcttcagcttcgtcaacatccgcgcgcgccagggcggacagacgctgagcgagacgctggcccgggccgaggacctcatcatccaggacactggggcctcgctggatgccgcgctggcgcagctcgagaatgcgcgcgacatggacgaaagcagcagccgggcctgggcgctgacggcctgggcgcacgcgctgcgctacgtggaccatgggcaggcttccgaggaccgacgccaggcgctggaagcactggagcggccgggcgtgaaggacgcggcccccgcgcaggtgctggtcaccaacgtgctggtggcggacgagcgcggacgtgccctggcgcggagcgcgctgctgggctcgcagcaggacagcaccgaggtccatgcgctcgccggcagcctgctcctggaggcgaagctcaaaaatcaggcgctcgatcgctatgaccgcgcggttcgtgcctaggacgctaatgtccgcgcggtggtggccctgggggattactacaaggcttccgaggactttccgcaggccatcgagatgtacgagcgcgcgcgcaagaaatcccccgagcacccctcggcccgcatcggccaggcggaggctcggctcgcactgtaccaggacctggaggccgcgctgacggacgtggcgcggctcgcggaggacccgaagcttccttcgtcgctgaaggcgcgccagcaactggtgcatggcgagctgctgtccgcgcagggcaagcattccgaggcccgcgcgctgctctccaaggggacccagggccccctggccttcgagttccaactcgcgctcggcgccgccagtcgtgcggccgggacgctggatgcggcgcaggccgcctacgaggccgcgctcaagcttcggcccaagagcgaagaggcccgcgaagggctgggccgcgcgctgctggaccgcgaccgggagcgcgacgtcctcacccacctggaggccgacgggggccgcaaggtggccctggtgcgtggcgccgcgtatgcgcgcctgggagactggaagaaggcccgtgcggagctggcgcgcacgcgtgtgaatgaccggtatcccccggaggccgtctcctggctggccctggcggacgccgccgagggcaacggcgcccaggcgcgggagctgctggagaaggccctgcacgcggcgaagcggcctcgcaacgacatgcggctggcgctggggcagctctactggcgcgagcgggcctacgacaaggcgcaggccctgttcgaggaggcccagaaggacccgcgtgactatgaggccgcgtgctcgctggggcggttgatgttgtcgcgtgggctgccggacatggccctcaagccgctgacgcaggcggtggagcgcaacggcgcgcatggcgaggcccgtgacgcgctggggcgcacgctgctggccctggggcggacgcaggacgcgctcaagcagttcgaggcgtggcagttggagaacccggggagcgcggccgcgcacaagggcttcgcactggcgctgttccactctggccgccgcaaggacgcggagggcgcggtgcaacgctcggtgaagctggcgtcggatgatgccgaagcgcacaagcttcgcgcggccatcctcttcggcgcgggagacgcgcggggcggcttctccgcactggagcgcgccaacaagctggacccgaaggacgcgggcacgttctgtgagattgccctcgccttcatgcgccagggcaacagcggcaacgcggaggcggccttcgccgcggcccgacgggaagggcccgatgacacctgcggccgggtgggagagctgtacgcgcagttgccgggtggtgggcgtggcgccgctcggacgctcgaggacctggcggccagggcaccgactgtctgggacaaggccttcgctcgggccaccatggcgcgcgcgctgctgggggcgggggccgtgaaggatgcccgtaccgcggcggacgaggccgtgcgtctggcgcctttcgatgggcgcgcccagcttgcactgggaatggtggcgctcaggcagaagcaggaggacgtggcccgggccgcgttggagaaggccgtggagctggagcctgcggacggcctggcgcgtcttgcgctcgcggatgcgttggtgcgcgagcccggtgcactgccgcgagccgtggagtcctacgaggcgttcctgaagctggccggtggctcgaatgaggccgcgcgggtgaagaaggccctgcccagcctgaagaagaaggcggcgaggtagcgtgaggtatttctcctcccggacggattccccactgctgcacatcatgtggggcaatgcgttcctgctgtcgctcatctacctgctgctggggctcggggtggagattgccctgcgctacttcccctcgcgattcctccagcggctgtcgctgtcgctggactcgctgccggcacgggccctggagctgacgggggccatggagcccttgcgcgcggcctacttctccggccgcatctccgagatgggcgtgcgcgtcgtgttcggcgtcaccaccatggtcgtgattttcctgctcgcgatggtggtgggcacgttgatgggcggcgtccgaacgctgctggcgcgccgggccctgcgcgagggcggacgtcggcacccctgaggaggccgcggcttcagctccggcgacgaatcgtgggcttgcgcgcgcgcaccgcggcgtctggtacggcttggggctcgtggcccgcggcgcgcgccatcaggcagatttccaccaccttggggccaaagcgctcccagcggctctccccggtgcccttcaccgcgaggaagccctcccggtccaccggtagcgccgcggacaggcccagcagcgtggcgtcgttgaagatgatgaagggggcaacgcccaggtccttcgccagctccttgcgccagcgccgtagctccgtggaggccagctcgctgtaattcg

SEQ ID NO: 805 - DNA, 6134 bp, Myxococcus xanthus
aggtagatgttgtcgcccatgccaatctcgtcgccgtaatagaggacgggcgtgccgggcagggtgaagagcaggctgtgcatcagctcgatgcgccggcggccgttgtccatcagcggcgccagccggcggcggatgcccaggttgatgcgcatgcgcgggtcggtggcgtattcccggtacatgtagtcccggtcctcgtccgtcaccatctccagcgtcagctcgtcatggttgcgcaggaagatggcccactggcagttgtccgggatgtccggcgtctgctgcatgatttcgacgatgggcgtgcggtcctcgcggcgcaccgccatgtagaggcggggcatcaccgggaagtggaagcccatgtggaactcgtcgccgtcgccgaagtacacgcgcacgtcggcgggccactggttcgcctccgccagcagcatcttccccttgtattcggagtcgatggtcttccgcaggcgcttgaggaaggcgtgcgtctccggaaggttctcgcagttggtgccttcgcgctcgaagaggtagggcactgcgtcgcagcggaacccgtccacgcccatgttgagccagaagcgcatgacgtccagcatggcttcctgcacttcggggttgtcgtagttgaggtccggctggtggctgaagaagcggtgccagaagtactgcttggccaccgggtcccacgtccagttggagcgctccgtgtccaggaagatgatgcgcgcgcccttgtactgttcgtcggtgtcgctccagacgtaccagttgcgcttggggctgttggggtcgctgcgcgcttcctggaaccaggggtgctggtcactggtgtggttcaccaccagctcggtgatgacgcggatgtcgcgcttgtgcgcctcatccaccagtcgctggaagtccgcgagcgtgccgtagtccgggtggaccccgtagaagtccgcgatgtcgtagccatcgtcgcgcagcggcgaagggtagtggggcagcaaccagaggcagttgatgcccaggtcctggaggtacggaagcttctcaatcagaccggggatgtccccgtggccgtcgccattggagtcatggaaggcacgcaggtgcagctcgtagataagggctttcttgtaccagaggggatccaggtccattacgcctctcgggttgtcactcgtagtagtcgaacgcgttctcggtgcggcggaaccggtgaacggcccagagggccgcaggctgctcgggcgtcaggcgcacctgcacgtccggaccctgccatagcgagcgctggtccgacatcagctcgtgcacctgatacgtctcgtcagggcgcgcgcccagccactcgagtggcacgtgcagcagcgcctcctgggcggcatacggatccaggctcaccgccatcagcaccaggctgccgccgtctggcgtgcgcttgccgtagaagaggactcggtcgttgttcgacgagaagaagcgcagcgtcccgtactgatgcagcgcggggtgcgtgcggcgcgcggcgttgaggcgcgcaatccaatcccggatgttgccgggccggtccaggtcccacgcgaccagttggtacttctccgaatcggtgtactcctccttgcccgggatggggcggccctcgcacagctcgtagccgcagtacatgccccacacggaggaaagcgtgccggccagcgccgcgcgcagacggaaggcaccgggccccgcgttctggaggaactccgggaggatgtccggcgtattgggccagaggttgccgcggaagtagtcggacaccggcggctgggtgatctcctccaggtactcctggagctcgcccttgaagttgcgccaggtgaagtaggtgtacgactgggtgaagcccaccttgcccagggccttcatcaccttgggactgctgaaggcctacgacaggaaaaagacctgcggatgggcttcctgcacgcggcggatgagccaggcccagaattgcgtgggcttggtgtgcgggttgtccacgctgaacgtgttcaccccttgcttcacccagtggaggacgacggattccagctccgcccagagcgactcacgggcggggcccatccagtcgaagttgacgatgtcctcgtagcgcttgggcgggttctccgccgtcttgatggtgccgtccggccggtgctggaaccactccggatgttccttcacgtacgggtggtccggcgagcactggaaggccaggtccagcgccacctcgatgccgtgagcctgcgccgtctccacgaagtgccggaagtcctccagcgtccccagcttcgggtgcacggccttgtggccgccttccgaggcaccaatggcccaggggctgcccacgtcgtcggccgccgcggcgaggctgttgttcttgcccttgcgcgccgtgcggccaatggggtggatgggcgggaggtagacggtgtcgaagccgagctgctggatgtacggcagccagccttccgcgtcccggaaggtggcgtgggtgacgccgtcgcgcttcgccgaacgcgggaagaattcgtaccacgcgctgaagcgggccttctcccggtccgcgaagacctccaacaccttgtcgtagcggcgggccagtgaacggtccggatgggtcgaggccacgtcggccagctcgggtgccagggccacggcgaggaggtcaggggaggggggctgtcacatccgaacgtccgattcgtccagcacccgcgagtggtccggctgcttcgccgtacgggtacgggagacggcgccttccagcagggaggcgccttccaacaactcgctgcgcacgtcccggcccgcgtcgaccttgcgcttcagctcggacgtccaggtccggaagaggtctggccaggcctcaatcgtgtactcgtagcggccgttccgcgtcagggggaattcgccttcccaccggtcattgccgaggaagcgcatgggcacttcctcccagtcggtctgctgcgccctgggcgtcacctggcgccaacggatgacggcgacgaggacatcatggccttccttgaagacatcggccttgacggtgcaccgctctcccacgacgcgcttcacggcgtgacgtccagcgtccagctcggggctgactccctcgatgaatacgcttccgagtcgttcagtcatggtggctggcggcccttataggtcttgggttgtgattgcctcgcggcgaatcgcggctgttgtcgatgctggacgccttccgtgccagccgcgttggctcgtcaacgttaaggatgggggcgggcactgcccaccctggaaggcacagcgcgcccgggtgcccgcctgccgatacttgaagctgggaactgccctgccgattgagctatccgggacgaacatggcgcctccttcctccgctgtgccccgagcaagcgacccagcgctggacctggccctcctccggcaggtcgccatgggaagcccgcaggccatgcgcgacgtctatgcgcgctgcggcggacggtgtttcgccatcgcgttgcggttgctaccaacacacgctgacgcggaagaggtgttgcaggagaccttcctggaggtctggcggcgcgcccgagagttcaatccagaacgcggcggtctggaggcatgggtggcgacgattgtgcgcacgcgcgccatcgaccggctgcgggcgcagggaaccgcggcccgggtggtggaaggggccgtgcagcaggagcctccggtcagcgccgcgcccgccgcgccggacgaagcggtcagccaggaggaggctcgtgctcgcgtggtggcggcgctggcccagcttcctccggagcagcgggcggtggtggagcttgcctacttcgaaggcctctcccagcgggagatttccgagcgcaccggagacccattgggcacggtgaagacccgtgcgcggctcgcgttggagaagctgggggcgttgttggagatgctgcgcccccacgcctagccccaatgccggtcagtcaggaacggcccttcttgcgctccgtcttcgccttcgggacctcaccgtagccggacaccacgagcccgagcgtctggacgaagttcaccgcggcctccacggggatgcgcgtggccttcacccggttgcgcgcggggtcgatgaacacgccctgcgcggttccgaagtccgccttcgtgagcgtgcagccgcggaagttgctgccggtgatgtccgaatcgctgaagtccgcctcggacaggtccgtgtcgatgaagttcatctccagcgccgtgcagcgcaggaacgccgtcttccgcaggctgagccccgcgaaggtgcagtagcgcaggttggagccgtcgaaggtgacttcggggaaggtgcccacgtccgtccagtcgatgcccatcagcttggagctttcgaaccgcacgtcccgcagcgatgtctccgtgaaccgggctcgcgtgaggtcgcaaccggtgaagacgcaggattccatccgagtcctcgtccagcggctctcctgcagggtgcagttgaggaacgtgcagcggtagaactccttcccgcccaggtccgtctcctggaggttcaggtcggcgaaggtttcgttctcgaagctgtcttcttcgtggatgcgctgggtggccatggcgggcccgtcactaacgccagatggcgctcgcgggccaagtcatttcgctccggactctctatccatgacggacggtgaaggccgccagcaggggccccgccaggcgggtgttcgcgggagacgtcggtcctccttcgggaagctgcgtgaggagcgcctccaatgcgggcttcatctcctcgaaggcggcggtggccgccgccgcgttgtcgaagaagcggtggtagaggagccagccggtgacggagcaggcgatggcgtggaaggagcgggtgtcatccaactcgtaggtgagccgcgccaggccgccgaagtcctcatcccgcgcgatggtgccgccctgggtgcccatccacccgatggagcccccgtcttcatatggccgccacgccgcgtcgtccgcacgtcccaccattccaccccttgaaaggaaaccagcgccatcatgcgtgccccggggcggacgctccaggactccgaggactccgcttcgtccggaggtggacgtcggttcagcgcggaggaggtagggaaggggagcacgccgctgttcgcggaacagttgcggcgggacggtttgtgcccggcgaggcgccgtcctaacctgccatgtccatgaaggcgattctcgtctcccttttcctgttgggctcggcgccggactccagcgcgccagcgattccgcccgaagcgctcgcggcgcctcctgtcgcggatgagtcccccaccgcgtggtcctgcaccgtggacaccctgcgtgctgggaaggaatgcgtgttcgaggcggacctgtccgcgggcgcgcccagcgattcgcaggacgcatccaacaagaagctcctccaggacgtggcccgcgcgctgtgcacggaggcggtgggcaacatccgcgagggccgcccggacgcgacgctcaccgcgctttgtgagcggcgctacatcaccgccgtggaccagtgcggactggaaggcacgtcgttcgtggtggacgccaagggtcgcttcgctcccggcgcccgctcctgctaccgcgcgctggccaacgtccttcaagaggtgcagttcatggccacggtggcctcgccgtgctgcgagtgcgccgcccgcgccaactgcccgggcaccgccgaccgctgctatgccgaggtcgcccagcaggccaccgcgccccagacgcaggcgtgcctgagtgacaggtgcgcggatgcgtgcgccgtcgtgctgccgctgcctcgctccggagcgcaccccgcgcccaccgtccagcagcgcaaccgttccgccagccctggctccgcttccctctaggagttccgccccatgcgccgtccttcctggaagctgtcctcctgggccctgatgggcacgttcgccgccggctgcggcgcctcgcattcccacgtgacgtggtcggaggacgcgcctcacccgaaggaggaggtgttcgtcgccaggcctccgccggagccgcccgcgcctttagag

SEQ ID NO: 806 - DNA, 5051 bp, Myxococcus xanthus
gagctctaacagctcgtctaggacccggcccaggcgcgaaggcgcggcgccagagtggaggcacgcgtcgaggcgctgcgtgtcggatggggagacggcgccgcgccctcgttgcggttggtgggggtgctggaggagacgctggtccatgcgactcggattggcgacctgtacggcgacctcaatggcgaggagtcacgagccatggagtggggcacgctcctcgcgcggcttcccgcggactccgttttggccgaggcccggagtcactggcccgcggtgtcgttgggggacactggggcggccaccggcggcgtgtccatggccgtggccacgcggtctttcgtgaggaagtacgcgcgcggcgaagagattctcgtgtggtcgaggtctgatgagggcccggtggcctcggggctcctcgtccgcccataggagcgtgaaggcatggcatccagcgatacgcatctggcgtgggacccgaagacgctcaaccacacggagcggccctctgggttcgggtgcctctggcggcacacgataacggacaacggcgggtggagttctcacccgtgcaaccacatgtccaactgctacgaggtgtccttgaacgagcggagcgcgctctacaacaaggaccatcaggcgattgcccggcggatgaagctcgtccaggaggacttcgccctgagcagcaaggcgaagaagcgcatctggaagcgcttccccgtcagtgacaactcgaagcggaagctgaccctgtcggacttcttcgacaaggggcggcagtcactctactggctgcgccgggggccggaggggtggcacatcggggtgaagcacctggacccggtgcccaaccagacgctgaagaaggggaaccggcctcagtttcagccgcgtcagaatcagctccagggcgggtatggggccttctatccctacgagcacaactaccatcacctcatcccggtcggcgccgtcgaggagtgggtcatcggcaagggcgagtcggggagcccggcgcgctccgaccaggtggtgaagctcatcctcatctcgcggtggaacatccacaacgagaagaacatggtcctgctgccgcagcaggagttcgaggcgctcatcgtgggcctgccggcccactgcccttggggcgtgcccgcgcatgcggcgtatcagtcgtcgctccaggggcggctgcgtaagttgcggagcaagatagatcgtgcaatccgccagaagaagcaccccaaggacctcaaggcggacatcatcgaggagctggattcgctgtcgaatgcactgctgagccaggtcgagaatatgagagcgggtgttcagctcggacccgtgaatgtttagagggaacgatgtcttatcgctattatacgtttgttcatgccttggaccctcgcgcggtcgagatcgtcgacctccccgacaaggttgatgattacttttatctgcgagatggcgtcccgatgggaagctatcttccgccgacgacggagcttgctctatatgagcgtgctggcgacatgcttacggattttattgccaacccagacactgcgctctacgtctccccgaatgttcagaaggtgttggcagactgcggattgacggatgcagtcgtcgagttgctgcccttcatattgttggacaagcgtggtcgtcagatccgggaacgatacgcgattgcgaacgccctgttgaaggtgccatgcctggacttcgagcgctcaaagtatcgacgggctgcgagcgatccgaatgagatcgcggagatcaaagtgttgtgcattcgcgaggaggccgtgccctctgatgcacagctcttcaggctcgcggaactcccagaaatggtcgtgctccgctccgacctgctggaggctttccagcaggctgggctcacggggctcgcggttcaccccacaggcacggagattccgggctgaggcccgggtgccccatggattcggtcctcgacaacatccttttcctcgtaggccagcggatgccccggctccagtcgtcgtcggcgaagccggacgcgaagctgaccttggagaccgccgcgctctggcgtcagtacggctgtggcctcctgttgtcggagttggacgatgaaggcttccgagacggcctggagcaggcggcgacgctctacctgaacctgctcaaccgccgcagcgcgtgctccgagttcgaccagtactacctggcccgcagcaagggcgagccgctcctcgacgcgctggctgcgggcaactgggacttggcccgctccatcgccgccgcgatgacgccgacctggatgcagcggatggagtcagaggaggacttccactacttcggcgccctcatcgccctggtgctcgcgcagtctcacctgggcgcggagctcgccgcgttcgagcggacgctccagggcggaggctcccaccgcttcgacgtggtgcaggccctgtcaaagcaagaggccgatgccttcgacgcgggcctccacggaatgattgaggagcaggccgcctgggtcgagcgccagcggcgctccggcctgttcgatccctaccgccacaagacggaggccttcgtcttcgtcgaaggcgccgcgctggtccaactggcccgccgcctgggcgtaccgacgcaggagcgctatcgcctcatcccctctgctgccttggaactccaggcccgcacttgatgcgcccaaccgccctcacgccttcgctgcgccgcccttcggccctcgcttgagcgccagcagggccacgacacacagcgcggcgccggaggcgcacaccccgctccatccccagtgcgtccatgcgaaggtccccagccacgagcccgcggcgccgcccgcgaagtacgtcaccatgtagagcgtgttcagccggctgcgggcctccggacgcagcgagtacacccgtgtctgattggaaatctggttcgcctggacgcccaaatcgagcagcaccacgcccagcgccatgccccacagccatcgtcccaggggccacatcacgacgaacgacagcagcaacacgacgatggccgctccgttgatgcgccggtccccgcgcttatcggcgtagcggcccaccagcggagccacggcggcgcccgccacgcccacgacgccgaacagccccgccacctgcgcgtcgtacttctgcggcaggctctggaggtacagcgccagcgtggaccagaacacgctgaacgcgccgaagctgagtgcgcccagcaccgcatgcagccgtagcacgggctcggtgcgcgccaggtggatgagcgagcgcaacagttgcggatacggcatggaggccatgggcggctgcgacggcagcgtgaagcgcaccacgccggccaacgcgagcatcagccctgccgcaatccagaacatggtgcgccataccaggtgcgttccgatgaaggccgccgccgtccgggacaggaggatgccaatcagcacaccgctcatgacggtgcccaccacccggcctcgctgcgccgcgggcgccaggagcgccgctaaggggacgaggagctggggaatgatggtggtgacgcccacgacgaagctcgcggccaccatccagtgcagcgtcggcgcgagggccacgccaacgagcgccagcgccaccagcatgttcatggtgacgatgacccgccgccgctccaggctgtcgcccagcgggacgatgaagagcatccccaccgcgtagcccacctgcgtcagcatgggcaccagccccagcgcgctccccgaggcccccagggcctcgccgatgtctcccagcagcggctggttgtaatagaggttcgcgacggtggcgcccgaggcggcggccatcagccacacgagcccggtggacagcgcggtgtggggagcttccggggaggaatgcgttgtcatggaggcgggcggactctcgcgccgcgccctgctggggtccagacctgtgtaggctcccgggaatgacaggtccggattccgcacggggcggcttgcccgtcatcgacatggcgtcactgttcgatgcatcccgcgtcaccgagcgtgcgcgcgtcgcgcgtgaaatcgagcaggcctgtcgcgacagcggcttcttctacgtgacgggccacggcgtgtccggcgaggtgctcgcgcggctggagcgggagagccaccgcttctttgcgctgccccgggtggcgaaggaggccatcgccatgtcgatgggcggtgtcgcgtggcgaggctggtttccactcgggggggagctgacctcggggcgcccggaccggaaggaggggttgtatctgggcacggagctcggaagcgagcatccgcgcgtaaaggccggctggccgttgcacggcgccaacctgtggcccgcggaggtgccggagctgcgcgcggcggtgctcgactacgtggcggcctgcacgcgcgccgcgcatgcgctgatggagggcatggcgctgagcctgggcctggacgcggactacttccggcggcactacacggcggacccgacggtgctcttccgcatcttccattaccccgcggagccccagcacgaggaggtgagctggggcgtgggcgagcacaccgactacgggctgctcacgctgctggcccaggacgacaacggcgggttgcaggtgaagacgccgcgcggctgggtggaggtaccgccgctgcccgggacgctggtgtgcaacatcggcgacatgctcgaccggatgacaggcgggtggtaccgctccacgccgcaccgggtgaagaacgtgagcggcaaggacaggctgtccttcccactcttcttcgacccggacttcgccgccgaggtccaccccctgccacgcggcgcgggcgctgacgtagatgatgaccgcgcccgccgctgggatggcgccagcgtccacgccttccagggcacgtacggcgactacctgctgggcaaggtgttcaaggtgtcccttagaagtcgtccgaggggtgtgcccacgcgcgcatagggcactgccggaggaaacacccggagggc

SEQ ID NO: 807 - DNA, 6063 bp, Myxococcus xanthus
gtcctgccggcgctggtggggcagggactccagccatgcgagcaggctgccgccttcatgccagggcgtgcgggcgctgggccgggtgatgttgtccccgcgactggcgctgatggggaagagccgcacgccctcgaagccgagcgcgtgggcgaagtccaccagctcggcgccgatgcgctcgaaggcgccgcggtcgaagcccgtgaggtccatcttgttcaccgccacggccaggtaggggatgcccagcagcgaggcgatgtacgcgtggcggcgcgtctgcggcagcacgcccagtcgcgcgtccaccaggatgaccgccgcgtccgccgtggaggcgccggtggccatgttgcgcgtgtactggatgtggcccggcgtgtccgcgacgatgaccttgcgccgcgcggtgctgaggtagcggtaggcaacgtcgatggtgatgccctgctcacgctcggcgcgcaggccgtcggtgaagagggagaagtccagttcctccccgtccgcgccggccgcggccttcaggccttggaccagcacctcggagggcacggacacggcggcggcggtccgcttcgcgctggccttccgcacggcggaaatctggtcctcgaagagcccgtcgcactcgtagaggagcctgccgatgagggtggacttcccgtcatccacggagccgaccacgacgagccggagcagctcccgggaggcatgctggtcgagcagttgctgcaagccggtgtccattagaagtagccctcgcgcttcttgagctccatggagccctcttcgtcgtggtcgatgagtcggccctgccgctcggactggcgggcgttcaccatctcgtggatgacggtctccaccgtggtggcggaggattcgatggcgccgctgagcgggtagcagcccagggtccggaagcgcacgcgccggatttcgggcttctccccgggccgaagccgcatgcgctcgtcatccaccatgagcagcgtgccgccccggtcaatgacaggacgctccgcggcgaagtagagcggcaccacggggatgcgctcgcgcagcacgtagtgccacacgtccagctccgtccagttggacagcgggaagacgcgcatgctctcgcccgcgtcgacgcggccgttgaagaggttccacagctccggccgctggcggcgcgggtcccactgtccgtgccggtcccggaaggagaacacccgctccttggcgcgggacttctcctcgtcgcgccgcgcgccaccgaaggccgcgtcgaagccatgcgccgccagcgcctccagcagcgcctgcgtcttcatcgcatgggtgtacttctggctgccgtggtcgaaggggttgatgccctcggccagcgcgcgctggttccggtggatgatgaggcgcagtccgtggcgcgccacgaaggcgtcccggaacgcatacatgtcccggaacttccaggtggtgtccacgtggagcagcgggaagggcaggggcgcggggtggaaggccttgcgcgccaggtgcagcaggacctgggagtccttgccgatgctgtagagcatcaccgggttggcgaactcggccaccgtctcccggaggatgtggatgctctccgcttccagctccgacaggtgggacgcccgcgcgaacgtgtgctcactcatgaccgccctccgccacgcgcgctggcgcgtgtccatgctccgaggttccttgcgctaccagcgaaggcaggcgcccgcgcagcgagacgacctcgcccacgatgagcagcgacggcgagccgattgcgtcacgcgtcgccgcctgggcgatgtggctcagcggagcctccaccacccgttgatgcgcccacgtgcccgcctccaccacggcggccggggtggacgcggaacgccccgcgccgaccagcgcgcgcaccgtctcctccaaccggctgcccgccatgtagaggaccaacgtctgggccttcgccaggaagtcccaggccggcgcgctgccgcctcggtatgcagtggcgaacgtcaccgccccggagacaccccggtgcgtgacgggaatggccgccgccgcgggcacggctgtccccgcggtgaggccgggcacgacttcataggggatgcccgcctcttccagcgcgagcgcttcctcgccgccgcggccgaagacgaaagggtcaccgcccttgagccgcaccacgcggcgccccagcagcgcctgggcgatgaggatgacgtgaatctcctcctggctcacggagtccccgccgccctccttgcccacgtagatgagccgggcgtggggccgcgcatgctcgagcacgccagggtggaccaaccggtcatgaacgacggtgtccgcctcccggagcacgcgcgcggcgcgcaaggtcaacagctccgggtctcccggccccgcgccgaccaggaacactcggcctctcgtctgctctctcatcgtgtctctccaggtatcttcgagtgctccaactccgtgcggagccgagcccaggcggccttgcgctcgcctcgctccagcagcgcgccgatgtctcccaccgccacctgcttcagcagccgctggcgcccttcgcctcggggcaggtgctcgcggagccagccgctgagtcgcgccagccagatgtggtgtcgcgtcacctgggcggtgagcgtcttgcgcaggtggctggcgagcgctggggcccgccccgccgaggacacggcgacggtgatggggccgcgcctgccgacggagggcagggtgaagtcacacagcgccggttcgtccgcggtgttgacccacaggcccacgtcccgggcttcggtggccacctgccggcccacggccacgtcatccgtggccgcgagcaccaggtgatggccgcgcacgtcgccggccttgtaggaacggggctgccattccaggcgcccatcggctgcgagccgccgcagtgtggcggtggcctccggcgcgatgacacgcagtcgcgcgccggcgtcgagcaccgcgagggcacggccctccgcgatggcgccgccgcccaccagcaggacggagcgtccctcgagtcgaaggcacacgggataatccagggggtgtgaaggcatggcgtgtttcatcggaccgggtggaggccgcactcgcggttctccgcggactcccaccaccagcggcccgcgcgctcgtcctcgtagggtttcaccgcgcgcgtgcagggcgcacagccgatggacgggtagccacggtcatggagcgcgttgtagggcacgctcttcgcccggacgtaggcccagatgtcccggctgctccacgtggccagcgggttgagcttgagcagcccatgcgcgctgtccacctctaacgtcgccacgtcggtgcgggtgacggactgctcacggcgcaatcccgtcacccacgcctgttgacccgcgagcgcgcgcgacaggggctccaccttgcggatggcgcagcacgccttgcgtgcctctaggctctggcggaaggagaagtagccgttcgtggactccaacgcctccacgcgcgcgcgctcggggaagtacgtctccacggtgacgccgtagcgcttacgcaccacctccatgagttcgtacgtctccgggggcaggcgtccggtgtcgagcgtgaagaggcgcaggctgggcgcatgctggcgcgccaggtcgatgaggaccatgtcctccacgccgaagctggaggcgatggccgcgcgcgcaccgaagcggcgctcggtccaggcgaggaggtcctgcgcgggggcgtccttcacttcagcggcttcggcgagcagggccgaggcctggggctgcgggggcgacatggtgactccaggaaaagaaaaggcccgcctctttcgagggcgggccgcacgagcaagaaggttcgagaaggacgcgctacacgcttctcgatgctcggcacccgcctgcaggcggacacgcgggacacgcacggcacagacagcacgcgccacccgtggcacaggcgtcatcacccccggcggggagcacgggagagcgggggacacgggcgtcggtggtgaaggtcatgggtgaggagagtggtgcagggctgggggaggaaacgaaaacggcccggttcctgggacaggagaccgggccgggaagagcgcgaagagggaggcttggaagggcgtcccgtatgcgcgtcaacaacccaggtccggctgacgacagcaggcacacgacggacagcagcggctggcaaacggcgcggcggtcggtgtgtgggagtgcgtcatcgcgaagacctacgctagcggctgtttcaggcgcgcgtcaacccgtcctccttgatgcggtatgcggtgctgggccagcccgggggacgcccgctcgcccgcccgtctggagggcgggacacggcgccatcggatgaacgtccgcgcagaccttggaagggggcggggaggcgagccctcgttgcccatgcggcagcgggcatcaccttttgcggcaagccggattcacccgtcacccatggaggccatcgatggcgagcaccaacaaggacgtcgagacgctcaactcgttcctgcgcggcgaaatctccgccgtggagacctatcgcaaggcgatcgggcacgtctcggacggactggcccgtgacgcgctggagtattgccagcacgaccacgagcaccggatcgaggagattcgcgagcgcatcctgaagatgggtggtgagcccgtggagagctctggcatgtggggcaccttcgccaagctggtccaaggcggtgcggacgtcctgggcgagaaggccgccatccaggcgctggaggagggcgaggaccatggccttgccgactaccagcgcgacgcggaccaggtgcatggcgagaatcgacgcttcgtgaggatggagttgattcccgcgcagaagcggacgcatgagcggctcagtcgtctgaagcgcacccttcactgaacgcgtgccgcgcggatgcacgccggccgggtgtctcgttccgggcgcccggccggatttttctcaacccgtgcgacacgtcaccggcttgaatccccgggcatcccgcccgtctccgtccacgcgcggcgccctgaaccctcccctgatggggtgttggagcttgtgcgcagggcatgcgatacctggggtagctcgtcgcgttgagggaggcggagcatgtcgccggaccgcggttcatcggaacgggatccacgcccggagcaggtctccggcgaggaagcccggaccgtgcccgcgacctccacctcgctgatggacgccagccatgcggggacgctgagcgcgggttgtgaagccctcttccgctccaccgagacgacgctccagtgggcctggcgggtgctgaagtgcgcgaaggcgggtccgggcgcgggccccctggccacgtccgcccgtcagtgcgcgctcgagttcctggatcgcgtcccgccccatgtgcgccgcggcgtggcggagctcctggggtacagcagcctgtggcaggcggtgtgtacgcggctgggccgcccggtggcgcgctccaccgaggagctgcagcatgagctgggcgaggacctccaggtcctgctccacggcgcccaggcgcggctggggaccgccgccgcgctggagcaggggctcctggtccacctggggcggctgcgcgattcccgccggggggagccgggcgcgccgctggagctgcgcgcggccctggacgccttcacccactccctgtccgagctgatgaccgcggccagcgcctaccgccgcgcgtgggaagccgccgagacggagctgtccgagtccgcggcgtggctgggcgccggagacccgggcttctgctcgtggatggcggaccatctgtcagagacagtcttcgcgtggcgcaacgcccaagcctccgtccgcacgctgcgcgagctgggagagctgtcccagcagtagtcgccggacgcctgcctcactcgcccacgaggatgcggtgcgggtacagctccagcaggacgtcctcggacaggtccgcctgcttgtgctcgcgcaggt

SEQ ID NO: 808 - DNA, 6012 bp, Myxococcus xanthus
ctggtggcgcgcttccccaaggggcgagtaccacccggtggcgcgcatcttccatctcaagcagggcaaggtgcgcgcgggccgcgtggccgtggtgacggcgggcaccagcgatatccccgtggcggaagaggcggccacgacggccgaggccatgggcgcggaggtgcggcgcgtctacgacgtgggcgtggccggcatccaccggctgctgcggcgccgcgaggaagtccaggagtgccatgccgccgtggtggtggcgggcatggagggcgcgttggccagcgcgctgggcggactggtggggattcccgtggtcgcggtgcccacgtcggtgggctacggcgccaacttcaagggcgtgtccgcgctgctggccatggtgaactcgtgcgcctccaacgtggccacggtgaacatcgacaacggttttgggcggtggcttctacgccgccctcatctcccgcacgaagggacgcaggtgagcaccatgcgacgcatcctctacctggagccggtgggcggcatcgccggggacatgttcctggcggcgggcctggacctgggcatttccccggcggagctggagcgcgcgctatcgggcctgcgcgtcccgggctggaagctggcggtgagccgcgcggtgcgccacgccatcagcggcacgcacctggacgtcgtgctggatgcgcgcgaggcccatccgcaccgcgcctacgcggacatccggcgtctcatcgaggaggcggacacgctgcccccgcgcgcgaaggagcgggcgctggcggtgttccgcgccatcggcgaggcggaggcgaaggtccacggcgtgtccatcgacgacatccacttccatgaagtgggcgcggtggactccatcgtcgacatctgtggcgcggcggtggtgctggagctgttgggcaacccggaggtccatgcggcgccgccgccgctgggcagcggcaccatccgcgtggctcatggcgccatgcccattcccgtgcccgcgacgctggagttgctgcgtgacgtgcccgtgcgcttcgaaggcgtgggtgagctgacgacgcccacgggcgcggcgctgctcaaggtgctggcgcacatcggccatccgccggacttcatcgtgaagaaggtggtctacggcgtcggaacgaaggacttcaaggaccggcccaacgtgctgcgcgcgtcgctgggccggctggagcaggccagcaacgaagggctctgggtggtggaggccaacctggacgacgccacgccgcagctgctggggcacctgctggagcggttgctcgcggtgggcgcgctggacgcgtgggtgacgccggtggtgatgaagaagagccggccggggcacctgctgagcgcgctggtggagggcggcacgcgcgaagccatcgtggatgtggtgctgcgcgagtccaccacgctgggcgtgcgctaccaccgtgtggagcgtcaggcgctggagcgtgactgggtggaggtggagacgccgtggggcaaggtccgcgtgaagcgcgggctgcgccagggcgcggtgctcaacgcccacccggagttcgaggactgccgccaggtggcggaggctgcgggcgtccccgtgaagcaggtgatggccgcggcggtggcggcgctcggccccaaggactgagcgcggtgggctcctcagggggcgatgaagtcccgggcgcgggcgcgctgaccgaggtggttacgccggcaagcgcacctggatgcgggtgccgctctgctcggcgcgcacgcacaggtcgccgccatggcgctcgacgatgcgccggcagacgtccaggcccatgcccgccgcatggggcttcgtgctgaagaagggctcgaagatgcgcggcagcaagtccttgggaatgcccggcccgtcgtcggagacctcgacgaccacgtgcgcggcatccttccaggtgcgcagtcgcacgcggcctccgcgctcgcccagcgcctccagcgcattgagcaccaactgcgtccacagctcgtcgagcgcgacgccttccgccttcagccggggcaggtgcgggtcgtactcacgctccaccgtgaggtgctctccgcgcagccggtggcccagcgccgccagcgcgtgctccagtccgtcgtggacgtccacgtcctcacgcggcaccgggtccatgaaggcataggccttcacgccttcgaccagtgcggacacgcgtgccgttcctcgcgccacctccgccatgagcacgtcgcagctcaccgccaccaccagccacgcgagcacgtcgcccagcagcgccccgcccacgcgcgtcgccaccgactccagccacgcgacgtccaggccggaggccaccagcgcgggcgccgcctcccacgcatccgccacgccgcgcgcctccaaccaggagcccagcgcttcctcgcgctcggcgcgggccaggggctccagcggcggagaggtccgcccgcgctccgccgcttcccgaggcagcgccagcaggacgctgcgctggggcagggacaggccgtggtcgcccagggccatggcgcgcgcggacaccgtggccatcagctcgcccagccgcgccgcgctccgccgggccgccgcggcggggctgcccagctcggcgcccagttcggccgccatgcggcccacggggagcacttccgactgaggacggacgtcttgcgcctgctgctgggagcgctgcgaggccagctccatcagtccccggctgagtccgggagccagccgcagcagctcccagaaggtggccggctccagccggaacaggcgcacgtccgtcaccgcgtcgccgctgtgggggtagggcgcgttcaggaagaggatgagctcgccgaagaggtcgccggcctccagcgtgaacgtgggcacgctctccgtgccggtgcggcggctccactgcgtgtggccctccatgatgacggacaggccatccgcggcggcgccttgctcggcgatacgcgtgccagcggggaagtggagttgacggccatggtccgccatccagcggagctgttctccggtgagccgggcgaacagcggaacctggcgcaacgccgcgacgatgtcgtcacttcccatacgccgggatgctgcctgtccccgccagggagtccatcggattcggcggggtcccgcgctatcgcaagggttgccgcgtcaacgcctgcgcaaaggcgtcgttccgctgcccggacacgcacaccggcagcccctccagcatcccgcagcgcgcgcccgcccggaggaaggcgcccacctgctgacgcaccacgacgtacaccgtgtccccgtccacgccgccagggcgcatggtggcgttgcactcctcggcgatcgacggtggggtccgggtgacgtagccgctgttgaaagtgaggcccagtcggtaggccatgtaccccgtcgcgttgaccagcggctcgttgtaggggcacacccactgcacctgaggcgggaagatggccaggtgctggtagtggcccttcagctccgcccactccggggcctggagccgacggaagccttccgggcggcggcgcagctcgctcttgtcctggcgcacgtcgtaggcctgcacggcgaccaccagcgcgagcaccgccgtccccacccaggcgcgctctcgccactgccgcagccacaggaggagggcgccgcccatcaccgcgtagcacagcggccagatgaagcgcccggacgcgcggaacgcggacgtcagccgcgagaagggttcgtacagcccgcccaggtccaccaccagccggcccgtccacgtcacccgggacgacagcgcgtagatggccagcagcagcaccgccaccgcgaagggcagtccccgccgccagggcaggtcccgcagggcgcgaaagcgaagcgctgcgcccacgacggagagcaccacgagcagcagcgcccccgcgcccacatagccgaagccttcgccctgccgccgcgccacgggcagcgagggcagcagccgcgaccagtccgtgggattgaacagcgtggtcaggtcggcggagaactggccgaagccttccgcgcccaggttgctgccgacgaagtagccgaagagggcgaagatgagcacgtccagtatgacgatgcccaccgaggccagcagcgcgcgtccccaactgatgacgcggcccagggccaggcgcacggtcagcgccatggccagcggcgcgagcatggccaccaggtacggatgcgtgcccgcgcccacggcgttcaacgcggcggcccacaggaggctccgcttcgccgcatgggcatccggtgtgtcgcgcagttgcagccacatcatggccaccaacagccagtgcgagcacagcgtcagatgccccagccgcgccgccatgggcggagccagcgccagcagcagaccgcccagcaactggtgcgtggggcgggacgaaacgacggacaccagcttcgcgccgaaccagcccatgagcgcgaagcccagcgccagccagaggccgtggtactggaagtcagcgggcagcagtgcgttgaagggcttgaacagcaccgccagcaggggatttccgtccgtgagcgccacggaggtgccatgcggatggagctggttgggcgagctcgtgagcggcaggccccagggtgcgtttcggtagaacagccaaccgaaaccggaggccgcccagtcctcgcgaatcatccagtcgatgcgcgtgggcggaatcgcccggccaccgccgagccagaggaaccacgccagtccgcccagcgcggcgccccagggcgcccaccggctcgcgggtgaaggagaaggcgcaacggtgggtgtgggcggagtcggggcaagcgccggtgaagcggattccctcgacgccggtggactcggggtcgtcatggcggccttggtggaggccggcactgtaggaccgcgcttcccgcacgggcaagcaccgtcccggcccctgtgcttccggccagcctaggggtggcaaggcgtgatgctgtcgttgttcccgatgaggcgctcctctggcggcccgatgtagacgtcgtccgcgagcatcgtcgccaagcacgaggggagctgggggttgtccgtgacgacgaacgcatcgcgcacgcgcgcgagtgcatccaggctcagcgccgtcatcgctggattcccccgcacctccagggtgcccagggtgtggagcgagcccagggggctcaggtgctccagcgcgtcattgcccttgacgtacaggccgcgcatccacgtcacttgctcaaagccagacaggtccgtcagcagcgggttgaggttgacgaacaacgcgccacccatgctctggagctttggcaggtccgccgcgcgcagcagccgcgggttctccgccaggatgatgtccttattcacccggagcagcgacggcatcgggcctacctgctccagtgccgcgttgcccgccacggcgagcgcgcctgtttcggagagggcatcgaagcggaggtccaggagctgggcgttgttcatcacggtgatgcggtccttcaccaccatcaggtgttccagcccggtgaggtgcgtgagggccttgttgctggagatgtcgagcacgccgccgaccctcgtcagaggtcccagcccctccagggactgaagcaccgggttgctcgaaatcatgacgctccctcccacctccgtcagatgggacacgggcagcttctccaacgcggcgttctcgtgaacggtgagcgtgcccgccagcacctggacgtgggggaacgcgtcggggctccactgcacgccggtgttccaaatggtgaggtcgaagtggggcgccacggcggccacgccgctcagggacgaaagggcggggagcgagttgagcgtcaggctttcgacgcgaacggctggaagcgcctccggcgtctgcggtccgacgcgcacctcgttgagcgggttgctgccgcggatggtcaacgctcccccagagtagaaaagcccctta

SEQ ID NO: 809 - DNA, 6529 bp, Myxococcus xanthus
gtccgcgcgtccgccccgtgcatcacggagaggagtgagtcgctccactcaccctcgagcagggcattgcaccggtccagggccgcgcggaagacaggctccgtttcgtacaactcacggtccatgcccgagtactgcgcgccctgtcccgtgaagacgaagacgaccttgggctcctccccctcgaatcggtgctgggccagccgggggacttcctcccctcgggcgaaagcctgcagccgctcccgggcctgctccgccgtctccaccacgagcgccatgcggtgagagaacgacgtgcgctgcgtgttcgccgcgtgggcgacatccgcgagcgacagctccggccgctgagcgatgtgctccccgactcggaccgcgagctgcgcgagcgcccccttcgtcttcgccgacagcgcgagcacctgcgcgccgcgctcggcctgcgccttggcgggctccggccgaggcgcctcctccacgacgatgtgcgcgttggtgccgctcaagccgaaggcgctgatgccggcgattcgtggacgcgcccgctccggccaggcggtgacttgcgtcgggatgtccagcgggaagccgttcagctcgatgtgcgagttgagcttcttgaggtgcaggtgcggcggaatcacgccgtgccggtgcgccaggacgaccttgatgagcccggcgatgcccgccgcggcctccaggtggccaatgctggtcttcaccgagcccatcagcagccgctgctcgggcgtgcgcccctcgccgagcacgttggccacggcgcggacctcgatggggtcgccgagcgacgtgcccgtgccgtgcgcctcgatgtagtccacgtccgagggggcgacgttcgcgttggccagggcggcgcggaggacctgctgctgggcatccccgttcggcacggtgagcgcgctgctcggaccatcgtgattgacggccgagccacggatgacggcgaggatgtcatcgccatcccgctgtgcatccgacaggcgcttgaggacgaccatgccgcagccttcgctgcgcacgtagccgtcggcggattcgtcgaacgtcttgcaccggccgtccgcagacagggcccggagttgcgccaggtagatggtggagtgcggcgcgagcgtcatgttgacgccgcccgccaacgccaggttcgcctcgccaccacgcagggcctggcaggcgaggtgcaccgccaccagtgacgacgagcacgccgtgttgaggctcatcgccggcccctggaagcggagcaagtaggccagccgacccgcggcgaagctcgcgtcgttgccggtggcgatataggcgtcacccgccgccgacgcgctccccacgccgttgagcatcgcgtactcgttgctgccgatgccgacgaacacccccgtcttggtgttggccagccgcgcgggcgcgagccccgcgtgctccaacgactcccaggcgacctccagcagcagacgctgctgtgggtccatgttcgaggcctcgcgaggcgcaatcccgaagaactgggcatcgaactggtcggcgtcgtccaggaagccgccccagcgcgtgtacgtcttgccagggacgcccggccgcgcgtcgtagtagtcgtctaccttccagcgcgaggcggggacctcgcggatggcatccacgccgccctccagcagcttccagaaggcgtccggacccgaggcctgtgggacacggcaacccatgccgatgatggcaatgggctccgtcgcgttgctgacgacgcggcttgtctcctccttcgcctccacatccagccggagcacgtccttgagcagatacgtggagagggccaggacggtcggacggtcgaaggcgatggtggacgggacctggacaccgaaacgcgccaccagtcgccgacgaagctccacggcggtgatggagtccatacccgtgtcgaagaagccctgctccagcttcaccgccgcgctggaggcgaagcccagcacccgggacacctcctcacgcacccacgacgtcaccaactccttgcgccgcgcgggcgtggcgttgcgcaactgcgccagcgtctcgctgccgtccaccggtgccaccggcgtgggcatggagggagcaccgagcacctccaggagcggccggggcgcccgcgattcgtacacggacttgaagcggctccagtcaatctgcgccacgctccgctgcgtcacgtccatggcgagcagcgctccgagcaactggagcccgccctccacggtgacgccgcgcacgccgatgcgctcgaaccagcgcagtccttcctcagcgaccatgccttcggccgcccacggcccccagttgatgctcagcgcatgctggccccgcgcgcggcggtggtgcgccagcgcatcgaggaactggttacccgcggcgtaatgccccatctgcgccgagccccacacggccgagcccgacgagaagtagacggtgaagtccaggtccagcccctgcgtgagctggtgcaacacccagccacccgccaccttcgggcgcaggatggcagcgagcaatgccgcgtccatggcctccagcgatacctgcgtggagactcccgcggcgtgaatgacgcccttcagcggagccggtccccgctggacggcgtcgatgacctccgacatgcgcgccacatccgccacatccgcgctgagggcgtggacaacggcgccctccgcttccatggcttcgatggcggagacctgccggcccacatcattgtcgcggggaatggcggcccacgcgtcgcggctcggcagtcccttccggcccagcagcacaaggtgccgcgcgccctgagagacgagccagcgtgccacgtggagtcccaatccgcccaggccacccgtgacgaggtacgtcgcatccgcgtgaagcgtgaggcgggcatcgccaacgacaggcgccgagggaaccagccgagccacgtgacgggtgccatcgcggagcgccgcctggtcctcgccatccgctccggacagctcgcgccacagcgcttccacctcgccctgcggcacggcggggtccaggtccagcaagccgccccagacctccgggtgctccagcgccaggacacggcccaggccccacagcggcgcctgtacgggcgagccgctcgtgacgttgcccaccggctgggtcccccgcgtgcacaaccacaaccgggcgccgctcgcggacggtgacttcaccagcgcctgcaccaggcgcaacgccgcgtggacgcctcgtttctgcgcggactccacctccgcgagcgtgggctccgcgccggacacggtatccgcgccccacaggtgcaccacggccttcaccgggcccacgtcctggagcaattgcgcgtagtgctccgcgttgtccgggtggatggaccgcaccttctggcctccgacggccgcgacctctccggggacgaccagccagcacggttcgcccagggcgtccagatgggccgccagcgcggcaccaacgccctcacggttcccgaagacgatccaggttccctcgcccctgggcgcacgcggcgaaggcgccccccgctcacgcgcgtgccaggtgatgtcgtagacccagccacccggactttggacattcgacgtgtccgcgctccgggccacggaggcccgggtcagcgtcttcacgggggcatcgtcaatccagtaccgcgagcgctgccacgggtagagcggcagcgacgcgagacggcctccctccgggaagatccgactccactccacggggtagcccttcacgtggagcccgcccagcgcgcccagcatcaccgtctggccagcccgccccttgcgcagtgacggcaccgccgcgccttccagctcacggcgtcgcagcgcctgctccacgtaccggcctagcgcgggctgaggccccagctcgacgaagagccggtgcccttgcgccagtagcgcttccacggccgctgagaaccgcacgggcactcctacgttgcgcgcccagtacgccgcgtcgagtgccgtgccgtcgatggcctcgccactcaccgtggagaacatcgggacggacgtcggccgcgtttcgatgtggcccaggacctgggtcagctcggcctgaagcggtgccatctgatagctgtggaaggcgtagttgacgcccaggtccctcgtggcgacacctcgggcacgcagtgtttcgagcaccgctccgagcgccgccggttcacccgacaagacgacgctccgggcgtcgttgatggcacccaccgacagccggcccacgtagggcaccagctcgtgctgagcctcgtcgggcgacagttcgacggaggccatgcgggccctgccccgtcgccttctgcatgatgcggctgcggtgcgccaccagccgagcggcctcgggcaggctcagcgctccagccacatgtgccgcggccacctcgcccacgctgtgccccacgaccgcggacgggacgacgcccagtgcacgccatgcggccgcgagcgcgacctggatggcgaagatggcgggctgggccacctccgtctcctccagacgggactcgggcccgtccgccatcagcgcgtcgatgatggagttccgggtgtgcggggccagcgccgcgtccacgtcacgcaacgcggcggcgaagtctccgttgctcgcgaagaggtcacgccccatgccctgccactgggagccctggcctccgaagacgaagacgacctgttcccggcgcccctccgcgacgcccgtcgtcagatacggcggtgccccgccttcgaggaacgccaggagctgctcgccccactccgccgccgtacaaccggccaccgcgagccggtgttcgtgggggttgcgccgcagcgcagcggtgtaggccaggtcttcgagccgaggcgccgcgtccccaggttgaaccaggagtgtgtggtacgagcgaaccagggctcgcagcgcgccctcgctcctcgcggacagcgtgagcagccgcgcggcggtctgggtggcctcgggcgcgggcgaagacgcgggggcctcttcgacaatcacgtgcgcgttcgtcccgctgatgccgaaggaactcaccgccgcgtaacggcgccgctgggagacaggccacgactgttgctgcatcgggatggcgaagggcgtgtcctcgatggagatgcgagggttgagcgccttgaagtgcaggtgcttcggaatggcctcgtgccggagcgcgagcagcaccttgatgaggcccgccatgccggccgctgcctccagatgaccgatgttcgtcttcgcggagccgaggaagcagcgcgaggcatcctcgcgccggtggccatacgtctcccgaagggcctccacctctatcgggtcgccgagcggcgtgccggtgccgtgggcttcgatgtagccaatgtccttgggcgacacctgggccgctgccagtgcctcgcgaatcagggcctgctgcgacaggacgttgggcgtcgtcaggccggtggagccaccatcctggttcaccgccgatgcgcgaatcacgcccagaacgttgtctccgctggcgagcgcatcggagagccgcttcagcaccacgacgccgcagccctcaccccggacgaagccattcgcccgcgagtcgaaggtccggcagcgcccatccggagacagcgccgtcagcttggagagccaggaactgggccgctgcgacaggagcaggttgacgccgcccacgagcgccgcgtcgcactcgcgattgcgcagactctggccggccaggtgcaaggccaccagcgaggacgaacaagccgtgtccaccgacatggccggcccccgcaggtccagcaggtacgagagccgcccggcaatcacgctgttggagcagccgatgacggagtagacgtcgccctccacgtcgcgctccgcctggagcatcgcgtagtcattgccgcagacgccgacgaagacgcccgtccgagtgcccgacaagcgcgccttcggcaggcccgcgtcttccagcgcctcccacgcgacctcgagcagcaagcgctgctgcgggtccattgccacggcctcacgtggcgcaatcccgaagaactccgggtcgaagccatccacccggtccaggaagccaccccagcgcgtgcccttgtgctccgccgcgtccgtgctgctcttccagcggtcagcgggcacctcgcggactgcgtccacgccttcgctcagcagccgccagtacgcctccgggtcattcgcgccgcccgggaaacggcagcccatgccgacgatggcgagcagttcggggccctgcgccgtcgtccccaccgccggaacaacctgcgcctccttcaccaccggacgcaccgtgacgcgcgactcgacgtcgaggacgggctccagcttgccgaacaggtgcgccgtcagcgtctgcaccgtgggataggcataggccagcgtcgcggacagcgtgagcttcagcccggactcgagccggttgcgcagctccagtgcggtcaggatgtcc

SEQ ID NO: 810 - DNA, 5337 bp, Myxococcus xanthus
gccctctcaggggcatccccccgagcccatgcgctccgccctcgtccgtcgcccggggagcgcggaccatccagaacgccagcatcgccgcgcaggcgcccgcgagcgccacggcccacggccagcgggccctgggcgcgctgcgcaccatgcgccgagccgcttccgcgcgaagtccttcgcccatggcgtccgtgcgcggcgcgggcagggtgccgcggccctcgtggaggacggcgcgggactgccgcacctgctccagcgcctgggcacattcggagcaggtggcgacgtgcgcttccacccgtccgctcgcatctgcgtccaactcgcccgcggccagggcccacagggagaggtgctcatgtcgcgccatggaaacctccggaccggttggcgccgagcagtcgttgcatggcttcgttgaactccagccgcgcatggtggaggcggctgcggacggtgttgggggagctgcccacggcgtcggcaatctcgtccggactcattccacacagctcgtagtacacgaagacgatgcgcttctttggcttcagccgttccagcgccagctccaccagccgggccgcttgacgccgcgaggccacccgctcggggtcgtctccctccgccaccgcttccggcaggtcccagacggagtcctcaggccggcgccgcttccagcgcaggtgggacagggccacgttggagcacacgcgatagaagaaagtccggaaccgggactcgccccggtagctcttcacggctgtcagcagccggagataggcctcctggagcaggtcctccacgtccacgcggttgccgaccaggtgccacaaggtgcgcgaggcatccgcctgcgtgagcgcatagagctgttcgaatgccgtcaggtcgccctcctggatgcgccggaccagtgcctggagccgcacctcgtcctgggcgggaacaccggacacgtcgcgtccctttcgctcctcggggaggtgggtgacgtgcgcgaatgagcgggctccacgcaggaacaccaggggttctccctcgatgggtggtcggggtccggcgcgatacgagcccggcccggtgaccgactgaaaggtccaggccactacatacctccatggccatgggtctccggaaagacgaaagccgatcaaataaattttttgatcatccgtctgcgctacggagtccatcgctgaaaccggaaagcacccccggtggccggaccggtacccctgagttctcggagtccccactcatgcggaacacccccatacgtagcctcatgtggctgccgttgctcgccgtcctcgccgttctcccgggctgcatcgtccatggagaggatgactggtacgacgactccgacgacgacatctgctactgctcctccgacaaggattgcagtacgggtgagagctgccgcagcggcgtctgtcggaccgttccacctggctcgggcgcgtgttcctcctccctggactgccccgggtcccagatctgcatcaacagcgtctgctcgcagttctgctcgcgtgactccgactgcggttcgggccagcggtgcgacaagaactactgcgttgggaacggcgggacgcgcccggacgcgggttctgatggcgggacgcgcccggattcggggacggacggtgggacgcgcccagacgctggctccgacggtgggacgcgcccggatgcgggcgtggacgggggggctcctcagcagtgccgggtgaacatggattgcggtgcggggaactactgcatcaacaaccagtgcatccgcggctgctatgacgattcctggtgcgacgccaaggacacctgcgtgagcggcctgtgccgtccgcgcccggtggacccgaacacctgctccaccgcggcggactgctccggcgggaaggactgcgtggatggccagtgccgcgcggcttgcgactccaccacccagtgcccggacgactacagctgccagattggctactgcatgcccattccggatgggggccagtgccgcgccaactgcgagtgccccgccggccaggtctgcttcaatggcaagtgcaagtcgccgcagccggacccgggccagacgtgcgtggccaactgtgactgcccctcgggtgacgtctgcaccaacggttactgccgtccgccggccccgccgccggacgcgggcacgggcacggcctgccaggccaactgcgactgcccgtcgggcgaggtctgctccaacggccagtgcaaggtgccgccgcctcctccggtgcaggatgccgggacgtccaccccggtgtgccgcgccaactgcgagtgcccgtccggtcaggtctgcacggacggcgtctgcaagcccgtcaacacgggcagcggcaacagctgtcacgccacctgcgagtgccccgccggcgagcgctgcatcgacaacgtctgctggctgtagtcgggacggacgccagcgtcagggagccaccatgcgccagcagcggtggatctccttgcgctggaagtcctcggggatggagcgaggggtgatttcctccacctccattccccgcgtggccttcggttccaactggaaccccaggaagttggtggagaagtagaggacgccaccgggtgcgagcagcgcccggatggcggccagcaggcgcgggtggtcgcgctgcacgttgaagctgcccgacatcttcttcgacgtggagaaggacggcgggtcgcacaccaccaggtcgtaccgctccggcgcgtcggcctgggcctccacccaggccttggcatccgcgcgcaccagcgtgtgccgcgcgtcggccaggccgttgaggtccaggttgtcctcggcccagtccaggtaggtgttggacaggtccaccgtcatcgtgctcgcggcgcctcccgcggcggcgtagacggtgaaggccccggtgtacgcgaagaggttgaggaagcgcttgccccgggcctcctcccgcacgcgcgcgcgggtgttgcggtggtccatgaagaggccggtgtcgaggtagtcgcccaggttcacccagaacttcaggccctgctcctccaccacgatgcgcccgctgtcctggcccacccggccgtactgagagcggccccagggctggggcgtgtgcgtcttcacgaagacgcgctcggagggaacggccagcacctgcgtcactgcggccaggacttcctcccgctgcgtgtccgcggcaccggaggcgatggcacgccgccgggggtattccacgacgtggacgcggtcgccgtagacgtcgatggcgtacgggtactcggggatgtccctgtcgtagacgcggaaggccgtcagcccctgcgtccgggcccatttccggaagcgcttgtcccccttgcgcaggcggttggcgaacatgccctcggggccggttgcgtcgtgagagccatgcgtaccttgtgtgtcagccatgcccaagcgtccttccgtccagaccaccgcggcccccctcatccctgagtctccgacgtacgacaagctccgaaaggcggctgcggggtgtcaggcctgtccgctctggcgcacgggcacccagactgtctttggcgagcccgagggccagccgcgccccggcccccgggtgatgctggtgggggagcagccgggagaccaggaggaccgggccggcaggcccttcgtgggtccctccgggcggctgctggacgaggcgctggaggccgccggcatcgaccgcgcgcaggtgtacgtcaccaatacggtgaagcacttcaagtggaccggccaggggccccggcgcatccacgcgaagccgaccacgacggagattcgcgcctgcctgccgtggctggaggcggagattcgcgtgttccgcccggacgtcctcgtctgcctgggggccaccgcggcgcaggcgctgctgggcaaggcgttccgggtgacgcagtctcgtgggcagccgatggcgtcggaatgggcgcgggtggtggtggccacggtgcacccgtcctccatccttcgcgcgccggaccctcgggcgaaggaggctgctctggaggccttcgtggacgacttgcgccaggtggcgcgcatcatccacggcctgtcggaaggggagggcgcgcacgcgcccatgtaaggaggcaccgcggcgggattgcggtccggacgcgagggaagaagactccgccgccatgagcgtgcgcgtcgagaagaacggcctcgtcaccaccgtcatcctggaccgcccggaggtgcgcaacgccgtggatggcgccaccgcccaggcgctggcggaggccttccgcgccttcgacgcggacccggatgcgcgggtgggcgtgctccatggagaagggggtaccttctgcgccggggcggacctgaaggccgtctccgagggccggatgccccgcctggagctggacggggatggacccatgggcccctcgcgcatggtgctgtccaagcccgtcatcgcgtccatcggcggccatgccgtggcgggcggcttggagctggcgttgtggtgcgacttgcgcgtggccgaggaggacgccgtcctgggcgtcttctgccgccgctggggtgtgcccctcatcgacggggggacggtgcggctgccccggctcattggcctttcgcgcgcgctggacctcatcctcacgggccggcctgtgtccgcccaggaggcgctggccatggggctggtcaaccgtgtggtgccccgggggcaggcgcgcgaggccgcggaggctctggcgcgcgaggtggccgccttcccgcaggcgtgcatgaacgcggaccggcgctccgcctacacccaggcggggctgggcaccgaggaggcactgcgtcaggagttcgcccgcggtgtcaaggtactggagtcggagtccattgctggcgccacgcgttttgcccaaggggcggggcgtcacgggaagttcgaataggcgggtcctgctgcgggcagggagggactgtgttagttcccccggcatgcgcttcgacacgcttgccatccacgccggtcaggagccggatcccaccaccggcgccatcatgacgcccgtctacctgacgtccacctacgtccaggacggccccggagagcacaagggctacgagtacagccggacgcagaaccccacccgcaaggcgctccaggactgtctggccgcgctcgagggggcgaagtacggcgcggccttcgcctccggcctggcgggtacggacatgctgatgcacatgctggactcgggcgaccacgtggtcgtctcggacgatgtgtacggcggcaccttccgcctcttcgacaaggtgttccggcg

SEQ ID NO: 811 - DNA, 6203 bp, Myxococcus xanthus
gctctaagagtgggcgctccccaaaaggcctcgtccagatggaaggcccccgagcggacgagccgcgatagaaagggcatgcgccccgcgacgagcgcttcatccagcaggctcttggggacgccatccaggtggacgaggagcagcttcctcgccctgcgtcccggcgcgggtggcaccttctcccggacccggcgcacgaggctgtgagcccatagatgcatcgctggtggaagcacagcgctcacgggtgtcgcctcccctcctccggcagccaagatgagcacttgagagaacagccgccccggggtgtgagccgccttccaggagagcgggcgggcagccgccgacgtttcctgggagaggccgcccctggacaagaacggaagcaagcgggcgggcgccgtgagcccccccctactgtcgcgtaaacctacacgcggcagccacccggccatggttgtgactggacgtgtggcgcagcgccgcatcccccgcgtcaggagcacgaagcacgcggatcatctggctcagcgcagcttcacgtactcacccaggtcgccaaaaccgatgaggtcggctcggtcatcgttgttgatgtccacggcgaagcgagggtgcctgttcacgcgccagtctccgacaccgtagacaaaatccggcgacatgagcgtggacgcagagaagctggagcccgtcgacagggcggcgcgggtctctttctctccaaacccaacaatgtcggccttgccatcaccatcgacgtccgcgacggtgcgcacatggcgatccacacgccatccctggtcccaggtgaactcagaagtccattgctgggtgggattgaagccagtgcccgtgttgttggccagcgcgacgtatacgccactcttggagaagccaacgatgtccgccctgccatcgccgttgacgtccgcgacggcgcgcacggtatagggcacaaaccactgctggtttacgccaaaatctcccaaccagagcctcgaagcaccgaacgaagagcccgtggaaagagaaacatatacacccgcatcaccaaacccaacgacatctgccttaccatcaccattgacatccgcgacggtgcgcacatggctctccactcgccattgaccgacattgtagccaaaatcccccacccagaactggggcgaaccaaagccgaagccattcgacagcgcgacgtgtacgccagcgtcatggaagccaatgagatccgccttgccatcgccattgacgtccgcgacggtacgtgggtgccggtccacgcgccagttctgagcatagccgaaagcttgaagatggagcagcgagggagcgaagtaaccggcatctaaagatgggggcacgtacacggtccgggagacaaacacgcccgcatagccgaagccgacgatgtcagggagtccatccccagtgacatcccccatgacacgctcgtggtagcccacctcccaccccccagcgctttggtcagctccaaactggcgcccccacatcgagtcaccgtagagcagggtggcacccttgatatcatactgactcaaccgaccgccccgacgccagcgactgtcgccacattcatacatgaccgaatcggaatctacttcttccccgaacaccgtgtcggcgtcgtcagcccccctcccccgacaactggacgaactgattctcgcctcctcattagcgaagccgagcgcatgaccgaattcgtgaaccgccatggcacgaatgcagcgctctcgcgtgtcctgacagttctgcatccaatgctggaaagtgaggttgagcaccatggcatcagagagcgcctcattgttccaccccaagccatacgtaaaggagccatcggaggtatcttcgatgaggatgcggatgctccccggattccagagacacgccccccagccagtgaagtcgagcggcgtgatcaggccccaggtgccctcgaccgcgctccgcacccattctcgttcgacatcgccagcggccgatgggttctcccagcagacggagatggttcgagaatcccaaatgtacgccgaggcggcgtaaagccctgccgagtcagcatcgacggtcgcctcttgttcgaatgatgtcagcgcatcgtcggatccaccacaacccgtgatgagaaggccacccacgaacatcaggatgagaggcagagcatggaaggtcagggttcgccgcacgaggctctcacttgtctggacggggaccgtccggctccggaatgggttatcaacggcggaaacaatggatagacgggcagatgaccgggaccatgatcctgctcatgagcccccggaatcgacattgaagcgcgaaggagggacacacacctgctgcccaacccctaacggatgatatacgacacccttccagcacaggcgctgtcccgagcacagccaacgcgaatccggtacgtacccgcgaccttcgccgtgtaccggatgtaggagaggctgtcataggcatcgtcgttgttcgcgaccccggtatacgtattggtgctggtctcgtatcgatccaggcgcaagtacgtgtcccccctggctgtggcgtacatcaccatggcggtccccacatagagggtctctcccgccgacaacgtgacattctgggcgacagtgttacgcgtcgcattgttggtgccgctggtcgcgaaatcaaacgtcaccggtgtcgctggtccttgaccaggacacagccgcgtgttggtcgccacagcgcaatacgcatcgatggcgggccgcacgtagttgatggcttcagcgctgcaaatggcatccgtgcaactaccgatggacgtgatgacattgacgacatagcattcgcccgccggtccgatgcgcttgacgtagtccttgttgccacgcacgaggataccagccagcaaatagctgccgtcgattttcgcatagacgcccgaccctgagttgcctccgaaggtatccgtgtcgccgacgaaaaagtccaacgtggaagcacgcgaggcaagcaccttgccccccgaatcaatcttgaaggggatgccgctacccgagccgatcacagccaactgggtcgtcgtcgacagcgccacgctgtccatgcgaacaggcgctggaacagcgcgcaatgcactgacagggcggtccaactggacgatggcatagtccaactgacggccacccaccgtggatgcgttgcgcacgacgacgcgactgcacctgaagacgtcttccgacgtcaccggttccagggtggtcgctcccgttcggtaatatttgaagacgaagcgcgtggatgcacacgacagcggccccttcacacagtggcccgcggtgagcaccaggtcgttatcaatgagcgtgcccgaacaaaaagcagccgtcgggtcattcaagaacctctggtcggaacaaaggccctgggcttcctgtagcgtctgcgagaagaagccgatactcgaggggttgctcgtgtcgaggtccgcgacgtccaccaacgccacggtcgattcccgggtgaacttcttcagagtcgcatcggagtgcgcgtaatagtccttgcggtcatcaacaccgtaaaccacgccctgtcgcagcgtgtccgtgggggcggacgtgtcgcctccctttgtcacggggccggagtcctgcacgcacgctactgaaagggaacagagcagcacgccgaaaagcttccgtcgcacgtgagtgagaatgacctgcatggagggcggcccctgctggagttgagaacctggaatgtcgagcagcaaacatttccggaattaccagcattcactgagagtccgcaagcaactttgaacgaatttcagcctgaacctggacctcaattcgagttgcagcacgcggacttccactactaccaaagaaaacaacttgatacacggagctcccaagcccccgtatgccatcagcgcccgttcagcgaaatgtgcgcggcgccagaagtcggcacggaaatatgcgcgtagagtcattgcatctggctatcaaccgcgccagcaatgacggttggcagtcatcgaagagcgcggatttctggccatgaccggccagacgttccgaatgagcgcaattgcggcctgcctgccctgaagggcaggaaactgtcatctacagacaacagcgcaacatgcccaaaggggttgagaacgcatcaggtatatctgagcgccccgtggctgagtacgctccccgcgtccggccatggcccgtccccgccgcaaggagccccacatggcccacaagtcccagccggactactccagtcatgcccttgatggattgaaacaagctttgcgcgagcgcctgaagaccaaccaactcgcgcacagagagttgctgtgggaatcaacccacggcagggaggcaccgctcgagaacgagcgggacgtcgaggcctggttcctgggcccccgcgcggagaacgcggacatcttcgagcaactggtgctggaggccctgagagaccactccttctggcgccggaacttccacccgatggacccaccggccatcacccagagcatcaagagagacccgggctacctccgggcgctcgacacactgcacaccgagttcgacaacctcctggccgagctgaagaagtccgcgccgttcttcagcatgcgctaccaggtccacatgacgtgggagcagacgctcccgggcatgaccggctacttcgcggccatgctctacaatcagatcaacgtcgcgctgaaggcctcaccgctatcgacggtcctggaggtccgtgctggcgaggacctgtgccggatggtgggctacacccagcagaacggcatccggccctggagccatctgaccagcggtggcaccaccgccaacatcgaggcgatgtgggccgcgcgaaacttgaagttctatcccctgtccctgcgcgaggcccttcagcgggagtccacgctttccgccgcgaaggccctcaaggtaacgctgccctcgggaacccaggcacgtctggttgacctggatgcgtggcaagcgttgaacctggatgtggacgaggtgctgggcctccccacccgcatccatgaggagttcaaaatcccgccggagaccctgacggcgaacgtgagcaactacatgctccaggatttagggctcgtggagttcacccgccgctacctgggagacctcccggcgcccgtgttcatggtcccaggctcgaagcactactcgctgcccaaggcggcggcgattctgggcatcggcgcggaccacatgttcagcattcctctggatgaagaggggcgcatggacgtgtcggccctggaggcgcggctggaccaatgcatgaaggacaagcagcccgtcatcgcggtgacggccgtgatggggacgacggaggaagggttggtggacccgctcgcgtccgtgctggcgcttcgccggcagaagtaccatccgcaggggatgtcgttctgcgtgcacgccgacgcggcctggggcgggtacttcgcctcactcctccgcgcgccgccgagttcaaacaagcgcctcgcggggcctcccgcccccgtgctgtcactgagccgctatgtcacggagcagttcgaggccctcccggaggcggacaccatcaccgtggatccgcacaagacgggctatctgccctaccccgccggtgcgctgtgctaccgcaatcagtccatgcgcagcttggtggccttcgaggcgccctacatcaacacagcggggagccaggaggacctcaccgtgggcaagtacggcatcgagggatccaagcccggtgccgcggcggcgggcgtgtacctcagtcatgccgtcgtgccacccgaccaacgtggctacgggaagatcctcggaagggcgctctacaactgcaagctcttccatgcccggctactgacgatgaacaccgtggcgagcgacttcgtcgtggtaccgggtccgcgattcaagctctccgattccctcaagcgcaagtacggcggagagaagcaggcgctggagttcctgcgtcagcaaatccagggcatgcgtcaggagcagctccttagcgcctcgagtgaggaggaactggagctgctgcgcgaaacgggcgcggacctcaacatcctcacctacgccttcaacttcaagaccgagcagggactcaacacgagcctggaggag

SEQ ID NO: 812 - DNA, 7698 bp, Myxococcus xanthus
cgcgcgatgacgacaccttcgtgctgaacgtcatccagtacgtgctgacgaagggggaggggagccggctgatccgctcgctggtgtacgagcagaagctggccgtgtcgctgatgctcgactggagctggcgcatcgacccgggcaccatcctcttctacctggccctgaagccggactccgacccgaagaaggtggaggccgcgctgtacgccgaactggagaagatcgcgcgagagggcatcaccgagcgcgagctgcagaaggcgcagaacaacctgcgctcggaccacctgcgcgagctggccacgaacagcggccgggcgcatgccctgggccactacgaggcgctgctcggtgactggcgccggttgctgacgctgccctccacctacacctccattaccaacgaccaggtcaaggccgtggccgcgaagtacttcgcgcccgagcaccgctccgtggtgacgctggttcccgcgcccaccgaagcctgagcccggtccgtacaaggaaaccttccgatatggcttctcgcaagagcccctcccgaaagtcccccgcacgtccggcgaagcgcgccggcggcaaggcccccgtcgctcgcaaggcttcgccgaagcgcggcgcgccccgcgccacgacgagcgccctcacgcttcccacgttgcacgaaagcaccacgtccagtggcctgaaggtcatcgccgccgagcgcgggcccctgcccatggtgtccgtgcggctggtgattcgcgcgggcagcgccaccgacccggatggcaagcacggcctggcggacttcaccgcccggttgctgcgccggggcacccgcctgctgaacgcgcaggccatcgacgaagcggtggagttcgtcggtgccagcctgggcgtgggtgtgagtgaagacacgctgtcggtggccctcaccacaccgtccgagcacttcgtacagatgctcgacatcctgggccagttggtgcgcgagcccacgttcccgcagtccgaagtggacgatgcgcgcgagcgcgagctggcgcagttcgccaatgacctggacgacccgtccatcatcgccgaccgcgccatggtccgcgcgctctggggcaaccacccctacggccacgacgtgggcggttcgtcgaagagcgtgaagaccttcacgcgcgatgacgtggtgcgcttccaccaggagcgcatgggccccaaggtgtccatgctcatcgtggtgggcgcggtggatccgcagcgtgtggctgccgcggcggaagacgccttcgctgattggacgggaggaccggatgcgcccgtggccattcccgcgccggagcgcattgccctgggtgggcgggtcatcatcgtggacaagccggaccagacgcagtcgcaggttcggctgggcggccccggcatgcgcatgggccacgaggactatttcccggccacggcgatgaacatcgccctgggcggtggattcacctcgcgcctgatgaacgagattcgcgtcaaccgcggcctcacgtacggcgtcagctcgtggttcgactcgatgaacgcggccggcgtcttcgcgctgtccaccttcacgaagacggagtccacgcgcgaaatcatcgacgtggcgctggcggagattggcggcgtccgggagaaggggctcaagccccgcgagctggcggatgcccaggcctacctcgccggcctgtacccgctgcggacggagacgaacgagtccattgccggaagcatcgccgaggcccgcctgcacgggctgggggatgactgggtggagcggttccgggaccggctgcgcgcggtgacgccgaagcaagtcgtggccgccgcgaagaaatactgcttcgcgcaggcgcccgccgtggtggtgctgggcaaggcggacgcggtgaagaagcagctcaagggcctgggtcccatcaccgtggtgccggcgtcggagtacgagtgacagacgtccgcatcctcttcgagggcggcggcgtgctcgtggtggacaagccgcccgggatgctcgtcattcccgggcgcgaaggcggcccctcgctgcgggagttgctggagacgcatcggcgccagaaaatcttcgtggtgcaccggttggatcgggacacctcgggggccctcgtgttcgctctggacgccgcggtgcaccgggccctgtcgggtgccttcgagacggggaaggtgtgcaagcgctacgtggcgctggtggaaggccgggtcgaagcgccgcaaatggtggatgcgcccctggtggcgggcaggaagggacgcatgcgcgtggctcggcctggggatacggacgccaaggcctcgcgcacccgcgtgcggcccgtggagaccttcgagcgtgcgtccctggtggaggccgagcctctcacggggcggacgcaccagattcgcgtgcacctgctgtccctggggcacccgctgctggtggaccatcagtacggccgcgaggccccgctgacggagaaggacctgggcggggaaggggactcggtggtgctgtcacgcacgccgcttcatgccgcgcgtgtggagtggcctgccctggcaggtgtcgaggcacgcgccgtggaggcgcccgtgcctgaggacatggcccgtgcccgtgagttgctgcgggcgtccgtcacttcactttgaagcccagggccggttcacggttcgaacctcatgcccaggtacatcgcgagcccgccgagctgactgtccagccagggcgtgtgcaccggcgcccaggcgcctcgcgcctccgccaacgcgctccagcggccgaagcggtgggccgcttgtagggagacgaagcccatgccggagaccctgctctctttcacttcgccttggaattcgctggagaggtagtggtggaaggggacgggaccggcgcctgcccggccgtggagcgagaacgcgccgcggcggaagagctccgcgcgaacggagagcagcaggggcaaggccagcacctgcgagcggaccgctccgagcgcctcgaccgggccaccgtacatggcggtgcgggctccgacttccagctccgccgcgatgcggtgcctccaccaaggcgtgaggaccgagacgcccacaccgcccgatggaccggtgttggcgctactcgcgatcacacctcccgcgagcaggaagaacgaactccgccaggtgtcgaccgcctcggatgggcgcgcggtggcggacgtggacagcacggtgacgccggcctcggtgtgtgatgcgtgcggctggtcccggtggcggacgcgcaccttcacccgcttggctccggaagctggaacgacgcgaacacgcagcacgtcctgggcattggctccgacgtcggccgagtggggcgcatcttccgtcggaatctcctgtgctggcggagcggagccgcttctcgcgggggccgtccgcgtcgccgcatcagacagaggctccgtcgtccgcagggcatcggaggtcggggccaccaccgctgacgtcggcatgtcctcatcgggaggagcgaccgccgcgccttgcgccaccacgtcgacgtcactggcgcgcaggggcgcttcgcccgccatcagtagccagcctccctccaccgagggcagggaaggcggcgtgagtgccgcggccagcggcgagtccggcggcgggtccagtggaacggctgcgtcggtgcgaagcgtccctcgcgtggccagcactcgcgcctgccggacgccaggagggacttcgacaggcacgcgagcctgtccccgggcgttcgcccgaacagggccgaagcgacgattcgcgacctctacctcgacgcgcgcgcccgccgccgtggcgacatcgagctccgtgagtcccaccagcggcagccgcaccaccgtcactgggggcggctcttccgcagagggcgcgtccgtccagaagaggagcacggccacctgtggataacgaacggagggaggccgccattggaagaggcggacagcaccacgctccacgcggctcgaatcgaaggtgcccgtggatgccgcggcgtggagggttcccgtgccggcggggacctggaccttcaacgtcaccggggcattggtgccgagcacgatgcgctcgggcgaccaggacacggtgacgtcaggtggggccgccaaccccgccaccggcatggcgaggaccatcaggaggggcagcgcgcgcagtgtcatcgtccgtgcccctcctgatgaatgtgcggccccggtcaatcctccgacgcggggggcggctcggcgccgtcagcgggcgccggctcggcgctgtcaccgacgggcaggggcttgtccgcgggtccggtcacctgccggttgggcgggttgaagaccggcttctccaccgggccgccaccacggccgtgcaccagcgtcttggtgtcggtgcggaaggtgatgtccaccttgtcgccgcgaacggccgacacgtaacccgtgccgaaggtgggatgctggatgacctgatccaccttgtacgtgtccttcgggctgtagcggggcgcgttggcgacatcctttccagcgagctgctcctcgaaggagatgatgaccttctccgccttggacgcgcttgagctgctgctggaggacgagcgcgcggtgcgggtggtgctggacgcggggcgatccgtcgcgccaggagccgcgcgatatgcgtgatctccgccacacgtgttgcaacgcacgcgagcaatcttcgttcccaccatcgccaggatggtgtgcgcgagggtgagcttgcagcgggtacagagtgcatccacctcgccgccgaccttatgagttgccatgttcgttcgtctgtttctctgcccggcaggggacgccgccgggcatgggagtaaaggggcgcggaacataacggcatcgcttccaagggaggaagtgtcttcgtcgcctgcctccccgggccttgtgccggccaccgggccgccataaagagtagccccgaacgcatgaccacgcagacccccagcaagccggcacgcgagcccgggcccttcacccaggccgtcacgcgctttggccagggcctcatcgacattgtcagcaccctgggcggcatcatcaccatggggctggacgtgttccgctggagcgtgcggcgccccttccggctggtcaacctcttcgcccaactggacttcgtgggtgtggggtccatcttcatcgtgtcgctcaccggcacgttcaccggcatggtcttcgcgctgcagacgtccaccgcctttcagctcttcgacgcggagagcctggtgggccccacggtggcactgacgctcacccgcgagctggcggccgtgttctccgcgctgatggtgaccatgcgggcaggttccgccatgtgcaccgagctgggcaccatgcgcgtcaccgagcaggtggacgcgctagagaccatggccgtcaacccggtgcagtacctgctggttccccgggtgctggccggcctcttcatggtgccggcgctcaccatgctcttcaacaccatgggcatgggcggggcctacgtggtagccgtcgggggcctgggcatctcccccggaaccttcctctcccggacgcagcagtggctggcgcccgaggacatcttccagggcctgctcaagggcgccgtgttcggcctgtcggtgtccctcatctgctgcttcaagggcttcaacgcctcgggcggcgccaagggcgtggggcaggccaccacggaggcgatggtggccagcgccctgtccatcttcatcctcgacttcatcctgggcatcctcttcttctgatgtcgcccccggcttccagcgctccggcgtccggcacgccgatgatccaggtggtcgacctgcacaagacgttcggcgaccacaaggtgctcaccggcatcaacctcaccgtgccggccggcagcacctgcgtcatcctgggcggatcaggctccggcaagacggtgctgatgaagcacatgattggcctgctcaagccggaccgcggccaggtcatcatcgacggggaggacatcgtccccatgggcgtcgagtcgctccagaaggtgcgcaacaagttcggcatggtgttccaggccgccgcgctgttcgactcgatgaccgtcttcgagaacgtagccttcccgctgcgggagcacacgaaggatccggaggacgtcatccgccagaaggtccgcgcgcggttggatctgatggggctcaagaaggacgtcgaggaccggttccccgcggacctgtccggcggcatgcgcaagcgggtggggctggcgcgggccatcgtcatggacccgaaggtggtgctctatgacgaaccgaccaccggcctggaccccatcaccacggactacgtggacgagatgatcctggccgcccagaaggaactgggcgtcaccagcgtggtcatcagccatgacatctcctccgccttcaacgtggcggaccagattgccttcctctccaagggcgtcatcgtggccagcggttcgccggagcagctccgcgaggcggatcaccccgcggtgaaggtgttcctggagacctggttcgggaagaactgaccggggctcggaggggcgggagggttaaaggccctaggaaaatgtggcactcaggatgcaaaacgttagagtcgcgccggccggtcgctctcggagtcacaacaggtgaagaagctcgtcacgccctttcgtgtgggcctgctggtcatcgcggcgggggcttttttcgtcaccttcgtcctgttcgctcgcaaaggtggtttgagcgacagcgaatccacgagggtgtgggcctatttccgggatgcgtccggcctcgccgtgcgtgggcgcgtgcagatcgccggtatcccggtgggcgaaatcgacgacatctcgctcgaggggacccgggcgaaggtctggttgaagattcgcaacgacgtggacctgcgcgaggacgccgtcgtcaccaagcgctcggaatcgttgctgggtgactacctgctggacctgaaccccggcacggagagcgccccccacctggggtcgggtgggcagatccgccgcgtcgtcgatacccagggcatggaggccgtcttcgagtcgctgtcgcagatcaccgccgacatccaggaggtgacgggggcgctgcgggaagtgcttggcggtgagcgtggtgcggggtcgctccagcgcatcgtggagaacctggtgcggctgtcggactccgtggattccacggtccggcgcaacgcggaccgcctggacaccatcgtcggcaacgtcgaggccatctccgcggacgtgcgcggcattacccagggcaaccaggcggaaatcacccgcatcatcgacaacatcgagttcatcacccgcgacgtgcgccaggtgctcggcagcgtgaagaacatcgtgggcacgggtgaaggcgacgtgaaggagaccgtcgccagcctcaaggagacgctcaagaagctggacggcacgctgggcaacctggaggagatcacccgcaaggtgagggacggggagggcgccgccggcgtgctgctggccgacgaggccgtgggccgcgagctccgcgagacggtgcaggacgtgtcgcgcttcacgtcccgcctgaccgacctccaggcggagattggcatccagagcacctacctggccgcgcagggaaattcgaagaacgtcttc

SEQ ID NO: 813 - DNA, 6439 bp, Myxococcus xanthus
ccgcgcacggccagctccgtgtacttggcctggaccacgcaggacaccttgatctccgacgtggagatcatctggatgttgatgccctcggcggacagcgcccggaacatccgcgccgccacacccgagtgattgcgcatgcccacacccacgatggacaccttcgcgatgtccccgtccgtctcgataccggacgcgccaatctcctcggcgaccttccgcaccacttcctgcgcggtaaggaagtccgccttgcccacggtgaaggtcacgtccgtgcgtccgtccttggacgggttctgcacgatgaggtccaccacgatgtgcttctcatcgagcggtccgaagatcttcgccgcggcgcccgcgacgtccggcacaccgcacaccgtgatcttcgcctcgttgcggtcatacgcgacgccgcggaccagcacatcctccatggaactgtcctcctcacacacgagggtgccggggtcatcggtgaaggacgacttcacccacagcggcactttgtacttcatggcgaactcgaccgagcggatctgcaacaccttggcgcccacgctggccagctccagcatctcctcgtaggtgatgcggtccagcttgcgcgcggacggaaccatgttggggtcggaggtgtagacgccgtccacgtccgtgtagatttcacaggcgtccgcgttcagcgcggcggccagggccacggcggtggtgtcggatccgccacggcccagcgtggtgacgctgccggactcgtccacgccctggaagcccgccaccacgacgatgtggccccgggccagcgcggcgcggatgggctgcgcgtcgatgctcttgattcgcgctttggcgaaggtgctgtcggtgacgatgcgcacctgttggccgaggaagctggtcgccttcccctgctgggcgtggatggccatggccagcaggccgatggagacctgctcaccggtggcgacgaccacgtcctgctcgcgctcgtccggccggtcggtgatttgcgccaccagtttcatcagccggttcgtctcgccggacatggcggacacgacgacgaccacgtcatgccccgcctcctgggcggccaggcagcgcagcgccacgctcttgatgcgggccacgtcacctacagaggtaccgccgtacttctggacgatgagtgccacggcgcctgcaacctccctcttcagacgggcgggagctatacgagcccggccggcgggtgtaaagcgcccgccagcaccaccgcacccgtttacgttagggtgcccgccctttcgtcgcacccattggagtcccgaatgtcgcgcccccgtatcctcatcgacggtgacaccctgaagctcgaggaaatcctccaggtggctcgcaacgaggccaccgtggagctgtcgcccgacgccgccacccgcgtgcgggcctcgcgcgccctggtggaccgcgtcgccgccggagacacgcccgcctacggcatcaacaccggctttggcacgttggccgaggtccgcatcgacaagaaggacctgcgcgacctccagcgcaacctcatcctctcccacgcgtgtggcgtcggcacgcccctcccccttccggaagcgcgggcgctcctgctgctccgctgcaacgtgctcgccaagggctactccggcatccgcatggagacgctggccctggcgctggacatgctgaaccgggacgtcgtgcccgtggtccccgagcggggcagcgtgggcgcctccggggatctcgccccgctggcgcacctggcgctcgtcttcatcggcgaaggtgaagccttctatcagggccagcggatgcccgcgaagcaggcgctggagcgcgccggcctgcaaccggtggtgttggaggccaaggagggcctcgccctggtgaacggcacacaggccatgtgcgcggtgggcaccctgctccagcttcgcgcggagtccctggcggacatcgccgacgtcgcgggcgccatgacgctggaggggctgctgggaagccacaagcccttcattcctgagattcacgacgtccgcgcgcacccgggccagaaggacgtcgcggcgcacctgcggcgcatcctggtggacagcgagctggtggagtcgcacgtcaactgcagcaaggtgcaggacccctactccctgcgctgcatgccgcaggtgcacggcgcggcgcgcgagggcatcgcgttctcccggcgcatcctggaggtggaggtcaacagcgcgacggacaacccgctcgtgttcgcggacacggagcgcatcgtgtcgggcggcaacttccacggccagcccatctccctggccatggacgtggtggcgatggcgctgacgcaactgtcgtccatcagcgagcggcgcgtggagcagctcgtgaacccgtcgctgtccaacctgccggcgttcctggcgaagaactccgggttgaactccggcttcatgatcgcgcaggtgaccagcgccgcgctggtggccgagtcccgcgtgctgagccaccccgcgtccgtggattcgattccgtcatccgcgggccgagaggaccacgtgtccatgggcatgacggcggcgctcaagggccgtcaggtcagcgacttcgcccgttcgtgcctcgcgattgaaatcctggtggcggcgcaggccctggacttccgcctgccgctgaagcccggcaagggcgccctcgcggcgtacgagctggtgcgctcgaaggtcccccacatggacaaggaccgcgagctgcaccgggacatcgaggcggtgagccagctcgtcgactctggcgagctgctcgcggcggtgcgctccgccacggcctgacgcagcacaagcgacatcgacttctcctacgatgacgaagggcccggagccgagaggttactcttggcactccgggcctttttcatttcatgcgcacgctgatgcacctccgaacgacactgctggagaacactcggcatcggagcggtagcacaccaatgcgcaccagcggttgcaatcaaacgctcagaaacacattggcaacaccctattcaatgccaacacccctgaatccatagattgccattagaacgattcgcctgacgggtcatcacgaagtgtggtgccacgcgaaatggggcacctccgcaaagcgaggcaacaagaccattcccgtttttctctgtgaaagaggacccctcctgcattaacgggcgatcttcctcattctgtgcggcgtttcagggaaaccgcacggacagaaccgtctcatcgtgctccgggacgattcgtgcgccctcaatcccatgctctcatctgtcgcggccaactcttattgagcgaggccctctaggagcaccaatgccggtaacaacaaatggtcacgatgttcattcagaactgaccgctgtcctcacccccatggagcaggaacgcaatcgccttgcagtcacaggacgatcactcacagaggaggagcagcggcgcctctcccagctgaatcgtctcgctccgctcatccgcaacgccctcgatgtgattaccgaggccgaaacgggcctacagccggcgccagttccggaggccgtagtcgccacacttcgcgacggtcgctacgatggcggcaacggcgaggtggcgcttgaattgcgtgtcgatggagcgggaagcggcgtcatcagcgccgacctgttccgtgtggacacagccggccgccagtacgtagcgtcgatgcgcaccgcgcccggcatgcgtgtgaatctgggcgatggccgctggcccatcgtggggcaagacgaggattctcggaagtcgacgggaacgctcactctcactcgacaaagcccgcagaccgatacgcttgtggggatactgcacttcgaagcccccctcaccggacttcccgtacgacgtgacttgtcgttcgtcgtggagcgcacttcggacagtctgcgccacgtgggcatcgagatggaaatcgaggatgatgtagaaccgcccaagccccgtacgttcggtgatcgggaaattacgatcgagacggcgctcgccgatgcaggcatcgaaacctacgtggctggtatggccagcaagattccctccaaccccaatggatgggacaacgcccaactgcacgcgctcatgaaggatgtcgcacaggcttcgcttctgcgacgcgcgtgggacttacatctgcttatactgtcgcgttcgacagaccagggattgctgggcatcatgttcgacacgacggacccacttccacgccagggagcagccgtcttcgcatccgagattcgtggcattcagggcatcgaccatgagcgaaagctcattcaaacaaccatccacgaactcgggcacgcactgaacctggcgcaccgctttgagcgcacagtaggccgttcagattccacctcgttcatgaactacgattggcgcttcaagggcggaagccggcgcgacgagttctggtcgaaattccgttataccttcgacgccgacgagcttgaattcctgcggcacggcccactggctccactcattcccggaggggaaccgttccattccatcaattactgggcagacggctccggcggctacgcgccgtacctgcccgaggtacccatcgccgacttcaagctcgtgttgaagcctccccaatcaggcccattgttcacgtttgcacagcccgtttttctcgaggtcgagctgacgaatcagaccggtcgccccctcgacatgccgtcctttctcctcgaccccaaagccggcttcctagagatcctaattcgtcgacacactggtcaatcgtcacgagggattgatggggcacgctcgttcatccccgtcgtccagcggtgctttgaccgaggtgttgcacatgccgatcgtgtccagcccggtggctcaatgacgaacaacctaaacctgacgtacggctctggcggattctcgtttgcggagcccggaacgtacgaggtgacggcggtgctcgccataatggatgagtcgaacaatcgcgaactcgtcgtgcgctcgcagcctctacgtatccgagtcgcaacgccgaaatccaacctggaggagaaagacgcactcgatctgctgcgggatgatgtcggcctttacctggccttgggtggttcgtcggcgctgcccaaagtagcggaccgcctagacgaagtggtcaatcggcgccgtgaaaaaatgggcacgtccgacccagtaaccgcaagcattatccgagccaaagccattgatgcacagcggccatacatccgcctaatcgacggaaagttcaagcggcaagccggaaatccgaacgaggcggcgaaactcctcaagagcctcgacgataaggcgttggaaaatttcgattcgacaaccatcactgggactcgacagctgctctcaaaaatacacaacaccgcaggctaattctctgactgggtgattctggtggggcgtacacgaagcgctcccaacccttcggcgcgataaccgccagcggattcggaaccgctggcggttggcccatttccataatgagtcagcggcctgagcaaggccgacacacaacaagccacgcgttaatcacctcccagcagaagttcaaagcacgattggctctttgagttggcggcgcaggtcctctgtggcaatcgcaggcgtcccctccggtgccatgagcgtctgtccgtcctcggcatagagcgccgggcgccggtacagcatccggagcgcgtgcaggtgcgggtacacctgtgacgcttcggggttgagatcgcgcaggtgcttgcgaagcagcggcgcgaacttcgggctcatggccgggaagatgtggtgctcctggtggtggctgaagttgtagtgcagccagtccatcaccggatgcgtcgccacgctggccgtgttcacgaaggggttgtccgactcctcgtgcgcggccagcagccaatggttggtggcgatgtagatcatcaaggtgatgttgccgatgaggagcggaaggatgagcgcatagagcgcccccatgggccccatccaccagcccaccgcgccccaccccaccatcacgagcaccgtgaggacgcgctcccgcgttcgatgcatgtgcacatgcttgaactgcggcagccggctgtggtgccagaggaaggcctgtccctgggcggtgaagaagaagctgaagctgacgaagctcagcaacgagcccgagcccggggacatcgcgtggaacaccttcgcgaaccactgggtccgccactcgctctgacgcggcaggatgtccggatctcgaaccaggacgttcgccgcgctgtggtgtgcctggacgtgccacgcccgccagttcccgggggtcaccaggaacgggctgaagcccacccagcccaggagactctccagcgccctgctgcggaacaccgcgt

SEQ ID NO: 814 - DNA, 7021 bp, Myxococcus xanthus
gacgacagtacaggcagggtgaatacgtcctgcagtagcagcagggattgttccccccgcttctcctgcgatgacgggcgctgccggtacactggcgtgcgccaggcagaccagcaaggctgcgtgctgggtggacaggccgcgctcctcgtcgtgggcctggccgctgtgggcggctacaggcgcaggcgttaggagcacacgcatgaggctggggctcaaagcggacaacctgctggagcgcgtggcggactggttcaacctggccccacagccagtagcccatgccttcttcgggatgatggcgtcgcggacgctgatggccggcgtgcggctgggcgtctatgaagccctgacggacgggcccatgtcggcggagacgctggcggcgcggctgaagctgtccgaggagggcactcgcacgctgctggaggccctcatcgcgtgcgaggccgtggagcgtcagcgcggtggacgctaccggctggcccctcgcgccaggcgatggttggacccacgctcgccccgctacgtgggcgccttcctggagttcaactacgcgcagtgggactggtggaccgggctggagggcgtggtgcgcactggccaggcggtggacatccacggcttcgcgcccgacgacgcacgctggcgggactacatccacgccatgcaccagatggcgcggctggcggcgccggaggtcgtggcggccatccccctgccccggggtgcgaagcaggtgttggacctgggcggcgcgcacggctggttcgccgccgagctgtgcctgcgcaaccggggactgaaggccacggtgttggatttggaaggcagcgcccgcgtgggccgggaaatcatcgcctcggcggggctgagccacctcgtcacccaccgcgaaggcgacatcctcaccgcggagctgggcggcccgtacgacggggtgatgctcttccaggtgatgcaccacctgacccccgcccagaacgtggccctgctgcgacgggtgcgcgcctcactggcgccccgagggacgctggcggtgctggagtatctgcgcgagaacgccgacacgcccaccagtgcggcgccgttgattggcttgcactacttcctcacctctggcgcggctgcctatacgcccgccgaggtggaaggcttcctggacgacgcgggcttccgcatcgagaacagccgccccatccggcacctgcccttgcagacgctcctggtggcccgactggactgagcgtccacccgaccgctgaactggcgtgcctgcccgcggaggcctgcccacccgggagacgcctgcgctaccctgcccgtccttttgacggctcccgtcacaccgttgcccatgcttccgcaaacaccacttcccgaggaccctccggacgtccctctcgctgtcgacctcgacgggacgctggtacgcacggacacgctgcacgagaacctgctcgtcctcttcaaacgcgcgccctggctgctgtttctggcgccgctgtgggtgctcaagggcaaggccttcttcaaggcggaagtggcccggcgcgccgccctggacgcagccagcctgccctaccacgaggagttcctgacatacctgcacgaggagaaggcccgaggacgccggctggtgctggccaccgcggcggaccggcgcatcgccgaagccgtggccgcgcacctgggtctcttctctgacgtcgtcgccagcgaagcgacggtgaacctgtccggcgagcgcaagctggcgaagctgaaggagctgctgggcaccttcgactatgcgggcaacgacgcggtggacctgcccttgtggcgtgaatgccgccgcatcgtcgtggtccacgcgccagccggagtgctgaaacaagcacaaggcctgggccgcgacgtccaccgcgtcttcgagcgcccagccacccgactccgcacctgggtgaaggcgctgcgcgtgcaccagtgggcgaagaacgcgctcgtgttcgtgccgctactggccgcccacaagggcaccgagccggacaagctgattcaggcactgctggcgtttacggccttcagcctgtgcgcctccagcgtgtacgtgctgaatgacctgctggacctggactccgaccggcgacacccgacgaagaagcagcgtccgttcgcggcgtgcacgctctcggtgagcactggcgtcatgctggcccccgtgctgctgctggctggcgccgcggtgtgcctgctgttgccgcccgccttctccgccctgctgggcacctactacgtgctgacgctggcctactcactgcggctgaagcaggtggtgatgttggacgtgctggtgctggccgggctgtacacggtgcgcatcttcggcggcgcgctcgcggtggacgtgcccacgtccagctggctgatgatgttcagcatgttcctcttcctctcgctcgcgctggtgaagcgactgagcgaggtccggcgcctgcggcagtccaatgagacgtccgcgcatggccgtggctacctggcccaggactacgagcagctcgccagcctgggcgcggtttcgggacaggtgtccgtgctggtgctggcgctctacatcacctccgatgaagtgacggcgctgtacggacacccagagcggctgtggctcatctgcccggtgatgctgtactgggtgggccgggtgtggctgctggctcaccgcgggctggtgaacgaggacccgctcgtcttcgccctgagggaccgggtgagctacgccgtggggctcgtgtgcgcgctggtgctatgggccgccacgtgagaggtctggcgcgatgaagccacgggagtcctgggggcgttatccccaagtcgagcagcagacgcacgccctggtgtggcgcacggatgcgctgccccggaaggacggtagcctgctgccccacgggctggggcgcagctacggcgactcatgcctcaacgcggggggcacgctgctgctcacctcggggctcgaccgcttcatcgccttcgacccggccaccggcgtggtccgctgcgaaacgggcgtgtcgctggacacgattctgcgcctggccgctccgcgcggctggttcctgccggtgacaccgggcaccaagttcgtgacggtgggcggcgccatcgccaacgacgtgcacgggaagaaccaccaccggggtggcaccttcggccgctacgtgcggcgcttcgaattgctgcgctcggacggcagccgtcgggtgtgcgcgccggatgagaatccggactggtacggcgcgacgattggcggcctgggcctcaccgggctcgtcacgtgggccgaggtgcagctcacgcccatcagcaacccgtacgtgctccaggagacggtgcccttcgggaacctggatgggttcctcgacgtcgcccgcgcgtcggagaaggactacgagttcaccatggcgtgggtggactgcctggcccggggcaagaagctgggacgggggctcctgtaccggggcaacttcgcgccgccacagttcgacgggctgccgttggccaggagccacctgtcgcacggcgtggggctggcggtgcccatggacatgccggccttctgcctcaaccgcctgtcggtgtccgccttcaactggctctactaccaccggcagaacggcaagccgaagcagcggctgacgcactacgacccgttcttctacccgctggacgccatctacgcgtggaaccgcatctatggccggcgcggcttcctccagttccaatgcgtggtgccctactccaccgcgcgggacgcgctgaaggaaatcctggagcgcagctcgcgcggcggactgcccagcttcctctccgtgctgaagacgttcggtgacattccctcgccggggtggctgtccttcccgcgcgagggcgtgacgctggccatggacttcgcaaaccgcggcgagaagacgtggaagctggtggaggacctggaccaactgacgcggcaggcgggcggcgcggtgtacccggcgaaggacgcgcggatgagcccggagaacttcgcggcgtactttccgcagcgggagcgcttcatgcagtacgtggacccgtcgttctcctcgtcgttctggcggcgggtgaatccggtgtccctgcccttttccctggccgcggagcgaggcgagacggcatccccgccgccgcggtccctgcttgccatccgctgaccttctttccgagattcgctccccatgaagaaagtgctcgtcctcggcgccaccagcgccattgcccaggcgacggtgcggctcctggccgcgcgcggggcctcgctgtacctcactggccgcaacgcggcgaacctcgacgcggtgacgaaggacgccgccacgcgtggcgcggcgaaggtcgcgtcgcaggtggtggacctgaacgacttcgacacccacgaggcgctggtggaggccgcgtacacggcgctggacgggctggacggcgtggtgctggcgcacggcgtgctgggtgaccaggcggaggcgcagcgctcgtgggcggcgacggaggcggtgctgcgcaccaacttcctgagcgcggtgtcgctgctcacagtgctggccaaccgcttcgaggcgcagaaggccggcacgctggtggtgatttcgtcggtggcgggtgaccgcggccggcagagcaactacgtgtacggcgcgtcgaagggcgcgctcaacgtcttcctccagggcctgcgcaaccggctggcgaaatccaatgtcgcggtggtgacagtgaagccgggcttcgtcgacacgccgatgacggcgcacctgccgaagaacaagctgttcgcctcaccggagaaggtggcgcgcggactgctgagcgccgcggactcgaggaagaacgaagtctacgtgcccggcatctgggcgctcatcatgctcatcatccggacgattccggagaccgtgttcaagcgcatgaagctctgagcaggcagggccgccctctggcgccgagacaaggcccgtcaggggagcgcctccgaagtaacgggggcgactggaaagcacctgggatattccggatagactgtcgggccagcccaccatgagcgccacggccccactgtcctcggtccccgagccccagcctgcagcgtccgaagcgagcgtgacaccttccgcgcccgaagcctggagtctcgcgcggcggctggccttccgcttcgccttcgcctacctgggcctctatttcttcccgttccccttggacctcatccccgtcctgggtgacttcatcacctcgttccaggaggggctctggaaggccgtggtgccctgggtcggcaagcacgtgctgcggctgtccacggacatcaccatgatgcccaacggcagcggcgacaccacgttcgactacgtgcaggtgctgatgttcttcgtcgtcgccgtggcggtgacgggcgtctggtccgtcatcgaccggcgccgcaccgagtacgtgaaggcccacgacgtgctgcatacgaatgtccggtacgtgctcgcgatgagcatgctgtcctacgggctggccaagctcttcaagtcccagttccccttccccagccctgagcggctggtgcagccactgggggacttctctcccatggggctgctgtggaacttcatgggctactcgaagggctacaatgtcttcacgggcggcgcggagttcctgggcggctgcctgctgctcttccggcgcacaacgacgctgggcgcgctcgtcgtcgcgggcgtcatggtcaacgtggtggcgctcaacttcttctacgacgtccccgtcaaactctattcgtcccacctgctgctgatgtcgctgttcctggtgctgcccgatgcccggcggctgctcgacgtgctggtgctcaaccgtgccacgcagcctcgcccgctccagccgccgttcccaccttcgcgatggctgagtggcgccgggctcgtgatgaaggtcctggtggtgggcggcatcgcctacggatttgggagctcgcggctggagttcatccgcaagtacggggactccgcgccgcgtcccccattctacggctactacacggtcgactccttcacccaagacgggcagcacctggatgccacgtccggagacgcccggcggtggaaggcggtggccgtcagccgcttcggccggatgaacatcaagcacctggacgacaccgtgaagtccttcggactggaggaagacgcaccgaagaagacgctcaccctcatcgacggccaggacgacaccgcgaagaagttcgtgctcgcctacacacgctcggacgcgaaccaactcgtcctccagggcacgctccaggaggccgccatcgaggtccgcctcacgcgggtggatgagtccaagttcctcttgctcaaccggggcttcaactggattcaggagtaccccttcaaccgatgactcagtccagcgcgggcacgtcgcggccctcgccgaagcccagggcccagaagcgcggccggacgggctcgcgcgccagcagccacagcaggtggtacttcgcctcgtcctggccatccagcgcgagcgcgaaggtgccgtagtgcatggccaccgacgtggccgagcgcagcaccttgtgcgcctggagggcttccaccggccccatgtggaccggacggaaggcggtgggccggtaggcgccaatgggcagcaccgacagccgcatgggaccgaagcgctcggccatcatcgcgaagtggggaccgaagcccgtgtcgcccgcgaagaagaccggcccgccggatgtggcgaggacgtagcccgcccagagcgtcgccgcgctgtcggtgagcccgcggttggagcggtgctgcgccggcaccgccgtcaccgtgcggcccggcgccacctccgtggacttccaccagtccagctccaccacgtgccggaagccctcgccgtccagcagcgccttgttgcccaggcccacgatgaagcgcggatggtgcgcctcctccaggcgccgcag

SEQ ID NO: 815 - DNA, 9053 bp, Myxococcus xanthus
gggaatgcccgtcagctcacgggggacggaggccagccccaggaagcgattcatcgtctcctgcgaatgccgggagagctgcgctggtgccccgtctccgtagacctctcccagccgcgccttgtaggcagacagcttctccgagaggggcaggtcctgcctcgcatcaatcacctggagcgcgtccaccagcgcgtggtgcttcagctccgaagcccagaggcgttgcgccgtctccttcccgaagaggcggttgcgcgcgtcccaaacggcggcacggcgctgcttcgagtccaaccctcgcaggtaggcgtcgttgtcctttacccacttctcgtagtccagacggtcgcgcagcagggtggccagcgcttcgtactggccgggaaaggctctgcggaggaatgtctggagttcttctctccaccggtccggtgagcgcgtctggaaataccgcatgagctgctccagcatccggagctggacggacggttcgtgcaggcgcgagccaaagcgctcgagcagcgagaggcgcagcacctccaactccaaggccagggactctgccgccggggctgctgcgttgacggcgccgggcatgggcggacggctcgccggggcccccacgagcgttggaccgctgcggccctgggagctcacggggccaggggcggggggcgcgccagcagtctgtcccacggggagaatccgccatcccaagagcagccccaggatggccgcactcgctcccagcacccggttggcttgcaatctcatgccgccaggtcctcggacgtgacgactccaatgccaatcaccctccagtcccttgagcggagctggaagcctcggatgtccgctgaagcgcagcggacgccgcggatgttattcgtgtaacgaaggtgatgggcgaattcacgagcgtttgtgttctgatttggattgttctccgggaagacaccatgaagtaggcgatgaccttgtttgccagcgtttcgctcggattcctcgtcagcgcgtgcggcggagcggagctggaggatgccgacggctcgacgctgaccacggcggcgcaggccatctgtgagggctacatccctggcgccatctgctctgtgggagttcgcaggtggcgtcgactggggcaattgccaggatgtggcgaacaccatctgcgagcgcacggcctacggcgcgtgctggaactggagctactgagcccgtcccggcctgacctcaaggcctcccacgtcgcaccaggggcagcccggcctgggcatacgtccgcttctcgcgcagacgtcctgcttcccagtgcaggacgtccagcccgtaccagccgaagtgctggccgtacatcagccggtacatgagctggcgcgggccgcggcgcgcggacacctcgtgctgacagcgccagcgcaacaccaccttgcccgcgggcgcatccaccaccatgtcctcggtaaggaatcggatgcgcccgaagtcaccgcgaaactgcgcggcgaaggcctcgcgcacctgcgcgaggccccggcacagctttccgtcgtacgtctcgtacatcgcgtccggcgtgaagtacgccatcaccgcatcgaggtcgtcgcggttgaaggcgtcggtgaatgcccgcaccacgtcctccagcgccctccggtcggcgtcgtcaccggccgggagggaaggggatgcgggccctgtgctcacggatccaccggcgtctgctggatgcgccagatctcctcggcgtactgcttgatggtccggtccgaggagaagatgccgccgcgcgccacgttgatgatgcacttgcgcgcccagccgtcctcgtccttgtaggcgtgcgcgacgtcctcttgcttcgccatgtacgacgggaagtccgccagcatgaggtagcggtcctcctcgaggaggctgtccaccagcggcttgaaaaggtgcttgtcctccggcgagaagaagccggtggaaatcaggtccagcgcctcgcgcagctcctggtgctggttgtactcgtcgcgcgggcggtagccctcgcgcttgcgagcaatcacctcgtccgccgtgaggccgaagaggaagaagttctcgtcgcccaccgcgtcgcgaatctccacgttggcgccgtccagcgtgcccagcgtcagcgcgccgttgagcatcagcttcatgttgccggtgccggacgcctccatgcccgcggtggagatctgctcggacacgtccgcggcggggatgatgcgctcggccaggctcacccggtagttgggggcgaacacgacctgcaggcccgtggtgcccgcgtcgctgttcaccacctcggcgatgccgttgatgagccggatggtcagtttcgccaggtggtagcccggcgccgccttggcgccgaagatgaacgcccgcgggtggatgatggtggacggatccctgcgcgccttcatccacagcgccacgatgtgcagcgcgttgaggagctggcgcttgtactcgtgcaggcgcttgatctgcacgtcgaagatggcgtccggattgagctgcacccagcgcaagtcacggatgtgccgggccaggtcttccttgttggcgcgcttcacctcacggaaggccttgctggaacttcgggttctccgcgtgcgcctccagcttcgtcagcttgtccaggtccgtgacccagccctcgccgatgcgggacgtaatcagcttggacaggcgggggttgcaccatgccagccagcggcgcggcgtcacgccgttcgtcttgttgttgaaccgctccgggttcatggacgcgaagtccgtcagcacgtcccggcgcagcaggtcggtgtgcagcgcggccacgccgttgacgctgtggctgccgacgacggcgaggtgggccatgcgaatcttcttctcggccccttcctccaccaggctcatccgctgcatcttctcctggtcgtacgggtagcgaatctgcacctgccgcaggaagcgcgagttgatttcgtagatgatttccaggtggcggggcagcagccgctcgaagagcgtcgccggccacttctccatcgcctcggccagcagcgtgtggttggtgtagccgaacgtctcctgggtaatcgtccacgcctcgtcccagagcaggcgcttctcgtccaccagcacgcgcatcagctccgccacgccaatggccgggtgcgtgtcgttgagctggatggctgccttgcgggagaagtccttgaagtccgtgtggttcttcagatagcgccggacgatgtccgcgatggagcacgcgacgaagaagtactgctgcttgagccgcagctccttgccggcctggaacgcgtcgttggggtagaggaccttggagatgacctccgagtcgttcttctccaccaccgagcgctcgtagtcgcccgcgttgaacagcagcaggtcgaactcctcggaggcgcgcgcctgccacagccgcagcgtgttgacggtgttgttgtggtagccggcgatgggcgtgtcatacggaacgcccaccaccgtcttgccgcccacccagcgcgccacgggacggccatccgggccctggtggtgctccacgcgcccgaagaagcgcaccggcaccgccttctccggccggacgatttcccacgggttgccgaacttgagccactcgtcggcgcgctccacctggtacccgtcgacgatgtcctgcgtgaagatgccgaactcgtagcggatgccgtaccccatgccggggtaggccagtgtggccagcgactccatgaaacacgcggccaggcggcccaggccgccgttgcccaggcccgcgtccggctccatctccagcaggttggtgaggtcaactcccacctcctgcatcgactcggaggccgcttcgtacatccccaggttcagcaggttgttgcccagggcccgacccagcaggtactcggcggacaggtaataggcgcgcttgacgtccttttcgtaatacgtgcgcgacgtcttcacccaccggtctgccagcctgtcacgcaccgcgagcgacagcgccatgaagcggtcatggggggtggacgactcgtagttctttccgcgcgaatagcggacgtggtcgaggaaggaacggcgcaagctggccgcgtcgtgcccgagcccgctgtcgtcagtcgtggccggctgggcggggcggggcggctgggaggcggaggcaggaggggccatggcgctgggtatctctggacggagttgctgcgggttcatggtttcgcgggcaccggggtttcccgggttcgcgaaggtgcatcaggctagcgcagccgtgtctcgcatcgcaccggtaaagcgcgtcccggcccttggggacagctcacctggaagggcggcggactgcctgccggtggatggcgcgccaacccggagacggattgatgtagagatccatccgccatgggctttccgcagaacgacctcgaacaacggttggccgtcatccgtcccgacgacacggtgcgcgggctcgtcttcaactcggtgttcaacctgacagagaagaagctgggtgtggaggcggccactcgcctgcgtgagcccttcttcaagcgctccccggtggacttcttctcctacccggccattgatgccctgcgcctcttgtacgcgacgtcggaagcgctcacgcccgtctacggctccatggaggacgcggtgcgggcctgcggggccgcggccgtcacgcacttcttccagtccacggtggggcagacgctcaaccggctcatcggcaagggcgaccccaagcggctcctctcccacgcacccaccgcgtactcgacgctggtgagctacggccggcgcgaattcgccgtgctgggagacaagcaggtgcgcctggccttccacggggacatgcagccggtgcagtaccacgagggcgtcttgaaggaggccctgagcgtcgtcggctgcaagagccgggtggtgggcacgcctcgcggcgtgacgggcgctgactacgtcatcacctgggagtagacccgcggcgcgcgtcccacggaggggccgcgcaccgcgtcacagcgtcacggcatcgctgcggcctgcccggcgacggcggccacggacaccgcctccatctgccccgtcagctcctgcgccttggcgaggaagtccggcagcagctccttgggcagtgggtccgcgcgggggaactgctggttgagcgggttggtgtactggccgttgcgcttgagcccgaagtgcaggtgcggcccggtggagcggcctgtgttgccggagtaggcgatgacctgcttctgccgcacgcgggcgcccgcgcggacgccttcgccgaagcgcgacaggtgcatgtactgcgtctcgaagccgttggcgtggcggatgaccaccatgttgccggcggcgcccgcgtagcccgcctgcgtcaccgtgccgtcggccaccgcccacacgggggtgccgatgggggtgccgtagtccacgccattgtgggccttgaggtacttgagcaccgggtggaagcgcgagccgaagcggctggtgacgttggcgtacttcaggggcgtcttgaggaaggtcttcttcgcgctggcgccctcctcgttgaagtagttgggctgcccgtccgggagcacgtagcggtacaccttcttattgcccacgaggccgcccgcgtacgtcgccgccagcacgtcgccgtagcgcagcaggcggcccttggagacgaacttctccaccagcgcgcgcgccgtgtcgcccttgcgcacgtcacggtagaagtcgatgtcccaggcgaacacgtccgccagcaccatgccgatggccgggtcctcgccggcggccaccgccgcctcgtacagcgacgactggatttccagcgccaccacggcgacctgcttctccacctcgatggcgcgcttgctgcccacgtacttctcgccgtcgcggcggacctgccactcgtccaccatgctctggcggtagtcgaagaagtccagctccccgtcgcggatgacgagccgcaactggtcgcccacgcgcgacttgcggaagtcgaacacgccctccagcgcggagatgacggcggccacctgcgcgtccgggagttgcgcgtcgtgcagcgcctgcgcgagcgtctggcgcggctcgatacggcggttcttgatgacgtgacggaccgcggcttcggacgtcgaagccagcagcgcggcggccaggcagagcaggggagcgattctcatggggcggcggccgagtgtagtggacaccctggcgctcgcccagcgaagggccgggaaatttccgggctcggctgcctggctgcttgaagccaccgaggagcgcctggcccggcctcccttcgcccccagcgggagacgctgcccacccggtgtcctcagggcctccggcgcatcgacgaggcccgtgtccgcggacccgcgctacttcgaacaggcgatgccgtcggtgaatctttggcgcaccgcccggggcgggcacggctgctcagagttccaccttccgctcggagtggctctgcccgtcgaagcggagaatgacgcccttgttgtcgtaccgcgtgaggatgttgacgggccggcgccacagggactggaggttgcgcagcgtctcgcgggcgtagtcgcccttgaggtcctgtccgtcgtggcggtgcgccagcagcagttcgctgcggttctcgaagttgccgtccaccacctcgatgatgggctggccgaagttggtgagtccctggaggagcttgttcttcaccttcttgaactcgcggtcgaggatctcccacgagttgcgcttgtcgttgaagccgtacacgaagagcttctgctccatcgcgaactcgggcgtcaggaacgtgtcgatgaaggtgatgtcgttgtagtgcttgcggacctcgaagatcttctcgcggccggcgcccagcttcttgtcccaggcgcggcgcgcgcgcaaatcatcgcactcgtcccactccttgccgaagcggcccttgttccaccgctcctcgatgtcgcgccacagctcgatgccgagcttgtacgggttgatggcgccagggcgggtccccatggtgccggagtggtggtccgcgtagtcgatgatttcgtcgtccttgagggcccggcgcgtcatgatggtggagtgccagtagctggcccacccctcgttcatgatcttcgtctggccctggggcgcgaagtagtaggcctcgtcgcgcagaatcgcgaggatgtccgcctcccacggttccagcggcgcctcttccagcaggaagagcagcacgtcgcgctgcgggcgctcggggaacttcttggcgcgctgcttctcgtcctccaccttcttgcgctgtgagtcgaggaactcggacgggttgatgtagccgcgcatgtattcgcggtccaccttgaagccctccacgcgctcgttggccttgagctcgtcctcggccttcttcgggtccgggttgcgccggatgtgcggcgcgtgctggtcgatgaggttctccaggctcagcgtccggtcgatgaagtcctcgaccttctccacgccaatcttgtccacccagcgcctcacccgcgtggcgtggttggccatctcatcaatcatccggcggttggtgtgccggaaggagaagttgttcttgaagaagtcgcagtgaccgtagacgtgggccatgacgagcttctggtccacctctgggttgctctccatcaagtaggcgtagcaagggtcgttgttgatgacgagctcgtagattttactcagcccgtactcgtagcccttggcgagctgctcgtactccatgccccagcgccagtggggatagcgggtgggaaagccgccgtaggcggccaccatgttcatctcgtcgtaggacaccatctcaaagtgggtgtcgaagaaatccaggccgaactccttggcgtagccatggatttcgtcgcggagcgaggcgaggcgaggggggaggctcttgggcatcgggcagtcgctccggtggggaaggaccgctgaagtcagcggcccttgccgaggaagtccttgatggacgcatagatggcgtccttgtccgcgatttcgctcagcgcgacgttgggcgtgtcccccaccgcctcgcgcaaatccttgatgaactggccgctgccgtagggcgactccacctggccgtaggcgaactggttgacgttgggcagcacgtcgttgcgcagcatttcaatgcactgccgcgtgtcgtccgcgctccagttgtccccgtcgctgaagtggaacgggtagatgttccacgcgctcttcgggtagtccgccaggatgatgtcccggctgagcttgtaggcgctggagatcatcgtcccgccggattcgcgggtgtggaagaacgtgtcgcggtccacctcgcgcgccaccgcgtcgtggatgatgtagcgcgcctccaggcccttgtattggtggcgcagccacgtatcgagccagaagctctcgatgcggacgatctccttctgctcgtcacccatggagccggacacgtccatcatgtagatgatgaccgcgttcgtttcgggcaggtcctggagcttgtagctgcggtagcggcggtcctcgcgcgtggggatgatgacgggccgcgccgggtcatacgtgccagcggcaatctgccgccgcagggcctgcttgaaggtccgcttgaagtgccgcagcgactccgggccggtggtgttgacgccggtgtagcggatcttctgggtgatgatgcgctcgttctgccgccgctcgatgttgggcagctgcagctcctcgcccagaatctgggcgagctcgtcgagcgtgacgtccacctccatggcgtggtcgccttcgccctggccggcctgcttgccctcgccgggctccaccgccccggggccgagctgttggccgacgtcgccgtcaccctgcccgacgcccccctgttccttgtgtccgtacttgaagcgggggatgtcgatgaaggggatggggatggagatggcgtccttcccttcttccca

SEQ ID NO: 816 - DNA, 7041 bp, Myxococcus xanthus
  unsure (1)..(7041): unsure at all n locations
acgcgccgacgggcccgctgccccgccaaccagatgatgcacgcattgggcctgccctcgctctgacgagtactgtataatatgacgcattcagtcgggtggctgcccgagtcgatgcgctggggcgacgcactgaaacggtgcacgatgcgctaggccggcaggtggcggtgcatcaccccatgggtgtttccacaagcaaggtttacgatggcgaaggaaatctcatccagtctgtggacggtcgcggaatcactagacggttcacctacgatgcattgggacggccgcgcaatgaagtgttggtggaaagtctgtcccagggaggacagtcacttgtcgtgggacagcgtgcgtacattgacgtcccggatgcagaagcgctgacacgtgaggaagtgttggatgcgcgtgggaacctcacgacgctctatcgggatgggcttggccgtgaggttcgtcgcatcgatgcgcttggttatgtgacaaaattcaggttcgacgcgctccataagcggcagactcaagatgctaaggggtacattgctcgcttctcatatgatggtgctgggcgagtccttggtcagtcggattatgcttcggccggcagttcgccgacatattcacagacatgggagtatgcggatgcggtccgcgagcagacgcacctgaacaggcgcggagttcctaccgtattgctccatgatggactggggcggaagacccgcagcgttcgtgggcaaggcgcagacgttgcggaggagtcctgggagtacaatgcttcgggacaccccattcgtttcgttgatgcgaatggccatgcggccgagcgactctatgatggtgctggacgtctcattgaagagctcttggccgctggctcactcgacgaggcaaagacgacgtttcagtatgacgctgccggtcagttgacgcagacgaaggggccccgagtcacaggaagcgtattcgatttccgctacacctatgatgatctgggccggcgtgtgcgtgaagagaacgcactgaatcaggtcacggcctgggcgtacgatgccgtaggaaacaaggtttgtgctaagcaaccactgggacagccttcgcttgcgcacggagcggcaagtggaatgtcactggcccagttggaggcgaatgcctgtggggggacgtacgtaacgagattcggatacgaggaggaaggtaggctcgtatccgttacggatgctgcgaatgggctctattcgtacgtctacgatgccgcccgtaacatggtggcgaagcaggatgcgaacgaaaatcttacgacgtatgagtacgacgtccggaatttgcgttcggctgagcaccagcatctcgatgctcactcgcggctgacttcggcacagcgggatagtgtcccactatttgaaagtggtgcgacgcccaccagcaacacgggcactttgacctggcgccatacgtatgatggcaacaggaacgaagcctcgcgtgtagatccgaaggggcagcgagttgagttcgcccatggtctccttgaccggttggcaagccgtacgtattcgcaacatgcgaccccgcgtgagttcccttctgttgattcggaggtccttacttatgatccgaatgggaatctgactggcgagtcacagtcgaagcagaccaccaatggtgtccgacaggaggttgttacctctacgttcgacgctctcgaccgactgaagacgcgcttgcgcgagtatgacgggaagcaagtgtcatacaggtacgacgcattggggagccgtacacgtgtcgaagactcagatgctgttgcgactacgtacatgtacgatgcgttgggtcgacttacacatgcgacactgcctgaaggcgtagtggagtatcgatactggcccgattcgctccttaagggtgtcacgtggcccaatgggatatccgaaggtcgctgctacgacgcggcaggacgcctctcgcagattgttgtcggcaagggaggcgtgaacgacttgtgccagagcatcgtggccatggtcagtcgccatgcgtattcgtatgatggtaatggaaatcgcttggtgcagatcgcggtgcgcacgagcccttcgactcaggaacttgggagcccggagtttaccgagtatggatatgatgttctgaaccgtctcaccggcgttaaggccccagatgggcaggcgtcgctctatcggtgggacgctgtggggaatagaacaggtgagcggcgtgcgccgagtcttgctgtctcggggctcggtcccgactcatacaatacggttctggcccacgaagttacgtacgacgttgtcggcattttcaatcgcgtggattggcttcggaatcttcgcgatctcaaggatgctacgaagcatgtttctctgggctacgatctggcgggaaacattacgcagaagacggtgcaggcttctacccgcgcctttgtctgggatgttcgtaatacgttgacggccgtttacgacaacggcgtggaggtgggtcgttacgactacgatgccaacctccagcggacgatgaggcacacggccgcagggaacgtggagtatgtcctcgacggtgctttcgtcttgcaagaggcggatggaagccaaatccatcgaccgacgcagcgccgttatcattatggtgaagggccgattgcggtcagtgaagccccctcggcaagcttgagttttctggggatggatgcgctagggagcgtgacagatgttctgaatgtaattggccaagtcactgctgctcgagagtatgacgcatgggggaattaccgcagtggctcggcgccaagcgtcagtgacttcaaactgggcttcacggggcatcagtatgacgtggagacaggcctcacgtacgcacgtgctcggtactacgattcggacctggggcgcttcatcagtcgggactcgtatgagggcaaatcggacgacgcgcccagcctgcatcggtacgcctatgcctatgccaatccgctgaggtactcggacccgacaggccattgcgtcaacttcttcgcgagcgacatggtgtcgtggggtaactgcgttgaatcaggccaggtgctcgccggttacggcgtgggtgtcgcgaaggtgttcgggggtgttggtgtactcacctacaacgccacgggagcgctcgtttatgcagcgacgggcgagtcgcagtatcaggcgcaggcggaggccttcagccaggggactgaggggttgctgcattccgtcagaagcccaggggcattcatccaaagcagttgggatggcctcacggggggcttggcgcagatgggcgacgcgattgatcgcggcgacctctacggcgctggtgaagggctgggcaacttcactgcgcaagcggcgttgctgcacgaagttggccggggcgcgtcggccaacatttcgcggctccccgcaacggccgcagcgggcgtctccgtaggacttggcaattcagggcgggtgcttgccgtgacggggccgacgcatccgacactgggcttggccgtctttgcgaacgcagcgaatggaaatggtaggtcgggggccagggaaaggacggtcactgaggcaagggacaagcctgggacggctgctgttgggaggccaaagaaggatgcgcccgggcctcgtagcgactccgttaagccgccgaagggggcagagggcaaggcgatcattcgcaagtatctaaaccataatgattcgcctcacttctcggtggaagtgcatccatcgattggtacgagaatcgagacacatcaaacgatgtctaggtcgggtcggtccacttgggtcaacgagattgacgatgtggcgcgggaccaattgcgaactcccgccgaagtacgagaggttagccttgcggatgccttcgctgcgcagcataagcagttggagcaactcggagccggtgatatggggcgatgggcccctacgggttcatctgccaacgcctgcacaacagcagtgtgcgatgtccttcgtgctgggggagtggatgtgcctgggccgactggagcacaggagtatttgtatggtatgtttggtattcctatgaagggggcgccaagatgatggagtgtgagcgtcacgggcttagttttattagtcgctgctgcgcccatgttgcggtggctgtggatgaaggattgcctctgggtgtgggtgtatttgtggacaggatgacagatgttcatcatctgtgtgctgcgtgcgtcgcgccggttgaaacatggctttctgagtatcgacgaggcgccccaccaacgcttgaaccggactactctagggatgccatgtgtggtgagtgcttgcgtgagtggtacagagctaacggcctaggcgacctcagtattgcagtgcaaaaggcacgcgaagaccgccttaaaatcgagcaagagcgtgatggctgacactgggcttcgtccgcttccctggacacctccgatgtggtggtgggacggagcgggagaagaagagggggcagcgacgtaacttcagccccgaattcaaggccggagcggtgaatctggtgctggaatagggtaagtccgtcgcggaggtggcgagggacttggacttggcggaggcggccttccgccgggggtatccgtccggcaaacgacgtggtgaggggcgttgagtgaggagccgccgccgtggaccctggcgtgcatgtcgaagccggtggatgttgctgagcacggtggttgatggaaaccgggcccgtttcgggtcggcagggtgatgggaagtggctaagggagtgcgagtcggccatcagcgagccggtttcttgcgtgtggctgtcggtgatgttcgctcgtcggctggcgggaggacggggcgcggcgtggtgccgctacggcagccgtagccagccgggtgcgagtagacggtgggagnaggcgnnacaccctcctgcccaccgatgccccgcgagaagactgtgacgagagcctcgtatccgtccggcaaacgacgtgctgagaggcgttgagtgagggggcggcgccgtggaccctggcgtgcatgtcgaagccggtggggaagcaggagtggttccggggcgtcgaagcgttccaggcgagtgggctgacgcagcaggagttctcgcggcagagcgggctgcggctgagcacgctgcagtcgtgagtgtaccggcgccgacgccagccggccaggaagccgtagccggtggaggtagctgtcgcgccgcagctgagtacgaagctgctcgaggtggtgctggccagcggagcgcgcctgcggttctccatggacaccgacgtcaactacgtggcgcggctcgttatcgcgctggggcggtgaggtggtgttctcgctgcctgcgtcggtgcgcgtggtgttggcgacggagccggtggacatgcgcaagtcgatagattgcctcatggcgatgctgctggacggcatcgacgtggccgaggtgaggagccagcccgcctggacgcctcccgggcgtacgggcacctgatgcgcccgggacgcagcgcggtggcgtgttgaggtggagtgccgcgggagctacctcaagaccgcttctgcccttggcgcgaggaggcggaggacctcaaggcgcgcctgacgtcactggaggcgaagatggcgacgctggagcgccacgtcttccgtcgcagggcagagaagttgccgacggtggccgacgagctgcgagaggacgggggcagatcggcagcgccaggagggcctccacttggagaatccggcggttggcagtcccaaacccattcgcgcgacaatggttctcttgctgcaaggccccgagcgccatgaacataccatcccatctcgtgagtaccacgagcctgatcagcagagcattcccggatggaataccagagaccggctacctgccgctcttggcagtgctgtacccgcatatggtcgatgagcagcttgtggaggtcgtgggtctattcacgggatgcgctcgtggcgtcgtcctgaatgacgtctatgcggcaggcccaggtcttggcctagctcccgattgagttgccgccgttcgtgcccggctcgcttctgctgggctaggtaaatagggcctggaggactgagcagttttgagttggcaggctgggacgctggctccttgagcctcaccgccttcctcgttgtttcccgtcagaacgccgtgccgttcacccgccgcccaggcgaagcctcaacaccggctgacagctgcgtatgcggcatccacgtcccggtggagctcccgtccgggctccggttgtaggagatgcccacctccgtgtcctgataccccgcgctgtcctgcacggtgttgtccggccgcaccaggagcacggtgtcgccgctgctgcccgtgttgacgccccggttgaagtacagcccgcctcccgaggccgccgtggcgttcgtcgcgcccgtgggcaccgccgtcggacccgagtacacgacgtacgacttgcccggctgaatcatcgtccccgccgggaatacgtgccgcgtgtcgtcttcgcccgcgtaggagctggcgtcgtgaatcttccagccacccaggtccaccgccgtggtgcctgtgttcaccagttcgacgaactgctggtcataatccggcatcgtggtgcccggtttgttgtgcgactgcggcaggtactcgttgatgaacaccttgtactgcgtcccgcccgtccccgttcccccgcctcccgcattgccgaagttgaagcggctgatgatggggtagtggtcggacgtgttgtcccggtagcccgtgatgctcggtcggatcacctgggtcgagttggggacgtagctggcccagagttcgttggtgacgagctgatggtcgatgaacgtgctgcggctcaccgtgctgccaatgcctgcctcggacagggcctgggtggtgaatctgtagttggctgagtcgctcacgaagttgcggtacggcgtgtcgtacttcaccccagtgctgggattggtcgcgatggacacatccacg

SEQ ID NO: 817 - DNA, 6368 bp, Myxococcus xanthus
ttgtctggctcgatgccgactaccaggaccaactgggccgcctgcagttcgaaggtcccgctccgattgtggcggaagtacgacgggcactttcgaatgcgccagggtaccgagaaagcaagatgaacgtcgatggcatggtcatgccactcgacttgcggacagcgatgggcagcaacgtcatgcggccgttccaaccggagctggtcgagggtgcgaacgtactcacaagcccgagtcctccgactctgacgacggaggaactcacggtcgaattcgcgagccgattcgcgacctgggtcgtcacgaacctaccaggccctgtcaaagtccagagctatgcgtgggagcacctcgtccgaggactccagggaacactgttcgagtggtccttctggcgccccaagtacccgtccgaggaaatggccgccagcgcccttgcggtccccctccgcgaggcgctggcccatgagacggcgcgtctcaagaacgtgtacgagaggcgccctatcgaccagcgcctcgttcccccctcgctgacgcccgaagaagcgcagcaagtagcgaacgtcttcgtcgaagcgctcgacaccgcggcacctggtgatgatggcgccgcgacgctcatcgttcggctccacgagcagctcctcgcgctcggactcatgagccggagagagacatgaccgccagcgcgcgagacatcctccaggccctcctccagaaaaaggctcgcgcgcgggaccttcagcttcacggtgcggacctcactggcgccccactcgacggactgcgtggagacggcttggacctgggcactgccagcctgcgtggcgccagcttgcgcggttcgcggttctccgcatgctcgttcgagcgcgcggttctcgaggaagccgtgctggaaagtgcgacgctccggcagtgccggctcgacggcgccgacctgcgacgggcgcgactctccgaggcccgcatcgaggacagctccgcgcgcggcacagacctatcccaagccgacctgcgcaagacccggctctcggagacatcgttctcacgggccatcctccgcgaagccgtgctcgacggcgcggaaggcgtcggcgtggagctacgaggcgcggacctcacgggcgcgtcactcgtggacgtgcggctggacgaggcggactttcgcggcgccgacctgacgggtgccaacgtgtcaggcgggagcttccgccacgcggacttccgaggcgccatcgtggacggcgtgcagtggaccgggtgcgaccgcaccggcgcccgcttcgatgcggaggacgccaccctgccgcgctcccagcccagcgatacgggcatcccgcccagcgctcccgagaacttcgatgccccagcgatggccacctggctcggaaacctgatggagcacgcgctgcgctccgcgccaggcagcgtgcacggcgcagccacacgaggcccggagacacccgccgaattgttacagctcctcggctcgctgcagcaggacctcggcgcccgtggcgttgaactcccggacctgaccgctcgcgtccaaccgctgctctccgccctggaacagcgtggcgatgaaccgcccgaggaatggaaggccttgctcgaagcgctcacccccacgggaaccgaggggcgtgacgcgagcgccgaagacatcgtccgcgcgctgctcgccaggcttcagccacctcgatagccatctcccaccgtcgcaacaggtctcaagcttttcacccaccgcgcgaggtgacttgactcaaggtggatgtttcgacaccatacccatactcaaaggcgattctcattcacctttagaacatacacgcggtgcacttggggggaccaacgtggccggcttttccgccatctattcggtaggcgattcgctggtctcatatctgagacacgcctacgagttgtctcacgagcccgaaggcctgcccacgtgccgtttcgagctcgtcccaagcggcaagatggctggaagcgagacaaacacccctccggtcgaagtcccaggcgtcaccctctttctctaccgcgtcgccgtcaacgaacacctccgcaatgagccacgcgcggaagcgcctccgccgctcgcgctggacctgcattacctgctcacggtctgggctgaaaacgtcgacgacgagcaccgcatcatggcctgggtcatgttgcagcttcacacgcacaacgcgttgagcgcctctgacctgtcccccgtgggcgtctggcggccggacgagctggtgcaaatcgtcccggcggaaattcctcaggaagacatcttgcggatgtgggacgccttgcgacgcccttatcgcccttccgtcacgtacgtcgcccgcgtcgtctgcatcgacgtgcagggcaaacccgctggacggcccgtcgtcgcgcggcgcttcgacttcacggacgaggtgcccaggcgatgattctcgagcgcaccgagagccgcgccctggccgccatccgcttcctcgacgcggagacgcaacgccccctcacggagcccatcaccgtcgcggggcatggcctccgcttcactcgcaacgtccgcgggctgcacgtggtgacggacgcgccgggcttctccgactacgcggcgagcttcgatttgccgaacccgcttcccgccgcagccgccttcaccctggtggcgagcgaccccacacgccactatcttgcccggagcttcacgctcgaattgccacgagacgcgacggctccgcccacgggccagccgctcccgccagattccgtcttccgcccagtcgacgtcacgctctacccgtcgccgctgatgcgcccgtccgcacgcagtgccgtggtgcggctccgtgtcgtggacgcccacgacacgcccctgcccggcgcgctggtgtcgctcgcgctggccgacccggaaatcacgcgctggggccagtcgaacgagcggggtgacgcgctcatcctcgtgcccggcattcccatcgcggactggggcaatcccgaagcccccgtccacttcaccttcagcctggccgctgcctgggcggcattgccgcagcctccggaccccgacgcactctcccaggacttccaccccttgagcagcaccctcgacgtcgccgccggcgaagaggtcaccaccaccatcaagctcgattgggtcgagctctgaacgcagaccaatgacggcgcgaccgcgcgccacgtaacgagaaagtgggggctcgcgtgcctgaatatctcgcacccggtgtctacgtcgaagagacgagtttccgagccaggtccatcgagggcgtcagcaccagcaccagcggcttcgcgggtccggcacgcaagggccctgtttccggccccccgtcgctggtgacgagcttccccgaattcgtccggctctttggcggcctcgcggacctggacctcaccggcacccaggagacgaccaactacctggcgcactcggtccgcgcctacttcaacgagggcggctcccgcctctacgtggctcgcgccttctcggggacgccggccaatgccaccgctggcgcggacgtcatccccaacgcggacgcgaacctgcgcgcacgcttcaccgcgaggttccccggccgtgcgggcaacgggagcatcagcgtccgggaagtgctcgcgcccgccacggtcggcgccatgcggcgcgcgcccacgggcagcctggtccggctgaatcagaccgccgcctcggccgcgcgcatcgtgggcaccctgcccccgcccttcaatgtccccgatggcaccacgctcacgctgacgttcgacgggaacaccgacgtcaccctcaccttctccgggcgaaatgccgaagccgcggcggcggcggagctcgacccttcgacgacattcctcgaagccaaccagacgctcaccgtcaccctgggcggacaggcgcagaccctcaccctgcccaccgatacgccgttgacgcccgcggaggtcgtggacactctcaaccggcagcttcggggtggttacgcccggctcagcggcgccgatgacgccgcgcccgtcggccgtctcctcctgggcaccgatgcccgcggtaccggggccatcatccaggtctcggccaacccgcagctcaagctcgctgcacagacggtcgacaacgcggcggacccgcagagcaacgtgagcgacctgggcgcggtgtccctcgcggacatccaggtactcctgggtgccaacgccacggcgtccgtcgatgacaacaagctcgtcatcagccacccgctccccggtgccagccattcgttggaggtggcctcggtgagctccagcgcgctgggcctggacgcggccacctcggagcccgggacggacggcacggcgggggtgacctggtggttgaagcaggcgaacggcacctggtccaacggcagtgacacgttgccgctgccgaacgacaccgcgtcgcagttccagcaactgcccgggaacagccagttcgtcacgctcaccgtcaccacgcaggacggtgacgggcaggagcggctgtatgaagggctgggcgtggaccgcgcccatccccgttacccgggccacgtgctcaccccttcgcccgccacgctctccgagcagatggagcggatgtacgcgttcgaggcgggcaacggcgtttccgcgttcgccctgcgcacggcgctggccgcgggccccttcacgctcaccggtggttccgacgggagcgagccaagcgcggcctcgtacgaagacgcgttcgagcggctgggcggcgtggaggacatctccatcatcgccgcgccgggctcctcggcgtatgcgtcggcgcaggccgtaaggctcgggctcatcagcgccgcggagcgacgccgtgcctatcgcatcgcggtgctggacacgccgcgcggatacgggccgcaggacgcgctggcacttcgcgcgcaggtggactcgaccaaggccgcgctctactacccctgggtcgtcgtcgccaacccgctggccgggtccgaggcggccgatgtccctcgtgaaatcgcgctgccgccgtccgccttcctgtgcggcatctacgcccgcagcgacatcgaacgcggcgtgttcaaggcgcccgcgaatgaagtggtccgtggcgcgctgcgcttcgagcaggacatccacttcgcgcagcaggagacgctcaacccacagggcatcaattgcctgcgcttcttcccgggacgcggctaccgcgtgtggggcgcgcgcaccgtcagctccgacccggaatggaagtacgtgaacgtgcggcgctacttcaacttcctggagcgctccgtggacgagggcacgcagtgggccgtgttcgagcccaatggcgagcgcctgtgggccaacatccgcgagacgattggcagcttcctggagaaccagtggcgcacgggcgcgttgctgggcgccgacccgaagcaggcgttcttcgtccggtgtgaccgcaccaccatggaccagaacgacctcgataacggccggctcgtctgcctcatcggcgtggcggtggtgaagcccgctgagttcgtcatcttccgcatcggccagaagacggcggatgcccggacctaacgcaaaggactcgccgccatgcctacccgccccacgccctacggcgccttcaatttcgaaatcagcttcgacggcacgtccttcggtgggttctccgacgtgtccggactcagcaccgaagtcaccctctccgagtaccgcgagggcagcgacccggagaaccacgtgcgcaaggtgcccggcgccttcaagacgggcgacgtcaccctcaagcgtggcgtcgtcgactctcgggccatctggacgtgggtggaggacgtccgccgcaacgggccgctgggccgcaaggccgccgtcaccatccgcttgctcgacgaggcgcgcaaccccgtgcagtcctggaagctggtgaacgtcacgcccatgaagttcaccggccccacgctggccgccaagggtggcggagacgtggccatggaagagctcgtcctcgccgctgaaacggtgcggatgggcttcccggacgtggactgagcggagcatcagggggagctcccgggccatgcggcgactgaccttcgaagtcacagaacgcgcggcgcccaccgcgcccgagcggatggacgttgccctcttcgtgggcttcgtccgccgtcgaccgggcacttccgtgcccgccgcgctgtcccgctacctgttcgagcaggggtggatgaccgcccccacgctccgcgtggaccccaacgatccgcaggccccgctcaccgacgtccccctgccttcgagagcttcgccgcttctttagagca

SEQ ID NO: 818 - DNA, 6715 bp, Myxococcus xanthus
gaggacatggacgggttccaggacgaggacggttgccccgacccggacaaggacaacgacggcgtgctggacggcaacgacaagtgcccgctcacccccggcgtgccggagaaccagggctgcccggccgaggcgcccaaggaccgcgacggcgacggcatcatcgactccgaggacaagtgccccgaccaggccgaggacaaggacggcttccaggacgaggacggctgccccgacctggacaatgacggcgacggcatcgtcgacacggccgacaagtgccccaacgaggccggccccatgcagaacctgggctgccccatcgtcgacaaggatggtgacggcatcctcgacgtggacgacaagtgcccggacgagcccgaggacaaggacggcttccaggacgaggacggctgccccgacctggacaatgacggcgacggtacgccggacgtccaggacaagtgcccgaacgaggccggcccgacggagaacggcggctgcccggacaaggacaccgacggtgacggcatcgtggaccggctggatgcgtgccccgaggagccgggcgtccaggaggagcgtggctgcgccaagcagtacaagatggtcgtcatcaagcgcgaccggattgaaatcaagaagcagatcctcttcagctccggctcgcacaaaatctacggcaagcagagcaccgcggtgctcgacgacgtggcgcaggccctgcgcgacgcgccgtggatcaagcgcatccgcatcgagggccacaccgactcgatgggcaacgacgcctccaacctgcggctgtcccagcgccgcgcggacgccgtcatggcgcagctcctccgccgcggcatcgacccgggccgcatccaggccgtgggctttggcgagacgcagcccattgcccccaacagcaccaagacgggccgcgcgatgaaccgccggaccgagttcaaggtggcggagtaacaaccgccctgccccggccgcacctggccggggcacgacgcaccagacgcctccggggcctcgcgcctgcggaggcgtcgtcgtttcggggctcagccgtccttgagcagctcgtggaggacctcggtggcatacgcgccccgaggcaactcgaaggtgagccagaggtcctcgccgtccgccgtcttctccgcggtcagctcgggcgagcccaggcggacgcggtaggggcggcggctgccttccgtctcaccaccgccgcgcttgaagtcctccggcgtgacgcccgcttccgccagcagccgcgcctcgagctcggccacggctccggcggaggccgtcatcttcggcccgaagagcgggcctgccgggctcacctcgaaggaggccacgcgggggccgtccacctcgggtgactcgcacacgaagaggccgcccgtctcctccttgcgcagcacgtcgccggcgagcgcggtggccagcgtccccgcgtgcagccgcgccgccagcgcctggttgaagaggcgcgactggaaggcggacaggtacaacttgcgctggaaacggtccggccgcttcggcagccgctggcccagcaccagcagccggcccaggtcggcgttgtcccctgcccggccgaagcgctgctcgccgaagtagttgggcacgccctgcgccaccaaccgggagaacgtctcccgcgccgcgccggaatccttcacgtcgcgcaggcgcaggcggaagcggttgccccgcaggtgcccggtgcggagcttgttgccgtggcgcttcgtccacagcacctggacgccgtccaaggcgaactccggcaccttcggctcggcgcgcgcgggcacggacaccaactgccgggtgatggcgtgccggtccttcatccccgccacgccaatgtcatcctcggacacgcccagtgacgcggccagcgcgcgcaccagctcgcgcgtgtcacggccccgcttctccacccagaggtagaggtgctcgccctcgccggaaggcaggtaggcgggaacctcctcgacctcgaagtcctcgggaaccagcttgaaggcgcccccacagccgggcacctccgccgtcaggcgcggccaaccagaatccgtcacgatacctcgagcgtggacagcagttccttcacgcggcgggccaggtcctcgtccgcgcgtgactccagcaactcaccggcctggaagagcaggaagaacatcatgtcgctgagcgcctgcctgaaggtcgccaggggctcactgcccaactgcgcgcggtggcgctcgaagctctcgatgagcttgttctccgggaggctgccatccggagcgaaggccagcccttccagcaccggcgacgacgacaggccctgaccggagagggccgcgttggccgcggcgatgaactcgcgatccatgccctgcttggccacctcgtcgcgaatctcccggaagatgaagttgaagacgcgggccaccgggcgcggatccaccgtcaccaccgggcgcgcgggcgcgcgggccggagcctgcgccgtgcgttcggacggctggggaatcggcgtcgggacgcccgggccaggaaccatcagcggtttgtccgtcaccgaggcgaatccgccctccagcaggcggaagaccaccttggtgacgtcgaactccgacaggcgcgcggcgtgccccagctccagaatcgtgcgtcggccgtcgagcaggcccagcacccggtcctcgtcctcctccagcttgccgtccgaggcgcgcttgcgcgtcacatacagccggccgtgggagatgcgcttccggaagtgcgccatctcgtcaatcttccggatgctgtccatcagcaggctctgcgtggacagttggatgatgtgaccggacttgtcctccaccggctggtcgatgaggaagaaggtcccctcccggcacaggacgatggcgtggaagatttcgctcacctggtgggtgacgcacttgaagaggtcgtgcgacttgagcagccccttctccaccagcgagcgccccaccttggagggcggttgctcacgcagcgccgcctccacctgggcgcgctccacgtagcccatccgcaccagcacctcgcccagccggtcggctgggtcgtcggaggaggcgccgcgcacctcaccctcgcgcagggtgacggagcgctctccgcccggcgagtgcacgcgcaccacgccgctccagcgcgactggctgaggaaggcgatgaggtccgacagcgggaagccgcccgcgtcccccgcaagcaccacgcgcggcagcggaatggagccgccctccgcgggcgtacgggagaacaccagcaggtcgggcgccgtcgccatcagcgcgtacgttcccgagcgccccgccagcggtgaaggcacatgccggtcctcggggacgagctgcgccgacgcgtcgatgcggaagcggggtgtcatggcggcgtcagtcagccgcccaggcgttcttgttggcggaccactccagctcgtcttccaggctgtgcgacagcatctccgcctccacgaaggacaggtccagcgcacgtccgttgaagtacacggagggcgtgccgctgatgcccgccgcacgcccctggctgcggtagccgtccagctcttccttatacgcgtccgtcttcagcagcgccgccagcttcgcgccatccaggcccagcgacgtcgccagggcggcaatcgcatcgggcttgaggttggactggtgctcgaagagggcgtcgtgcatctgccagaacttgccctgatccctcgcccacagcgccgcctgggcggccggcttcgcgttggcgtgcatggacagggggaacggcaggtagcagaagcgcacctgctgcgcgtgcttcttggcgaaggcctccaacaccgggcgagccttggcgcaatacgggcactcgaagtcggagaactccaccaccgtcaccggcgcgccggccgggcccatgcacatccggtcatccaccttgaactgcgcccgcgggtcgcggaaggcggagtagtacgtcgacagggagaggatgacctcggtggccgggctgccctcggacaccctccgcgcggccagctgcgccatgcgccgggcgtgcttgcagggagtgtgcgacttcagacaggcgcccaacgtgtgggggcagccgcagtagcagaactcgtcattgaagacggtggccagctcccgcttcgccgtgggcgacagcgaggagaagtccatgcccgggatgcccgacacggcggtggccgggtccacgggcgcggcggcgggctcggccggggccggagcggcggaagcttgcggggcgggcgacgccgactgcccccccgtcggggccgcgctctcggggttcttgcaccctggggccgtcaggaccgcgacggccagcaggggaacgacacgcttccagcagaaaaggagcacgcggcgggtcttagcgacgcgcggggggcttgtaaagcaacgccagccttggcagggaagcgcctgttcatcatgcccagagtcctgctgctgcataccgggggtacgctcggaatggccggggggcgcccgtccgccctgaagcccgcggccttcttcaagacgctcaaggcccgcgtgccggagctgttcgagctggccgacatcgagttggagctgttcagcaacctggacagctcggagatgcagccggagctctggagccggatggccgcgcacctccacgcgcgcctgccccacttcgacggggccgtggtgacccatggcacggacacgctcgcctacaccgcgagcgccctctccttcatgttgcgcaacccgccctgccccgtggtgttgacgggttcgcagcggccgttgggcaagattcgctcagacgcgcggctcaacctcatcgacgcggtgctgtccgcgctgcacgggccccgcgaggtcaccatctgcttcgactcgcgcctgtaccgaggcaaccgggcgcgcaaggtgaaggtgtccgagtacgacgccttcgacagccccaacttccccgtgctgggcaccctgggcgtggacaccaccttcgagccgggcctcaagtcccgcggggccttccgcctctacgagcggttggacgccaaggtcttcctcctcaaggtgtacccggggctggaccccgcgctgccgctccagttgctaccgcacgtccggggactggtgctggaggcctacggggcaggtaacttccccatcgccccggaactggggcgctcgctgacgcccctcttcctccaggcgcgcgagcggggcgtccccgtggtggtggtgagccaggcgcaccggaatggcgtggacctttccttgtatgagtccggagcggcggcactggaggccggggcgatgggcggcgcggacatgacgccgtcggcggccctggtgaagctgatgcaggggctggcctaccactccggctcgtctggggccctggcgcgctacatccagaccccggtggccggagaattgaccgtcggaaggccgacagtcgctccggaggcccccgccggcccccccgccactcggcggccccgaggagagtagtggagagtcgggcagtatgcttgccgccgcgaaaaggcggcccgtaagatgggtgccgcgatgtccgaggagaaaacttccgtccattcgatttcggacctgctgggcagtgcccagcagcagagcgcctatctgatcgtcatcagcgccaagtccgcggcgggcatcgggcgcatgttcaagctggaccgctccgaggtcgtcctggggcgcagctccgaggcgcagttccaggtcgaggatgacggcatctcccgcaagcacgccaaggtggtggcgctgggagacggccggttccagttggtggacctggccagcacgaacgggacgtacctcaacggcctgaaggtcaacgccgccccgctctacgacggcgacaagatccagatcggctccaacaccgtcctcaagttctccatccaggacgcgctggaggagcagtaccagcgcagcatctatgagtccgccacgcgtgacggcctcacccgcgtctacaacaagaagtacttcctggagacggtccgcgacgtgcgggtgatgtccgtcatcatgaaccggcacgagacacgcgtcgacggggaggacctcaccaccggggagcgccgccacttccgcctggaccacatcacccgcgccgaggtgctgcgcgccgccggaccgtgaaggcggcccaggagcgctggctgcgttgacgtgaggggaagtggctactgcgtcctcccgggggcgggggcgccgtcccggaaggttgccctgggcaccactgactgcgtggcaagcccaggcggcacgatactgggctcaaatctccagcggcggctggggaccggggatgatgtccgcgatatcggggtcgacctcacccggctgacgcggcccgcgctcggacttgaccttcttgcgctcctcgcgcttcgcgttcttctcctgctggtgctgcttgcgcgcctgctctttctggcgcttcgtggatctgccttgcattgagcctccctcgctgaaaacaaaagcccggcctcgcagtgaggagaccgggctgatggtgctgagcctgagctctcagccgacgacgcggacgttctcggcctggaggcccttggggcccttccgggtctcgaactccaccttctggccttcggccagggtacggaagc

SEQ ID NO: 819 - DNA, 6808 bp, Myxococcus xanthus
tccccgtgctctaaggggttgtacctccagcagcagcggctccagcggcatgaatccgcgttgtgggcacgcgagcgccggatgctggagcagcagggcgagctgcgcttccgccggctggtggacaccatgccccagttcgtctgggagctgctgctggacggcaccatcggctatgccaaccggggctggctggactacgcggggctgtcgccggagcaggggcggaagtggaaggacacgctgtactgcctgcacccggaggacgctcccagccttcggagcgcctggcaggaagcccagcgcgagggccacccgctggagcaggagtgccggctgcggcgggcggatggcgagtaccgctggttcctgacgcgcaccattccagagcgcgacgagcaggggcagctcgccggctgggtctccacggcgacggacatcgacgacgcgcgccgggcggtggagacgctgcgggcggccagtgaggcgaaggacatgttcctcaccatggcggcgcacgagctgcgcacgccgttgcaggccgcgcgggggtatgcgcacctggcctcggtgaaggcgggcgacacgctggcgccgggcgtggacaaggcgctgcacggcatccaccgcagcgtgaatcgcatggcgaagctggtggagaacctgctcgacgtggggcgcatccagcggggcgagctgcacctggagccgaagtcgctggacgtgggcgcgctgctgcgcgacgtggccgagcacttcgagccgctgcccgaaggccagcacatcgagctggacgcccccgagggactggtggtgccgggagaccgcgagcggctggaccaggtgttcaccaacctggtgtcgaacgcgctgcgctactcaccggagggcgggcgcatccggctcgccgcccgcgaggaggcggggcgcgtgcacgtggaggtggtggaccacgggctgggcatccccggcgagaagctggagaacatcttcgagcgtttcggccgcgcgcacgggatttcctacggcgggctgggcctggggctgtcgattgcgcggggcatcgtcgaacgccacggcgggcgcatctgggcggagtctcccggcagccagggcatgggcagcacctttcacgtcgtgcttccggtggagccgggcaagcccgcgccatgacgccgccgggccgcctgcctgggttggcggaagagggggaggcggatggagcccgaggccgagtcggtccacgaagacgagctgcgtgacgcgtggccggcgctgtcggcgcgagagcgggtggagggtttccacctgctgccgcccgagcgcgcgcgggacttcttcgccaccctgaatgctccagcgcaactggggctgctcgaggcgctctcgcccggggagcggggcacgtggctgcgggcgatggcgccggatgacgcggcggatgtcgtgcagcggctgtctcccgaggcgcgggaggcctggctggccctgctcgacgcgccgtccttgcgtgaggtgcgggcgctgctggcgtacggcgaggacgcagcgggtgggctgatgaacccgcgcttcgtccgcgtgcggccggagatgcgcatcgacgaggccctcagctacctgcgccggcaggcccgcgagcaggtggagaccgtctactacgcctatgtgctggacgaggcacagcgactcaagggcgtggtctccctgcgccagctcttccaggccacgccggacaaggcggtgcgggaggtgatgcgcacggagttgatccgcgtgcgggaggacacggaccaggaggaggtggggcgcctcttcgcccggtacggcctggcggccatccccgtggtggacgaccaggggctgatgaagggcatcgtcaccgtggatgacatcgtcagcgtggtgcaggcggaggccaccgaggacatccagaaggtgggtggcacggaggccctgggggcgccgtacctggaggtgggcctgcccgccatgctgaagaagcgcgcgggctggctgctggtgctcttcctgtcggagatgctcaccgccaccgccatgacgcgctaccaggatgagattgcccgcgcggtggtgctcagcctcttcgtgccgctcatcatctccgcgggaggcaacgccggcagtcaggcctccacgctggtcatccgcgcgttggcgttggcgcaggtgcgcctgcgggatgtggtccgcgtgctgcggcgggagctgctgtccggcctggcactggggttggtattgggctcggtgggtgtggcgcgcatcctgctctggcaggtgctgttccacctctacggcgagcacgccttcagggtggccctcacggtggggctggcggtgttgggcgtggtgacgtgggggacgctggcggggtcgatgctgccgttcctgctgcggcggctcggtttcgaccccgcgagcgcgtccgcgcccttcgtggccacgctggtggacgtcagcgggctggtcatctacttcaccacggcggagctcatcctccgtggcaccctgctgtagccgccgcgctcagcgcgggttcgcggcggaggatggggcgtcctcgttggggtaggtgatggcgcctggtggtggcacgggcgccgcgggcgcggggcccagcagccggctgtggggcatgggccacgcgccggtgtgcacggcgagcttccccgtcatggccacggccagcgatatctggaacgtgcagatgtacgagatgatgcccatgtccccgaacacctggttgatgtacgtggccaccagtcccacgatgatgagcgcggcggcgcggtactccgagacgtcggtgcggtgatacgagcgcaccaccaggtagatggtgacggccaggtacatccacacgcccgtgtagcccagcagccctccgaacgcgaacagccccagcagtgagttgtgcgggtggaagcggtactgagggaagacgaaggcgatgtccggcagtgggatgggctccaggaactcatgcccgtagccggtgcccaggatggggaactgggcccacgtcgcaatcatgtccaggttctcgatgtcgcggtagtccaggttgccttcgccgccctggccgtcaatcagcgagcggatggtctgcaccggcgcgaagacggacgagccggagttccaccccgccgcgatgtacacgatgatgaagggcgcgaagaacggcagcgtccgcaccaggaaccgcttcagcggcgtccacgggttgatgaggaaggccgccagcaggcagccggcgaagctgacataggccaggcgccggtcgttgaaaatcatcccaatgccaatgaaggcgatgatggccaggccgcgcagcatgtgcgcggacttgggcttctcgatgaagcgcatcgtcgccaccagcagggcgaagacgaacgtcatcgagtcggagtgggacgtggtgtactccacctccacgcccagctcgtgcaccacgaccatggcgaagtaggtgctcaccgcggacttggtgaggcccgccaggatgatggtcttcgcgaaggcgggccagtcctccgggccccgcatggcgtagtgatacatcgccacgatgaagggcatcatcgcggcctggtgccattgccacagcgagttcttgatgtccccgccccgggcgatgccgcgcacctccatccagaggatggcgaccagggacagcgccaccacggcgatgagcggccggggcatgggcagcggctccgggtcgatggtggacttcgtcacccgccggtacatcgccagccccatcaacccgaggatgagcacgtccaccagcgggaagcgcagcgccccgattttggtgatgtagctgagctgcgcgaacatcagctcgcccagcgggtggagcggcgagggccacaggcccgactggggccgttctggcacgtagtccaccgccaggacgagccaggtcaccaccaacaccgggtacttcaccggcaccttcaggatgacccacaccacccccacgcacagcacaggggccaacgcgaccacggggtggatgacggcgccgcccacggtggccagcaccaggaaagcaagcagtgcgccgtagcgcaggtagggcggccggtcgggtgcgtacatcgagacccggaggaggctacatccggggagcgggttgggatagatggagtggcacgtatgcctgctccccgcccacgcgtccttctgattgccgagctgtgcaaccccgactgggtgagtgtcccgctcgaaggctggtcgctctaccgcgctctggccgaggtggcggacgtgcacctggtcacccacgtccgcaaccgggagaacatcctcaaacagggggtgcaggagggctcgcagttcaccgcgctggactccacgccggtggagaagccgctcgacaaggtgggcgaggtgctgcggggaaagacgggggtgggctggacgacggccaccgcgttgagcgcgctgccctactactacttcgaggaggtgctctggcgccgctttggcccgagcatcgaggcgggtgagttcgacctggtgcaccgttacacgcgcatcagccccaccacgcccagcacgctggcggcgcggtgcaagaaggcgggcgtgcccttcgccatggggccgctcaatggcggtctgccctggcccaagggctttggcggcgcgcggcggctggagaaggagtggctgagctacatccgtgacgtctacaagctgatgcccttctacaagtccacgcgggagaacgcgtccgccatcatcaccggctcgcgcgccacgcgggggcaggtgtcggggcagtggcagggcaagacggtgtacgtgccggagaacgccatcgacacccggcgcttcggcacggagaagtcggagggcccggtggagctgcccctgcgcgtggccttcgtgggccgcttcgtgccgtacaagggcatggccatgctgatggaggccgccgcgccgctcatccgcgagggcaaggtggtgctggagtacatcggtgacggtcaggagatggccaacctccgggcgcaggcggcgcgcgagggcatcgagtccggcgtcaccttcgccggctgggtgaagcaccaggaactccagggccggctggcgaagaaccacatcttcggcttccccagcgtgcgcgagttcggcggcgcggtggtgtgcgaggccatggcgctggggttggtgcccatcgtcatggactacggcggcccgggggaaatcgtgagcccggccaccggcttcgccatccagatggggacgccggaggaaatcgtcctgcgcgtgcgcgaggtgctgacgaagctggccgcggacccgtccgtcatccgccccatgggcgagcgcgcccgggagcgcatcttcaagtacttcacctggagggcgaaggcggagcaggtgctggaggtgtaccgctgggtgaagggcgagcgcggccagccggactggggtatgccgctggcggactgaggcgcggcctcactcgtccaggtccagcttgcggtacagcgtgcgccggttgatgcccaggatgcgcgcggcggcggccttgttgccaccctgcgcctccaccacccggcgcacataggcgcgctccacctcttccaggggcgcgtcttctcccgaggcgtggctgagcagcgacgtcaggccgctttcgccgccgcccggcaggtcgaagtcctccggcaccagcgtgtcgtggtccgccagggccaccgcgcgctccagcaggttggccagctcgcgcacgttgccgggccacgcgtgggccagcagccgtttcagcgcgctggcggacacgcccaggacctcgcgctgctgctgctcgtccaggcgcccgaggaagaagtccactaggggcaggatgtcctcgcgccgctcgtgcagtgggggcacctcgatgcggatgacgttgaggcggtagtagaggtccgcgcggaagcggccttcacgcagcagcacctccaacggctggttggtggccgccagcacgcgggcgcgcacgggtgtctccgtgctcgagcccaggggccgcacgcgtcccgtctccagggcctggagcagcttggcctgcacctccagcgacagctcgcccacttcgtccaggaagagggtcccgccgccgaccgacacgaagacgccggcccggtcctcgcgcgcgtcggtgtaggcgccgcgcctggcgccgaacagctcgctctccgccagccccgagggcagggccgcgcagttgagctggaggaagggctgggtgcgccggccgctggattcgtggatgaagcgcgccagggcgctcttgccggtgcctgtctcgccggtgagcagcacggtggcgtcgctgcgcgccgcgcggcgggacacctccagcgccttctgcatggcggagctgcgagccaccagcccgccgggcgtgtcgccggggacggccgcgcgcaggcgcacgatttcgcggcgcagttgccgctctcggaaggcgcgctccagcgtgaggacgagcgcgtcgatgttgaagggcttggtgacgaagtcgcaggcgccggccttcaccgccgccaccgccagctccacgctgccgaaggcggtgatgagcaccaccaactggcccggcttgcgcgtcagcagcgcctccagcacctccgtgccgcgcatgcggggcatctccacgtcggtgatgaccaggtcgaaggactcgcgctcgaagagggccagcgcctcctcgggcgaggtgcgccccaccgcctcgtagccccgcgcgtccagggactctaaagcttgagag

SEQ ID NO: 820 - DNA, 8144 bp, Myxococcus xanthus
  unsure (1)..(8144): unsure at all n locations
ctctaaaggagctgtccgtacgcgcggagctgctggaacagggcggcgcaccgctctggaacgccttcatggaggagctgcaccacctgcatctcggctcgccgcggccggcgcgctcggtattcggcgagctgcaggccgcctacgagaaggcgctggtgaagcgctcccgctgagcccggcgcgtcatcctctgcgccgggcgaaggttcacacccacccgcactaggcgcgctgggccatccggcgcaggatttcagactccatcccgtgcaccacatccgacagggggatggtgctggaatccacgtgcaccgcgtcctcggcggccttcagcggcgccacggcgcgggcggagtcgtcgcggtcccgcttcgtctggtccgcgagcacggcatccaggctgctctccacgcccttctggaacagctcctcgtagcggcgccgggcgcgcacctcggggctggccgccaggaagaacttcgcgtccgcgtccgggaacaccaccgtgccgatgtcacggccctccaggatggcgcccttctccgactccagcgccagccgtcgctggagttgcagcaggcccgcgcgcacgaccggccgtccggacacctgggacgccgccatggagatgtctggggtgcgaatctccccggacacgtcctggccacccaggaagacgtggttctcctcccccaccacctggaagtggatgtgcacgcggcccagcagttcgcccaggcccgcgtcgtcgtcgaaggcgatgccctcacgctgagccatcaaggccacgcagcggtagatggcgcccgtgtccaccagcgagaagcccagccggcgcgccagaagcttggacaccgaggacttgccggcgcccgcggggccgtcgatggcgacgatgaagggccgggcgctcatgtcaggatctctttcagcacctggacgcagcgcgcgttctccgcgggcgtgcccacggagatgcgcacgtggttcgggaacccctgccccgcgaagggccggacgatgatgcccttgcgcagcagctgctcgtacagcgccactgcgggacggccgaagtccacgaacacgaagttggcgtggctgtgcgtgagcgtgccgcccagcatcggcaactccgcggcgaagtagtccagacccgcgcggttcacctcacgcgtgcggcgcacgtgctcggtgtcctccagggccgccagacccgcggcctgggccagcaccgtcaggttgaagggcatgcgcgtgcggtgcaggtacgccgccagccgggcattcatgatgccatagcccaggcgcacgcccgccagcccgtgaatcttgctgaaggtgcgcagcgccaccaggttcgggtgctggccgaccagcggcacggcgctggtgtactcgggccactcgacgaactcgcagtaggcctcgtcgtgcaccaccagcacctccggcggcaccgcggccaggaagcgcgtcagggcgtcgcggctgaacgcggtgcccgtggggttgtccgggttggccaggaacaccatccgcgtgcgcggggtgatggccttcgccatggcctccaggtcgtacaggaagccctcgcgcatgggcatctccacgaagggccgcccatgggcctgcgcggagatgcggtacgcggagaaggagccctggcacaggaggatttcatcctccggcgtggtgaaggtgcggatgagcagctcgatgagttcgttggagccgctgcccagcaccacctgctccggcttcacgtccacgtgcgcggccagcttgcgcaccaggtggaaggacgtggcgtcggggtacaggtgcgtcgcgccagagacgttccgcatggcctccacggcgcgcggggagggccccagtgggttttcgttcgaggccagcttgatgacgcccttgaggccgaactcacgctcggtctcttcaatgggcttgccgggcacgtacggcttgagcgtctcaacgtgggtggggacgagcggtcgcatggtgtaagggccctgatacggtggattcagcgtccggagaacacaccgagcgcgcgaaacttcgcgtaccggtcctggaccagttcatcgggcgacagctcggcgagctggcccaggtgcttgcgcagcgtcttgcccagcgcctccgccatcttcgcggggtcgcggtgggcgccaccagcgggctcggcgatggcctcgtcgatgatcttcatctccagcaggtccttcgcggtgagccgcatcgcgtccgcggccttgtccgccttggcggcgtcgcggaacaggatggaggcgcagccctccggggagatgacggagtagacgctgttctggagcatcagcacgcggttgcccacgccaatggccagcgcgccaccggagccgccctcacccaccaccgtggagatgatggggacgcgcagccggctcatgacctccaggttgacggcgatggcctcggcctgccctcgctcctcggcgccgatgcccgggtacgcgcccggcgtgtcgacgaaggtgaggatgggcttctcgaagcgctcggccagctccatgaggcggcgggccttgcggtagccctccgggcgcggcatgccgaagttgcgcgccatgttctccttggtgttgcggcccttctggtggcccatcaccatcaccggcttgccgtcgaagcgcgcgaagcctccgacgatggacgggtcctcaccaaaggcccggtcaccgcacagctcgacgaagtcggtgaagaggtaatggacgtagtcgaggaagtaggggcggttcgggtgccgggacatctgcaccacctgccaccgagtcaggtcgctgaagatctccgtctggagcttcttcgccttcttctcgagcttggagatctccgaggagaagtccaccgtgccgctggtggagaggaccttgagctcgtcgatcttcttttccagctcaatcagggggcgctcgaactcgagcacatagctggtaccggttgccatggcgcggaactagcaccagggtaaggcggctttcaacgcgcaagcgtttacgcacccctgtctggaggcacatgcaccccgccctgcccctattgctcctggccctcacgggcgcagcgtccacccctaatgcccgaggactgaacacccagggcttccggctgtaccaggcggggcgctacccagaggccctggagcgcttccaggcgtccgcccgggagtccccggactatgcgctggcccactacaacctggccgccaccctggggatgctccgcaagcaggggaaggtctgcgagtacagcgcccaccgggacgtcatcgtcgagcacctcacccaggcggtgaagctggatgcccggcggctcacccgcgcgaaggaggacgcggacttcacccccatccgggacaccctgggctggcagaagctgctgggccgcagcccggcgagggaggcggatgtccccgtgctgctgcgcgaggtgtcctggttcggcccgggcgtgggcgtctacggcaccacccaggggctgcgcttcggcccctccggcagggtcaccctgtggacgaaggaggtgggcgacgacgggacgccccgccagaaggaaacgcggggccgctacacggtgcgaggcaggcaggtagcgcttcggttgaatggccgtgcgccgctggaaggcacgctgacggagtcgggcgcgctcaccttccccggcctggagacgttcaccgactcaccttcggaatgcgaggcgtaagcccccgcgggcctccgtgccttccagccatcagtcgcgacgtgagccacgctcgctttcagatacggcccgcgcaacccccttggcacccatggcgcgcgtcgtcatggtgcgcacggnggcaggtgggaagggatgattcttcggggtggaatcagggcgtgaggcggatgtggcggcggccccctctacttctgcacaacagccaggacactcccgccgggtggaacgaagcccggcagggcttccttggctcgattacgagagcctggacctcagnccgctttggtcttggcggccgacggcgacagcgcgtaccacgccgtgcggaaggccttcagctcgcgcagacccgccgggtgacggcccagggccggcgccatggtcacgggcaggcccagcttcttctcgatggccttcgccgcgttgaactccagcttgcgccggctctcgcacttgtcgcaggtggacttggggcccacgcggttgacgagcacccgctccacggggagcttcttctccttcaggtactccaccagccgctcggtgcgggccgcggccagctcctcgccgcgcgtgacgaccacgaagcgcgcctcgctcggggaggccagcgcgtcctcgaagcgcttcacgtgcttgatcatcccggcgatgtcgtccgccagctcggccaggcccttggcgcggtgcttggtcagcaccgcgtgcagcgcgcccagccacgtcttggccgtctccgccatttccaccacgcgcacggacgtcaccaccggcgccgagtccaccacgatgcgcttgaagcgctcctgcaccagcgcgtccgtcagacaggacagcgcggccagctcgtcgatgcccggcggcgcgcactccagaaggttgcgcaggtagagcagatccgcgggcacctcgctgcccgaccggggcgcgccctcgaacgccttctccgccttctccttcacccgcttgcgcagggcattgaaccagccggcgatgtccagctcgcgagcgtataggcccttggtgcccttcacctgcgtctccgtgtccgtcaggcggctctgcagcacgtccgacagcgagtgcgccggatccgtggagatgaggagcaccggcccctccttctccgtcagcgtcaccgcggcggcggcggcgcaggagctcttgcccaccccgccctgccccacgaagaagatgagccgcgtgggcggcagcggcggcgcggcgatgggcggcatggacggcgcgcgcaccagcgccggaggcccttcggccgcggcgaactccagcgccttggtctccttgccagcggcccacgccttggcgaacagcgccaggccatccagcccgcgcggcgccacttcacgccggcccagcaggtgcaccggcaccgtcttgtccagtgcctggaacttgcggacgtggggggcctgtaggccgcgacggccctggcacgcgggacagccgtccttgtcctcgatctgattgacgacgatctccgtcaccggcagcccgcgctcgcgaagctgggtgaagagcatgcgcgtctgcgcctcgggcaccggctccgccagcgccaccaggtggaaggccgtgcgcgcggggtccttcagcagcgccagcagcttctccgccttctgccccacctgctccaggaagccgggcgcctcggccgcggccgccgccttcttgcccttcttcggcggcgcctccgtcttgtccccaccggccttcaccaggcccaggaacttgcgcaggctcgtcggcaggtcgaacagccgcagggtgtggctggtcggcgcggcgtccaccacgatgcggtcgaactcctcgccctccagcaggtccaccacgtggaagagcgccaccaactcctccagccccggcacggcctgctggtacagcttgcccatgtcgtcttccgacacgtgcgtgcccttcgccgcggccttcgacagcgctggcaggtaggaggccaggaagggcttcatcagcgccgccggctccacttccaggccgtacacgccgccgtctcccttacccgggaccagcttggtcgccttggccgggagcttcttcttcaccaggtccgacagggagcggaccggatccaacgacacgagcagcacccgctccttgggcgcatcctccgacagcctcaacgcatatgccgccgcgagcgtggtcttacctaccccgcctttgccgccgaagaagtgaagtactcgcgcgtcgctcattgcgttgtggccttccttgtgcccccccgcggcacccgatgcacactccggggcgcccgaatagattggcgccgctgcagttgcccgaggcgtggaacatgtacggccgggcactccctgtgggtgggagaccccccaagaatcccccgtccggaggtcaaaagtcaagaattgacgggggtttcgcggcggggtcgccgcctggacgggcgtcccctccgagccaggccaagagcccggaacccgaaggggatttcctacctgtgaggtcagcggatgacgaaccagttggtgcccatggcccccatcgcgccgtcactcccctgcccgcccagggggccgccgccaccgccgccgggcgcctgttgcgcgcgggcctcggccgcgtagcggttgagcttgttgtacagggtcttctcgctcacccccagcacctcggcggtgcgggccttgttgttcccgttccgctgnaggctgcccaggatgtactcgcgctccaccgcgtccaggctcagcccgaagggcagccggaaggtgtggcgctccgggctcttgccggccatgtcgggcggcaggtgctcgcgggtgatcagctccccgtcgcacaggatgacggcgcgctccaccgcgttgcgcagctcgcggatgttgcccggccagtcgtagttcttcaggacctccatggcctccgggtgcacgccgctgacgcgcttgccggagtcgccgcggaacttgtccacgaagtgctgcaccaggatggggacgtcatcgcggcgctcgcgcaggggcggcaggtggatctggaagacgttgaggcggaagtagagatcctcgcggaagcgcccgttcttgatctcctgcttgaggtcacggttggtggcgcagagcacgcgcacgtccacctcgatctccaccttgccgcccagccggcgcagcttgccctcttccagcacgcgcaggagcttggcctgcaactcgatggggatctcacccaattcgtccaggaagagcgtgccgccgtgggccatctcgaacacgccgggccgccgctgatcagcgccggtgaaggcgccgcgctcgtggccgaacagctcggactcgatgagcgtggccgggatggacgcgcagttgatggcgatgaagggcttgtcgcggcgcaaggacagattgtgcaccgcgcgggacaccacttccttgcccgtgccggactcgccgctgatggacacgctggccttggagggcgccaccttctccaccagctcgatgaccttgcgcatgcccacggactgggcaatcaggtccgacgagccgagctgcttcagacgccgccgcagcgtctgcacctcgcgcatcgtctctttcttctccagcgcccggtcgatacagaccttgagccgcgcggtatccagcggcttgacgatgaagtcgtaggcgccctcgcggatggactccaccgcggcgtcaatggtgcctcgccccgtcaggaagaccaccgggcagtccggcagctcctccttcaggttgcgcagcaaccagagcccatccgtctccggcatggccagatccgacaagaccacgtccggccggaactcgttcgccttgcgaagggcgtcatgcccgtcgaatgcgatctcgaccttgtgcccccaggcactgagcatgtccgccagcgcctcacacgtgtcgcgttcgtcatccacggccaggattcgtgcgctgcccaagtgaagacctcccgtactgcgtcgtgacgcgaagttgtcgtgactcgaaatcagaagccggcccgcctggatgagacgctcaggcgcgggagaaactcaggcggcacagccccgcccggacgtgcaggtcaacgcccaactgtgaacagcgcagttgcagcgcggccacggtttcgggcaagggctccgggcaggcgccggccgaatcctcgacctccagcaccgcgctcgtctcgtccccccgcaccgtgacgcggatcgagccgccattctccgcccggcggaaggcgcgcagcatcgtctggatgaggaagaagcccacctccgacgtgtactgcagacggatctggacgcccgtctccaccgacggctggacctggacgcggcgcttggcggccctagtgccccagcccgccca

SEQ ID NO: 821 - DNA, 7160 bp, Myxococcus xanthus
  unsure (1)..(7160): unsure at all n locations
gcggccgggggcacggggcggtagatgagcagccagcgcgcgaaccagctcatcgaggcaggactgtggctgcgcctcagtggcgacgcccagggagcgcagcggctcttcgagcgcgcgctggagctggatccggccaacacccgcgcccgggagtacctggcggccgccgcgggcgcgccttcgcggggcacggcgacgccgttcgagcggcctccggagttggagccttcgctggggcggctggcgcccaccgacgcggacctgcccgtctcaccggcgctggaaggcgactggggcgcatgggcggaaggacagggcggcccctcggaggccggtggcaagtcgccgcccgcgcccgtcgtccttccggaggcgctggacggcgcgccggcggacgtgctggagctgctggcgcgtgacgtggtcatcgaattcgacgagcccgtcctccaggcgaagggggacaccgacgagtacggcatccccgcaggccacacccaggagttcgacctccccgtgatggagagcgagctggacctgctcctgcgcggggccgaggacctgctggaactggatgaccactccggcgcggtggacctgctcttcaaggcgaaggagctggcgccgtcggacatccgcgtggagtcgctgcgcgcgcgcagtgagcggatgctgatgggccggctggagtccaagctgggcgacctgggccgggtgcccgcggtgcgcctgcagccggacgacatcatctggctcaacctggaccaccgcgccggcttcgtgctggcgcagattgacggttcggtgagctacgaagacctcttctcgctgtcggggatgacgcggctggataccgcgcgcatcctcgtccagctcattgatgaaggcgtcatttccgcgggctgacggctagccgcggatgatggccgtccacgtgcccttcaccaccagggtgccgtgctggttgcgcgactcactggtgacgatgacgaagcccattcgggcgcgctcgtagaggtccgcgatgcggccggtggtcgtcatcacgtcgcctgggcgcatgacgtccaggaactccaggtcctgttcgccgtgcaccagcatctgcatgttgatgttcagcgcggggtccgcgatggcggcgctgaaggggcggatggcgaagacgacggcgaagctggggaaggcgatgaggcccccgtgaggccccgccttggcggcctgcgcgtcgtagaggagcgggctgacgtgcgcgggaggctcgcccggcgttccggcacccggcttcgcgccgccgacggcgagcgtgaactcgcgcatcttctcctcgcccagggtgtagtggtacgggccgtactcacggccgatgaattgcttgtcgagggccatggtcgttacccgatgaaggcttcgacgacggcgcccttgaggacgtcctcgccgcgctggttggtggcggagacttccgccgtgagccgcccgtcctggacggcggtgacccggccctggaaggtaatcgtgtcctcgggcccgcaccgggcgcgagaagcgcgccttcacgcggcgggacccggccggggtccctccacgaagcccggcaatggcttccaccacccagcccagggtgcacagcccctggaggatgttgccattgagcccggcggcggagcccgcctccgggtcgatgtggatggggttgtaatcccccgaggcgcccgcgtagtaaatcggccggtaccggtcgcactcgcggacgtgcgtgaacgtgtcgcctggctggtaggtgcgtggcatgggaaccgtcgatctaccacggctggccgccgcgcgtgctcagggacgctccgcgtcgggtgccgtgccctgatccaacgggtcgtattcgtccgagccctcacggcgcttgcggtactggtcccgcacgtaggccacgagctgatccagataggatgataggggagggcaccgcacgccggtgccgtccagcagctccagcgtgttgtggcagttgtagatggccaggtggttgacgtagctgatggcggcgcgctgggggcgggccagcttctccagcagcggcagccgcagcatgacgtccgccgcgcgcgcggagaggttgaagcgcggcagcttcttgttcgacttctccgcgatgagctcgtacacgcggcgcgcgctcatcgggttggggtccaccaggtggaaggtgttgccctgggcgcgcgggtccttcgacaggcgccacaccgcctccaccacgtagtccaccggcaccacgttgagcggcgccacgccattgcccggcaggggcaggggcaccaccagcggcgaggtgaccaggaggatgcccaggtagtagggcccctcgaagcggtcgatctcccccgtgcgggagtcgccccccacgctgcacggacggaagacggtgatgggcacggtggcagccgcgcgctgcaccagccgctccgcctggaacttcgtctcttcgtaggcgttgcggaagccctggccccggtccagctcgtcctcggcgatgacgcccaggcggtcgccggacacgtagcaggtggagaagtagttgaagcgcgtgagcttcccgcagtcccgagccagctccagcatgttgcgggtgccgtccacgttcacccgccaggccgtctccttggccacgcccaactgggccaccgccgccaggtggaagatgtccgtcacccgctcgcacaggcgctggtactcctcgcccgacaggcccaggtgcatgtccaccacatcgccggtgagcagctccaccttggcgcccttcacgcgggcggcgtgctgctgcgcttccttgaacgacttgggctgcaccagcgcgtagatgtgccccttcgggtcctcgcgggcgatgtgttccaccagccgcttgccgatgaatcccgggtagccggtgatgaagtacgttccggccgtggccttcttgcgcgtctcgctcatgcggcgcgcagcatacccggcgctcagccgcgcgcgagcatggcgcgccacatcgcttcaacctgggcgcgggtggaggccaggtccccactgttgtcgatgacccaggtggcatgggcgcgcttgtcgtccaggggaagctgggcagccagccgggcgtcggcggcgtcggagtccagcccgtcgcgcgacatcagccgggccttctgcattgcgcggggcacccacaccaccgccacggcctccatccaggtgtgcatgccgctttcgatgagcaggggcacgtcgtagatgacgcgcgccacgccccgttcctccagcgcctggagcttgtccatgaaggcctgacgcaccagcgggtgggtgatgtcattgagcgcggcgcgctctgcggggtccccgaagacgcgtgcgcccagcctcacccggtccagccggccgtccgagcccaccacgccggggaagcgcgccgccaccgcggccagcccgggcgtgcccggttccaccacctcgcgggcaatcacgtccgcgtccagcacctccgcgcccagctcccgcaggatgcgcgtcacggtgctcttgccggaggcgatgcctcccgtcagtccgaagacgtgcacgggcggggccttacttcgcggccttctgcgtggtgaacgtcaacgactgaaccgtcttgccgtcctcgttgaagaagatggccaggcccaggcgggggtagagaaagtaggtgcggaagtcgtccgtcagcttgcgcaggtagcagggcgtggcgggcgcggcgccggaggggcaggaggggccgtagctgttctccaccgtctccttgtcgatgatgggcccggggaacacgtcgatgcgctccaccatttgcgtgtccggatccaccttgaactgagcctgggtggtgcccttgatggcctccttggacaggtaggcgatgatctccttgccgtcctgtttgacggtacgcgagggctcaccgaacttcttgatgatttcgtcgcgcttcgacacgcccggctcaatgccctgccagggcttggcggcggcggggacggcgaaggtgaggacggcgaggacggtcaggatgcgcatacggctcctccctgctggaacgggcgggcaaggctctagcaaccccctatgcccgacggaagtttctgccggtcattcaaccacgagacgccttgccccgtccggggggctctgctactccggcttcatgcgcgttcctggcatcaggatcctctcccttctcgtgctggccgccgctggggcggccgggggcgccgacttcgtaggcccggatagctgcaagggttgccaccccgaggcctacgacgcctggatgcagtcgaagcacgcccgggcggagagttcgctcaccgaccagcagaagaaggacgggcgctgcctgtcctgccactcgccggagcaggtcacccaggcgacggtgaatgtcacctgtgagacatgccacggcggtgggcagtactactcgcccgagtacgtgatgaaggactcggagctggcgcgcctggtgggcctggtggacccctctgagaagcagtgccgctcctgccacgacgcttcctcgccctccctccggccgttcgacttcaaggagtcgctcaaggccatcgaccactggtccgccgagcgcgcccgccgcgccgcggatccgtcggccaagaaatgacgttgtgatcaaggtcctcgacgcacgcttcgtcaccaccgccgtggagcccaagggctacccgacggaccacacggcggaggtggccttcgtcggccgctccaacgtgggcaaatcctccatgatcaacgcgctcaccggccgcaggaagctggtgcgcgtgtccaacacgccggggcgcacccggacgttgaacttcttcgacgtggacctggagcgcggcggcgtgcgccaccagatccgcctggccgacctgccgggctacggcttcgccaaggccagcaaggcggacaaggcccagtgggagaagatgatcaccacctacctggagaagcggcaccgcctggaggccgtggtcagcatcgtggacgtggaggtgggccccacgccggacgacctcaccacgctcgactatctccaggcgcacaaccgccgggtgctggtggtggccaccaaggtggaccggctcaccaaggccaggctcaagcctcggctggtggagctctccaagctgatggacctgccgctggaggtcatcctccctttctcctccacggagaagctgggcgtggatgaggtctggggcgcgctgctcgacaccttcggcaagtccgcccgcgtctgagggccgccggcatcatccggtagccgccgctcccggtggggttctgctcccgggccggggggcgctgtggtagggaccgcgccgtgtccgaaaacggcaagggaaatggaagcgacacgcagctggctccccgggagctgcgtcagcggttgatgaggttgtccccgcgtcagcgggtggacgccctcctggatgtcgcggaggcccgcgcgctggtgcgctcgatgcccgccgaggacctctacgtcaccatccaggagctggggctcgcggattcgacggagctggtgcagctcgcctcgcccggccagttccgcgccttcgtggacctggccggctggcggcgggacgcgctggactcgcacgccgtcctcacctggctgcgcgccgcgcggggcggggtggaggacacgggggagttcctgcgcaagctgcacacgctggacctggaagtgctcgaaatcatcctgcgcgagttcatcgaggtgcacgacctggaagagaacccggacgtcaaccctccgggcgtgacgatggagaccccggaggggcgttacctcgtcgaaatcaaggtggagggcgtggagatgtccgccgtccgctcgctcctcaacgacctcatcgcggagaaccccttcgaggccgtgcgcctgctggaggccgtgcgctgggagattcccagtgagctggaggaggcggcgtaccagttccgacgcggccggctccaggacatgggcttcccgtccctggaggaggcggtgtccctgttcagccgcgtggacgtggcgcccgctcccgtggccgccacgcgcccggggctggcgcccaccacgggccacgtggactacctggaggcggccttccgcggcctgacgatggtggaggcggtgaacgcggaggacgaactgcgcgaggtggccagcgccgcgctggtggcggacctggcggacccgggggatttggacgccatccgccgcgcgagcgagacggtgcgggactacctgtccctggcgctcgagcacctgacgggagcggacctggagcgcgccacggacgtgctgcgcgacacgccgctgcggcgcatcttccagacgggcttctcgctcacgctccagctcaagtttcgcgcggaccggctggccaaggcgcctggcgccctggtggagggcgtgctgatggtgctcccggaggaggcggccgccatctccgcgctgcgccagaagcggccccggcgggcgcttcgcgtggaaggcgcggagccggtggcgttccgctcccggcgcgagctggccgccaccgaggcgctgctggcccgcgcggaggcccaggtgcaggtgttccgcggcgtgctgggcggcaccgacgattccacgcgcgaggccctggctcgcttcggcgtgcccctggagacgctgggccaggagcgcttgctggccgcggtggtggccatggcggtgctggaggagcgcgcggacgcgcgcccggttccgctggggcgggtggtggaactgggccagcgcctcttcgaaggtgccccggaagcgccgcgcctgcgcgcctccgctgccgagcgcgcccagaagggcctggagccggcggtggcgccggaggcgcatgcggagctgcgccgtctggtgatgctgaccctgtcgcggctgttggaggagctgggcacgccctggctccaggacgggcggctggagccggtggcctcggcggttcttccgatggagagcagcccgtcccgtaggaatttcagtccggggcggcccgcacgttcggcgaggccgccccgttctagaagattcagggtttngcccgcggggcccctggcatgtctctggttcgcccagg

SEQ ID NO: 822 - DNA, 5360 bp, Myxococcus xanthus
gagcggcggaagtgtcacacgagccgcttcgatgcggccccggagttggtgataatcgaggggctccgacggtcccgggtcggtatcctgtgcggccagcacaatgtcctgaatacaggcaggcaggttccgaatgtccacgccctgagactcgctctctcccagcgcgccgttcctggtacgcctcacagcggtacgccccgctggagtccccccgcgcgccaccttccgccccttctctgtccttgccatcaacacctcccagcaagtgcaaacgatgcgcagtggagcgtcgtgggtccactgcttcatgggacgagaagggcgcgctggtccgcacggctgggcgaacgtgccgtggctggtcgcccaggaagacagtggacagcgccgacgcgggtgggcgccatccgcgtgtgctgccaccagcctatgacgcgggcattcgcgccagattctgccagaatcggttcaagctcgtgaggccaccaaaagccgagctccagatggtggcgtcgcagacgagcaggtgcccagcacgagtcgcatcgggcggcatccacagcatggcattgaaccggtcatgaccgcgttcgacaaaaggatgaggcggcgctgaggggtgaatcaactggcgcgccagcacgctcacgcggccttccagcgcaggtggtacccacaagtgtggcagatgcgcgtggaggttgaacgtctctacgcccacaagaaacccaggcgtgtcgaggtgggtagccacatcgagcggcgcgggtccaccatcgggcgcggccgccgggctgagcccgtagcgattctccacggggaagcccagttccgcgagcagggatctcgccacaccaccgagccgctgctgagaagagacaaggcggtcaccgtggtgcaggagctcgacctctcgcgccgactgctctggaggcgcccctacgtcatgatgaggacagacgatgagcgccgtgcccgagcgcatcaggaaccgccgaaccgcggccacctcgttcgcatcgaccgtctgctccgtcaccagatggtcgagactcacaacgataacggtgtctgcactactgagcagccggtcatccaggggactgcagcccccttctgcgctctgacgctccacgagcgttacggcgttgccggtggcctcgagaatgacctggatgaaccgctgaaaatcaaagagaatgacgtgctcaagaaaacctgcgatgccctgccgatagcgctctccatctgccgcccactcatagtgaggccagatggcacgccgcagctcaaaaagcgctggatagcggttttccagagtacccagcgacgccttctcttcgagcacgcgactccatgcaaagtacaatagaaagcgacgcccggccatctcagtagcccctgtctcgagtgggaatgagttcctcaagagccgcacacaccaccttgcggaactcaacctccaacacgtcgataaaggatccctccttcgtttcggtaacccaggggtccatcgtcaccgaacgcagcaccgtgatgttgtcgcccggcgagccacctactccgagccgggccttgtagttctcgatgaagccacgaccgtaacccgggccagacaaatccgtcgtgctgacgatcaagtcatagccatagatgtccgatcccggatcgatgctaagccgatcataaattgccttgttgagctggttggccagcgcaaggtcccggttgagctcccccgtggcagtccggaagttgaacgcgtatgcaaggatattctcatccgggccgagctctcgcagcaacgccattgcctccggatccttctccagttgcgcagacgtcgcccgatcaatgcgctcacgaagaaattggagctgctctactatatttccaccgtttgcctctgccggaagccgcgacaccggaacgaccacgaatgggtccccttccttcgccatgcagagcagacgcacatagaggcgtttgcaactgaagagcgcctgcccaatgatcttcccgtatccacttcgggtgggacgaatgacccggtggctcaaatacacggccgcagcggcagcgcccggctttgagccctcgagcccgtagatgccaactgtgggctctgcgtctccgtgaaagaccacgggggcgctgaaggtgaccagatcgcgcatggccgagttgcggtagcagagcgcgccagctggataagggatgtagcccgacttgtgtgggtccacggtaatggagtccgcgccctctagtgcgcggagctgctccgtcgcataccggctcagtggcatggcgggaggtggagcggcggcgaagccacgcgtcaagggctccagcattgcgaaatcctcgcggatacaggacgcatgatatcccccccaggctgcgtccgcatgaacgtggaagtcgagtcctcggcttcggtactcgtcacgcaaagccaggagctccttcaatggatcaatggcgctctcttcggtactgccaatgaccgcaacgacggcgtaaaccggccttcgccgcgtgaggcagtcctccaggattcgacgcacggcggtgagatccatgcgcgcatcgaggtccacgggcacatcgatcatattcgaggcgccgatccccagcaccgccgcggccttcgggaacgaatagtgacgcgtgcccggcaccaggaatactggaggctcgggaacgtctcccaagaagcggcgtgagaactcgatcatgccgaggttttgcagcgagaagcgagccagcacctcagtgagggtatctcgggggatctggaactcccgagtcagtcgtccgaaaagggccagcacggtgtcttctggaaggttcaacagggaccaggtgtcgagctccacgagcttcgctgttcctccttgaggaacgggcaccgtgaggtctctgccgagcgcaatcgatgcgtcctcccgaagcgcggcctggagggcaacgggcagaagcttcaggtttcgcgccgcccagatggcctcgatgttggccaccgacccatcgcacgtaatgtggccccagggtcggagggcaccggcagccaggccgccggtgtccggaatggtatagccaagcatccggcacaagtcgtcaccgacgaggatttcgagcagcgtcgttgccgtggagccctcgaaggcaacgttgttcggattgtacagcatcgcggagaagtacccgacaacccctggcagcgtgaggtcccaattcatatgcccctggtagcgcatgctgaaaaagggaacggacttcttcaggaatgccaacagcgagcggtgtccggcaacgagcgcatcaagggcctcgatatattcggggctgcgttttatctcctctgtgatgtgagtcgggtctcccgggtgaaagttgcggcgccagaacacctggtcccgaatggcctctacaatgagagactccaagacatccgcgttttcgcccttgggccccaagaaccacgcttccactgcgcgggtaccagctccatccagtcctgaaatgttgctggcggtcgctacctgccgcattccctcacggagcctcgcaaagctcggacctctgaaatcccgtcgtgatttcatgaccagctcccttgctacagaaccgcgaccgaatgagcgcccgctcgtctctcagccctcacaacccaaggccatccaaacctagtgtcgtaagtccagaggacacaccacctgccggggcatgaggaatgtcctcaattcccttgcaaggtcttcaagcgctccatggtggtgcccgtccatgcggacggggtccagcggcgcgtggaacgggctcgcgcacggctgctgcggggagggagttgtccaccggcgaggtcgccctgagcgacgctccgcgtcggaaagtggacgcacaggaaccactccgcttcctgcgaccgccatgtcgtggccacaagtcccatccctgccaacaaggcccatcaggaggaacgcccatgaagaccgaacgccagaagatgctggacggggaactctacgacccgtttgacgcggagctcgtggcggcccgaaatcgcgcgcgggacctctgccaggtgctcaacgccacccgtgagggtgagcaggaggagcggcggcgcatccttcaagcattggtgggggtgggtggcgacacggtgtggatgcagccgcccttcttctgtgactatggctcgaacatcgagctgggccagcgcgtgttcttcaacttcaactgcatcgtgctggacgtgtgccgggtgagcatcggcgactacacactgttcgggcctggggtgcagatctacacgcccatgcacccgttcaacgcggagctgcggcggaaggaggagttcggcaagcccgtcacgatcggttcagacgtctgggtgggaggcggcgccatcatcctcccgggcgttcggatcggctcacgcgcggtcatcggcgcgggcagcatcgtcaccagggacgttccggatggcgtattcgcggccgggaacccctgccgcgtcatccgcgagattaccgagtaaccgtcgagcccgacggcgcgcttttgccagagggagcgcgcgcttagaggctggagaatgagcctctgggtcctcgtcgcggcggtcttcgcgggtctgctggccgccgtaccgccgtggtggttcgcacgtcgtcgccctggctacagccacgtgcgaaacaccatcagcgagctgggagaaacgggggcacccgacgcggcccgagttgcctggctcgccttcgcgccactgggcctcgcggtctgggtattcgtggcgatgctcagagggcagttgcaggatgacacccaaacgggcctcgtattgctttccttcctgggcgtcagctacgtcggcgccgcggtgttcccatgtgacgctggcgcgccattctgggggacctggaggaaccaggttcacaacatcgtcgccgccatcggctacttcggcgcgggcgccggcctgattgagctcgggcgcgccttcgaggacacggcgatgctgtccggtcttgcgatgctcactgccgcgctgggcaagggagtcctcgccggaatcttcgtgctgtccttcgaatcgcccgtgcgaggactcgttcagcgactcatcgaggcgacggttttcggctggatggtcctggtgggcgtgtggctggtggtcggggcctgagccaatccctgcaccatcagggctttgcgaaagaacagcaagattccaaagtcagcaagcaagcatcttgacatgagctgtggccgaaagaatcctgtgttctccttccagccaaggagattcttgtgttccggtccgctgctcaccatgccgttagagc

SEQ ID NO: 823 - DNA, 5859 bp, Myxococcus xanthus
tgcgcccggtgggtccagccccatcctccgcctcaagctgcagcacttcaagccggaggaactgtacgcgacgctcaccgcggcgaggttggtgccgcgcgagcgctacggccgcttcgacggcaagcccttcgacctggaggactcgcgccacatcggcatcgccggaacgtgagcgcccgtcagcgctcgaagcggtagcccagtccgcgcacggtgaggaagtggcggggggcttccgggtcgggctcgaacttcaggcgcagctggcgcatgaagttgtccacggtgcgggcgctgccttcgtagtggtagccccacgcgccggacagcagctcctcgcgggtgaaggtgcgtccagggtgcgcgaggaagtgcgccagcagcttgaactcctgcgcggtgagctccaccggcgtcctcgcgcgtgccaccgtgcgggcggccatgtccacgctcacgtcgccgaaggtcaccggcggcggcgaacccgcccccgcggaggggtagcgccggcgcagcacggccttgattcgggccagcagctcctggaggccgaacggcttcaccacgtagtcgtccgcgcccaggttgaggccgacaatcttgtccgtctccatgcccttggcggagagcacgacgacgggcgtgtcccggccgcgctggcgcagctccttgaggacctcgaagccattgagctccggcagcatgacgtccagcaccaccaggtctggcgactcgtccagcgcgcgcgccaggccggtgcggccatcctgggcctggagcacctcgtagccctcgaagcgcaggttcatggacaggcccgtgaggatggacaggtcgtcctccacgaccaggatgctccgcgtcttgtcgctcatgccttccccgccggcaggtggatggtgaaccggcttcccttgcctggctcgctctgcacggagatgcggcctccgtgggtttcgatgatgcgccgggtaatggccagccccagcccgctgccttccgtcctgcgcgtcagcaggttgtccacgcgatagaagcgctcgaagatgcgagtgcgctcctgcggagcgatgcccacgccgttgtcctccaccgtcaggtccacgcccttgccgctgccccggacctggagggtgatgcggcggttgtccggcccactgtacttgtaggcattctgcagcaggttgagcagcgcgccggccaccgcggcccggtccacgtccagcgcgggcaagccgtctgacacctccaccgtcaggtccacgccgtcctccatgcgctgggttcggaaggcttccaccgccgcgttcacgagttccgacaccggcacgatttcgcgctggtacaccttgcgcccgccttcgatgcgcgcccagtccagcacgcgctcgacgaagatggacaggcgttccgtttcgcgcatcagcagggtgagcacctcctgcgtctgcgccgggtccttcagccgccccagggccagggtctcgatgaacatgcggatggacgtgaggggtgtgcgcagctcgtggctcaccagcgacacgaagtccgtcttcatccgcgagagctgcgcctcacggtagagcgcgcggccggtgtagacgacgccgaaggtgagcgtcaggtagaacacgcccagcagcacgccgtacagcacgcggttgcgcgtggacgcgcgcgccaccgggtcctcgccggtgggcagcaccaccagccggaagtcctggaggggcgaggacagcacgcgctcagcgagccccgtgggccccagggcgctggcgcgcgcctgcgccacctcggacaccagccgccccatcagtccgccctcggagggctcccggggcacgggcagcagggcgaagcgcaccggttcgctggacacggctcgggggtccacgcgctcggccagcagggcctccaactgctgcaccgatagccgcacgccgtgcaccacgctgccgcgtcgctcggcggccaccagcaccgcgcgcccgcccgtggtgagcgagaagacggtgggctcggtgggcagtccgcccgcctcgggcaccacggtggcgagcgcctccgccagctgggggtcccgggtgcggacctgtccgtcctccaactggaatgcgccgtccggctccgacacgggctgcccgtcggggaggatgaactggagttggccattcaccggctccaggctcgccgaggcgaggatgcccggcagttcctccgacagtgactccagcgtgccgcgccaggcggcctccagccgtttctccacggccgcgcgctcgttgatgatggccaccaccccgaagccggacaggccggcggatggcaccaccaccaggacgatgagcagcgcgaacgtgcgccggaagttgaggaatcggggcggagtgcgggacacgacccctctcctttacccctacccggcgctacacgctcgtggcgtttcatccacgcccgcgacagggagtgtgcaccacccacctggagtgtgtgcggacgtcatcgacttcgggggtattctggtgcaagcatgggcggccgcggggcaggcgtgcgacgtgggccggccgccttcttccccgctcaggacgcggccgcccggtgtctggtgggtgggacgggctgccgcgaggaagggaacccctccatgagacggatggtcctggccacggtgttggcctcgatgctcgcgcttccggcgtgtgaagaccgcgacgcccaggcgacctggacccaggcgtcgggctcggtggcgctcagccgggatgacgcctttctctacgtggtggactcggacaatggcgtcctcgccgtggtggacacggcgcgtcgtgaaaaggtgggcgaggtgaaggtgggcctccttcccgagcgcgtggcggtggggccggacgacaccgtctacgtctccaatcgcggctcgcgcagcgtgtccgtcatccgccggggggactggaacgaggcggcccgcatcgcggtggggggtggagcccgtgggcctgtcggtgtcgcccgccggggacacgctgtacgtggtgaacagcaccgcgctggcgacgtcgagccacggctcgttgatggcggtggacacacgctcgctgtcggtgcgctgggaattgccggtgggggatgagccccggggcattgcgctggcgcagggcggcaagcgcgcgctcatcacccgctttcgccagggcgacctggtctccgtggacctgacggacgcggaccggccccgggtggtgcgtgagcagacggacctgtacgcgcgcgccaacgtccgggacaacgtggccgcgtccccgaacgggctgtcgccgcggcttccgcccgcggacatccgcttccagccgcgcagcatgtcgagcgtcgcggtgacgccggatggagagcgcgcgctggcgacggtgatgtgggcgcgggaggacccgttgtctccagacgggacgcccacggcgccgagcgggggctcgctctacggcggtggtgggccctgcaacacgggcggcgtggtggcgccagggctggtcaccttcgacacggacacgggctcgccccgggtggatgacctggaccggtgccgtccgccgccggacctgtcaccggacttcccgccctccaccatcatcagcccggagtcgacgcaccccatccaggggccggtggcggcggtggtggacccgacgggcctgtgggccttcgtggtgaaccgggagacggacaacgtcgccatcatccccacggggcgccgttcgggctcggacctgaggtcgggcctgggcagcacggtgcgccagttggtgcgcgtgggctccggccccaccggcatcgcgatgacgcgggatgggcgcaaggcctatgtctacaacgcgttcgaccacacagtgacgacgctggtgagcgacggcgcgggtggcaccgccaacatccgcacggacggcgcgccgctgcccatcgccggggacgtgctggcgcccaacgaggtggcgggccgcaagctgttcttcagcgcgctggactcgcgcatggccagtacgtcggtgggcgcgtcgtgcgcgagctgccatcccgatggccgcgaggacggccacgtctggggcttcccggacgggcctcgtcagacgcccagcctcgcgggccggagcatgacgaagacggggccgttccactggagcggcgagttctccaccatgcgggacttcctcgacgcgacggtgcgccaccgcatgggtgggacggtgctggacggcgtcatggtggcgcagctgtccgacttcatcgacgtgctgcccgcgccggacaacccgcacagggccgacgtcctcaccgacgcgcagacacgcggcgaggccgtgttccgcaaggccgcgtgtgacacctgccacggaggggcgcacttcaccctcaacacgcaggccgacgtgggcaccttcgtcacctcggggctgctccaggatgacccggtggtgcgcaagcaggggctcaacacgccgtcgctgttggggctggcccgcaccgcgccgtacctgcatgacggcagcgccgtgtcgctgaaggaccggctgatgcagggccgcgagtcgaaccggcacggcatgacggcgcatctcaccgacaccgaggtcgacgacctggtggagtacctgctcacgctgtaggggacggaatatgtacggggggcctagggctcgccggagtctcccgcgtcctcttttggggcaccgggagtccccgcgtcgagcacggcgggcttggtggcgatgagcgccgagcgcgccacctccacggcccgctccgtctcaccgcccagccaggtgacgacgaccgcgcagtccgtgtcgtcatcccaggccagcacctgggacatgccctgggcgggcgcgcgccgcaccgcggcacggcccagcgcgggcacctccacgccgccggcctggagggtgggggccatcaactcgtggatgtccgactgggcgtagcgggcgttgcagtcccaggtgatggagacggcgaggccgggctccgcgtccgagcggaagctgcacagcgggccacacgtcgggcaggcgcgctcctgcttcatggtgaagccggggagcatcagctcgcggtcgtccgcgggcagcagcacctcgcagtcgggaagcgccgcgcgctcggcggggggcgctggggtgcccgcgtccaccgcgggtgtgtcggaaggtcggctccggcatgccgccagtgccagtgccatgaacaatgccgcgcgccctccagccctcatcccgtgtgactcccgtgtgcgcctgccgaagcggcgcggatggtagaccggaggatgcctcgcgcggcgacgtttcccgcatgtcgctgcccgcttccggacgccggcccggtttggcctccgagcgggcgggcttgcctcgtgccttatacgcccgtcggactaagctgaggcttcccaccatgcgctccgccccctccttgcccttgctcgtgtttgccctggtgggagacgtccaggctcgtccggcggagggcgctcccctggctgccgtgccgtcgcagccaagggcgtcgggcgccgaggcttcgaaggcgcgtgtcccatcggcgggctcgtcgaaagcatccgcgccgtcccagccaggagcgcctgcgtctggaggcggggctccggcacgtgtgccctcgggaaccgcgcccgcgacggcttctgcgccagcggagcctcctggggcgcctccgcgcaacccggcgccggacacctcctgggcgcagcccggccaggtccccgcgcccgctcgcaacgaagctccggacgacgcggcctgggagtccttcccgggcgccaccgctcgttagagc

SEQ ID NO: 824 - DNA, 7811 bp, Myxococcus xanthus
taaaggtcagtccgtccacggtgagcaggcgcggcaggtccgccaggggaacgtggttggtggcgagcgccacgcgcacgcgaggcccatccatcaacatcatcacgtccacgccgaaggcctccgccagcacttcggtgtgacccatgaaggggatgcccgcgcgggaaatctgctccttcgacacgggcgcggtgcacagcgcgtccacgtgtccggcccgcatcgcgtcgatggccgccgtcacgaaggcgtattgcgcgcggccgccctcgcgcgagggctctccgggcacgcggtccttctccgcgagccgcgttacctccaccacggtggggccttccacgcggcccagggcggagggctccacgcgggcatagcggcggaaggcggggaagcgcgccagcgtgggcccgtccccgaagatgacggggacgagcaccttgcgcacggagggcttcgtcagggccgcggccgtcacctccggcccgatgcccgacacgtcccccagggagattccgacgtgcggaaggcccacggcggctacagcttcacgtcgacgttggccttctgccgcagttcctgcacgtactggtcgaggaacttctccgtcttctcctggagcagcttgccctccagcttggggcgcatctcctcgtaggacgcggcggccaccgtgcggcgctcctccaccttcagcacgtgccagccgaagttggtgcgtaccggctcactgacgccgccctcggggaggccgaacgcggccttctcgaaggctggaaccatgacgccccgcttgaaccagcccaggtcaccgccgtccgcggcgctggggccttcgctgcgggcgcgggccagcgaggcgaagtccatgcccggccggcgcgcttccgtggcgatggcctccgcccgcttcttggcggcttccacctgctccgccgtggccttggcgtccacctgcaccaggatgtggcgcgcgtggacctccgagtcaccgctctccatgcgcgtgtactgcgtgtacgcggccttgaggtcctcctcggtaatcttcacctgggggcccaccttcatgcgcagcaggcggtcacgcaggatgcgcttgcgcatcatgtcccggtaggtggccatggtgaggccttcacccagcaggagctgctcgaactgcgcggggtcggtgatgttgttctgctggcgcacgtccgccaccagctcatccacctccgcctcgctggcggtgatgcccagctgcgcgatttcggactccatcagcttctcgccgatgagggtgtccagggccgtcttcatcagctgcagccgctgctcgccgcgcttgcgcgggtccgggtcgttgacgcgggccatctctggcgccgcgcgctgctgcacctcggacagcgcgatgatgtcgcgattcaccaccgcggccactttgtccaccagctccgcgtgcgccgcgccgccgctccccaggagcgccaccgccgcgattgccgccaccagcttcttcattcccgccatccttccgtaccgccccgggcgcgtccaaccgccgccccggtcttcgatttcgtcgtcactccgccgtcgcctgctgaggcgtcggacgcccgcggatggcctgcaacgtggcctcgttcacctggacctgggccttctgccgcagctcctgttcgaacgtctcctgcgcctgcgaccgcttctgctccagcagcttgccctccaccagcgaacggacttccacgaactcccgcttgcgcgccggcttgcgctccagcacgcggaacaggtggaagccgtactcggtggacaccacgtccgaaacctgccccacccccagcttgaataccacttcgtcgaaggcgggcggcatctgcccccgggggaagaaccccaggtcgcctcccaccttggcgtccgcgctgagcgaatacctgcgcgccaggtctgcgaacttcttgccggacttgagctgggtttgcagccgccgtgcctcgtccaggcccttcaccacgatttgcgcggcgtggacctgctcgggctcgtggaagtccttctcgtgcgcgccgtaccaggcccgcagttcttcttccgtcaccgccacgcgcgaatagacgtggctggcgaacagcttttcgatggtcagccggcttgcttcccgcgagcgcagctccgccatggagagctgcccctgggccaggacctcgttgaagttgcccgccggatagtccccggacagccgcagcaccccccggtccacctcctccggggtgacggtgacgttgtgcttgcgcgcctcctgcagcagcagcatccggtggatgtacgtatcgaggagcgcgcgcttgaagggctccacgtcctccaaggtgcgctgggacacgtccgtcagcgccagctcgcgccacagctcctgttcgaagtccgcccggctgagcacctcgccgttgacgctggcgaccaccagggcctccggcgtctccatcacgggcttggtgcaggcgggcatgcccacccccgcggccagggcgatggcgagtgggaccaggaaggcgcgggtgggagaaaagcgcatgcgcggggcctcgtgagggggagggctccagattggcaagccgtcagtcatggcgcgaggcccgttccggtagcacgccgggcagggccggacaacctcaccgggcctacggctgcgtcgcgtgtgcggagaggaacgcctccaccagggggaagatttcgtccggggcccggcggcccaggaccaggtccgcgtgcccgtagtccgccccgaagccgtgggccttgccggcgaccaggaccttcaccggcccgcccaggtactccttggcgcgcgccaccgccatgggtggggccagcaggtccttgctgcccgccagcagcaggaaggggatggtcacccgggacagggactcgcggtagtcgaactcgccgttgtaggacgtgaagcggttggtggtgatccaccgcgcgaactggcgccccacgccgccggcgatgtcggcgggcacgttggccagcgcgcgccgcaccacctccgtctccatgttctccgccagcatcatgtagcggctcatgggccccggcggcgcgccgaacagggcgatgctggtgacgcggctggtggggatgacccgcagcttcagcaccggctccaccttctggatgaaggtgcgcaggcccggctgcaccgcgaaggtgaagggactgcccagggtgacggccgcccgcacgggcgcctgcggcgtcttcgccaggtgggcatagagcatcagcccgcccttggaatgaccaacccagagcacttccttcgcacctgtggacaagacggtacgcaccgccgtgcgcacgtcatgctcggcctggtcatcgaagttgaaatccgggcagtcgcccgccagcccccggccccgcagctccagcacccacgtttcgaagccggaccgggccaggtagcgggccaggctgtactgctcgtcgaagtccatgtggaagcggttggcccccaacccgtggcagaggatgacgggctgggcgaagcgcttctcgcctcgggcgtggtagcggcccagggcaatggaggccccgtcgtccgtgggcacccggtacagctcgtccgggcggaaggtgagcgtcagcagcccctccttcccgcgcaccatcgttcgcgaaaagaggtccgccatccgacccaaccgtgccacctgtcgacgagtcacgtcgccagtctaagccggaccgcggggccatgccgtgttcattggtgagcaagaacccgcccggcaggactgttgcagggagatgtaggcaacgactcggaggaggtggcaatgcggcggaaacaggcttggaaggaaatgtggtcctcccttttcgccaccgtttttcccacggatacccttctggcggcccttcggaagatggagcggcaccaggtgcggttgttgggcgtggtgggggaagggggaggcttgttggggttggtcagcgaggagcacatcctcgcggcctggaggggggatccgctggcgccggtgtccggtgtcatggcgcgggcgggggctcccggagcggcgcgggcgggggcgcggcggtcgcgactccagggcgcccagcctcacggcgcggggtgagacggcggtccgcgggggcggtagagtgcggcacgccgtgccggacgaatcgccctcgtggactgtctacatcctgcggtgccgtgacggcacgctgtacaccggcgccaccaacgacctggagcgccggctggccacccatggccgggggcgcggggcggcgtacacgcgggcgcggctgcccgtcaccctggtgtggagcgaggccgcgggggaccgcggcgcggcgctccggcgggaggccgccatcaagcggctgtcgcgcgctgagaagctgcgcatgctggggcgcccctgagcgctggtggcacgccagtggggcaatacctctcccgatgcaggcgcgttactctggcgccaccatccaaagggggccggttcatgtctcactcgtactcgaaagtgttcggggcgctggtgctgttggggctcgctgtgtcctgccgggccaatcacgctcccaaggtctccacggggcctcggccttcgccgcaggtcgtcggggcggggggcgtggtgtccttcgtcttcgaggtcgaagacccggacggggacgccatgaccttccaatggcagcagctccccgcggagcccgcgggcaccttcagcgacgcgaatgcgcgcaaccccacgtgggtggcgccggaagtgtcggagacgacgaccttcgccatcatggtcaccgtggaggacagcgagggcgatggcatcctggcccaggggccgtgcgccatcttccactcggcgggatcccaggcgtattgagcgtcgccgggccgagcatcaagcgggggcgcgtggctcctgaggggggggcgcttgggacgtctgcacccgggccttccggtgtgatcggttctcgacgaccacgcccaggatgaggaagaggccggcgcccacgcccccaccgatgacctggtacgaaatcaggtccgcggacgtcttgcggacgacctcgggcaggttgcacatcgtctgggtggcgtagggcgtctcgttgtaccagcccaggtagttgggccccagccaggaggcgaccacgaagcccagcagggcgcccgcgaggatgaagttgagcagcgtcttggcggcgttcatcggcaggcacctcggctggttgacgtcggggcgtgcttaatatgtgcacgccatcgctgcaaagcgtggaacgtgttaagggggtggacgtgccgctgctcccgctcgccatcctgttcgccgctctcgcgctgggctgcgccgctaccctgctcgtccacgccttccggcggagtgtgggcacgggggtgatggtgctgctgattccctgctacatgctcttctacgccttcagccagttcgagcaccggcgcaagggcctcatcgtcgcgggcttcatggccagcaccgtgctggccgccgtgttcctgggactgggcctgcacagcctttcggcgctggcctcgcgctctccgccctcgggcttctgacggcggggcgcccggcgtggaaggccgcgtgcggacacccgtcggcgccgtctgcgccacccacccggacgaggccgcggtggccacgtgcgcgcgctgcggtggcttcctgtgcggggactgcacggagctggcgggcgaaacgccctactgcgcgccctgcgtggcggtgctgcgcagggaggcgcgtccgtcgcgggtgattcaggtggcgctggcgctcaacgtggcggggctggcgtgtctgccgtgctcgctggcgttgccgctgcccacgctggtggcggggctggccggcgtggtgctgggcctgcgggagctgcggcgcattgcccggggcgagggcgccgagcgcggacggaccctggcgcgggtgaccacggggctcggctgggtgaacctggggctggcctcgagctggctggccgtcgtgttctggggcttcggaccttgagggccgtgcgcgccgcgctcacacgccgcgcgcgttcgggtcccacatgtacttgtgcatctgcagttggaagcgcacggcgagcctgtcctcgatgacccattcggcgagctcgcgcgggtggagcttgtcgaacacggtggagaacaggctgccgtagggcttctggagcagttggtgctcggcgatgagcgccttggcccagtcgtagtcctcgcgcgagccgatgacgaacttcagctcgtcgttggcgttcatcgacgtgaagttgcggtagtcgttgcgcaggtgctcgcccgaggagggcgtcttcatgtcgacgattttgtgcaccgccggaggcaccagccgcacgtcgatggcgccgctcgtctccagcagcaccttgaagccggcgtcgagcagcgcctccatcagcgggtagacgccgggctggagcaggggctcgccgccggtgacctccaccatgggcgtgcgcaggccccgcacctcgctgacgatgtccgcgattttccggcgcgcgccgccgtggaaggcgaactcgctgtcgcagtaggtgcagcgcaggtggcagcccgtgaggcggatgaaggcgcacagcagtccggcgtgggaggactccccctggacgctgaggtagatttccttcaccaccacggagtccgcggtggggacgcgtcggggctcgatgtgtgggcgcgctgcgggcatggcttcttcgctgattcgagggaggcgtgcttcaaccccaacctgccgcgccaggtcaagcgcggcctgttgcctcgcctgaggaggggtcaaggggcggtggggcccttcacgcgctcgatgaaggtgtcgatgagctgccgggcgatgctgagcttcggggggatgcgcggcaggttgtccgggctgaaccagtgggcctcggagatttccttctggtccacggtgatgtcgccgcccgcgtactcggcggtgaagcccaccatcagcgagcggccgaagggccacggctgtgagccgaagtagcggatgttcttcacgtcgatgccgacttcctccttcacctcgcgcgccacgcactcctccagcgactcgcccggctccgcgaagccggcgagtgtgctgaacatgggctctggaaattgggcgttgtgcgccagcagcatcgtgtcgccgcgggtgatgaggacgatgatggcgggggcgatgcggggatagaagggcgtcttgtccaccgggcagcggcgggcgcgctcacccggaaccaacagggtgggttcgccgcagcggccgcagaagcggtgggtgaggtcccactcgacaatcgcgagcgcgcggcccgccacggcgaagcgggcgtcatccacgcgcttgtagagcgagcgggcggcgacggccttgtagcgctctggcgggacgaagtccttggcgaaccccgccgcgtagcagtccacgccgtccagcgctcccaggtagtgcgcggcggcggcgagctccgggaaggccgcgccggtgggaatggcgacgccgtccgcatgctcctggacgagcacgtccatgccccgggcgaggaagagcagggcgccctcgcggggccggtcgggcgggatgtggtcggggacgaagaggggggcggagctcacggggccacactaacgggcccgggccgggtgtgcaggcgttgcgtgcgctgcgggcctgggacggcggtgggctcagcggacttctggaaagttccaccgaagagca

SEQ ID NO: 825 - DNA, 5982 bp, Myxococcus xanthus
gcccctgggcggcatcgccgcctcgtacatgaacttcagcgtgggcttcttcgtcggcggccaggtgctggccggcatcctcggcagcgccgtcacctacgggtacggcgcggagggcaagcacggcgccaactacatgcagacgatggccgcatcagtggcctcgctgtgcgccatgtccgtgctcatccagtccatggtgtggctgggcatggagatgcccgcggcctggcagctcatgctcttcgtcggctgcgtgggcatgttcgccgtgggcgtgggcatgctctacacgccgctgctcgtggacaagctccagctcgactatccgtccgggctggcggtggccaacatcctgcgcgccctcacggacaagcgcctgctcaaggcgtccatctccaagctgggcggcggcaccctgctgggcgccctggcggcgtggatgacggagaaggtggccttcgtctcctccatcggcaccagcgcggcgacgctgggcgcgggcatgattgtcggcagtcgcatcaccgtccccgccatcgtgatggccgtcatcggcgcggtgctggtgcccaccctccgcgagatagggtggctcggccctcaggatccgttccgcaaaatcggcttcgtcatcggcctggggatgatttgcggcgcggccgtggtggacctgtcgctgctggcggtccaggcggcgaagcgcatccgcgagcgggcctcggcgaaagacgaagaggaggagtcctggaagaaggtcaacatcccccggctgctggcctgggtgggtgtctggggcggcgcgacgctggtggtgggcacgcaggtgctgaatcagcctgtcggctggctcctcttcggcatgctgctcgccctgctgttcgtgctcatcaacggcatctcgttcggaatcaccgaccagaaccccatctccagcgccttcgtcatctccgtgctgatgatgtccatgatgggcctgcgcgttccgctggtgggcatgatggccgccaccatcctgctcatctccacctcggtgggctgcgacatgcagcaggaccgctccaccggctggcgcctgggcaccaaccgcgtcacccagttccgctatcaggtgctgggcgtcaccatgggcgcgctgctgtgcgtgggcctggcgcgcgtgttcatgaccgcctacccggcgctcaccatcaaccagctcgacaaccccaacgccgaattgtggccagtggggctccgcgatgacgtacaagctggtgggcgccatccgcgacctcggctcgctgtcgcaggccgtcgtgaatgccctgctcctcggattggccatcggcttcatctacgaactgctgcgcaaggtggtgcgaggcaacgcgcgctaccagcagtacgtgaagggttcccgaaagggcttcgccgtcggctggacggtggacgccatcctgcttcccagtccctacgcgtcgtcgttcggcggcttcgtggcgttcccggtgtcgctgtggttcggcgcgggcggcatcgtgacgtccgtctggaacacgttctccaagcgtgaagagcccgcggtgagtggcagcccgggtgaaggcgaggcccttccggaggacatgagcaccatgtccctcatgggcggtggcctcatcgccggtgagtcgctgttcttcctcatcgccggcctcatcgggctcgcgtcgctgttggcgtagcaacacctgcacgggccctcccagtggcgcagggtccgtgcacggggccgagttgacaattctccgcgcccctcgcatcttcttcgccgtgagcttcgtcatcaccaccacgaccaccggcaccacgactcgcttcggcgggcgtggaaccgtgcgcgtcacgtggtgagctgacgaacgcacggttccctgccccgccttctccggccggggcaaccgtgcgctcgctcagcgctccgaccggatggcgtttcacccttccgaatcggagacgaagcaatgcttgacgaacacgaccaccgcgcgctgggccaacgcctggacctcttccacctgcaggaagaggcacccggcatggtgttctggcacccgcgcggactggtgctgtaccggctgctggaggagcacgtccgccagcgcatgcgccgcgagggctaccaggaagtccgcaccccacagctctacgcgcaacccttgtgggagcgcagcggccactgggacaacttcggggagaacatgttcctggtggaggacggcgcgcggcacctgggcgtgaagccggtgagctgccccggccacatcgaactggtgcagcgcatggcgcccagctaccgcgacctgccgctgcgcctgggcgagttcggcctggtgcaccgcgcagaacccggcggcgcgctccatggcctgttccgcctgcggcagttcacccaggatgacggccacatcttctgcgccgagccgcaggtggtgccggaggtcgtccgcttcgcccgctcgctgaaggacttctacgcgggcttcggcttcgacgacgtccaggtggccttctccggccggcccgcgtcacgcgcagggcgcgatgagctctgggacaaggccgagtcctggctcctcctcgcggcgaaggaagcggggctccagtgccacatgcagccgggcgagggggcattctacgggcccaagctggagttcgtcctgaaggaccggctggggcgcgcgtggcagtgcggaaccatccaactggacctcgtgctgccggagcgcttcgacctccactacgtcgacgcctccggggcccgcgtccgtccggtgatgcttcaccgcgcgctgctcggcagcctggagcgcttcatcggcgtcatgctggaacaccacggcggcgcgctgccgccctggctggcgccgcagcaggtggtggtggcctccgtgggtgaaggcgcggccgactacgccgagcgcttcgccgcgaagctccaggaggcgggctgccgcgccagcgtggaccggcggggtgaatccctgtcccgcaaggtcctggatgcccacgcggcgggcgtcccgtggctggtggtggcgggcgcacgcgaggtggccgcgggcaacgtccgcctgcggcagcgggacggcgcgcagcgggacgtcccgtgggaggacgccgcggcggagctcgtcgcatcgtgccgtccggccccgaacgcctgagggtgacaccagggcgcgggcggtgagaaacgccgcaccgctcgcgccccgtcgcttcagacctgctggagccgctccagcacctcgcccgcgtgcaggacttcctctggcaccgtggccaggtcgtccaggctcaagagccccaccggccgccgttcaccgtccaccaccacgaggcgccgcaccatcttctcctccatcaccttctccgccacctcgagcgtcgcgtccacgtcgcaggtgatcaccgtggccgtcatcacctcgcgcacgggcgtggtgttcgggtcctgccccagcgccgcggaccgcaccgcgatgtcccggtccgtcagcatgcccaccagttgcccaccctccagcaccggcagggagccgatgttgcacgtgcgcatcctcagcgccgcggcccggatgggctcgcccgcttcgatggtctccaggttcttggtcatcagctcgccaatccgcattgcacgctcctcacttggcatgacgcccctccccacacccgttgaaccccggcgccccgccgtcgcctcccggattgcgcctggccctggagcgaggagccggacaagcaccctcacaccttgctgcccaccaggcgcgacgctggggcaggatgcgcatctgatgtgcgcgtgggccccggtccgggcccggacaaggagcaggaaggcatggtcgacaagctcaccctcagcgacgacgaatggcgcaagcgcttgagcccccaggagtatgaagtcctccgccgccagggcaccgagcggcctggctccgggtgcttcctgggcacgaagacgcccggcacctacgtgtgcgcaggctgcggcaatcccctgttcaaggcgggaacgaagttcgagtccggcacaggctggccgtccttcacgcagccggtggcgcccgacgcggtgacggaaatccaggacgtctcacacggaatgattcgcaccgaggtccgctgtgcgcgctgcgatgggcacctgggccacgtcttccccgacggccctccgcccaccggcctgcgctactgcatgaactcggtgtccatgaagcacgtccccgaaggccagccgctggagctggtcaagacatagcctcctcacggaacgggtgagcgggccggatgctgtcccggccctgctccccgcccagcgaacccgcggcgctcagcccagccagacgcgggcgttgcggaacatgcgcatccaggggccgtcgtcgccccactcgcgaggccgccacgagtgctgcacggagcggtgcacgcgctccgggtgcggcatggtgatggtgaagcgcccatcccgcgtcgtcagaccggcgatgccgtggggggagccattggggttggcgggatacgactccgccacgcgtccgtggttgtccacccagcgcgtcgtcaccagccccagcccgttgacgcgggcggcgtcctccacactggggaactccgcgcggccctccccgtgtgaggtgacgatgagcatccggctgccttccatgccctggtagaagagcgacggcgtcttcgacacctccaccagcgacaggcgcgcctcgtactgctcggaggcgttgcgcacgaagcgggggaagtgctccgcgcccgggatgatgtccttgagctgcgacatcatctggcagccgttgcacacgcccaggccgaagctgtccggccgcgcgaagaaggcagcgaaggcgtcccgcgcgcgagggttgaagaggatggacttcgcccacccgccgcccgcgccgagcacgtcgccgtaggagaagccgccgcacgccagcacgcccttgaagccttcgagcgacaccctccccgacaggatgtcactcatgtggacatccaccgcggcgaagcccgcccgcgtgaaggccgcggccatctcctgctggctgttgacgccctgctcgcgcagcacggccacccgaggacgagcccccttcgcgatgaagggcgcggccacgtcctgggccgggtcgaacgtcagcttcggcgacagacccgggtccgacgcgtcactcctcgcggcggactcctggtccgcacagatgggattgtcgcgcagcttctgcatctcgtagctgacgcgggaccacgtgcggcgcaaggccaacgtgtcctccgccatcaacgtgtcaccgccgtggcgcacccgcacctgaagcgccgtcaccgggcggcccagctcgtggacatcccgtgacaggccgtgctgcgccagcacctcgcgcacccgcgccacatccgaggcgcgcacctgcaccaccgcgcccagctcctcgttgaagagggccgccgtcacgtcaccgcccagcggcgccaggtccacatccagtccgcagcgacccgcgaaggccatctcgcacagcgtggcccacagaccaccgtcggagcggtcgtggtacgccaacagcgagccgctttcgctgagcgcctgcaccgcggcgaagaagccacgcagcagcgcggggtcctccacgtccgggctctccggccccacctgcccgtggacgtgcgccaccacggagccacccagccgctgcttcccgcgcgccaggtcgatgaagagcagccgcgtgtcgtccgccacgtccaccaactgcggcgtcagggacttgcgcacgtccagcaccggcgcgaacgcggagatgatgagcgacaccggcgacgtcacggccttgcgggcaccgccttcctcccagacggtgcgcatggacatggagtccttgcccacggggatggtgaggcccagcgcggggcatagctccatgccca

SEQ ID NO: 826 - DNA, 6799 bp, Myxococcus xanthus
tcatctcatggcgggtgagcgtgcccgtcttgtccgtacagatgacggtggtgctgcccaacgtctccaccgcgggcagcttgcggatgacggcgcgccgggcggccatgcgttgcactccaatggccagggcgatggtgacgatggcgggcagtccttctggaatggcggcgacagccagcgtaatcgccaccacgacggcctcgctcaccgcgtagccacgaaccaaccccacccccagcagcgcggcggagatcaccaggatgcccagggtgatgtacttgccgatgacggccagcgccttggtgagcggtgtctggaggtcggtggcctcgcggagcagcgtggagatgcggcccagctcggtggcctgcccggtggccaccaccaccgcggtggcagagccggacgtcaccagggtgccaccgaagagcaggctggcccggtcccccaactccgcctcctccggcacgggcgccacggccttttgcgcgggcacggactcgcccgtgagcgcggcctcctccaccgtgaggttgcgcgcggagagcagccgcatgtccgcgggcaccttgtcacccggcgccagctccatgacgtcgcccggcacgccctgcgccgcggggacccgcagcttgcggcccgcgcgaatcaccgtggcgttctccggcaccatgcggctgagcgactcaatggccttccccgcgcggtactcctgcacgaagccgatgagggtgttgagcaccaccaccgcggccaccaccagcccgtccgtcaccttccccatgatgacagccagcaccgcggaggcgatgagcacccagatgaaggggctgttcacctgccgccacagcagcttcagcgggccatccccctgggcgcgctccagcacgttgggcccatgacgcgacagccgctcgcgcgcttcctcgtccgtcagcccttcggccgtactcccgagcgacgtcagcacctggtccggtggcagcgcgtgccacgggggcttcgtgccagcaggcggcccggcgggcgctggtgcatccggtcgttcgggtgcggcgggctggtctttcatccggtggctccttccgatgcaatctggcaacggtcgcgcgcatctccacctgggcagtgggcgggtggacatcacacggccctccagggccattgctccggaccgagagggaaagaaaggcgcccgtgaagtcgggcccaggttgaatccccccacgaacttccgcacctcgaggacgcctttcattggcactgccactgcaatcactctgcaacgagcaatgggtccgggaggcgcaagtgattgtgaaacaaaggaggcttcactctcctcctgagacggtcgccctgaagcccgccgtgtcctccgggatgggagggaagcacttacggcccggaggacaggcgaatccactggcgctccgcatgtgagcgccgagccgcatccaacacccgttggttgcgccagccgtcctccagcgtggccgcgtcctccaccgaggcgcggccttcgcgcagggcctgcgtcagcgcaccggccaacagcaggaagccgcgcgcccactcgttgtctggcaggccgggtggaagcggcggttcctcgggaagcgctacccgctcccaggcacgtgcccccaccgtggagcgccacagctcgcggccctccacgcgcaggcccccgcgcgcgcaggacacctcgacgccgtgcacgggcttgccggaggacaccatcgacatctcgattgcggctgtcgtcgcaccgaagcggagcagcagccgcgcctcgtcgtcgctcgtcaccgggcgcgactgtcccgtgagcgcatcgggccgctcgggcgtgtgcgtggccagctcgcccagcacctcgtcgggctcggcgcccagcatgaagcgcagcgtgtccaccgcgtgcgagccgatggcgcccaggaggccgcctccttgcgacgcgtccgaccaccagtcccacggccgctccggcgaggcgcggttgtcgttgcgatagaagacacgcgcgccgcgcaccgcgcccagctcaccggaacgcagcagcgctcgcatccgctgccgcgcagggaggaagcgcagctcatggtccagcagcgccaggacacgccgctcacgggccgcgtgccacatggcctccgcttccctcgcatccaacgcggtgggcttctcacacagcaccgccttgcccgcctccagcgcggccagggtgatgtcccggtgcagcgcgggcggcgtggagatgcacacgcacgtcacatccggccgtgacaccacctcacgccaatccgtcgtcacatgtgacacgcccaactgccggcccgcctcctccaccttctcgcgccgcgcactggccaggctcaccacctccacgcccggcaatgcgcgcagcgcggggatttgcgtggtgcgcgcgaagcccgcgccaatgacacccattcgaaccgtgcgtgcagtggacatttctgtctcccttgaagcgatgacgcgacgcgcaggctgagttctggggggccccattgccaaggccctcaaattcaaagtatccaagaattcgcaggattcactgattcgccccctcccctgatgacttccagaaaccttcgttggaccgtggccgcaggcgtcttgctggtcgcggcggccgtggcgttgctgtggccacggactggcccctctcttcccggtgagcccgtattgaccgagcccaccgcctcggcggcctccggccctcgcggcacgcccggtgtcggcaccccaggcgccacgccctcggagcccgagcccgcggtggagcagatccccatgcctgggtgctgggacggcctgcatgccttcgacgcaacggtgtccatggactcgttccggaaggcgctgacgacggccatcggaaacggagaccggtacctggcggcatacctccaggagcggctgacggagctggtgggcaacgacgcggcccgcgcgctccaggtgttggagtgggccaagggcgccagcggaccggaactgggcatctacatggacgcactgaaggccgcgcccgcggtgcatgcgccgcaggtggcgcagagcctgatgaagctgggcgaggacccaggtgcgcctttgcagacgcgctccgccgcgctggacgcgctggagacgcaacggaagctggcgccgggagacatccagcgactcaagaagctggcgctggacgagacgctggactccaccgcatgggtggccacgcgcacgctgggccgggtgatgaaggaggactacgagcgcaccggcaccttcgagccctactggaaggagctcctggacatcggcggcacgtccgacgacatggccgtgcggctgctcgcgctggagatgccgtcgtattcgaaccccgtcatcggcgcggagtccttcgactcgctcaagcgcatcctctccagcgaccgcgagcgggacgtgcgggagatggcggccttccggctgggcgtcaccagcgagccggagaaggcgatggagatcctccgcgccgccttcctggccgaacatgacctctgcgtgcgctgggccatcttccgcttcgccgtgcgcgcgggtggcgacaaggcgctgccgatgctggagcagttcgccgcgaaggacccgcgcttcacgcaggactacctggagttccaagccctctacgcgtcgggcaccgtggacttcgcccgcatctggctgggcaagcgcgagcaccacaactgcctggtcgaagaaggagcgccgcactgatgtcccccctgtcgatgaagcgaatggggcgcgcggcgctcctggtggccctttcgtccctgactcccgtgacggcgcgcgccgaggcgacgctccgccccgcgcaatgcacggtgcagggcatgctggacgacgtgcgcgtggcgatgaagaacggctcccccgcgctgaagcgctacgtgaagatgcggttgaaggaagccgcgctcgccatgcccgcggagtcactgctggcggcattgcacggagaaagagacccggaggtgctggaggccctgggcgcggcgctggccaccaaggcgagcaacgcggagaaccccggcctcatccagccgctgctcgcccgggccaccggggatgcggacccggcgctgcgcgcggcggcggtgcggggcctgcgcggcgtgccctccgtcgagttcatggagaagaacggcggcgtggtgacgtacgagcagttggtgcgcgacgcgtcccccgaggtgcgcgcggcggtggcggacaacatcgtctccgagagcgcggacgtctacagcggccatgaccgccgggtgtcggaggcggcggtgtcggtggcgacggcgtcggaggacccggcggtggcggcgaagctgctgcgcgaggtctccatggaggccgtgggccacgaggcggtggagcaggtgacgcgccagctccgcgcggagaacccggagctgcgcgcggcggcggccacggcgctgggcggcgtgcccggcggtgcgtccgcgggcgcgcggggctcgctggtggacctgttccgcgaagacaaggacccggcggtgcgcaaggcggcgctccaggggattgcccggctggggcaggcccacgcggtgcccgtgctggagtccttgcgcggcgtggaccgcgccatggacgcggaaatcgacgcctgggtgtccgtcctgaagctcaacctccaggagtgggagctggtgctgcgcgagaagcagcgccgccggaggtgacccctgcttcaccgcagtacgcagcgctacaccaacgagggagtctcttgatgaagacgatgaagctgaccatggcgggcctggtgctcgccgccgcgggctgggccacctctgtcacggccgcgacggccgtgggtcccatctgtgacaccgccgcgcgcgtgggttccacgacgtactactcgtgctcgggcagcagccacaacgcgctcgacatgagcaacggcacctgcagcgtgtggaaccaccgcgggatgatcaacgtcagccgctactacgcctactacggcggctgtgcgaacaactgcagcggcggcacgagctgcaacggcggcgcgggtaactactacgtcgtcacgggcggcagcggctgggacttccgccagctccacctgaactccaacgtgtcgtcgggctccaagacgtgcgaccgctgcgcgctggggctcgtgggctccacgggtaactccacgggcgcgcacgtccacgcggacaaccgccagtacggcacgcgcaagacggcctggtacaccaccgtcggcaccacctgcggctccagcgcgtactgcagcaaccgcgtcggcacgcccacgctgtagtcgctccgcagcctgcttcacccacaccccgccccgtcccggtgccgcaatgcacctggacggggtttctcgtgccgaggcatggcccgcccatgaatgaacaccggcccgccccaagggacaccgcacattgactcggcacttcacatggccgcaccgtggagcagcccagcagtctcgcgttccatcccattcaggagcgtgcgcgccatgccttcgacctctccaggagcaggagtacgcggcatcgaccatgtcggcgtgacggtgccggacctcgaagcggcaacggccttcttcatcgaagcccttggcgccgaagtcctctacgacagcctggcgaaaggccagccgccccaggaaggcgaggacctgcaacggcgcctgcgcttcctccccggctccagcatccgcgcgatgcggctactccggctcggcaacggccccagcctcgagttgttcgaatacgcggcccccgagcagcgcccaccggcccgccccaacgacctgggcatccagcacctggcggtctacgtggacgacatggacacagcgctcgcgcgcttccaggcggcggggggcgaggtcttctcgagcccccacgaactgccagccctggagaaaggcccgggcaatgccttctgctacgcccgggccccctggggcaccatcatcgagttcatcacctacccgtcgccccagccctacgagaagcagaccgcgctgcggcgatggaaaccgccggagcgcgactgaacctccatcacagcgccgcgcggaccgccttcatcgcgccgtcgtagtccggctcgtgcgtcatctccgggacgatctcccggaacacgaccttgccctcacggtccaccacgaaggtgctgcgcgcgagcagccccagctccttcatgtacacgccgtacttctcaccgaactcgcggtccttgtagtccgacagcgtggtgacgttctggatgccctcggcgccgatgaagcgccccagcgcgaagggcaggtccagcgtgacgaaccacaccttcacgtccggccccagcgccgtggcttccttgttgaacgcgcgaagctgcgccgcgcacacccgcgtgtccacgctgggcgccacgctcaccaccaccacgctgcccttcacgtccgacagccgcacggcgtcgttgagccccttgaagacggtgaagtccggagcggcgtcgcccaccttcacctcgtcccccaccagcgtcaccggctgccccttgaacgtgacgatgcccttgtgctcggccatggaatgcctcctcctccggaaaggggcgcggactacttcaccagcaacgccgcgccaatcagaccgctgtcgtctcccaactccgcgtccgcgatgagcaggccctcgcgcgacgtggtggaggaccaggcgcgcacgcccttcttcacacgggg

SEQ ID NO: 827 - DNA, 7280 bp, Myxococcus xanthus
  unsure (1)..(7280): unsure at all n locations
aacatagtggtggaatgtagctgggtgcgggtgcgactgatgttccaaggactttctgtttcagcgtgtgtagatcgattatggtgggtcgaccatccctgagtggttgcaggcatgacttttatggccgttccatggagtgctgcgcgagcgtggtcagccgaaacggaagtatcagggcctggggttatggttgtacgtcgtgtagcaaatagtcacgtcgccctcaggctgggtgatcatgcggtagccgccatcctcgtggacatgtaccagcagaagggcaccgcgctgggcctgcgcaacgccatccgcttcttcctcggaattgaggtgcgcgccgtctcccccttcgcctcggacaccctcgtgctgggcgagtccgagctgggcgtggactgggtgctgggcccctcggagcgcttcgcccgctacgccttcaacgtcgaggtggagcgcctcctctcgactgcggagcgccagcgcctgcgcaccctcgtcgagtacctcaagcccgcgcatacccacttcatcgacttggtggagcccctgccacccattctccccgagcactgggagctgggactcagcgagttgggcgagacgacgacgctgcactgacgtccgcccggcatgtccccgatttctcgcgccatgcctttgcactccactggagggcgcaggcatgagcaaccggctggattttttcttcaggcaacgtgtcagcgaggccgagctggacttggccttcgcacagttggagcaggcggaccgaaacctcgcctcggacttgggcgtccacggcgtcatctccggggctgtgcccgcgccgcactcgccggtgcccaacctctccgtcgacctgacggccccggcgcgcgcctacgacaacctcgggcagcgcatcttcttcggcaccgggcagacggtggactgcgcggtggacgtctccggcatccccaccgacgtctccacctcgggcagcgagcggtgggtgggcatcttcctgcgcttcacccgtctgctgtccgagccgcgcacggacggcaactcccagcaggtgtacttccgccgcgacgagtccttcgagttggtggtgcgccaggcaccggagggccccgtcggacaggcgcccaagcccgccctccagcccgacgagttgctgctgtgtgacgtccggcgccgcccggggcagacgcagattctcgccgcggacttggatacctcccgccgccaggccttcatcttcgcccggggcacctccgtggccgtggagagcggcacctgngacgtcctgagccccagcgcggacacggtgcaggtcgacgttggacgaggtggatgccgagctggccggccacttctccggcgccgcccggaggcacgaggccagtgccgtggactatgcgccccacggcttcctcacctccaccaccgtgcaggaggccgtggacgaagtcgtcgacaagctctcctcggccgcagttggcacaccgggcgcctcccgcgtgggcgcggacccggtgcccggcaggcccaacctcctgccaacgggcacagtggacgcgcagctggcctcgctgctgggcttcctcaacacccaccagaggcgcggccaccggggcccaccacgccagcgccattggcaccacgccccacagctacgtcagcggcaccagcgtccaggcgcagctgcaggaggtcgtcacccgcctcggagagacaacggcaaacagccccggcgcctctcgcgtcggaggagacgcactggccgggacgccccacgccctccccgccagcagcctgcggcagcaggtggccgcgatgctgggcttcatcaacgggcacgtcacccagggcgcgggggcccacgccgcctccgccgtctccgtcgcggacgcgggcaacctgctgacggcaggcaccgtcgaagcggcgctcgcggaagtcctctcggccttcagcggcgggcacttccgcggcaacgaaacggcggtgggccagcacaaggccatcctccagcccgtcctgggtaccggccgtgtccttctcctcgacgcccaaggtgcgggcggcgccgccgcgcggctgcgcctctacgctgacagcgactcggtgtggttcaccctcaacgccgcatggaatgggagcgcctgggcccgggacaccaccggcgcggctgccgccggcttccgcctctcgcgcaacgaggcggagttcctccacgacgccagcctcaccgtcacattcacctcttggacgcgcacgttgcgactcccactgagtagcaccgccagcaacacttcattcgaggtggcgggcagcgtgcgcgaggtgggccggctcggcctccagtacagcaacagcgacaccgccgcgcacgacaacctggccgggggcggctcggtgacgttccgcagtcgctttcctggcgtgccctcctccatcaccctctccccctacgccttcgccggaagcttcgtcggcaatcccaccgtcatggtgccggacagagacggcttcgccttctacagccaccaaaccctcccaggcctcgcctcgacgtattggttcggctcgtacaccgccgtcgcgtaagggcgcgcccatggccatccacgaaatcaccgccgaggatgtacttcagcgctgcgcccggtgcggcagcggcaatcgcctctccctcgacaccctggaggtcggcgtcgcgcgtcgggaggacgtggacgacggcctcgtccagctccctccctgtcccgcctgccgctccaccgagtttctcatccgcgcgcccgagggtgagccggagcatccagcgccagggagcttcggccacctgcaccgactcctcgtcggccacgtccacgcggaactcgtcaagcgcgggcgcctgcacacggtgctcaagcccaaggggggcggcgccggcaaggtggtggtgcgtcccctgtcgcaggaggctcgcgagcgctggttcccccagggattgagaatcgaggtgccgcctggcgagcggcgcgcccaccccgaagcgtcaagccaagacacgcccagtacgtcctgacaccggacacaccgccaacgccctctggaggcacaattcctctcttctcgacttgctaccccgaaagaagagagcgtgtatgtccaacaccaacagcactcactacctcggagagcctcatgaaagtgaaacagctcattagcatcctcgcgaagctggacgccgacgcaaatgtctacgtcatgatgcagcagcacctccccttcgaatgcgtccttgccggcgtcgccgtccgcggcgatttcaccgccgaagggatgcagcacaacgaggggccacgcccaggggaagtgacggcgtcaaacgacgtcttcctcctcgaaggggaacaactccgacgcggcgacaaggcagcgtggaagtccccacgtcgcgcgtaacagcccagccctgcaacagcgtctggacggccagcgccgcgtccggacgccgctgtagtcgggacgaaggcgctcctgtcgctcggagtccctggcgcggctttcccaagcaggcgacttgctatcagcgcggagcagagcgtgtatgtcttcgcgcgctccccactgcgcgccaaggagacacccatggttatcggcactgacaccacctacctcggcaacgaaatccccggcctccgggggcagaaggtccgcatcttcgcggtgctgcgcggcggcctgcgccccgacgccaaccccgacgcggacgactactatgtgaatgacaacgagacgctggcgcacctcggaggcgtcacggccgaggactgcatcgacgccgccctcattctcccggacggcaccacctccttcgtgcatttcgacccgcgcgccatcgacttggagtgcttcgcgcacctgcgcaaatagcgacttgcattgcacctgaaacagagcgcgtatgcacgcacgcacgcacgcacgcgctcgcgagcaagcgcgccagaaaaagccatgacagacacccccgaggcgcgtagcgcctccgaagaacactccgaagagcaggccatccccccatcgcgcgatgcagcacttgagagaatcgccaacaggcacatgggcttcgacacgctgcggacgcgcatcggccccatcgacttccgcgaagtcgcggtgtgggaagtgaaggatgccctcgaagcggcctaccaagctgggctcgacgcagccggcagcactcgcgttgccgccccgaagcagctcgagagtcgtcgcaatcccagcgcacaatgacttgccatacgcgcgcaacagagcgtgtatgcctcacgcgcgccacccaagggcgcacggaaggatgaaacaatgacaccccgcaagccacgcaccacgaagcctgcccgggcgcccgaggcaaccctcgaacgcatcgcaagcgaaacgctcaacatcgaaacactgaagacacgcaacagcgacagcctcgactttcacgacgtgccggtgtggcgcctgaaggaggctctcgaagccgcctatcaggccggcctgagcgccgccagcaacccccgcagcaagtagcgcctcctctcaccacccacgccccgcccagcggggcaccagcgcatgagggccgccgggccgcccttgtgaatggcagacgtgtacccacggcccggaaaggaaaacaccaccatgccccgcaccaccgccccgaagacgaagaagctggagtccatgaatttgacggagctgcgcgcccgcttccgcgaagtggtgggcgaggagacgcgcagcccgaacaagacgtacctcatccgccgcatcgaggaatccctcgccgccaagaagcggcgcagcccctcccgccgggccacagccaccgcccccagcgcccctcctccggcccctgctgcaccggccaccacctcggccgagggcacgcagcccgctcgccagcgcgggcgcttcgcgggcatgtcgctgcagcaattgcaggagaagtaccgcgaagtcgtcgggcgtccgacgggcagcagcaacgtctcctacctccagtggaagattcgggaggcggaggctggacgaatcaacgtaggcccgcgtcccgagcgcgaggtgaaggtgcgcgaggacggcaagcgcgtcatccctctctccttcgacgcagaggccctggacgccctggacaaggcctggcgcgacgcgggcctgccgagccggacccgcttctttatgcgcgcggtgcaccgggaactcacggccatgggcgccacccaggccgccgagcacttcgctccgaaggccgaggagtagggcccagcatggcgacaaaggaacaagccaccgacgccctcgtgtcggtggcacttcgcaaggcgctcgcgggggcccgtgtggaggtgaagctggcccttcacagcagcggctgcgagctacagccggaagtcgaggtcgcattcccccagggcacctcctcacgccagcgcaacgcggcgctccaccttctagccgaacagggggagctgctcaccacgattcacgagcactggctcgtcgaatcggaggtcctcgacgacggccatagaggccgcatctatctggtgctgctcggtgtcggcgggccttggccgacgcgtgaagaggccagcgagggctgcaagtcctgcacagtgccctccgctgacatgggtatgcgggcggcggcacgagctgccgccctgaagggacgcagtcgatatgacacctgaagaagcaaagctcacgaagaagctgagagcccaagagtccgtccgacgcccaaccaaccctcgtcactgctgggcagttgtaaagaagcccagcaccggcagcgggtttgcgaggaatttcggcctgtacggcaactgcgaacaccgcccccggaagggcatgaggacctgcaccatccacagagacagagaagaggctgcacaggccttgggtggcatctgagccgctttcaatgggggacgtctgccccgccaccgttttctcttcaccaagccctcattcaacgcagcatcacgagaacaacatgaagacacgcagcgaattggacgcgatgactgtcaagcagctacgtcgctacgtcatcgaccgcggactcagcttcccctacctgggcgagagcaagaaggctgagatcatcaacaagctgattcagttccgagccgcgcgggaggacgaaacgtccgccccgccaaaggccgagttgcccggacccaagcaccacgctctggccacccccaccccagcgccgactcatccgttgtcaaaccccgcagcccgcggagtccacattccgctgtcgaaccccgccgcccccggagtccacattccgctgtcgaaccccgccgcccccggagtccacattccgctgtcgaaccccgccgcccccggagtccacattccgcacaccactggtgacgttgatgacctcttttccctctaccgcaggattgtccacgacaccgccatgagcgttgacgcgcgcgcgggctacctgacggctgtggttcgggtggacaagcgaatctccaggcgcctcgacagccagccgaacgaaacgttggtcgcgctcttccgggagcggttggcggccgaggatagccagcgcgtcaccgtccacccgctcgcggcccagagcttcgaggaggccgcgaaggagatgagcggcgcggacctcggcgccagcagcgacgagtaagcctcaaccaccaacaatgcgcgcggcgggccctctcgctcgccgcgcgccccgctccctggctcacgacatgaagacaagccacatcatctccgtcccgcagaaactcgggctgggcgtgcccaaccgccgcgcagccctgctctccgatgtcgaatccctcctcccccaccccattcgccccggcgattaccgtgtgacgattgagcggctggagagtccgagcgacgtccctgtctacgtggacgttgagggggccctgtttcgattcgccaaccaacgggcctgggcccggctcctcctccactgggtgcgcacacggaatcagggcgtccccaccgggatgctgaggcgcctggcggaacgaatccccatcatccacacctgcctgccgcggctggtggattggggcgccgaggacgcccaggccgccctgaacgaactgaggcacacggccatccgggagcgcttgcaccgcccgaaacaagggtgacatccctcacaccacccggatgcgcaaggggaagaggtctccacaaaggcatatccctccagaaccttagag

SEQ ID NO: 828 - DNA, 6890 bp, Myxococcus xanthus
gccgtctccgccacttcttccggcaagccggtgggggccgcccaggccgtgggcgttccggggtagggccgcagcgtcagtgtggcgagcggcaccggctcctctcgcccctccgccacggtgcgcccactcagcgtcacgccgtcgggcaggcgcagctcgacggccgtctccgcctcgccgagcggacgcgtggcctccagccgcacggggccgtggtccggggcatgcgcggacagcaggtagtcgccgggcgccgcgggcaggcggagcacgccgccatccgccgtggtgccctcgcccgcgcggcgccacggcgtggccccggtgccgtccgcgcccacccgcaggtaggccccgcacgcgcgcgcccgtcacgggcccctgggcgttcaccacgcgcaccacgaaggcgcccagctcggcgtcgggggcggtctccagcggcggggtgggcggcgtgctggcgcgggacggtgcgccgttggtgacgggcgctggcgcgttcaaggccgcggcctccgggcgcgcgccggcgggggccgcggggacgggcatgcggaaccacagcagcagcacagccgcgatggccaggcacaaggcaatcaagaagggggttcgatggcgcacgagctcggcctcccccgcgtccggccgtcgccgtcgcggctgcccacagtgtaggccagcctcgcagtgaaccgaaacttcaggagggcgcgggcgcgtagacgcgcagggccgcgggggccacctcgaagcgcatgggcgtcttgcccacgagctcgccgtccgcgttcacctcctggacgggggcggcctccacgtagagccgcgcggcgcgcagagcggtgacggcggggtgctccacgtgctcgcccgagcgcagggacagggccacccgcatcaacgtggcgatgtcctggagctggcccaggccggtgccttcgtgccccgacgcggcggagggcgcggcgatggcgtagatgtccagccgccggtcatccagccgggcatcgggcgccaccatgtttccggcgccgtggtagaggccgttgcccaccaccaactggagcacgtccagcgccagctcctggtcatccgccttcagccggatgtggaaggggcgcaggtccttcatctccgccgcggccgccacggggtaggccagcttgcccgcgcgctgcttcagccgcttcgtcagccgcttggcgatgccggtggccagtccgaggctggcggcgttgaggaaggggcgcccattggccaggcccacgtccacgcgggccgtgtagccctgggcgatgacgtcacaggcggcctcgatgtcgggcgggattcccagcgagcgcgcgaagtcgttgccagtgcccagcgggaggacgcccagcgtcacgtcgcggcccagcagccggaccaccgcgcggctcagggtgccgtcgcctcctcccacgatgaggcggcgggtgccccgtgccaccatccgttccaccaccgcgtccagccgatccgctcgggacagcgcgtggcattcgacgatggagacaccccgcgccacgagtgtttccctggcggtctcgaacgcctcacgccctgaacgcgagcgcgtattcaccaccaacaccgcggggccgtcattcaggacgggcctgcatgggggcttgatgagggcgggttccagggtgcctcctctttcgtgtcgcccgccaatttgtgcacgcactgcccgtccggccagcgggacgcgaggtggtgtcgtgcgcgcagcctcgccgcgagtcgccccgtgcttcggtgcattcccgatgtcgggtgccacgtgggcgtgcatgcgtgcgtcggcgggtgaacaagtccatccggctgcgcgcttccggatgggtgggtgactgctcacctctgcgctggagctggccccatgcaggtgtcagtcaggcctggagagcaagtcgcatggcacgaggaagcaaggcgaagtacacggcgaagcagaagcggatggccgagcacatcgaagagggctaccagaagcgcggcgtctccgacgagacggccgagtcccgggcctgggctaccgtgaacaagctcacgggcggcgggatgaagaagggcggctcgggcggcaaggccaaggtcgcgcgcagccgtcccctggcgcggaagaacgcgcgcaaggcgggccgcaagggaggcaaggccaccgccgcgaagcgcgccggcacccgtcgccgcgccgccaccggccgcacgcgcaagcccgctgctcgagccatgcgttcgggttccaagtccaccgccgcccggggcacctcggcccgtcgcgccaccgcccgtcgcacctccaccgcgaagcggcctgcttccaagtcccggagcggtacgcgtcgcggaaccagcagccgcggctcgcgcggacgcacccgtacctagcacgcggccgcttccccatccctctcgtggggtggggaagggcgggggcgcggcttcagcgccgctcgtcgtccttggccacctggctggtgccggactcgttccagggccattcgcgccgggacgcctcgtagcgcgcgagcagcgccgccgggtccttcaccagcgtgcggcagcccgcggcgcgcaggtcatccggagggaagccgcccgcgagcacgcccacggagggcaggctcgacttgttggcggcgagcgcgtcatagggcgtgtcgcccacgacgaccgtcacgtccggagagggcttgcccagccgcgccagggcggcctcgaagatgtccgggtggggcttgctcttgtccacctcgtccgcgcttgtcttcgtctcgaacaggccttcgatgccgcacagcttcacgtagtgcttcagctcctgctctttcgcgctggaggccagcacgatgcggatgccgcccgcgcgcagccgctggaagagctcccgtacgcgggggaagggacgcacccttcggcaggaactcgtccaggaacagcttgccgcggtattcgtccagctccttgccgaagcgctccacttcctcgtcattgaagaagacggggatgagctggtcggcgcccttgccaatctggctgcgcacgtgcgcgaacgggatgtcccggccgaagtgaaggaaggcgcgccgccatgcctcggcgtgctcgtccaccgaatccaccagggttccatccacgtcgaagatgacgttttccaccatgtgccttgtccctcggccccgaaggtggggatgccgagggtggcggtcaaccgtccgtgggctgggtggcgggggtggactccaccagtgtccgcgtctgtacgtcgtagccttcgggggcggtgagggtgaagccgtcgttgggcagggccgcgttcagctccacgcgcgtgagcaccgtctcacctacgcgcttgcctccctgccaccggccaaggcgcttgggcacgcacagcgacaaggccgcgtcacagtgctcctcctccacgcgctcctcggccgcggcgccgtccggtgagacggtgcgccggcccaggaagtccagctggggccagcgcagcacgtagaccatctccagtcccgcggcgtcaccgtccagcttctgcaccagctccaccgcctgcggcgccagcgggtgcgtggcgcggcggaccgtcgcatggctcagcaagagcggcgtccggaagccctccggcatgaaggggtggaacgtctccgacaggaagccggcgagcttcgcgggcggcagctccgaggtgaaggttgcgaagcgcttctccccatcgaactgctggaagaagtgcgcgccgtcccacgcgaaggtgcgcgaggcgggcgggcccagcgtgccacgcaggcgctgtggcgcgcggtattcgaaggtgaacgtcaccggctccagccccgcgtcctgcacggtgcctgcgatgcggtagctcttcagcttcgcttcgcgggtggcgagcccggctttgacttcgggcagcagcatggccgcgtcatcgccgcccttcttggggcagccggtgagggccgtcagggcacacaacaggaggaggcgttcacgcatgggagggcacaaaagcaagaaggcccgcctgtcgccagggggccttccgcatgaaccgcgcggcttgcgcggtgtggactacttgaccgccacgcccacggcgctggagctggtcacgccgatgatggtgccggtcagggcgtagatgccgtgacgcgcggtggtgcccgcggtcagcagctccaccttggaggcgcccatggccttggcctcggcgatgagcagcttgttgatgacggtgtcgaggtcgctctgcacgatgtcgacgatgtggaagatggcggtcaggcccagggcgttggcctgaacaacggccacggcctcaccgttggaggcgatcttcgtgccggagacaacggcgctctcaacgctggtgcaggcaaccatgctgctggcggaaacggcggacaggacgagcttcttcatgttctttcccctcttgaattggatgcttgtgtggcggccggacgccttggagagcaaccggccgttgtcttgagaccttcaagcgggcggggtcgtagcagatgtcgactccatgtcaaggtccgtccgagacacttggtatcgctccggttgggcggctgcgcgttgcaatgcacatctcctcttgctagccaacctcgaggctcccttcatggacaccgtctctgctgcccgccccgcgccgcgttactgggtgcacctgttgctcctggtgctgacggtagggaccaccttcacctcgtatctgctctacttccatttccagcggccctactcactgggagaggtgtcccccgaagcggccttccgcgcgctggccttcagcctgtcgctgctggccatcctggggacccacgagatggggcactacgtgttggcgcgctggcaccgggttgaaacatccctgccatatttcatcccgctgccggtgctcggcgtgggcacgctgggcgccgtcatccgcattcgcgaccgcatcccgaaccgcaacgccctggtggacattggcgcggcgggaccgctcgcggggttggtggtggccctgcccatcctcttctgggggttggctcactccaccgtggtggatgcgccggacatcccgtccaccctcttcccgggggacggctcgctgtgggtcattggccgggacgtcttcacttgggtgatggaccgcgtcaccaacgcgccgcccgcgccggagacgcctttcaacggcgtgcagacgctcttcggcgacagcctgttgatgcagggcctgacgcgcctggccttggggccgcttccggagggcaaggacatcctggtccatccggtggtcatcgctggctggttcgggctgctcgtcacgctgctgaacctgatgcccgtggggcagctcgacggcgggcacctggcctatgcgctgtggggccggcgcgcgcactgggtgggccgcgcggtggcgttggtgctgttggttctcacccttttcgtcaccgcgtcctggggcttgtggctcctggtgacgagcaagctggtaggcttcggccatcccgaggtggtggaaccccaggaaccgctcagtccactgcggaagtggatctgcgcgctgtgcctgctggcactcatcggctgcgccatgcccattcccctgcgccaggtgatgacatgaagttccagtgtgacgcgtgcgagcggctcgtgccgctggagacctaccggacggaggccgggggactcgtggtgacgtgtggccgctgtggcgcggacagccgcgtgggcccgccggccaccaccgcgccgcgaacggaggtgccggctgtcctcgccgcaggggcggcgccagcgccgttggtgccggtggcgccgccctccgacagttggagcgcttccgcgccagtgacgccggccctgcgggtggtgcgttcggagtcggcgccgctgacggacgacgcgctcttcgagccaccccctggcgtctgtcccaagtgcgtggcgcctcggcgcgaggaggccctgtcctgtccgcagtgcgggctcgtctacgtcaactaccagcccgaggagcaccccctgtcggacgtgctggcggacgcgtggcgcaagctggcggcgcgctgggaggactgggacgcccatgaccggctgatgacgctggcggtggggcggggcgagctggccatggtggggcggctgtatcggattcgcctggcgcgcgcgcccgacgatgccgtcgcccggcggggccgtgatgaggtggtgcgcaaggccaccctggtggtgccatcatcggtggagcccgccggaacccccaacgtcttccgacgcctgaagacggtggcggtgggtgtgggcttcatcgtggtgctggtgctggccgtgctcgtcttccagcacctgcgcacgctgagcgcggggtactgagggctgggctgtccgggcgccgtgccgccgagggcggtgcggctcgctggcggaggagcaggcggccccccgggccaggcggcgcgaccgcggccggaaacgcgcttgaaacggcggtcgctgctattttgtccggccgcttcccgtctccccctcggtgccgatgtcgctctccgtctccacccctccgtccgtcgacagcctgctcggtccgggaggcgcgctcgaggttgcgctgcccgcgtacgagcaccgcccagagcagcttcagatggcgcgcgccgtggagcgggccttcgccgagcacagctacctgctggccgaggcggggaccggcacgggcaagacgcttgcctacctggtgcccgcgctgctgtcgggacgccgggtggtcgtgtccacggccaccaagactttgcaggaccagatcttcttcaaggacctgccgc

SEQ ID NO: 829 - DNA, 6159 bp, Myxococcus xanthus
  unsure (1)..(6159): unsure at all n locations
gcgtacagggtgtggaagagcatcccctgttgcaggggcgagagcgggtagatgtcttcgatggcgtggtgtgacatcagtcagcccgtccggttcgttgagagggagacgccgcgagcagggcggcaatgtgagaggtaccgttctttcaatggcagttcaatccaggggacacgttccacgcctatgtatgggtggagcgtgcgccgcgcgcccacgccacgcgttcgtcgatgcggcgggtcaaccggtagagggctggactgaagcccatgcggggccaggcgcgggaggcggtcagattggtcgcgcgccaatcggtgacacaggcgcggaatcccattcgcccggcctcctccacgccacgcgcgaacagcgcacggccaacgccgcggcagcgaacgtcctcccgtgtgacccctaccgtgaaggtgacgctcttcggaggcgtcagcacttcgtcggggggctgttcggcagggctgaagatggcgaacccgagcagccgtccgtcctgctcagcgagccagatgcgatcggcttcgccctcaatcaactccgtgtagtcctgcggccagtctttggaaaactcgggcaggtacggcgcgaacaccggtgacgcgcgctggtgctcggagatgagcccccccatttccaggaagccgattcatattcgtncatggcccgcgcggagggacccggagggggctgtccaggacgccaggccggaggtccaccgggtccagggaacggagcgagtggacttgctcatgcccgaagccggcgccgtaccaggcctcgagtgcgggacgatcatgggcctggactaagcgcggcgtgaacgaagcagccttcctggacccactgcgcggccagggccgcatacaggtcgcggtacacctcggggctcgttcctggggcgagggcgtggccgggcgcgaacagccaggccgagcgcccccacgtggtgtcgatccgcagtgtcccgagggcgaagccgatgagtcgcccattctggagcgcggcgaagccgctcgtgcgaggtcgctgccggagcgcttccaggatccgccgcgcttcggtggctgactcgggctcacccggcaacagcgggagcgtggcccgatgggcgcggtgccgcagggcgagcagcgaggcggccgcttccaggtgctcgttcgcgaaggggaccaggttcatggtccgagcttgtcccgtcttccgcggacagtccatgttccctggaagccatgccgcggcctcactccacgggctgtgtcaacgccagacgcaccagtcgcatcgcttgttcgagcagctttgggtcgtcggatgggaagcggtaggggaaccggtagcgcgcgcgcagcgccgccacacgcccggcgatctgctccgtcggctgcgtctggaagattgccgcgacgaagagcccggcgagctcctccatgtcgtcggccatgagtccgtggtacgtgggctcgttcaggccgacccggaggaccggttcagggatgccgggcagcgatggataggcattggtgcggatgcccgcgtcgaacagccgctggctcgcggtgaacgcgtccacgccggaggcccgcgtccggatccagagctgatggccggccgagaagccacgttccttgccgtcaagcgccaacccgagacgatcgagcgcggcgccgaagcgccgggtattcaacaccacctgggcggcgtactgctcaccccggcagtgcttgaactcgagcagcgccaacgccaggctcaccgtcgccccgaagtggtggctgctcaccatgtactgctgggttgctcggaagcgctcgaagagctccctccggttggtggcgaagatggccttctgcggacccgggaaggtcttgtgggtggagccgccgaaggagtgggccccctccgtgagcggattgggaagctgacggccgagcaccagacccatccaatgacttgcgtcgatgtggagcagggtgttcggggcatctcgctggacggcccgcgccagccgttcgacgcccaggggaaacagcgcattggattgatcgatgtagacgagccccggctggtgggcccgcagcgtctctgcgaactgtgtctcgtccacggtgtgcgcgtcggggcccgtggcgtagcagaccttcaatcccagccgggcggcgacgctcgcggtcgcatagtgcccgccctgggcgcgggatagcagcatcaccgtggagccaggcgggcctccgagcgcggacagcgtcagggtcatcaggttcagcccggacagcgcgcgcacgttgacgaactcggcgccggccaactcgcgcagcagcggcctcgccagctcggtctccagcgaggacagctcttgtacgccccggaactcccagggctcctcttctgccccatcattgaaaaaatagcggtggtgtagatcgagcagcatcggcagcttggccagcgccgacatgctgttctcgctcggcaccatgttcagggtgcgcgcggcgcgtgtctcatgctgttcgaggcgggtcaggatctctgagatctgttccaggtccacggacgctccttgaggcagtggcccgcgagaccggcctccactgcgcaatcctaacgacatgtgtcaggcgcgggttcgcttgtggggctgcgagcggcacttgcatgactttcccatgatgggcacaatcctggactctcgcaggagttttccggatcaacgtccggatgcgcagacccacgtcgcgtgaacattccgtccagacggcagtgcgcttcagccattcccaggcgggcgcgcgggctgggtggggaagcgttcgaggcggtgaggaatgacgaggtcgacaccacaggtgggactctctcttggggccgcttcatccttcctgctgcatgagcaggtcgcggagcaggctcggcgcacgccggacgccatcgcaatctggtccgaagagggggaggtgtcctatggggagttggaggctcgtgccaaccggctcgcccaccacctgaggcggctcggggtggggcccgagtccatcgtggggctgcacgtcccgcgctccatcgacatggtggtctgtgtgcttgggatctggaaggcggcgggtgcctatcttccgctcgatccggagtaccccgccgagcgcctgcggctctccctggctgacgcgcgcgcggacgtgctggtgacctccggcgccgtggacgcgtggtgggagtggggcggccatcgtgtcgtcgatctccggcgggatgcggcccggatcgcttccgagcccgattccccgtccgacaacggactcaccgccgagcacctggcctacgtcatctacacgtcgggctctaccgggagcccgaagggcgtgatggtgacgcaccgggcggtggccaaccacttgcgctggcgtcaggcgacgtaccctcttggcgcggcagacgcgttcctgcaaaaggcctcgctgagctttgacatctcggtctgggagatcttcgcgccgttgatcgctggcgcgcgtctggtgctggcccggccgggtgggcagcgagatggaggctacctggccggcctgatcgcgcggcagggcgtgtccatcgcgcacttcggccccacgctgcttcggctggtgctggatgcgccggagctggagcgctgcacctcgctgcggcacgtcttctgtggtggcgaggtggtcccggtctccttgtgtgagcggttgctggcgcgggtgccggcgcggcttcaccaccaatatgggccgaccgaggcgaccatcgatgcctcctgctgggactgtgtcccgggggagacgcgctcctatgtcccgatgggagcgccggtggcgaatacgcggctccatgtcctggacgcgcgcggtcacctcgccgcgccgggtgaggtgggagaactcctcatcgggggcgtggggctggcgcgggggtacctccggcgcccggacctcaccgccgctgccttcgtcccggatccgttcagcgaggagccgggcgcgcggctgtatcgcacgggagatctcgtccgacggatgccggatgggacgctccagttccttggccgccgcgatcatcaggtcaaggtgcgtggctaccgtgtcgagttgggcgagatcgaggcggccctcttgggccaccccgggctccgcgaggcggtggtggtggtccgtggcgaaggggaggacgagcacagactggtggcctatgttgtcccggcgcggaatgccgtggagccgctcgaactcacggcgcttcgggcgttcctggagcggtccttgccggattacatggttccggcggtcttcatcccgttggacggactgccgctcaccccgacaggcaaggtggaccgcggcgcgctgcccgagccatcggagttcaaccgcctcgtgccatcgggccttcatgaggcgccgcgaggtgcgctggaggaaaggttgtctcggctctggggagaggtgctgcgcgtcgcgctcccggggcgccacgcgcacttcctggagctggggggagactccatcctcgctgtccggatcgctgcccgtctccgcgaggcgggttaccggtgccgcccctcccagctcttcagccatcccaccatcgcggaactggccggggggctgcgcgcggccttgcaggaactcccggacggagggaaagcctccgctgtcccggaggacgagtggccctcttctgccgcgtcagagccgtatccgctcacgcccatgcaggagggaatgctgttccacacgctgctcgcgcccggttcgcgcgtgtaccacgagcaactggagttcgaacttcgcggtccgctcgttccggagctcatcgagcgcgcctggtgcgaggtgggcgcccgtcatccggggctgcggatgcgcttccagtgggaggggctctccgctccacgccaggtcgaggcgcgggagttgccgccgatcgagtggtgggactggcgctcgcaggagtcgctcgcgttcgaggaacggcgcgagcgttttctcgccgaggatcgagcgcgcggtttcgcgctcacggatgcgccgccggtgcgcctgtcggtggtccagttggaggacgggcggtattgggccgtctggagcctgcaccacctcgtctttgatggctggagcgcggcgctcgttctgggcgaactcttcgccacgtacgcggcgctccgggctgggacccgtcgtgagctgcccccggcccgaccgtaccgggatttcgtgcgctggattcgctcgcgcgacttctccgcggaggctccgttctggagggaagcgctgggtcctggcgtctctccaacgccattgtttgcggaccgccggcccacccgccgcgtgccggagccggacgcggcgctgcggctgcggctcaacgccggacggaccgcccggctcaaggccctggcggtgcgtcaccgcatcacgctgaacacgcttctggcgggagcgtgggccgtgctcctgggtcgctacagtggccagcgcgaggtcacgtttgggctggcggtgtccgggcgttccatcgaactggacggagtggaaggcattgccgggttgctgctcaacacgttggccgtgcgggtggaggtgccctcccaggccactgccgacggctggctgcacacgctccaggctcggctcaccgagctccttgcgcacgagcagacacccctggccgatgtccagcggtggtgcgctggcaagcccggtgaggcgctcttcgagagcctgctcgtcttcgagaactaccccgcggaggcggcgtgctggagcccgccgggggccggactcgttgtcgagcgccgcttcggcgcggcgcgtgctccttatgcgctcacgctcaccgcgcgtccgggcgaggcgctcgaactctgggcctcctacgagcgtgaccggttcagcgacgaggtgatccaccggttgttgcggcacctggagcagtcactctgggcgctggcggagggaagctccaaggtgttggcgtcgctggagttgctgccggcggacgaactgtcggcgctgctggcgcgaggccgaggaccacgggtggcactaccggacgaggccgagctccccgccctgttcgaagcccaagccgcgcgcaccccggagacggtcctgagag

SEQ ID NO: 830 - DNA, 7846 bp, Myxococcus xanthus
cgcacgggccgccatcgaccaggtgcgcgcccgccacgccacaccggatgctccggccgtcacccggtgggagcgggagacgccggtccgcgtcgtggtgacggacgaatcgaacacgtccgcggtggaaccggaagtcgagcttccggatgccacacgcgacgagctccctcccagccgcaggggcccgctgtcgctggtgcctccgcccgccacggacgcgggtgagtcgtcctatcgggagtccttctctccggagtccggacggggtgagccagagggtatccgtcccctggcggagcgcgccgtgggggccctgtccctggcgcgtgacatcgctgggcaggccctggcgagcgagagtctggcccgggcgatgctcgcgatgggcggcctgaaggacatgctccgcgccggcctgggcactggcggtggcgcgaacctggacgagtacggcaaggacccatcgctcgtcgagcggctggagcccgtgctcgagttcctctattcgcagtactggcgcgtgtccgtgcagggcgtggaccacgtgccgccgggcgcggccatcctggtggccaaccattcgggcgccctgccctacgacgggctcgtcatgtccatggccctcacgcgtgagcgcccggacctgcgcgagccccgctggctggtggaagaccaggtcttccacgcaccgatgctgggcaccctcttcaatcggctcggcgccgtgcgggcctgcccggagaacgcgctgcggctcctggacgagcatcgtccgctggtcgtcttccccgaaggctaccaggcactcagcaagcccttcggcgagcgttaccggctgaagcgcttcggccgcggtggcttcgtgaagctggcggtgcgcaccggcgcgcccatcgtcccggtggccatcgtcggcgcggaggagacgtcgccgctgctgggccgcatccccgcctccttcctgggactgccctacgtgcccctcacgccgctgggccccctgcccctgccggccaagtggagcatccgtttcggcgaacccattggcgtcgaggacctcgcgcccgaggccgcggacgacctgggcgaggtccagcgcctcaccgagcgcacccgtgaggccatccagagcatgctccagtcactgctgcgcgagcgccgctccgtcttcgcgggctgaagcggaagcgcctggacaggcacttggtgggctggagactcagcccaccacgcggttgcggccggacgttttcgcatcgaagagcttctcgtcggcgtcgcgcaccagttcacctggctcgcggtggtgcggctccagcaccgcgagccccacggacaccgtgacgggaatcacctgccggtcgaactcgaagcgctgcttctccaccagccggcgcaccttctccgcgagctgacgcgtgccggacagcgacacctccggcagcaggatggcgaactcctcgccgccgtaacgcgcgaacacgtcctcacggcggatcttcgtgcgcaccgtggatgcgagctgcttgagcaccgagtcccccgccaggtgcccgtacttgtcgttcacggccttgaagtggtcgatgtccagcagcaccagcgacagcatccgctcgtagcggcggttccgcgaaatctcccggtccagctgctcgtcgaagtagcgccggttgtagatctgcgtgaggccgtccatcgtggtcagccggtagatttcgtcgtggtacgcggcctcgatgttcccgccggcgatgtacttgaagatggtgcggccaatcttcacgaggtcgccgttgcgcagctcgcgcaccccctccgccagttcgtcgttgacgaacgtgccgttggtggagcccaggtcgcggatgcgcacgccctcgcgcgaattggtgatgctcgcgtggttgcggctgaccgattcctggtcgatctggatgtccgccttggacgagcgcccgatgagcgtctcctcggacgtgaggtcgaacttgcgccccaggtccaagccgtagatcaccaccagcgccgcgtcgaggttgaccggccggtcggagatcttcgagatgaccgtgacgaccgtctccttctgcaccttgcctcccggaacgacaacgctaccacccggcaaatcacgaaagcgagccagcacgcgaaaacccaggcggatgttcccttacgcggagctcagggaatgtcgacctgccgggtcgcggtgacgagcggacgcagggggtcaccctccaggtccaccagggtggccaccagcgacacgcccagccccgagcactgcgccgggagctgcaactccacctcgccgcgtcccggtgcaatgggggcggaggcgaacagcgcctggtcgttgcaacccgagccgccccgcatgctgacgcgcacctggccttcgccgccggaacccgtgcccagccggaagccggagacgctcacccgcaccgcgctgcctcgggccagccgctgcccgtccgcctccggatggcgccacgtcacctccggccggcccacgctcagcgtggcgacggcatccgtcaggtccgcgagccgctccgcgcccaggccctctgaagccaccaggcgggacgggccctgccccacacgccggtccaggccccgcacgcgcagcgcctccacctggagcttcgcccgcgtcgcctgcaacacgccgtcgaagtcgaaggtgcggtcctcgaaccctggcggcggccggggaacgacgacgccgtcgtccgtatcgtccggatccatcaacaccgtccagcggcggccggcgcggttggtgaactcggcgcgcaccacgctggcccgcccgtccacctgggcctggaactcgcggccgacgagctcgccgcggggggccccatcgaagttgtagcgaacggactccggtagggagaggaagctcagccccgcgtccacgggctgcacgccgtccgggtcgaactccggcctgggcaggttcgccacgagcgtgctggtcgccaccgtgccgtcctcggcctggtcacctgatgtggcggacaccaccagccggtacggcaggccctccaggccccggtgcgtgggcgccatgcgcacgggcaccagcccgggccggcccagccgcgcatcggcgtccgtgttcggatcggccggcgccacgttggccgcggcgcccagccccagcggaaccatgcctcggccggggaccgccacggtggccagcacgtaggcgcggtccaggtgcgcgccccggtactgaggcagcggcggtacgcgcacggcgaaggggaacgacagccgcacgcccggcgtttcccgctcgaaaggcagcgcctgcgcgtactccgccgcacgggtgtccggctcgccggtgaggatgccgggcgtgggcgccagggtgaagcgggcgtcacgcgacagcgccgagaagaagcgcgtcgagccgggcaacaactgccccaattgcagcaacggatccgtccccggcgccatgaggttgagggggagttccttcagggggagctcgcccgtcagcgcccaggccgtccgcgtcccacaggcgcccgtgcgaatggccagctccgcatccaacacacccggaagcgagctgtcacacacacccgccacgcccggggccgcgacgtctggagccgtgctgcccgtcaaccacagtgcgctgcccgacggcagcgacaggcggtcctggcccgtgcccacggggagcgccacctcgtgctccgggcccaggaaggactcgggagccaggtcggtggggagcccgggcacggacaaccccatcagccccacgcgcagcgaaaccgccgtcgagaaggtctccgtcaacgtggggaatgggcccttcacgccgccgaagcggtccaaggggttgcggcgcagggccatccgcacgtcgcggaactggctcgcgtcgtggcgcgccagcgtcaggtagccgtagtcggagtggaaggcggagagcgccacctcgccttccgcgggcacccagacggctccgtcggcgttcgtcaccatcgccgcttccaggccgccgtcatcggcggacaccgcgacgacggccagcggcaccgggcgcccggtcagcgcatccaccaccagcacgcgcaccccacccggggctacttcggcgggcagcacggtgacgcgcgcatggcaggagacattgcccactcggaccgccagcgcctggtgctccgaggcgggctcgctcagcacgacagaggcctggtggccgcccccgcctccgaccacggagggagacagcacctcccatgccacgccgtcacgcaacaccaacggagcgcccgtcgattcgcgcacccacacgcggaagtccaccgtcatgcccggggtgcccacgacgacatccggcgtcacctcgcacgcgaccgcgcgggattcggacggcggcgagccacacgcgccgtctcggcacaccgtgcctgagtcacagtccgtgtcggcggcacagacaacgggcacgcaccggttcatgtcgcattggcagccagcgccgcctacctcgtcacacgcggccagtgcatgagggccccgccgcgccacgccgcaatcctcgcgcgtcaggcaggcgggctcgcagcgcgaggtggccgagtcacagaagaagagcgaggggtccgggcagtcctgatcgacggagcagtaagtcacctgtgggaacggacccacggggttgtcaggccccatgtccatgtcgccgcagccgctcaggtacaggaggacacaggccaggcaagccagcgcgaggggacggggggggtgactcatacgaatgcggctccggggggaccgtccgcgaccttacaggcaggacgcgcgctgcgcgacggtacgcggcgccggccgccgcccttcgagccccatcatagccggtccgcccgccgtgcgcccctcctccgcacgggatggttggctttcagggttaacagatcgatgatcgcctcctgatggctcgtagtgaacccaagtccctggaaagtctccttccccgcgtcctggcacggctggcgggagagtccggcaagggccacgcgctggcccccgtgtgggaggcggtggtcggtccgcacctcgcgcgccacaccaccccccaggccctgcacggaaccaccctggtggtggcggtgacgggcgcccagtgggcccagtcgctggagtccgaagcggcgtcgctctgcgagcagctcaacgcgcggctcggcccggacacggtgaagtccctctccttcacgttccaggtagcgcgccgatgatggccttgttgccgctcatcgccgtcctggccgccacaccgccggcgtcggccggaatggaacgcagcgccgcgcagcacgtcagccgcgaattcgagcgcgtgggacggcgcgccccggtggaagacccgaagctgaccaccgccgcgcggcggctggcacacgaggccctcaccgaatacaccaccggcgcgccgggcctcttcaccctcacctccgccgtcagcgacgcgggcgcggcggacccctcgcctcgcgcgctggtcatccgggcgtgggtgccacagcacgccgtcgagaccttcctcgaccgcgacgacttcaacagcgagcgcgcctcgcacttcggcgtgggagtgtccgtcctcggcaagcgcgcggcgctcgtcctgctgctggtggaccgcaaggcggagctccaggacttcccgcgcctcatcgccaacggcgagcgctcgaccatgacgctctgcggcgccctggtcccaccactgcggcgggcagaggtgtacgtcacccagccgaacggcggggtgagtctcatgcccgtccagaaccggggggcggggggcggcttctgcagccggctcgccttcgccacgccgggtacgtacaccgtggaggtggtgggacgcgcggacggcgggccggaggtggcggcgctcttcctggtggaccagggtgaaccccgcaagcacgccgccagcgaggacaccgccgagcccaccacgctggaggacgcccgccgggccgtctacgagcgcatcaacgccctccgccgcgctcacgcgttgcccgaactgtcccccgacgccgtgctggaacaggtggcccaggactacagcgcgcgcatgtcgaaggagggcttcttcgcccacatcgccccggacggctccacgctgacgaagcgcctgccagcgggcgcgcgctacgtgcgcgcgggagagaacctgggcctggcaccggggccgctggcggcccacttcggcatcgagcacagccctggacaccggcgcaacgtgctggacccgggcttccgcttcatgggcgtgggcgtggcgttccacacggtgaacgggcgccaggaggccgtcctcaccgaggtcttcaccgtcgccccgcccgcttcgccggagctggcggacccgcaacaggaggcctacgacgccctgagccggcggcgtgcgtcccgcaagctgccgcccctgacacgcaacgccgcgctcgagacactggcacgcgcccacgccaggcgcgcgctggagctggaccagccctccgcccagccgggtgaagccccggtgcacgaccgcgtcttcgaactgctgcccgacgcgggaacggcgtccgtggacttcttcgtggtgtcggaccccacggcgatcccggagtcccgcagcatggccgacgccacgaacaaccgcgtgggcgtaggcgtcgtgcggggagactcccgccgcttcggcacgaatcagtactgggtggccgtcatctacgcggccgtcccctgacgtcccgcacggagacgccgtgcgtggtggtgcccccggcgtgtgtggccaggggcatcaacgccatgaaccccgttcagacaggccggcgctgcgtggcgtaggcctcgagccccatctgcggcggcgccacctgctgatacatcggacacttcatgcaggtgaacgactgccaacctcgccggacggcttcatccaggcagttgtcatactgatgacagttgaggttgcggtgggtctcgacgccggctcgcttcggcccggcttcggggttgatggtttgtggcagatcggctggacacggcttcatgaagccctccctctgaactgtttcccccccgagcgctgtgaacgagcggtgctacctgacgacaacgactggacccgccatgcaacgacggaccggagtggcgctgagcggcggcgcaaggtagtgattcactccgggtgacgcaatgggtcggcagttcctacccaagtgcacgtaatcgccaggacgctttcagcgaatgacatcgggtgctgaacagtctggactgacccgatgccgcgcggatctaggacttgtcgcgcccgctgtcaaaccaccctccctgcggggcaaggggaatgatcggtgtgtgcgtctcgttggcaggccgcaaagccgcgtcgtgaaaggaagaccacatgagttggagtgggtgggttgcgggggtggttgcggggatgtcgctgggacaatcccccacggcgctggaggccgtccgcctccacaagccggatgcggccgccctggcgcgcgcggagctgacggcctgcgccgcgaagaagtgcgacgacgtgggacggctggcgctgctcgcggggacgctcgccctctctgacggtcaggccgccgaggcaagggaactgctggctgcctggcccgcccctccactgctggcgccgtaccacgccttctacctgggccaggcccgcttctacgccggggacgccgcgggcgcggccgaggacttgcgcgagtgctggaatccaaggcacccgcggaactcgcggctcgtc

SEQ ID NO: 831 - DNA, 6338 bp, Myxococcus xanthus
gcgactacatcgcctggctccagagccgggagatttcgcaggcggagacctggtggaagcaagcactgcgaggcttcggcgagcccacgcccctccccggtgaaacgggaggccaggcgcgcaccgctgcgcaggtcatgggcgagcgcaaggtccacgtgtccgccgaggtgacggagcagctccgcgccttctcgcggcggcaccaggtgacgctcagcacgctggtccaggcggcctgggccctggtgctcggacgtcatgcgggccaggacgacgtcgtcttcggcgtcaccgtcgcgggccgaccaccggagcttccgggcgtggaacagatggtgggcctgttcatcaacacactgccggcccgcgtgtcgctgttggcccaaagcaaggtggtggactggctgaaggcgctccaggcgtggcaggtggagcgggctccgttcgagtacgcgcctctggtgaatgtccagggctggagccccgtgccgcgtggcaccccgctcttcgagagcctcgtcgtcttcgagaactaccccgtggaggattcagtgcggcagggcgcgggcgcgctggaggtgcgcgacgtcaccgctcaggagcgcaccaactatccgctgacgctctccgcgcatgcggacaagcagctgatgctgaacctggacttcgagtctcctcgcctcggcgtggaagccatggagcggctgctggagcagatccagacggtcctggtgggcatcctcggcgcggaggacaagcacctgtgggagctgtcgctgctcacgcaggaggcccgtcgcgaggtgctgttcgactggaacgacacgcacgtgcctggactgggcgcgtgcctccacgaactcttcgaggcacaggcccagcggacgccggacgcggtcgccgtggtcgcgccggaggcgggctcgctcacatacgggcagctcgacgcgaaggcgaaccagctcgcgcaccacctgcgctcccggggcatcggccccgaggtgctggtgggcgtgtgcctggagcggacgccggagctgctggtagcgctgctgggcatcctcaaggcgggcggcgcctacgtcccgctcgatcccacctacccagccgagcgactcgcgcgcatggcctccgaggcccggctctccctgctgctcacccagcagtccctcgtggagaccttcgtcaacccggaggtgtcgctctacctgctggacacggaggcaccagcccgcgccgcgctgtccacccaggcccccacgcggctcaccacgctggacggtctggcgtacgtcgtcttcacctccggctccacgggcacgcccaagggcgtgatgatctcccaccggagctggaccaacgcgtacctcggctgggagcggagctatgggctgcgggagcactgccgcagccacctgcagatggccagcttctccttcgacgtgttcgcgggagacctgtcccgagcgctgtgctcgggcggcaagcttgtgctctgcccgcgggagtggctgctcgaaccgccccgcctgctcgcgctgatgaaggagcaggccgtggactgcgccgagttcgtccccgccgtgctgcgcgggctgctccagcacctggaggagacgggccagacgctggacttcatgcgcgtgctcgtggccggctccgacgcctggtacgtgaacgagtaccaccggctccaggccgtcatcggcgacgacacgcggctcatcaactcgtatggcgtcagcgaggcgaccatcgacagcacatggttcgaaagcggcgacctgggccccggcgacacgcaactggtccccattggccgtcccttcgccaacaaccgcctctacgtgctggatgcgcaccagcagccggtgcccgccggcatcgcgggcgagctcttcatcggcggcgagggcgtggcgcgcggctactgccaccgccccgacctgaccgcggagcgcttcgtccccgccccgttcgccaccgagcctggtgcgcggctctaccgcacgggagaccgggcgcggtacctgctgggaggcgacctggagttcctcggccgggcagacacgcaggtgaagctgcgcggcttccgcgtcgagctgggcgaaatcgagtccgcgctcggcaagcacccggccgtccagggcgcggtggtgctgctacgcgaggacccggggacgccccgccgcctcgtcgcctacgtggtgggctcagacatccgcgacacggcggtgctccgcgaccacctgagggagagacttcccgactacatggtgccggccgtcttcgtgcgcctggagtccatccccctgagtccgaacggcaaggtggaccgcaaggccttccctgcgccggacgcaactcagcgcacgggcgagcagcgggtcgtcgaaccgcgctcggagacggaggtgagtctgctcgcgctctggaaggacgtgctgggccaaacgtcgctgggcgtcacggacgacttcttcgacgtgggcgggcactcgctgctggccacgcagatcatctcgcgcaccaacgcgatgttccaggtgacgctgccgctgcgcgccctcttcgagcaccccaccatcgcagggatggcggagcaagtggtgctcgcgcagttggaaggcgtggacgaaaccgcgctggcctccgccatggaggaagtcggcgccctttcggacgcggacctggagaagctcctggaggggacgaatgagtgacctgctcaagaagctcgcgggcctctccccggagaagcgcgaggcggtgctcaagaagctgcgacagcagaacgtggtcgccgcgccgaaggaagaggcacgcacacccggcatcccgcgcgtctcacgggagcagccgctgccgctctccttcccgcagcgccggctctggttcctggaccagttcgagcccgggacacccgcttacaacatcccggagttcgtgcgcctcaccgggccgctccacgtcccctccctggagcgtgcgctgaacgaggtcatccggcgccatgaggtgctgcgcacgaccttcgtcgcgaaggacggcgaaccccagcagcgcatcctcccggagctgacgctgtcgctgggcgtgctggacctgagctacctgccaggccccaagcgcgatcccctgtgcgaggagctggcgattcagctcgcggggacgtccttcgacctcgcggcggggccgctgctccacgcgaggctggtgcgcatgggcgacgaggaccacgtcctcctgctcgtcgtgcaccacatcgtgtcggacggctggtccaccggcatcttcgtccaggagctgacggcgctttatgccgccttcgcccaggacaagccgtcaccgctgccggagctcccgctccagtacgcggacttcgcggcgtggcagcagcagtggatgcagggcgacgtgctggcgtcgcagctcgactactggcgccagcagctcgaagggagcgacagcgcgctcaagctgcccaccgacaggccgcgcccgcgcgtgcgcacctacgcgggtggcaagcagagcttccaggtcgcccctgccgtagcccagcaactgaagacgctggggactcaggagaaggcgtcgctctacatggtgctgctggcggcgatccagacgctgctccaccgctacacgcgcgagccgcgcatcagcgtcggcacgtacatcgcgaaccggaaccggacggaggtggagccgctcatcggcttcttcctcaacacactcgtcatgcgcacggggctcgaaggcaatcccaccttccgggagctgctgcggcgcgtggtggacgtgacgctgggggcttacgggcaccaggacatccccttcgaaaagctgctggaggagctggcgccgtcgcgcgacaccagccactcccccttcttccaggtgatgctggtgctccagaacacgcccacgcccccagccgagctgggcgcgctgcggatggagtctttcagcgtctccggtgaagccttcgcgcagttcgacctgacgctgtggttctccgaggaagccggtggcctgcaaggcatctgggagtacaaccgggacctcttcgacgcctccaccatcgagcggatggtcgcccacttccagacgctgctcgcgggcatcgccgcaaacccggcacagcggctcatcgagctgccggtgcttccggcgaatgagcgtcagcgcatcctgcatgactggaaccaggcccggctcgacgtaccgccgggcacgtgcatccatcacctcatcgaggcgcacgccgcgcgcacacccgatgccatcgccgtcaccgaccccggacgccggctcacctacgcacagttgaacgcgaaggccaatcaactggcgcaccacctgcgttccgtgggcgtggggcccgagcgaatcaccggcgtcttcctggaccgctccgtggacatggtggtcgcggtgctcgccgtgctcaaggcgggcggcgcctacgttccgctggatccgtcgtatccgccggagcgcacggcgctcatgctcgcggacagccggcccgcggtgctcatcactcgccagggcctggcgtccctcctctccgcgccgctgccgcccgtggtggccgtcgacacggacgcggacgccatcgccgcgagacccacgacgacgcccgagggcggcgcgagcccggagcacctcgcctacgtcgtctacacgtctggctccacgggccgccccaagggcgtgatgatttcgcaccagagcttcgccaacgcctacctcgcctgggagcgcgactaccggctgcccgcgctgcgcgcccacctccagatggcaagcttctccttcgacgtattctccggcgacctcgcccgggcgctcggtgcggggaagacgttggtgctttgcccgcgtgaatggctgctcgagcccgaaaagctctacggcttgatgcagcgagagcaggtggacagcggcgagttcgtccccgccgtggtccggctgctgatggggtacctccaggagaacaatctccggctggacttcatgcgcctgctcatcgtcggctcggacacctgggacatgcgcgagtaccaccagctccgcggcctgtgcggaccggacacgcggctggtgagttcctacggcctgagcgaagccaccatcgacagcacgtacttcgaacagcccgagcccacgcccagcgagcagatcgtccccattggccggcccttcgccaacacgcagatgtacctgctggacagcgcgatgcagccggtgcccatcggcatctcgggagaactcttcgtgggcggtgacgggctcgcgcgtggctactggggccagtcgaacctgaccgccgagcgcttcgtgcccaatcccttcagcgccacaccgggcgcccgcctgtaccgtacgggcgacctggcccgctacacggaggacggcaccctcgccttcatcggccgcaacgacacgcaggtgaagattcgcggccatcgcatcgaactggatgaaatcaaggcgaagctgctggagcacttctcggtccaggccgtggagctgctcgtccacgaggacgctggcaacaagcagctcgtcgcctacctcacgctcacgacgccagacgtggccacggccgatgacttgcggcagcacctcaagaagcacctgccgccgtacatggtgcccgcggccttcgtcatcctggccgccttcccgctcacccccaacggcaaggtggaccgcaaggccctgcccgcgccagagagcgtccgccgcgacgcgcaggacggcttcgtcgctccgcgcgacgaggtggagacccggctcgcggccatctgggaggagctgctggcagtgcgccccatcggcgtgcacgacaacttcttcgaccagggcggccattcactgctggccgtccggctgatggtgcgaatccgtgagcaattcggccgcgcccttccgctgtcggtcctcttccagaaccccgcgctggagcagctcgccaaggcgctccacgaagaggcgtcgcccgcgccatggtcgccgctggtgacgctccaaccgggagcaggccgccgcgccctgttctgcgtcccgggcgccggtggaaacgccgtctaccttcgcgagctggcccaggcactgggccccaccctgccggtgcatgccttccaggcacgcgggctggatggacgcgcggagccgcaccgctccgtcgaggagatggccgagtgctacatcgaagcgctcaagcaggtgcaaccgcaggggccataccacctgctgggccactccttcgggagctgggtcgccttcgagatggcgcagcagctccggaagcagggcgagtc

SEQ ID NO: 832 - DNA, 8352 bp, Myxococcus xanthus
cgtagcgcagcacctccaccgcgaggctcacgatgacgagcagggccgcgaaggtggtggtggcgacgacgacgacggccacctgcttgttgagcacgtcgaggacgtagagctggccgaagtacggcaggcccaggacgcgctccgcggcgaaggaaccggcgagcagcgacgtggccaccggccccacggcgtccagcatcgcgggccacacgttgggcaggacgtgacggcgcagcacggcggcgcgcgacaggcccttgcccagcgcggtgcgtacgtagtcgcgcgacagctccgcctccagcgagtcgcccacgagcgtgcccaggaagatgccgggccagatggacgttaccagcgccgcgcacagctccggcagcaggtgtccacgctccaccacgccaggcgcgagcagcagcgcggggatgaagacgggcgtgccgaacgccacggcgggcaccacgtcaccgagcgcggcccacgggcccttcctccaccgggtccgaagcaaggcaaagcccagggcccacgtgagcgagagtggcagcgccatcaagcccacgcctacgctgccagacagcttcgtcagcagctcatcgccggtgatgccctgggcgctcgtgcccagacgctcgccgcgaaagagcttctcccacgggcggaggaagcccagcggctcgccgatgcccaagtccctccggtacgaggccgcgagctcacgcgacacctgccgcttcgcgtccgtctccgtggtcagcggaagcgaggccatgaggaagtacgacgccacggccacgacaggcaccagaaccacctgccgcaacagtcgctgggcgatggccctcatggcccgcctcttgagtgcagaacgacgccatgagccactcgcgaagcacgcatgtgcccaaagccgccatgaataccgctgtcgctcacggcgactcccccgcccaaggcgcatccgacgccgcccccaagcgaagcgcgcgcagcgccaggaagttgaaggggtccacgtccagcccgcgaagccgcgagcgcgcgcggtaataacggtccgggtggtacaggggcgcaatcacggcctgttcccccacgagcacctcctgcgcctggacatatgacgcttgcgcagtcgccgcatccggcgcgctgtcccccgcctccagcagccgctcgaagcgcgccaggggctcgccgcccgcctgcgtctcccaccctgtctggtggttgccctcacgctcgaacagcgtgaagaacgtattcgggtgcgcgtagtccgcccccaggcgcctcaggtacaagtcatacgtgcgaggcccctgcgcggagcgccgggcaatctccgccgagaaatccgagcgcgcctccagcaccacccgcacccccacgcgcgcgagctgcgcggccacccgctccgcgatggccacctcgggaacgaatccatcccccgaccggtagacgagccgcaacggccgctcgacacccgccagctccgcccgagcctgctccggcgcatagcgcggcagccgcgcggcctgctccggcgtcgcggcccctggcagctccggcggaagcaacacatgagacggccgcgccgcgggcagcagtcccgccagcagcgcctcgcggtccagcgcccgggacagcgcgcgccgcacctcgggcctgtccagcggcgccttctccgtgttgaaggccaggaagtacgtggacagcaacggctcgcggcgcaagtcgtccggccggtggatgcgcagcgccgcggcgctgtccacgaagacgaagtccacccgctcccgctcgtacagcgccggaccgatttccgacttcatcagcgtgatgaccggaacgggcgtctccccttctgccatccgcggcggaaaggccgaagccgggttgtggaccagccgcacccgctcccccgcgcggtcccaccgctcgacgcggtagggccccagcgccagggggcggccatcgcgcggacggtcgaagtagtcccgaacctcctcatccgacttcccctcgaggtccgccgagggcgccggatagaacaggtacacattggccacgcgcgccaggaagtagctgcgcggccgagccagcgtcacccgaaccgtgtgcgcgtccacagcctccacgcccacgcgctccaacgcggcgcgaacctcggcctccggcgcgcctcgctcctggagcgccagcgcctcggaggccccctccaggtccgccatctccccgcgctcgcggccctgcagcgcgcgccgccagcccacgacgaagtcacgcgccaccagtggtgccccattcgaccagcgaacatcccgccgcaggtggaacgtgtagacatcccgcccctgcccgtccgtgacgcgctcccaccgctcggccagccccggctccacgccgtggtccggccccaactgcgtgagcccgcgctgggtggccagcatcaccgggtagttcgcccagctgtccgggtccgagtggctccaatccagcgtggtgggcatggccggcaccaccaccttcacgccgggctccggctggaagccgcacggtccacacgacgcggcccacacggccagcaggtaccaccaccaccggagtcgagcgcgcggagccaccaaggccccttctaccccgaaggtccaggcgccagaaaaggagaagccaggaacccggcgaccttggtcgtccggcgtcctggcttcccttcagctcggcccgacaggcgcggcggcccaccgggtgctgtctgtctccgctaggccggggccacggccggcgaggccggcagctccgtggtgccacccagcttgccgccgtccgtcgtcggcttgcggccgaactcctccggcttctccagcaccagcgcctcgcgcagcacgtcgtccacgaactccaccgggacgatgcgcagctgcttgcgaatcttcagcgggatgtccttcaggtccttcttgttcgccttcgggatgaggaccgtcttgatgcccgcccggtgcgcggccagcgtcttctccttcaagccgccaatggggagcacccgcccacgcagggtgatttcacccgtcatcgccacgtcgcggcggatgagcacgcgggtgagcgcgctcaccagtgcggtgcagatggtgacgccggcggacggacccgtccttcggaatcgcgccctccggcaagtgcacgtgcatgtcgtagttctcgaacaccttgcggtcgatgccgaagcgctcggcgcggctgcgcacgtaggacatggccgcctgcgcggactcctgcatcacctcacccagcttgccagtgatgatgagcttgcccttgcccggcatgatggtggcctcggtggtgaggatttcaccgcccagctccgtccacgccaggcccgtgacgatgcccacctgatcctcggcctccgccatgccgtaacggtagcggggcgtgcccaggaacttcatggccatcttccggtccacgtcgatgtcccgcttgccgttcttcagcacgtcgcgggcaatcttgcggaacacgccgccaatctcacgctcgagcgagcgcacgcccgactcccgcgtgtagcggtggatgatggtccgcagcgccgggtcggagatgtccaccttgaggtccgacagcccgttggcctcctgctccttcgggatgaggtatcggcgggcgatggagagcttctccggctccgtgtaccccgcgatgcgaatcacttccatgcggtcctgcagcggaccggggatgttgtgcatcgtgttcgcggtgcagatgaacatcaccttggacaggtcgtagtcgaggtccaggtagtggtcgttgaaggtgtggttctgctcggggtccagcacctccagcagcgccgcgctcggatcgccacggaagtccgtggacatcttgtcgatttcatcgagcaggaagacggggttgttgctgcccgccttcttcagcgactggatgagcttgcccggcatcgcgccgatgtacgtgcgccggtggccacgaatctccgcctcgtcacgaacgccgcccagcgacaggcgcacgaacttgcggccggtggcccgagcaatggagcgcgccagcgacgtcttgccgacgcccggaggaccgacgaagcacagcacggggcccttgagcttcttcaccagttgctgcacggccaggtactcgaggatgcgctccttcggcttcttcaagccgtagtggtcctcgttgagcaccgtctccgcctcagtgacgtccagacggtcctgcgtctcgtcgtaccaggggaggctgatgatccagtcgatgtagttgcggacgacggtggcctcggcgctcatcgggctcatcatccggagcttcttcagctccttcttgaccttgagcgtggcctccttgctcatccgcttgttcttcagcttctcttcaatctcctgaatctcgttcttgaactcgtcgcgctcacccagctccttctgaatggcctgcatctgctcattcaggtagtactccttctgggtcttctccatctgcttcttgacgcgcgtgcggatcttcttctccacctggagaatctcgatctcaccctgcatcagctcgtagagcttctccaggcgcttggccggggactccgtctcgagcagggcctgcttgtcgttcagcttcagggagaggtgcgcgacgatggtgtcggccagccgcgccgggtcgtcgatgctggccacctgcatcagcatctcaggcgggatgcgcttgttgagcttgacgaaggcctcgaagacggagtggacgctgcgaacgagcgcctccagctccaccgtcttctccgtctgctcctccacctcctccacctcgaccatgaagaaggcgtcgttggggtggaacttcttcaccttggcgcggcgcacgccttccaccagcaccttcaccgtgccgtcgggcagcgggaggagctggatgacgtggcccagcgtaccgaagtgaaagatgtcgtcgggggtagggtcgttcgtcttggccttcttctgcgcggccagcaggatgacggccttgtcgtccggccccttgtgcgccatcgcgtccttcaacgccgcgatggacttctcccggccgacgaacaacggcaccaccatgtgcgggaacacgatgatgtcccgaaggggcaagagcgggaccgtcaaaccccgcttctgggcttccttcttgtcgtcacgtccgaagaacatgtatccgccacctgcgggccctcggagttgcaggcccctagaagagttgcccgtctgctcgctcgccgagcattcgtacgggatgcagcagttctataacacggcgtttcgcggcgccgttccccggctcaagattggggaacggcgtcttgccatcaagggaacacccgaggctccctcgggcgtccgcttggggtgtcagcggccctgcgccgccaccccaccctgtgccccctggacatccaggacttggaacaggaacgaatacaggtccacgctggactcaatggccttggccacctgatccgcgccaccgtggcccgcgttggcctcgatgcgcagcagggccgtcgccgggtttccgggcgagttctgcaccgccgccacgaacttgcgggcgtgcatggggtccacccggtcgtcgtggtccgccgccatcatcagcagcgcggggtagcgcacgtccggccgcacgtggtggtagggcgagtaggcgtgcagcgtcttgaagtcctcgggcttctccgccgtgccgtactccggaatccaggtccggccgctgccgaagaggtggtagcgcaccatgtccagcaggggcaccgcgcacaccaccgcgccgtacagctccggccgctgcgtcatggccgcgcccaccagcaggccgccgttgctgccgccgtagatggccagccgcttgggctgcgtgtacttctgctggaccaagtactcggccgccgcgtggaagtcgtcgaagacgttctgcttcttgtccaggcggccggcgtcgtgccaggccttgccgtactcgccgccgccgcgcaggttggccaccgcgtacacgccgcccgcgtccagccagggcaggatgctcgagcggaagttggcctccatgttcacgttgaagccgccgtagccgtagagcagcgtgggcgcgttgccgtcacgcttcaggtccttgcggtgcaccacgaacatgggcaccttcgtcccgtccttggacgcgtagaagacctgctcgacctggtactgctccgggttcatgggcacgtccaccttggcccagagctcagacttcccggtgctgacggacgtcttgtagatttgacggggcgtggtgaaggacgtgaagacgtagtaggcgtcatccaggtcctccagccccatcaggttggacgccgcgcccacgcccggcagctgcaccgtgcgcaccggcttgcccttcagcgtggccacgcgcacctcggacgtcgcgtccttgaggtactccagcgacaggtgcccgccgacgatgctgacggacagcagggacgcggacgagtcctcggggacaatctccttccacgacgcgcgggccggcttcgccggatccacctcgaagacgcgctggcgcggggcgccctcgtcggtgaggacgtagaagcggtccttccaggcgtgcacctcgtacttggcgcccacgcccttcaccagcaggcggaagtccttctcacccggccgcttccagtagacgtcgttctcgctccagccgcggaggatgtagacgaacaggtacttgccgtcgcggctcaggtcgctctggaggaacgtcgtcgggtcgccggtgcgctcgtgcaccacggtgtccttcgacggctccgtgcccagcgtgtggtagcggatggtggtgtagccggggcgctcgtccaccttgatggacgggtccgtgggcagccactcgtaatagaagcccttgctgtcgggcgtccacttgggcgtggcgtacttgccgccctcgatgacgtccaccttggaccactcgccagagtccacgtcgatgacgtgcagcaccggctcatccgcggcgttgggcttctgggcgaaggccaccttcttgccgtcccaggacacggcccacgtccccagggacacggtgccgtccttgctccagccgttcggatccaacagcaccttctcctgcccgctctccccctggcgccagtagaggatggccttctccttgtccttgtgggtgcggacgtagaagaagcgcccgttgcggcgcgacggggtggagacggagtcggtgtagaacagctccttgaagcgcgcggccagggcctcacggccggggaacttcgccagcgcttcgcgggcgtgcgcgttctgcgccgtcatccacgtctggacctcgggggccttctcgtcctcgagccagcgatacgggtccgctacctggacgccgtgcaacgtgtcgacaacctgctccgcccgggtcgccgggtaggacatgcggggagactcctcggatacgggggccgcggaggctgccgcgggcagctcatcacgcgcggcctccttctgggaggcacacgccgcgagcgacatcaaggcgggaacgagcagctttctcatgggcccagcacatacagaaaggcccccggccgtcccacaaaaagtgtggcggggccaacgcaagcccggcccctcccctgacgaaagaggcgcgcccggaccacaccgggtggttccgtgacgcgccccgtcaaccagacaacaccgggcccctacgggccctggcgtcaggcggattccttcttcggctccgcggcttccttctccggctgggcgtgcagcaccaccggctcgctcttcttgagaatcacttcctcggagatgagcacctcgcgggccgtcttgcgggacgggatttcgtacatcacgtccagcatggccgactccaggatggagcgcaggccacgggcgcccgccttgcggcggatggcctcgttggcaatggccttgagggcgccgtcggtgaacttcagcgtcacgccgtccagttcgaagagcttgcggtactgcttggtgagcgcgttcttcggctggttgaggatgttgatgagggcagcctcatccagttcctccagcgcggtgatgatgggcaggcggccgatgaactccggaatcatgccgaacttcagcaggtcctccggctccacgtgcttgagcagctccgtgaggctgcgttgcttcttggactgcacgtccgcgccaaagcccaggctgcgaccgcccatgcgccgctcaatcacctggtccagcccgccgaaggcgccgccgcagatgacagagagatgttggtggtgtc

SEQ ID NO: 833 - DNA, 7000 bp, Myxococcus xanthus
tccagcaaagtccaccgtctccttccaatacaccctgagccgccccaagggctggcgtctgtatcagaagtaccagaactagcccgaggaccgaaccatgcctgccctgcctctgacgctgtgggcgctcgtcgcgtccgccaaggtgtctactgtcgtggtgtatccggaccgtgcacaggtcacgcgcgaagagaccgtgacctgcacaggccccacacgtgcccgattcgaggccgttcccctctccgccgtggccgacagcctccgggcccactccgacagtgccacggtggaagggctcatcaccgatgaacactcacgcgaggacgcccttcgcgaagagcgcacccggctggaggcacgccgagacacgctgctgcgtgagcgggctgccctgggcgatgcggcggcgcgagcgaacgctctccagacactcgcgagcggatacacggacgtcgccgtgtaccgcgtcacccatgagatgacgtacgcgaagcccgacacgcgcgcatgggcggccgccttcgactcggccatggccgtgaggcggcgcgcgatgaccgaggaccaggacgccatggcccgacagcgcgtgctggagaaacaactcaccgaggtagacaccgaactggagaaactccgaaccgcctccgaacaacgagagcgccacgtcgaggtgcgactctcctgtccccaaggcacccgggcccgcgtggcgctgacgtacctgatggggaacgccagttggacgccctcctacgaggctcgtgcgaacgacagtacccggacggtggaattgacgacgctggccacggtgcgccaatccaccggagaggactggtcggacgcgaagctggtgctgtccaccgcgcagccgcagcgggacgccacccttccagaaatccagccgctgtatgtcctggcggaagaacggccgaaggagcgtcaggtgctggtgcgccgcgacgagcagccacagcacgccaacgctggcggcacccccacggcgacggtcacgaagggactcgaagccatcccccaggggctgtccgtgcagttcgcggcacaggcgcgcgtgagcatccccggcgatggcaatgccgtgcggatacaggtggcacgaacccgattcaaagccgcgttcaactggcgcaccatccccaagctacaccccgtcgtcttccgcgtggcccgcttgaacaacgccgccgcgttcccgctgctgccaggtgatgtggacctctatcgtggcgcgggcttcatcggccgccagtcactggagcacgtggcgcaaggtgcccccttcgagctgaccttcggcgtggaagaaggcctgcgcgtggagcgccgcgtggtggaggaactccagcgccccaagggcctgttcaaggacacgcagcggttccgctacgcctaccagttcacgctgaacaacctccgcgggcacccggaagaagtggagatctccgagcactttcccgtgtccgaactgcaggacgtgaaggtggcgatggagccagagacgacggccggctacacgctccagtccagcgacggcatcgcaacctggaaggtgacgctggccccgggtgagaagcgcaccctggacttcgccttccacgtcgacgtcccctccagctacgaaacgaaggggctctgacgtcacgccggggcatcctgcccctctccggggcaatctgccccgcccagggtgggacacggcacacgcgtccccgagtgaggcaccgcccgcgtccgttggcacagcggatgctttgcgtgagcccaaggaagcacgccccgcccgtcccgacagccggcgagggctcgtgcggcaaacgccgccttccttgttgcagcactcgcggtacgttgtgagaacccacctccggtccgtgcgctccctccccctcgaggcgcacggaccggagcagcctctttcgaaccgcccgtgagactcgcccgcaagttcaccctcgccctcgtcctgctcgccatcgccgtcatggcgggcttgcagtacgtccaggtccgccgtgagctcgagcgctccgccctggacatgcagcatgaccaccggttgctcggccacacgctcgctggctccatcggcaaggcgtggcagctcgccggggagcgcgaggcgctcaccctgctccaccaggccaaccgcttccaggagcaggtccacctgcgctgggtgtggctcgatggcggccccggcaccccggccctcaccggcttcccgccgcgactgctctcgaccctgctccaaggcaaggacggctccatggtggaccccgccgtggaccccggcctgcttcattcgtacacgccggtgctcatcggcaaccggctgggcgccatcgaaatcaccgagtcgctgggcgaacagcagaagtacgtcaacaccgtggtcatgggcaccttcgccgccaccgccgccatggccatcggcttcatcgtggccgccatggccatgggccgccggctggtgggcgagccggtggaccagctcgtgtccctggcccaccgcatcggcgagggcgacctcaccgcccgtgtgccgctcccgcagcgccgcggcgacgagctcaccacgctggccggcgccatgaaccgcatgggcgagcaactggaggagacgcgctcgcgcctcgccacggagacggccgcgcgcctgtccgccgtggaccacctgcgtcacgcggaccggctcaccaccgtgggcaagctggcctccggcgtggcgcatgagctgggcaccccgctcaacgtcgtcatgggccgggcgaagatgatctcctccggcgaggcggagggcgaggaagtgggcgagtgcgcgcaaatcatctcgcagcaggcccagcacatgacggccatcatccgtcagctcctcgacttcgcgcggcggaggaagccgcaccgcgcgccggaagacgtgcagggcctggtcgaacgcaccctgtcgctgctgcgctccatggcggcgcgaaacagcgtcacgctggagacggacatccccgcgggactcacggtggaggtggacgcgggccaggtgcagcaggtgctcaccaacctggtgatgaacggtgtgcaggccatgaagcagccgggcacggtgcgcgtgcgcgcggcccacacccggagcaccccgcccccggacgtgggcggacccgaggcggacttcgtgcgcctggacgtggaggacgagggccagggaattcccgaggacgtgctggcccatctcttcgagcccttcttcaccaccaaggacgtgggagagggcaccggactgggcctgtctgtttcctatgggctcatgttggagcatgacggctggattgccgtgcgcagcgagcccggacgcggtagctgcttctccatctacctgccaaggggtgaagacacatgccaggccgcgtcctagtcgtcgaggacgagcgcgagatgcgcgcgatgttggagaaggggctcacgcgccggggcttcacgcccgtggcgctcccgtctgcggacgaggccctggtgcggctggccgccgaggacttcgacgtggtgctcaccgacctgcgcatgcccggcatggacgggctggcgctgtgcgagcgcatcgccctcaaccgcccggacatccccgtggtggtggtgacggccttcggcagcctggagacggcggtggccgccatccgcgccggcgcgtacgacttcgtcaccaagcccatcgacgtggacgcgctggtgctggtgctggagcgcgccgtgcagcaccgcgccctgcgtgaagaggtgcgcaggctgcgccaggagctgggccggcgcgaggacagtggcactgtggtgggtgagagccccgccatgaagcaggcctacgcgctcatcgaccgcgtggcggacctggactccacggtgctgattaccggcgagagcggcaccggcaaggaggtggcggcccgcgccgtccacacgcgcgggcgccgcaaggacgggcccttcgtcgccatcaactgcgcggccatgccggagaccctgttgcagagcgagctgttcggccacgccaagggcgccttcaccgacgccaaggccgcccgcaccggcctgttcgtccaggccaacggcggcaccctcttcctggacgaggtgggcgagctgcccctcacgctccagcacaagctgctgcgcgccctgcaggagcgcacggtgcgcccggtgggcggagacacggagctgcccttcgacgcgcgcatcgtcgccgccaccaaccgcgacctggagctggccgtggaggaggaccgcttccgcgaggacctctactaccggctcaacgtcatcggcgtggagctgccgccgctgcgcgcgcgcggcaacgacgtgctggccctgtcccagcgcttcatcgagcagttcgcctcgcgcaccgggaagcgggtgctgggcctgtcccccgcggcggcccagcggctgctcgcctacggctggccgggcaacgtgcgcgagctgcagaactgcctggagcgcgcggtggcgctcacctccttcgaggaaatcaccgtggacgacctgcccgagcgcgtccgcaactacagccagccgcgcgtggtgccggagacgcaagacgcctcggagctggtgacgctggagcagttggagcggcgctacatccaccgcgttctggaggcggtgggcggaagccgcacgctggcggcgcgcatcctcggggtggaccgcaagacgctgtaccgcaagctggagcgcgacgacgacacgcgcaagggctgacgtcagtccaccacgtccagacgcacctcgaagaggcggggccacagcttgcccgtcatgaagatgcggcccgagcccggctccacggcgatgccgttgagcaccgcctcgggattggtcacctgccccgccaccgcgcgcgtcagcgccgacgcgtcgatgacgcccaccaccgtgcccgtggcggggtcgatttccagtacgtccgagctgtgccagatgttggcgtagatgacgccgttggcgcactccagctcgttgatgagctccacgggctggccgcgcagcttcacctgcaccgcgcccaccagggcgaagccgtcgggctcgtggaaggtgagcatggtgccgccatcgctgcgcaccagcttcccgttccagtagcagaggccccagccctcccccgagtagcgcgtggtccgctcgcgctgcggcggcatgccgctccaggtgaagagcaggccttcggtccaggtgagctggtacaggcgctcgccgtcgctggccaggccctccgcgaagatgttccccagacgctccatccacaccggctgcgcgctctccagcgacagttgccgcagcgtcccctggtgcccggtgctctcgaagaggtgcccctggtggaataccagtccctgggtgaaggcattcgtcgcgtggggatactcacggatgatgtgcgccacgcgccgcacgggttcctgcacgctgcctcccgcatccggcaccggccggttcgtggggctgcaatggcacgccgcgcccagcgcgagcaaggacagcagcgaggatggaatccgcatgagacgcctcgagtgaagcggctcgtgcgacgcccaccgccccgcgcgagcctggacccaggcccgccagggtgcaagcacccaccccaccgcgtccatcggatttctcgccgggcccacgacaccgggcggacagtcggggcacgcgcgccgtgaaggctcagcgcggcggcggtaccagcatctccaccgcctcgcacaaatcctccatggcgaagggcttgttgagcacgcgcgccgcgccgagcagctccgcttcctggtggagctgcgcatcgccgaaggcggtgatgaggatgacaggcgtcgtccagccctcgcggcgcaggcgggccagcacctcgatgcccgaaaagccgggcatgcgcacgtcggtgacgatgaggtcggggacctgcgtctgctgcgcgagcaatccgtccaccagcgccttgaccagtcccggaccgtccggggcctccacgacgtcatacccgcgccgggacagcgcccgacgcagcaggctgcgcatctcgggttggtcctcccccaggaggatgcgcggagcgctgcggcgcgacacccactcacgcgtcgacagcggccactcccgcacctcgtcgctgaccgccgtgaattcgtctggccccatcaatggctgctccttgtggtgtggtgggcacgccccgcacctgggcccctccctcgcttcgggacggggcggcgccgggcgcccaacacatgagcatccgccgtgccacgccgtggcccctggagcgttgccccctgcccgcccgccagccagcccgcgggggctcgctcgccgcccatgcctgggccgccaggagccccaatccctgtcactcatataaggaggcgctccgcttctgggacaggcgcggcacacccggacagcgcgccggcctgggtgtggaacgctcctgacagggtccacacccgctgtatggcccgctggcgccccagaaactggggcggggcacgttgccccggggagaaatgccccaagccggggcagtttgccccgggatgatggggcacctggggcacgcacgggccgtggctccgaggcattccgagggcgagaagcgttggcccgccaactgcaatgcctcccagcatcggttcgggcgcggggctcacgcaagaaaccccatggcgatgaccgctgctgacgtcgggggacagtcggccgcagggcatcaccttccacccctccaaggtgggacctttctcgcgcaggcccctcgcctggaccggcattttccctctcgattggagaacgaacgatggcctgctcgctcccctcccgccgcttcctcagtgcgctggtccttcttcccgccgccacgcttggcgcttgtggccaagccattggcaccgcgtccgcggcatcgcccgctcccaccgcccaggtc

SEQ ID NO: 834 - DNA, 8450 bp, Myxococcus xanthus
agctctcagggtcgccgacgcgagcattgcgctctcctcgcagggacccaccatcatgattccccggacggcgctggtggagagcggaatgggcacctacgtcctgcgggtgcaggatggcgcggcgaagcgcgtgcctgtctcacgcggcatgcgtgccggcgagaaggtcgaggtattcggcgcgattgagactggagacgtgctcgtgttgaaggcgtcggaggagatgaaggacggaatggccgttgccggcggctgagctccgcccaggtcggcatgaatcgtcaactggccgggcaccggaagcggatgggcgggtgtgcataaaactgcacacccatcattcgtctctttgattggaatatttccaggaccgccatgtacaaccgcgcctgtcggcgggctgctcgctccaagcgagggaccgcaagacagcgcacacctcccgctggcggccgggcctctgggcactcattggacgaatcatgtcgatgagccgttcacccgcattgcctctattgctttgcctgaccgcgttgggatgctcggagccagagccatcttctccgactcccgacgcgggccctactccggatgcgggcccattacccgacgcgggccctactccggatgctggccccgctccggatgcggggccggacgaggacccggccctccaggtgcgcatccaacgcatgcgacgctaccactcgcccggcggagtcgagatgcgccccgaggacttcgagaagacgcccatctccctcttcgtcgcggacggaacctcgctgaacgaagttccggggagaatcggcggccctggagagttcatcttctcgaacgtgccggacggaacgtattacgtaaaggtgggcacggactacgtcgtcacccgcgctcgtgacgtggacctgagcatcaacctcatgggacgccccgatgttcggttgcaagacaggtcattcgcctatgtggacatcgcgctgactcacttggaaccctggcaatacagccccttcccaacgccacccgaggcgccgggctcctcgctggaaatcatgtccgaagaagttcccctctccgcgactctggcggtgtctgacggactcgccgagggccagacctcatggaacaactcgggtaggagttttgacaacgcggacactgttccagtcttcgaacgagaacgcggagataggatttgggtgcaccagtacgccccgcgacaggccgaggcgctgcccgatggcactccactcggatacagcgccatcgtgcgttccgctcagctggccccgctcgacttcgacggcacccacctgatgcccatccaaggaagcctccaagctgtgcccagcacgcattcactctccgtggactggaaggtctccgacttcaaggctctcgccgagcaaacgcatccaggcgcccaggcgcgtcctctcgtgctctccatcgtcaccaccatccccggggaagcggatgtgagggttcccacgaatgggcccatcctcgcggcgatgttgcgcccaccctccatggcggaggatgtccagaccaccctcgtctatggcaacccctatccctccagccgggatgtgctggttcgtgcttacgtgagccttcgcattccccgcgcccccggggcgaatcagtttttcaccaccggctcaattgcatgggtggaccgtgttgcgaacctctcgggccggcccattcgtccccttgtacaaccgccccgtgccttgatggtggatggggccgacggatacctcccgagaacgctcaccagcggacctcaggtcatctcctggcaggcgcctgcggacggcgcgcccgacggctatgtcgtgtcattcggagccccctctcgcgtgggtggcgaacgcatctacctcgccggggacgcgacctccgtcgtcattcctccggacctgcttccacccggcacctcctttctccacatcgacgcgattcgctcggaaggatatgcgcgctccggacagccaatgaccgcgtatgaccatgttccgagaggcagcgcgaccacggtcagcggagcgttgaccctccccaactccatccactgacgccagcgctcggcggagtcggcgctggtacatcctcaccgactccgttgaggcttactgttctgcttcgtctcaagcgcagtggggacggatggcatcaacggcttcaccctggagccgaagcgctggaacggcgacgacttcttcgagccccgcggcgtcagggtggtctccgagcgcctcgccagcctcgtcacagagtcggtcgctgcctcatgcgtgcgtccaagcccccctgggcagggcgtcatcgcgagtgaacgaggcgcgcacggtcatcattcacccccgggtcaacgctacgcgagcgcgactttgtacgtaggcaaagcatctgcctgtccgcgcgactgtcagggatgcgtcgtatgacttggcctgccgtcacgtgcgaggcatggacaagcaccaactccgtgctccagtgtgcgcggcaccaacgctcctgactcagggatgaaggcatgaagacgaagctcgccgcggtgacactggttgcatccctgctcgcgtcgtccgccgcgtgggccgcggtgacggtgcgctattacaaccgcgattcgcgcgaccactcgtggtccgtggtgtgtagcggcgtgaagacgtcggtgacgttcggcaagagccagacggcctccgtcaccatccagggctccgggccctgctccgtgaagacggacgcgggaaccgtggtcctcaagggcggtgaagacctggaaatcaaggacgggcgcatcctggtgaagtgagcgcctgcccgcccgacgtccgcagcttaggttaaatccggaccaatttaacctacctgagctcaaaataagaccagtccggattgaatctagcgcgagctcgccacatcctgcattgcgtcagtcttccgggtggaggcgcaatgaagaagtggttcgcgatggcccttctcgtgggtgtgggtgtgacggggttgctggtcgaaccggcggcgcagttgaagcaaggggggcccatcgacacctcggacacggcgtggatcctcacagccacggcgctggtcctgctgatgacgccgggactgtccttcttctacggcggcatggtgcggctgaagaacgtggtgtccacgctgctgcagagcttcatcgccatggcggtcatcagcctgatctgggtggtggtgggcttcagcctgtgcttcggcgacagcttccatgggctcatcggcgacccgcgaaccttcttcatgttcagcggcgtgggcggtgagacgcacccggacctggcacccaccatccccttgatgctgttcgcgctgttccagctcaagttcgccatcatcaccccggcgctcatcaccggcgcgttcgcggagcgcgtgcgcttcaaggcgtacgtgctcttcatggtgctcttcacgctcgtcatctacgcgccgctggcgcactggacgtggcacccggagggcttcctccgtcagtggggcgtgctcgacttcgcgggcggcacggtggtgcacatgtccgcgggcttcgcggcgctggctggcgcgctggtgctgggccgccgcaaggtgcacgtggagaacacgacgcacgcgcccgccaacatccccttcgtgatgctgggcacgggcatgctgtggttcggctggttcggcttcaacgcgggctcggcgatgtcggcctcgtcgctggccacgctggccttcgccaccaccaacacggcgtccgcggcggcgatgctgggatggattgccttcgactggctgcgcggccgcaagcccagcgccatgggcgcgtgcatcggcgcggtggtgggcctggtcgcggtgacgcccgcggccggcttcatcaccgtggggcagagcatcttcgtgggtctggtcgccagcttcgtgagcaacgcggcggtgcacttcaagaaccgcacccccgttgatgacacgctggacgtcttcccctgccacggactgggcggcgtggtgggcatggtgctgacgggcgtgctggccaaggacgtgggcctcatccacggcgagacgcgcaccttcatgatgcacatgctggcgctggtgctggtgtcggtgttctccttcgccggctcgttcctgctctacaagttggtggaccgcatcgtcccgctgcgcgtcacccgcgagcacgaggaagaaggcctggacctgagccagcacggcgagacggtgggcgagtccatcatcgcggccgcgccacagcccgcgctcaccgcgacgacggcggtcgccaccgagccagcgccggacgcatcccgcctgcctcagccagcctgaacgacaccgaagtcctgtgtcgcgtgccgccgctcggagtcccgggcggcggccccgttcgaagcctgagcagcctcagctgctcttcttcctcgccgcgggcgcgcgccccttgcgtgccgcggcccgggtgggcgcggtttccggcatggggcccgtcgagggcgtccccgtctccacggtgggcttctgccggcgcttcaaccggcgcggcggcagcaggtccggttcgccgggcaccttctgcgccatgaagatggcggcatccagcttgtagaagctccgcgtccggtaccacgtcagggcggactcgttgttctccgccacctccaggaccaggtgcgtacagccccgcgtccgggccaggtgctggagctgatccaacatgaagctgcccacgccccgcccctggtagtccgggtgcaccgccagctcctccacaaagagcggccgcatgccccgcttctcgaaccagcgggggttcacccagttgtcgtccccggtggcctcgaaggcgcactccgagtaaccgacgatgctgccgtccacctcatagaggagctgttcgatccactccgaggtgtagacctccaggcaatcgccgcttggagcgaggccgctggtattccaccgtctcccggttcacgtcccggaagacgagcttgaggaactcccaggtccggttcaggtcccgcctgtggatgcggcgcactcggacttcgagtgagtccgggggtttgggagtcttggccttcggcatacgcccgcctccttagcaggctgccggtgggacgcacagtctcgtcgcgtgctacgacccggctgggtgtactgcgacatcaggagggttgcctcatgggggggtgggaggatggaatgggcgaagtttccccggaatgccctgcctgagagtcccagccccatgaccctacccgctgacggtgacctccgcattgatgaggtcctgcggaatacgtacaggattgtctccctactgggacggggaggaatgggctcggtgtacctggcccaacacctgcggcttcccggcaagcaggtcgcggtcaaggtgctgcgtggcggcgaccacctgacgcccgaaatcttcgcgcgcttccgccgggaggcggagattgcctcgcggctgggccaccccaacatcgtcgaggtgctcgactacgacaccctggagaacggcaacccgttcctggtgctggagtacctgcgcggtgagagcctccaggagcgcctggcgcgcggacgcctgcccatggaggacgtggtctccttcacccggcagatgggctcggcgctccaggcggcgcacggcgcgggcgtcatccaccgcgacctcaagccagccaacgtgttcctggtgcccaccgactccggtggcgtggtgggcgagcgcgtgaagctgctcgacttcggcatctccaaggtcctcagctccacgacggtgcagacgcaggaggcgaccatcatcgggacgcctcagtacatgtcaccggagcaggcccaggggaagaaccgggacatcgacgcgcgcacggatgtcttcgcgctggggtgcatcgtctacgagatgatggccggcaaacccgtgttcggctcaggcagcctcgcccagatgatcttccgcgtcgtctatgagccgcccgaaccgctggccccgctctgtcccgaggccacgccggaggccatctccgcggtgatgcgcgcgctcgccaagggcgtggacgagcgctacccggacgtctcctccttcatcgaggacttgacgggcacgccgctgcactcgctgtccaccacggcgggcaatcagcccgccccgcgcccccaggccccggcgtccggaatcgcgctgccctccacggacccggcctcactctccgccaccgtcccgcccggaagcctgaaggtggcaccggacacgggccgcgagggcttcgattccacgatggcgcccggcaccggccagcagggcttcagtccatccaccacggggcagatgggcgtggcgcaggcgcagggcttcagtccatccgccacggggcagatgggcgtggcgcagttgtccgccgcatcgctcatcgacccgcctggcctggagcccacgctcatctcaaagcagcttccggccattcccgtgccggaacgccccgctcagcaccacacggccgtgagcgttcccgtgcccatcccgggcgccgccgaggccgatgccgccgccgcgctggtgtccgctccgtccacgccggtctcgccgccccctgcggcaaaggggcgcggtgcattcatcggcgccaccgcggcggtcctgctggcatccagcgtgggactcgtctggtggatgaagggtgggacctccggcacgggctcgcccacgacgcccgtggcagacgcccgcgcgccccaggacgcgcggcaggccaacggtgcgcagcagaccaacggccagcaggccaacggcacgcaggcaaacggcacgcaggcaaacggcacgcagcagacaaacggcactgagcaggccaacggcactgagcaggccaacggcactgagcaggccaacggcacgcagactccgccggacacagagaacccgcagcaggtggtggtggccactgtcaccccgcccgacaagccgacctctcgcccggtgacgcgtcccgagcccaaggaagaacttcccgagcaggtccgcaagctgttgaaggaaggagaaagcgcgttggcctcgggtgacgccagccgagccatcgcgctggcacgcagcagccagcgcacgaagcgctccatcgcggcgtattcgctgctcacccgcgcatactgccagcagaaggacctgggcggtgcggtcagcgagtggcccaaggtcgcgtcagcggagcgtgccaaggtcaagaagttctgccagaagcacgacatcgagctctgaaacagcgggccatccgggttggggggccctcatgcaacacgaggtgattcgcttgagaaacatggtcgcagtgattgtcacggcagtcgcgctgggggcgtcgcaggccctggccgccgcgccggtggaagctggcaaggtgtactccggtacggagggcgaagaggtggccgtggtgccgctcacgccccgttccgacaagaagttcatcctgcgcgtgaagggcacgggctcggagttcgacggcctggtgttcccctacgagcagaacgactggagcacccgcagcaccgagcagttcaactacagcacccagtggcacggccggaagtacacggccctgcacgtacgcgacacgaagtacgagctctacgtgcccggccgccagcgccccatccgcctggcctatgacgagaagaagaccgccgcgctgaagccggaggaggtctacgcgctgcaccagaagcagatgaaggacggcaccctggcgaagctgatggccttcgaccgcaagggcgaggagtccggccacaacaaggaatttgccgccaccctccaggagatgaacaacgcgtgtggcacgtccgtggccgcccgcatcgactggagcagcatcaacgaggaccagctcaaggagctgagcatctccagcttctgtggcaccccgctgaccagcctcaaggagctgtgcaccgcgtccgccatcgcgaagcagaccatccaggagaaggtgaagcaggtcagctgccgcttcggctccgcgttggaacccaagattgaagcggaccgcgtcatctggacgacctcccgcgacgcctccaatcaggacaagttcgccaccaagtacttcaagcagaacctgtagtcggagccttcacgatgcgattccagcgtttcgccttcgcggcgatgtctttcgcgtgtaccgccgccatggcggccgagcccatccagcccccctggggcaaggagtccaacctcggcgagaagatgatgttggaggccacgtcggtgtgcaccgacggcaagggccacttcgtggcgctcacgcccgacgacgaggacaccaacgccgtcctctactacggcgatgagaagcagttcgtccaggtgcctcgccccgggccctacacgt

SEQ ID NO: 835 - DNA, 6410 bp, Myxococcus xanthus
ggagcgcgtccccggccgggacttccccgccatcggcttccgctgggaggacttgccggagacgccgcacgagggcgcgggtgtgctccgactcgaatcggcgcgcgcctacgctgatcaatccaagctgtgcctctgctgcatgcggacgcggtccgcgctcacgctcgaacttcagtacgatcgaagcctcttcccactcgctgctgctgaacaagtgcttgggcagctcgaggcgctcctggagcagatcgccggctcaccgcgggcgcggttggatggcttggatgcggtgagcccacgcgagcgggcacggttgctggtggacttcaacgccacggaccgggagcacccggcgcgctgcgtccacacttggatggaagaacaggcctcacgccatccggaccgggtggcactcgtctacgaggagtgcacgctcacctacgcgcagctcgacgcgagggccaaccgggtggcgcacgcactccgccgccggggcgtgggtccggagatgcgtgtggggctgtacctcaaccgctcgctcgaaatcatggtgggaatcctggccgtcctgaagtctggcgcggcctacgtcccgctcgatccgggccaacccaggcaacggctcgccgggttgctcgacgacatccaggcgaaggtcctcctcacccagagacggttgcgcgaaaccgtccccgaggccgaggaccgcgaggtgctgtgcctcgacgaagagtccacgttcgccggagaacccaccagtgccccgcactgcggagcccttccggagcaccccgcgtacgtcctcttcacctccggctccaccggccggcccaagggcgtcgtcgtcgagcaccggcaactccacaactatgttgcgagcgtgatggagcggctggacctgcccgaaggcgctgcctacgccaccgtctccaccttctcggcggacctcggcaataccgtcatcttccccgcgctctgtctcggcggaaccctgcacgtcatctccgccgagcgcgtgtcggatccggcggccttcgtggagtacctccagcgcaacccgattgacgtgctcaagattgtgcccagccacctgcgcgcgctcgcgagcgctggcacggccggggcgcttctcccgcggcagcggctcatccttggcggcgaggcgacgcccctcgcgtgggccgaagaactgcaagcccaggcgcccgggtgccgtatctacaaccactacgggcccacggagacgacggtgggcgtgatgacgttccggctggagccgtcgcggcccttcgccgcgaacaacaccctcccgctcgagcgccccatcgacaacacccaggtctacgtgctcgacgcaaggctgcggccagtggcggtgggcatgaccggcgaactctacgtcggtggtgccgcgctcgcccgagggtacctgaaccgtccagacctgaccgcgcagtccttcctccccaatcccttcagcaccacgcctggcgcgaggatgtaccgaacaggggatctcgcccgccacctgcccgacggcaccctggagcacctcggccgggcggacaaccaggtgaagtaccacggctaccgcatcgagctgaacgagctgcgccacgcgctcaatcagcaccctcaggtgcgcgacagcgtgatgatgctgaaacgggacacgaacggtaacgaggtgctcgtcgcctactacgtctcgcgccaggagcaggagcacgctcaactccgagccttcctcgcggagcggctcatcgaggaggtgctcccgaacgtctacgtccatctgaagaagctgccgctcaccctgaatgggaaggtcaaccacgaggccctcccttccctggacgaggcgcggcggaggcaacgcagccaactcgtcgccccccggacgcccgtggaagccaccctggcggacatctggtgccaggtcctgaacctgaaggaggtgtcggtcaccgacaacttcttcagcgtcggcggggactcgatcctggggatcctcgtcgtttcgaaagccgaccaggcggggctcaagctgaccccgcggcagctcttcaagcaccagacaatcgccgagctggccagcgtcgcggcccaggcacctgcctctcccgacgccgaggggccggtgaccggccccctgccgctgacccagatccagcgctggttcctggagcaggaagtgccggacctggatggctggggcattgtcgtaccactcgaagcgcggcaacccctggacccgtccaggctccagcaggcattgaccgcgctgctgaatcaccacgacgtgctcaggctccgggtgacgcgcaatggctccggctgggaagccctcgtggccccgcctggcgcaccgatgccgttcactcggattgacctcgcatcggtccctgacgccttgctcaaggagcgattccaagcgctcgggcatgaactccaggcgaagctccggttggacgggggccccgtggtgacgaccgccctgctcgaactgggcccccaccgcccaagccggctgatgatcgccgcgcaccggctcgtggtggacggcgtttcctggcgcgtcctcttcgaacagctccagctcgcctatgagcagctcggaggaggcggcgaatgcaagctgccgcccaggaccacctcggtccgcgcatggctcgagcgcctccagggctacgcggaatcgccccggctgcgggaggaactcgcgcactggaccgctcagggaaaagagcaaccccggccgcttccagtggagcgcccggggcccctggttcccacgagcctggagcgagaactcacacacgccctgtcgtctgaagagagtcggctcctgctcaacgagctgcccgaggcgtaccggtgtgaaattggtgagctgctgatcgccaccctggcctggaccctgcacgagtggacgggtcatccggaagtgctgctcgacatcgaagggcacgggcgcgaggacgtcttcgaggacgtcgatctctcccggacggtgggctggctcacctcgctgtacccggtacggctcacgccggaacgggtggggcccagcgccaccgtgcggacggtgaaggagcagctccggtccgtgccgaaccggggcctgggctacggggtgctgcgctacctctcacccgacgcggagcttcgcgcccggttggcgcgagcgccccaggccgaggtgctcttccggtacgtggggcagtaccacctcgcgggtccgtggttcaccgtgctggaccacccggagcaacgggcgcccacgcgccagcacaagctggcggtgattgcccgcgtggcggacggtcagctccatgtcacctggtacttcagcagcgacatgcatgagaccgccaccgtggatcggctctctgctcggtacctggacacgctccggacgttgctcgcggagcgaggggttcccgagcggcaggtcctcgcgccttcagacttcccactggccgggttggaccagtcgaagttggacaagctcctgggcaagctcaagaagtagcgccgggtggtgtacctcttccggaggactcgccctccggaacgcgttgccggaagcatcctttccggtggcgcggtgaactcttaaactcgcgtgggcacggccgccgcggcggtggcgcctctcgcacggtacgacgtggcccctccatccccctcctcgtggtaccgcgcgcttcggccctggctgctcggattggggctcaccctggtggtcgtcgcgatccaggccgaagcgagccggacacccagtccccgcaccgcggacgcgccttccaccgagttctccgaagagcgtgcccagcgcgtcatgcggcacctggcagatggcatcggtcggcgcatccccggcacccccgcccaccgggaggccgccacctacctggccagcgtgctgcgcgagcttccgcgcctcgaggtcgagattcaggaggcggaggggcactatctcgatgacgacaccctcgtcgcctacaccgtccggaacgtggtggcccgcttgccgggacgcaggccggacgcggtgctcctctcggcccattacgacacctctcctgagggcgccggagcggcggacgacgcgctcggaatcgccgcgatggttgaggtcgcgcgcgcactcgcgaacggaccggagctcgagaacacggtcctcttcaacctcaatggggccgaggagtatggcctgctcggcgcggccggtttcatgcagcaccggtgggcgagccaggtccgcaccttcctgaacctcgaagccactgggctgggcggccgggccatcctcttccaggccgggccggacgcatcctggctcctggaggcctatgcccgggccgtgccccaaccgttcggcgacgtgctgggccaggacctcttccagtatcgactggttccggcgggcaccgacggccacgtgtaccgcagcgcgggcatctccggattggatctcgccctcttccgggacggctatgcggtgcactccccgttggatcgacccgagcgggtagaacccggaagccttcagcacatgggcgagagcgcgctggcagtgacacgcgagctcgccacacggccattcccggacgggaaaggctcgggcccgtccatctactacgacgtgctggggcgctggatgctccagtacggcgcccacgcggcgtgggcatgggccgcggccgccgcgctgctggtggccggcgccaccgtcctcgccacacggcggaaactcgtccgcctgtccgtggccgccgaggggctcggcttctgtacgctttcgctcgcggtggcgctggtggtgccggttgccttcggcttcctgccccactacgcattcgaacgcccacatggctggtacgcctcgccgtggctggccgtcgcgaccttcggcacgctcgctgtgacgggggcgctgctcccccgcgcgctgtgggcgcaaaggctggctgcccggggcgtggctccccaggagcgagtgttcacggcctggctcggagggctctggctgtgggtgctgacacttggcgcgttgcagctcctggggcttggcaccgcctacctggcgctgtggtggaccgtgggcggcgcgctcgggctcatcgccgccaccttcctcgcctcgcctcgcgctcggatgatggccctgtatgcgagctgggtgccgggcttgctgctgaccgtgcagatggggcgctccctgctggagctcttcgtcccggtggcgggccaccttcggctgggggtaccactcgatccactcgtggccctgctggcggcgctgccggtggccatggcgtccgtgctcggccttgcccccgtccaggagcagtctcgcttcggcccatcggccgcggccttcgccacggcgagcgtggccttcctggccgcgctgctcctgcgcttcccgtacacacacgaacggcccaagcggctctggctggagcaccgccttcaagagggccgcagtgagctgcagtactcgagctgggactttcccgatccgcgcgccgcgctctccgggcagcccgggcccctccagacggccgcgcggatgccgggctttcgcggtggttacaccgcgccagtgccgcccgcgaacctgcctgcaccccaggtcgacgtgctcgaatcacaggacgacgaaaccaccgcgctccgaaccgtgcggctgcgcctccaattgggcgcggcatacctcggccgggtgcggattccgcgggctgccctcgtgggatggtcgctcccggcccccctcccgccgctggcgcccgaggactcggtctatgtcctcgacgtgctcgcaccgccaggagggcactacgaggtctcgctgcgtctgagaggccaggaggaggtgccggtggacgtacaagccttcttcgcggaatggacgccgccgctcgaagaggcgcgttcgcggctccccgcgtggacgacagcgaacctgcgcgtctccacctacgccaccatccggctctgacccgcccggcttacgccttcacctggacgggcggcggggccttgtcacccgcccgaggaggcatgggatggggcttcggcgcatcagccctggcgccgcgccgctgcaattccgccgcgtgggccgcacggatgcgccgcgacgccaactcaggcgtgaaggcgggggccagtgagaggaaccggcccccctccaagcgctccccttcccggtacaacaagccctgctggttccacccctcgatgagctccgcaatctgctgcgcggtggccctgcccggctcgatgaactcctggttgagatcgtcccagcggcgtatctccgcgcagtacatgtagacatcgcgcgcgaggcccttgaacacgctggtccggagcacgccggtccgcgcatcgaa

SEQ ID NO: 836 - DNA, 6269 bp, Myxococcus xanthus
ggtccacgcgatgggcccgcgcgtaacgggcaatggacgagcggtacgccagcggccaggtggcctcccagatgggacgggacgcggcgctcagcggaccgtgcacctcctgcttcagcgaggtgcgcgccacctgccgcgcggcccgattgcggccggtgcgcttcagcgtctgatacagcagccgcgccggggcctcgggcagcgcgcgcgcatccacggcgaggaactcatccaccgcgccgggcagccccaggcgcatcagctccacgcccgcgttgaagcgcgcgtccttcgccagcgcgccgggcggcagcggccagatctcctcgggctcgcccacctcctccaccacttcgtccgccggggcgtcatcgcggccggagccgccggtgccctccatggcctcgggaggcacgggcttggggtacagccgcgccacgcgctccggtgagagcagcgcgagccgtgagcgggccagcatcccgtaccaggccgcggggcgctcggcggcgatgtgcgcgtacgcatcgagcgccgcctgcgccgaggcgccggactcctgcatgcgcgcacgccagtaccgcgagcgccacagcgcctcgtccgtgcgtgccgcctcgggcaggttctccaccgccttcagcgcggccagggccgccggggcgttggccttgcgggagtgcagccagaaggcacggaagagcgactccgacgcgaagttccccgccgggtagcgccgcgcggcctcttcgtagcgcgccagggccgtctccacgtcgcccgtgcgctggagcaaccacgcctcgaagaagagcgcgtcatccgcgtagccatgctccgggtagtcccgggcgagcatggcataggtggtgacggccgccttcggctccaccaccgactgggagtagcccaggatgtagagcgcctgcggccgctgctcggacgcggtgcagcccaccaccatgggctccagcgcctcgatggcccggcggtgcttgcgctccttgcgcagcgcccggccgtaggtgaggtgcgcgcggcaggccagctcgtccggcatctccaggtgcggcagcaccttgtccagcagcgccatgccggcatggttgcggtgcagctccaccagcgcctccgcgcggcgcacccgccacttgaggggcagcggcaaccccttcaaccgcttctcggcgcggcgcgcctcgttcgacagcggactggtggcccacacctccagcagcgcgcggtgctcggcgttgtactgcccttgcgcgcgcgccaggtcgcagatggccagcagcgccttcatccggagcgcgtccggccctcgcgactggcggctgtcgatgagctcctggagcgccgtcaacgcgcccggaatgtccccccgccgctggagcacccgcgacaggctgaagcgcgcctccgggtacagcggcgagcccgggctcacgccgcggtactgcccggcggccgtgtccagcttgcgcagccgctcgttggcctgggcggcccgcagcaggctgtggtcgcgcagcgcgccgtagccgtccgccagcgcggcgaactcctcggccgccaccgcgtggttgcgcgccagcagcgcgcactgcgccctgaggaagcgaacctgcggcgtggcctcctcatgggccagcaggctccgcgcccgcgcgtagcgcccgcgccggaactccgcgtgggcctttgccagggtgccttccacgaagtacggcgccaaccgctccggtccgaaggccgcggtggacagctcaccgtcggaaggctgcgccaccggtgagtcgagcagtgcttccaactggtcctcggaaagcacctcgccgggctcttcctccaggggcgcctgcgcccaggaaggacctgctcccagcatgcccgcgcacgccaggaacaccacggcacctgctcgaagtccgtccatgactgccctcgtcttgaatccaggggcggcaatgcatcggcactcggagtgcgattgggacgggtacctcacatgactttccgcgcgcccgtcatccagcggatacagcgcgccccgcggtgcgacaccggatgctcgatacccaacggcggcgcgcgcacgcacgtaggacgccctgcggccaggtggcggtttgcaccacccgggcccgcgcgcgctccggcagcggcgaatccagccccaaggacactaatgcaacacggttgcgcaacacaattacacgtgagatatggccagacgtgccgaagcagcctgaaggcttcgcgccatttcacccatgtgccgggaaccgtgatgcatcctcgacctcttcgactggccctcctggccgcgacggcgattctcttcgccgcatgcggcgcttctgattccgactccgacgaaatcgagtgtggaggatatggacacctccacggcgaccactgccactgcgacgagggctatgtcgcggacggcctcacctgtgtcatcgccgaggagcccgtcgaggaatgtggcggtcacggacacctccatggtgaccactgccactgcgacgagggctatgtcgcggacggcctcacctgtgtcatcgccgaggagcccgtcgaggaatgtggtggtcacggacacctccatggtgaccactgccactgcgacgagggctacaccgaacaggacggcacctgcgtcgtcgcccaggagcccacgctcgactgcggcgagcacggccacgcgcacggcgaccactgccactgtgacgcgggttacgtggagcagaacggcacgtgtgtcgcggagacgccagtactggactgcggcgagcacggccacgcgcacggcgaccactgccactgtgacgcgggttacgtggagcagaacggcacgtgcgccccggctcccgcgccgtgaggcgcccctgagctcgagctcatgaggccgtgacgggccctcgtgcggaatgacgcgggcccgttttcatgaaggcgcggctcagccctccaggtcgttgagcatcttgccgatgggcggcggctggccgctcatccgcgggaagaagttccgattgtccgggccctgctcgaacatgcgcaggctgcggttgttgcctgggcgcatgcccgaggagtcctggtgcagcggcagcccgtgctcggcgcgaatcatgttgtcgctgggcgcccagcccttgagcgggtgtcgggcgcggagcgttgggcctggccgcggtttcagttttttgagtcttgctggtgtccaccttcgggggcgcgctgttggagcaggaggtaggcgactccccgacaccagcgcatctcccgtgcctgtcgcagcgagtccgggcccgctgcgaaaaggacgtgatttcaacgagcgacgcctctctctgaagcctggtgggacaggctgcccggtgacgccgctcaccgacgggtgactagcgtcacccgtcaccaccactgccgcgtctggcggcgaatccgctccacgcggctccggacactgcggtggcccgaggccaggcacccgcaccgtctgccggccacacaccgcgacgcgacgctggcgtgcgggctggccttcggagcgctggaggtggccggcgggcgggacacccggggggagcgcctgcgtcggcagcagcggcacgagcttcctggattccaggccgtcatcgcgccacctccaggtgagaagggctgcacgcacctcgtgagggcttcgtcgccagttgcatggatggactccggggctcgcgtccaacagccgcgaaaggcaaccttcgtgcctttcaacggacagacgcaggtccctggttttcctggcggtaccggaacgagctgactgtgcgcgtgtgcaatggacgtcacaccgcgcgacgcgggtggcagagcgacacggcgacaatgggagacaatcactgctcacggcgtcgtcgcgcgcacagcctcacacgcgatgcgcttcaccccgtccgccagccgacgtcatccttcgactcgcggacgactggcaggatgacgggctaatcacgagattccaagctattcaggaagaagcggcggagccgtcggttctcagtagcggaaacgagggctcggccacatcttcaggaaaggcgggaacacacgcctttccaggtggcggaagggccacccgggcagccctcttcagacagggagggagtcccagaccaggggtgcgaggcgaggggcacccaccgctagatgaggtcgaggggcatcatcgtgcccgcttcgaactccggggcacggcgcagctggtccagcacccgcggcgcgcagcgcaggtggagcatgggcatggagcccggctcgctcaccgagcgcaccgcgcccaggagatggtgtgcctccagccagcgcatgaggctctggtggaactgcgcgctttcggccaggccggcctggtgcacttccgctcgggagcggacgggcggccgtggagacgtgcgtctacgcgacgccgccgccggctcctcgcggggcatcaccgtcacgtcaatccagtcgggctgcgtgtccgcacccgcggcgcccggcaatgggcgcacgcgcgcggacagacccgggacgccgccgacccggacgtccccccactcgccatttttcctgctcatggccctcatcctctcccgggtccggcgctcccatggcgccgaccccggattcaaccgccaccgtcacctgaatacggccaggcccttgcctgtcttgtgcgttcccgaccgagggagcttcaccgcattcgacaggatcaaatccctcacctcgagcgccgtcaagtcaggggcacggcaacggtacagcgccgcgatacccgctacataaggcgctgccatgctcgtgccactcattcgctcgtagaacgcctggttgttacaacgacgctccgtgctggaatagacattcaccccataccccatgatgtccggcacgacgcgcctacccacggtgccactcgcggagaatgtggccacgttacgctcgaagtcgaccgcgccgacagccagtgactctggaaaggcggctggataaccaaccgtgtcgggtccactgttacctgccgccacaaccggcaggacattgctgtcgagcaggcgacgaatcatcgtctgcagcgcgcgcaggttgaggttgtagtccgcctccgagatgccgggcggcggcatcagcgggaagccgagcgacaggttgaccaccgcgggccgcgtcgagttctccgggcggctgaactggtgcagcagccactccatgcccgcggccacgcggcccaggctggtgcggatggtctccgattcgataacggacgcgacgtagaggtccacctccggggcgacgccgtggtgcacacccgcggcaatgccgcacacgtgcgtaccgtggccgtccgggtcgaagccgcggatgtcacgcgccggattgtgcggcgagttggggaacagcgacacgtagcggaactggatgacgcgcgccgcgtgctcggggtggtccgcgtccacaccggtgtcgaggatgcccagcatgacgccggcgccgcggatgccctgggcgtgggccaggggaacgccgcactcgtcgggccactcgcgctcggccagcgaggacatgccccggttgcgcggtccgggttgtccagccgacaccgggccggggaaggacaacgggacgacgtcggggatgaactcgaagtcgcgttccagctcgccgcgggcttccttctccgtatggtcttcgtagaagtgagccatggtggcaccgatgagcggcatgtaccggtagctgccgggctccgcgccggtctgctcggccaccgtcgcgcccggcatgggcggcgtggaggagtccgcgccgcgcgtgcccgtgcgcgccgacttcgcgcccttgcccttccgacggcgctcttcctgtccactgacgggcggacgcgcgccgggcagcgtggccgaccgcagtccgagagcgaacaacgcgtcgggcgccttgttcgccaccgcgaagcgcagcgccgtcgtgcgcgacagcacgcgctcgccctgctccgtgccgcgaggccccacacgagcctgcgtctcgatggactcctttggaaccaacaggtaggacttcatgggttgtgtgctccttgaaccaccgtgctacgccggacgcatgaggcgaggtcatccggcatcaggtcagcacccgtcgcgtgcggagcctcgcgcgtgcgacaggggcaatggggccgcgctcgtggccgcgcgcctacgacagaggggggccct

SEQ ID NO: 837 - DNA, 6915 bp, Myxococcus xanthus
  unsure (1)..(6915): unsure at all n locations
gtcgttttgcagcaggttcaacaactgcagatcgatggcgtcgagctcgtctttaagttccataaataataagaatttgaaatctaatttcatccaactcttattgcgaaatattattccgaaatgagttgaaaaaataatcagaaatttcaaatcgctctgcgcaccatcgctgacattcgggggcgcagcacggccccatggttcagcagtcggaagattcggatctgcccccagtaggagcaatcaccatgtgcggcatcgtcggcgcggtttcccagcgcaacatcgttcccatcctcgtccagggcctgcagcgccttgagtaccgtggctatgactcctgcggcgtggccgtgcacgaggccagcatgggcaacaaccccatgggcggcctgcaccgcgcacgcagcacggcgcgcgtggccgagctgcaggcgcaggtcgatgccgaacatctgcagggcgcgaccggcatcgcccacacgcgctgggccacgcatggtgcgccggcggtgcacaacgcgcacccgcatttcagccacggccccaacgccgcgcctgccgagaccgaccgcgctggccgcgtcgcgctggtgcacaacggcatcatcgagaaccaccaggagctgcgccgcatgctgcaggcgcgtggctatgcgttctcgagccagaccgacaccgaggtcatcgcgcatctggtcgacagcctgtatgacggcgacctgttcgacgccgtgaaggcggccgtcgcgcaactgcacggggcctatgcgatcgcggtgatgcacaaggacgaaccgcaccgcgtggtcggcgcgcgcgccggatcgccgctggtgctgggcgtgggcgtgggcgagaacttcctcgcgagcgacgcgatggcgctggcgggcgtgaccgaccaggtcgtctatctgaaggagggcgatctcgtcgacctgcagcccggccgctactggctcgtcgatcacgacggccagcgattgagcgaggcacagcgccccgtgcgcaccgtacacgcacacagcggcgcggccgagctgggtccctaccgccactacatgcagaaggaaatcttcgagcagccacgtgcgatcgccgacacgctcgagggagtgcagggcatcgtgcccgagctgttcgacggccttgatgccgacggcaacacccgcacagccgcgtggcgcgtgttcaaggaaatcgactcggtgctgatcctcgcctgaggcaccagctaatacagcgcatgagcgtccaagaactggatggagtcctatcacgaagctcacagtgcaacgtggaagtcaccacagaataccgctaccgcaccagcgtgccgaacccgaagacgctggtagtcaccatcagtcaatccggcgaaacggcagacaccctggccgcgctgcgccatgcgcagagactgggcatgacgcacacgctcaccgtctgcaacgtggccaccagcgccatggtgcgcgaatgcgagctggcctacatcacgcgcgccggcgtcgagatcggcgtggcctccaccaaggcgttcaccacgcagttggcgggcctgttcctgctcacgctcgcgctcgcgcaatccaagggccacctgagccaggagcaggaagcgcaatacctcacctccatgcgccatctgcccgtcgcactgcaggccgtgctcgcactcgagccgcaggtcatcagctgggccgaagatttcgcgaagatggaaaatgcgctgttcctcgggcgcggcatccactacccgatcgcgctcgaaggcgcgctcaagctcaaggaaatcagctacatccacgccgaggcctaccccgcaggcgagctcaagcacggcccgctcgcgctggtcaccagcagcatgccggtggtcaccgtcgcgccgcacgacgagttgctcgaaaagctcaagaacaacatgcaggaagtgcgcgcgcgcggcggcgtgctctacgtgctggccgacggcgactcgcagatcgaaagcgaagacggcatccacgtgatccgcatgcccgagcactacggcgcgttgagcccgattttgcacgtcgtgccgctgcaactgctcgcctaccacacggccgtcgcacgcggcacggacgtggacaagccgcgcaatctggcgaagtctttgaccgtggagtgaggggctggagggagtgttcgacggtgctcccggcaaggtggcagtgacagcgccaaactgaagagccgccattgcgaccgttgacttcagagggatggggccctgttgagggggagggagggtgcagaggggccgaggagggccgcagtctggcgcctggagcgaagacgccttccggcaccagcgcatggtagtgaggcgttacttgcaaggccgagccgaaaaattgcgttcttcgtggggtcgagtgctaccgcacccagcccacgaagccctgaagctctggtcccacctgcgatgccggcacgtcgagccggatgctggaagcggagagcgcggtcagggtggggctgttctccaattggacgcgttccatcaccaggagcgaatcgaaggtgtccggccagcacacctcgcttgcctgggagcgcagcaggaccgtcgcggcgaggacgtgtgcgtcgtcgggtgagaacgcgaggaccatgagtccacccagtcccgttctcggctcgatgcccggtcgcgacgcgtcgaagttcgcctggaagagcgctggcgcgggcacacggtcgaaggcgcaggagcgaggctgtcctgagtaggtcgtgagataggccacggggtggtgctgcatccaggccacgtggcgcaggagtcgggtgtcgacctcggaaggggcatccaccttccttccatccagcaatgcggtgggaaccccggcttccggtgtcgatggcagcaggagcgtatgcaccccgtcggaggaaaccgcaccgcgcgcgtgcgcgtctcgtatgcctcttcctggctcgaattcgaagaagcggccgtccttcccgacctcggcggttgcctcacaggagagcagcgagaaggagacggtcccttgtgcgctccaccctcggggggtgagcatcccgtgcgttggactctcgaagagccgctccaccttgcccgaacccacctccaccgtgtggacctccgcgagcgggcagggccgcgactccggaccggttcgcgcgaaggactccagggagaatgcgatccgggcgccatccgaggaccagaggatggggcccgcgcggaacggccccggagtcagcgcgtgctcgcgaaggtccagcagcatgcgtcgacccgagccatccgaattgacgatccacaggagggcccatcggcccggggattcgtgctcctgcgcttccgggcgttcgacataggccacctggcgcccatcgggagagatggcgacgccgctccatcccagcccgtttccgtaggggcgggtggccaccacccgcccggtccgcgtcagtgcgtactcgctgtccccagcaggggtgcggacccacaagtcctgtttgcggacctgaagcagccagggccctccgcccacgcgcctggcgggcgaggcttcctgtccggggagggtttcatgggttcgcccgtcggtgagcagggatgggctccggcatcctccggcgaggagcaggagcaatgcggctgttctcaacccccttcgcaccttggattccagtctcaccgacggcctcgctgaccagggggaataggagcccccggtggacatcggacttgaaccgatgtccaccggggagggcccaccgtcgctcgccacggatggacccgtttacttcggagcacctaggggatgacggtgatgctcaggtccgcggtgttggtcgcatcattgatgtccaccgcgacccggtggcatccacgaaggtggtgatgatcccaatgctcagcggctgcaagaccaccgtcacggtcaagctggcgctcgcgcccaatgcccccagatcacagcctaccgccgaaccgttgcgttggcagcttccctgcgaggacgtcacagagacgaaggtcgccgcgtcggagctcgggcggcatggaatccgggtgaatgtggtggcccctggagccatccagacaccgctggcggagagtgtcggactcatcgaggtcatgggtcatgagttcctggctcgcacgccgctgggcaagccgtgtggaatgccgtcggatgtcgcgggcgtggtctccttcctgtgcggcgaggacgcggcgtggatcaccggggagaccctctccgtcgatggtggaaaccacatccgtggcctgcacagctactgggacatgctgagccgcgccgcgaagtagcagcgcggctctgagtcgcgcggctacatcacgagaagcagtcgaaggacaggctcataccccatcgggtccctgcggaggttggcgaccggtggcgagacctgcgcgtgcccaggccggcgtggacgaggcggcgctcggtccaccccggtgggctccctggtcagcggtcgtcgctgtcgcggcctgcggaggccggcactgccggggagacttcgaccctattgccggagagcacccacccacgctggctcggagcgaagcgcggcgcgaggtagccgtcgttgatctcccgggtcaccgcgaagcggttgtaggtcgtggccggaaggtagaggcacgagctgtcactgtccgtgcactcgtcgctcggcgtcgcagggaagcacttcgcgttgcaggtgtcgatgtcgccctcggccgcctggatgatgccgtcaccattcgtgtccgcgacggtgatcgccgccttgtaggccgccacgagccgctgctcgaggttggtcacacccggttggaaggagtcaagtcgctggaacacgttcaggaacacctcccgcgcgacgccgctcggaatgaagcgctggcggaactcgcgctgagagtcttcctctgcgtcgaagcggtccggatcgcgagggagggacgggttgtcgccgaactcgatggtccgctgcgggtccttgttgaggccgatccgattgcccggaacgatcgaggccttccggccgatcttgccttcctgatacgtggtcgccgggtccgtcgccgattggtcggggaagccgccggtgaagggcagttcgtagagggggtggatccagttggtcgtgtagttgaactcccagtactggtgtgcgtcggattgctggagcgagttgtacgcgcccatgctgagctggagcggcaccaggttcgtgacacggtccgggaagttgtcggaagcgctcggggggcggggctcctcgccatcgacggtgaagaagttgccgggcacgttgttgccacttcccatctgcgccagcagtgcggcgtcgttcggggtgatggtcccgtagatcgcgctgccgtcctggcccggctcgtggacttccgccacgcgcaggtcgtgaatcatccacccctcgtaccagccgctctcgttgttgatgacgaaaagacccgagatgtccgtgatgatgtcgatgaacgctcgcgggtcattcgggtcgaccgggagcccctgcttgggctccaggacgaggcgcaccgcagcaaccgtcggaagatcgcagttggcgcccgtggcggtgagcatcgccgtgttgttgacgcccgggatgagcgaggtgaagacgttgggctcgaagtcgttggtgtcgaggaggtagtactggaacagctgactcgggctatcggcctcggagtagaactggatgggaagcgtactgtggggtcgacacgcaagccgcgtgagctggttcttcagctgcgtcggcagcgacgccacgtccccgcgggtcatgaccgctgtcccatcggcgaggaagttcgggttgccgtggcactccgccgggtgctggggcgggttgccggggcgcggagcggcctcggtctcgcactctggcggcagcgagggggattgggaggaattggtacttgcctccgcgtcgtcgccgcccaccaaggtgctggcgaaccccagcaccgtgaggccggccgcggcccctccaatccacaaccgctttctcgtcttcatgccaccgctcctttcgaacgcgcatgcggggccgcagcggccccgggccttcgctagcaagacgctcgccagcaggcgcggatgaggagcgaggaggaggtcgtcgacgccgggtgccgctgccgtccctgcgtttggctcggggaggggaatcgggtcgccacggtagggcacgtgcggcagcacccgctccaccaggtgcaccgccgttggggtgcgcccactactccttcatcggtgagcagagctccaccaggacgccgttgaggtctctgacgtacgccaccgtctgtccccagggcttctgcttgggaggctgcgtggcctcggcgcccgcctccacggcgcgcgtgtacgctgcggccacgtcggcggtgacgagtgccagttcaatggccgcggcctcctccttcggtcgcagatggcgcacggtgaagccatgctccttcgccgcgccttcctcgacgaaggccagggcggtggtgcctgtctccatctccgcatagccaccgctctcatggatgaagcggcgcgccagcccgaaggccttctcgtagaacgcgatggtggcgctcacgtccggtacgtagaggatgatgtagccgagcttcatgggcggactcctgtcggtcagtagaacgtctgtgtgagcgcgtcgtcacacggatggcgcgagcgtgtcttgaagaaatcggacagggctcagtccacgagtgcggtgggggacacgccggccaattcccgcacgtctcgtgacagatgtgcctggtccgcancgcatgagaggaatggggccctgttgagggggagggagggtgcannagggctt

SEQ ID NO: 838 - DNA, 6851 bp, Myxococcus xanthus
agcatgccgatgctcatccccgcgtggtagcccgcactggagcgcaccccccacgccagcgacatgcccatgcccgtcagcgccagcgccgacagcaccatgacggacagcagcagcggcacgttcagcgtggccgcgctcacacccgccagcggcgccagcaacaggaacagcgacgcctgcagcagcgcgatggcggacgagcccagcgccttgcccagcaccaccgccagccgcgagcccggcccggcgagcaccgcctggaggaagccctccttgcggtcctcgatgacggtaatcgtcgcgaagatggcgctgaacagcagcaccatggtgacgacgcccgggaagaagaactgctggtagcccaagccctgcgcgccctccacgcggaaggagcccgcgaagccggagccgatgacgaaccagaagaggacgggctgcgcgagcgcgcccaccacccgggagggctggcggaagaagcggacgatgtcgcgcatcatcagcacccgcaccgtcgcccactggagcgcgagcgttccgggtggcgacgacacggccggagccccggcgttcatcggttcgggggcggcggacagctcggcgctcatcgacgtctcctcggcgcgggttcagcggtgggcacgtccgcgcccagcgcgcgccccgtcaattggaggaacacgtccgccagcgtgggccggcgcagcgcgacggaggtcagccgcccggcggggaaggcctccaccaatcggggcaccagcgcgtggccccgcggggcctccacctgcacccgcccctccaccaccttcgcgtccagcttcagccgctcgcgcagctcggtcgccagcgcctccggctcgagcgcctccacggagaggatgtccccacccatgcgcgaggccagcgcctgcggcgtgtcacacgccaccagcttgcccgcgtccaacaccgccagccggtcacagacgtcggcctcgtccgcgcggtgcgtggtgagcagtaccgtgaggccctcgctgtcgcgcaggcgcttcaggtgtgcccagaaggtacggaaggccgcctcatccaggccctgtgtgggctcgtccatgagcaggacgcgcggctggtgcaccagggcccgcgccagctccaggcgccggcgcatgccaccggaccacgtggacacccgttcgtcgccacggtcggccaggccgatgagcgacagcatcgcctccacccgttcgcgggcccgctctccgcccaggccatacagccgggcgccgagcatcaggttctcccgcgcggtcagcaggtcatccaggctgctgcgctggaagatgatgcccatctgccggcgcagcgacgggtcgctcagcgacagctcccggccctcgaagcgaacgaggcccgcatcgggggacagcagcccggccagcacctggaaggtggtggacttgccagcgccattggggcccagcaggcccagaatctcccccggccgcaccgacagggacaggccatccacggccgtgcgccccttgaagcgacgcgtgagcccctccaactggagcagcggctgagaggtggcagtggaaagcaggacttcgggcatgagcgggcgtcccccgttcgccccggacgctattcgcgaggaactcggtccagcgccagcgcggcgaacaggccggtgaggtagatgagtgagaagaagaacgtctggcgggcccaggtgtttcccagccgtcggaagaagccccacgcccccagcccgaggaagctcagccccaggagcaccgccgcggccaagtaccacgcgcctgcgatgtggagttggaagggctggagcgtcatcggaatcagcgccaccaggtagagcaccacctgcgcgcggctggactcgtcaccccgctccaggggcaccgacgtgaggcccgccgcccggtactcctccttgcggaagagcgcgatggcgatgaagtgcggcatctgccagaggaacatgatggcgaagagcgagaagccccccacgtccatctggttggtcaccgccgtccagcccatgagcggaggcagcgcgccgggcaccccgcccaccagcatggccgcggacgtgcgcgccttcagcggcgtgtaggccagcacatagctcagcagcgccaccaggcccagcgcggcggtgagcacgttggcgcccagggccagcgccggaagcgacacggccgccagggagatgccgaaccacagcgccaccgccggctccatgcgcccggagggcagcggccggttgcgggtgcggtccatgaactggtcgctgtgccgctcccagtagcagttgagggcattggccgcgcccacggttcccgccgtggccagcagcgtcaccagcgcgttgacggcgcccatgtggccgggcgccagccacatgccccccgccgcggtgacgagcaccagggaggagaggcgcggcttggtgagggagatcaggtcggacgcgactgtcggcaaggactcggcacgcgcgttcacacagactccagaggtaggcacgacagacacgctgccggcgcggtaacggccttccccatacaggcaccacccgggggtgggcaaggacacggcgcccccgggagactccggcggacggacgcccggctggcccccgtgagacaccagggcgacaccggactcccgccacccacccaggtgcgtcgggggagacaaacgccccgggcatagcgtcagggcgcgggggcagcaaccacgacaacggggctgaccgcgcgttcaactgcccgcgcgcatcagccccgcttgtccggcgcctggaaggcagccgtggtttttcagccgcccgccagcgaacgggccgcagacgcgtgctcgccgctcggttcgcgcttcaggtactcctgggccagcatcttcgccttcgccccctgcttcgagtccttcgagagcagcgtggcgtagaagtagtaggccggcgagtacgcctcatccgcgttgagggcgcgctggtaggtctcgtccgccttcgccgtgtcgcccttgctctggaacacgcgtcccagctcggtgagcgcaatggccgcgcggtccgactgccccaggaactcctggctcgccttctccaactgctcctgagccaggtcccacttggaccgctcgcggtagatggcgcccatggccagccgggcctccgggttcttggccttcgggtccttcaccgcgcgctggtactgggccagggcctcatccagcttgccctgacggcggtacgcgttgcccagcatcaccaccagcttcgggctgtcgcccatcgtcttcagggccgtctgcagcgcctcggcggcatccttctcgccgccctgcttgcccatgagcgacttggccagctcgacgtagaactgggcgcgcgaggcgtccatgcggatggccttgcgaatctcctccgccgccgcgtcgaagttgccctccgccagcaggcggcggcccttgatgaggtgcagctccgggttctgcttgtcgagcgagaagccggtctcctcactcttgagcatctccgtgcgggccttgtccttgtcctgggggacggcggtggcctcggccagcttctgctgcatgtccggcttcaggtccaccatggccgtcgacacgcggctgatgagcagcgagcgcgccatgtgcgccgcggccagctgccgcggagacggcggcgggtcggactccagcagcttcttgagcatggtgtgggccagctcgaagttgggcgagtcctgctccagcatcagcagggagcgtcccagcagcgactccgggtggtccttcccgtaccggagggcggagtcgtagttccgccaggcggcggcgtcctgccccaggcggcggtacaccgcgcccaggctcgcgtaggtacgagggtcatccggagacagcaactgcgcgcggtccagactgtcgcggccgcgctccaggtcgcccgcgttcatctggatgaggcccagcgtgaggtacagcaacgagctggagcggccctgcgcgtccaggcccttcaccttctcctccaactgccccagcgcgtccttgcccttgccgctgtaggtctggatgagcgcctcggacgcgatgaggtgcgagctgaggtcgccgctcttcttgcccacggccagatgctcctcggcctggcggcgcgcatcgtcaccaccgccgtgctcaccccaacggatggcccaggcgtaggcgaggtagccgtgcgccacggcggaatcggagtccacctccagcgcctggtccgccgcctcgacggcctttttgtagctgtcgaaggagtcgtgcttgagcagctcgctggccacatccaggctcttcttcagctcgcgagacttcgtgcgggcgttggccgagtaccagccatagccgatggcgaacagcgggatggccacgagcaggcccaacgtcaccatcttgctgcccttgccacccgaggagggggagcggcgggacaccggctcgtcgtcctcgtcctcatccacctcttccacgacgacctggggccgacgcggctgaggggcgggacgcggcgcgggggcctccgcgcgcgcggtgggcgcgggcttcgcggcctgggtggcggcgggcttcgccgcgggcgcttccgtccccgccgtcgccgcgacgctggagagcgcggaggcggactgctgggtggcggacggagccggcgtcgcgggcgcaaccggagcagcgggcgcggcgaccggagccggcgcggcgggccgcggcggttcaatcttgtgctgctggagcagcgtgacggtgtccgggtcgcccgggtccgcggtgtaggccttgagaaggttcgccttgccgggctccgcttcgccggtcttcagctgaagcgcgccggccatgcgcagcgcaaccttgtcttcaggctgcacctgaagggcgccgagcgcctcttccagtgccttcttgtccttgccctgctccgcatagacgcgggcgagcaggaggcgggggtccgccgcattcgggtgggccttcacccccttcttgcagacgaccatcgcctccatgaagcggcccatgctcaggtacgcttcagcgagaggcttgtaggccgccgacgaagggtcggaagcaaaggcgtgttcaagcttcgcgagctcggccgggctcaacgtcttcgaagaggagatagacattaacggggggcagctaaacgggcgggaaggatacgcctgacaagaagggtttttatggcacccggtacgcagcacgtcaatcgccggaatccatgttggcagcttgcgcttgacacggtgaagggcctccggtactagcccatcccacttcggcggccccaaaccgcggaggcgcagcaggcagtccagttgtgggggtgtagctcagttgggagagcgtcgcgttcgcaatgcgaaggtcgtcggttcgatcccgtccacctccaccatgcaacaaacgaagggcctcacgggaaaccgtgaggccctttgcatttggggcatcccggcgaactgccgaattgcaaagcatccgggctttgttatccggtgccgatgaccgaccagcccgcctctctgtcgttcttcgcccgcttctggctcgcctggctgtgcttctggcgctgcctcgtgtcccgcgagttcgcgcaggccgtgctgcccacgagcaaggcctatgacgccggccagctcgcccagcttccttcgggcggccccgcccccaccccgcttccgaagcaggaggaggtccggcccacgccccgagcgcccgagccgccccctgccctgccccccgagcgcgagcacgccagcgccctgtccttgctgggcatgctccagcgagagggccgcttcgtggacttcctccaggagaacgtctccgccttctccgacgcggaagtgggcgcggcggcgcgcatcgtccatgagggctgccgcaaggtggcccagacctacctgacgctggagcgggtgctgccccagtcggaaggggactcggtgccggtgcccgtcgggttcgacgcccagcgcatccgcctcaccggcaacgtggcgggccagccgccctacaacggaatcctgcgtcaccacggttggatgacgacggcggtgaagctgcccaccgtcagcccggccatcgacccgcgcgtgcttgctcccgcggaggtcgagctttcctgagccggccaccacgacctcacagcgcgaacaaacccgcgtcttccaggagttctcgtccgatatggcccgctattccattggcatcgacctgggcactacgcactccgcagcgtcctacttcaatctggaggagggcaagccccgcggcggcgcgcagtccatgctgcccgtcccccagttgaccgcgcccggcaccgtcgaggcccgcccgctgctcccctccttcctctatctcccctccgagcaggagttccccgccggcagcctggcgctgccgtggaagccggaggccagcaccctgatgggtgagttcgcccgcacgcacggcgccaaggtgcccacgcggctggtggcctccgccaagagctggctgtcccaccccggcgtggaccggcgcgcggcgctgctgccgtggcaggcccccgaggaggtgcaacgggtgtcgccgctagacgcctccgcgcgctacctccgccacctcaaggacgcgtgggaccacaccttcgcccgcgagcgcgaggagtccgacaacgccctggccgaacaggacgtcatcatcaccgtccccgcctccttcgacgcggcggcgcgcgacctgacgctggaggccgccaaggccgcgggcatccccaacatcaccctgctggaggagcc

SEQ ID NO: 839 - DNA, 5663 bp, Myxococcus xanthus
  unsure (1)..(5663): unsure at all n locations
ggtgttcgcgctggacggccccgtgcccggggctggcgtgaagggcagcaccggaatctgcgcggcttgcggggtgggacgctgcgccggacgcgcgggcgcttcggcctgcggcatgttcagtcgcagcggtgcccggacgaaggcgggaggccctggcggcggaaggggttcagggcccggcgtgagggcttccggcggaggcgggggcggccgctgggggctcgcgggggcctcgggacggggggccgcggcctggggcgcggcgctggtctccacggcgaggggctcttgcgcgacggagcgagccaaccgctccaccatgtccgcggtgagcgactcctcttccgtggccgcggcgggcggcggtggcggcgtggtggccgcctgggcttccggatccaacgccgccgcgagcttcgcgaagcgcagggccaggggctggcggtagatggtggagacccactcgcggacgcgcacctcggtcgccacccagagctcgagcggcttgcccaggaggaagccgacctcgtcgagctccttcttgggcaccgggtagccgctggcgacgtgcagcgtgttcccgtccagggacagggggacgacgcacaggcgctcggcgattttgggcgggatgaaggaggcgacttcgggattgggctcgaagtccatcaggttcaccggcatgaagccggagacctctccgagcatcgcgagcacgtccgcctcgctggcgacgccctgctccaacagcacggagtccacctgcccgcccagggtctggtgctgacgcagcacctcccccgccctctcctgcgtgagaagcatgcgtgagacgaggaactgggcgagacgggcgggcatgtaggacgcggcatcttacggccacggccgcaaggcacaatgagccggtggttcagctcggttgaacgacgaaggtggacgtcagcttgtcatgaagcgtctgcccgcgccggtcgaaaagcgccatccagaagccaccaaggaagaagacgaaggacacgccggaaagcagggcgcgcacgatggctcgtcccggtgccggggcgatcccatgtgtgtccaccagccgcagccccaggagcagccgtccgagcgtccggccattccagaggaaggccgccaccgcgcagtatacgagcgcgagcaccagaacgaggaaaaacccgggcaggaggatggtgtggaaggcgcgcagccaggccacgaaggcatcgagccccgtcagccccgcttccggcgtcttcagtcccgtcaccgatgaggccagggtgatgtagagcgccgccacgccggcgatggccgccgtgtcgatggtgaaggagagcagccgccgccacagggaggctgggcgggcgcgcacttccgtgacgcccgaggcggacttgacctgggccttggatgggggcgccttgatggcctcggagcgcgccacccccacggacacgccggggaggagcggctccatgtgcggcagggccgaaggggccgcggccggggattccatcgccgggagatccgtggaggcggcttccgcgtgctccatgcgaggcagtccggaagtggacgcggcgggaggcgccgcctgctccatgcggggcaggcccgcgggaggcgccgcctgctccatgcggggcagaccaacgggcgcaatcgcaggagccgccagttgtgccggggcctgcgggcgcggcgcgggcgccaccggcggcgttccataggccggcgtcatgggagagcccgtcgcgggctggggctgagcagcgcgcggcgcggcggcaccaggctgaggcgggtgcggcgcggcgtgaggcagtgcggctcccgcatgcagaggtgcagcgccaggctgcgcggaccggggtgcggcctgctggggcgcggtggcacccggctgcgcggtgtggggcagtgcggcaccggcctgctgaatcgcggcggcaccgggctgagcggcgcggggcgcagcctgctgaggcgcggcggctacgggctgagcggcgcggggcgcagcctgctggggcacggctacgggctgcgcgggacgaggcgcggcggcacccggctgcgcggcgcgcggcgcggcgacactcggctgagcggctccggcctgctgaggcgcggcggcaccgggctgagcggcgcggggcgcggcctgctgaggcgcggcggcccaaggcacagcggcactcggctgcgcggcgccggcctgatggggcgcggcacctggctgcgcggcgcggagggcggcggcccccggctgttggagtggccggggcgtggcggctggctgcgccgcgcgaggcatggcggggcccggcagcggcgtggacaggggggcgacggaagggggcggcggcggcgcatgctgcgccaggtcggcgaacgcgggcgtgcccgggagcgtcgatagctcttcctcgcgttgctccgtgcggcggtcgatgcggatgtcgcgatcgaggaggctgggcactccgggtgagcggacagtgacggtgtcgcaggccgcgcactcacccacgggtggaagcatggcaccgcacttcaagcacttggacaacggactcctcccggctggacgactgctacatgaaaagacagccatgggccgggggcaagaaaagtgcgagcccccgaggtcccttgctcgaaggaccgtcaggggctcatcaccgtgtcatgcgcgtgtcccacggggggacgtcccgtggagagtccttcactctcaggcatgtacccgtcgccgtccggctgcgcccaccagcaggagcacgacgattgcgccaatcaccgacatgatgatgcctgagggcctcacgtcgaagagccgaccatcacgctggaacagcgaaccgacaaggccgcccacgagcgaaccgaccatgccgagcaaggtcgttgcgatgagccccatgctctgcttcccggggaggatggcgcgggcgatgagacccgcgatgaggccgatgacgatgaatgcgatgatccccatgagtgtctctcctgtgttgagggtccccctgaggtcccctacggcagaaacgtaggaatcatcttcggacagtgtgaaccgcccactccgtgcggtcggctgccgccctgctacccgagttcgccgtccaggtgcatcatcaccgccagcgccgcgagcgccgccgtctcggtacggaggatgcgcttgcccagggtgactggccgcgcgcccagggccatcaaggcatccacttcttcacgcgcaagccccccttcggggccaatcaccagtgccacggcggtgcccgcgcccgcggcccggaacgcttcgcccaagggcacggccgactcttcctcgtcgagcacgagcagcacggtgcccgcggtcagcgagcgagccgcatccagcagtggggcaggcgtggccacgcgtggcacgtcgtccctgcggcattgccgcgcggcctcctcgacaatcttcgtccaccgggaggtgcgctcctccgcgcgcttgggctcgagcttcacgacacttcgcgccgtggccacggggtggaaggcggtggcgcccagctcggtgcctttctggagcaccagctccagcttgtcgcccttgggcaggccttgaaggatgctgacctcgcggcgcgggggggccacgcgcgcggtgcccaacgtcacgcgcacgacatctggcgtgacgtgggccacgcgggcctcgaaggcccggcccttcccgtcgaagacctccagcgcgtcgccttcctccagccgcaggacatgcaggaggtagtgacgacgctcgccggtcagctccacttcggcgggagcgggctcgggcaacggggcgaagaggcggaccaatgcggtttctccagagcgcgggggggctggactctgaccctgggggccaccgacttcaaggtgtcaggttggcagacagttgctccgtacgcgtcctggcgtgcgcaaaagatgcgctgactgcggaagcccagggtcctcgctgtccgtgggggagttgaggcacgatagcgggcagtgctcgtcaccatgcgccgcagcgacaaagccacatcacactccaacgaagatgtggtgctggcaaccagctcgcttcagggcgagcgccgcgtggccatcgtccgcgtcctggtggtgttgctgatggcggtcagccaggtcgtcatcgcctggggcggaggggagacgtactcggcaccggtggacggcgtgcgcctgcaggcgatggccgcgtacgtgctcttctccgtcgtcgccatcgccgtgctgctgctccagaagccgcacccgaagcgggcgcggtggctgcccgtgcccacgacgctggcggacaccagcttcttctccttcatggcgtggcacacctggcgcatctccggcgtcttcgatgccggcatgttgtgcgccagcctgggcatggtgctggcgttctccgtggtgcgttactcgtggtggcacgtgctgttatccacggtgctgtccagcggcgcctatgcgctgctcgcgtggatgacggggcacggctcggtggcgcgcaccagcttcgttctcatctgctacgccgccttgggcgggctcatcgcgctgacgaactcggaagtggggggcatgttcctcaatttgcggcgccgcgacggcctgtcccgcttcctgccccggcaggtggtggagcgggtgatgcaactgggggatgcctccctccagccggtgcagcgcgacgtcaccatcctcttcagcgacatccgcgacttcaccacgctgagcgagacgctggacccgggacaggtgctggagttgctggacgactacttcgggcacatggcccacatcgtcatggcgcgccacggcatcgtgaacaagttcctgggcgacgggatgctcgcgtgctggggcgttccggatgcgcgcgagaaccacgcggagctggccatgcgggcggcgctcgacatgcgcgccaagctggaggacatcaacgcccagcgcgtgcagcgaggtctgccgccgctgcgcatcggcatcgggctgcacaccggcatggtggcggcgggcatgctcggcggcgccgagcagcacgagtacaccgtcatcggtgacgcggtgaacctggcgtctcgcgtggagggcctcaccaagtcccacggcgtggacatcctggtgagcgagcggacgtggcagatgagcggcgggcatttcacgggcgagcgcctgggtgaagcgcacgtgaagggccggcgggagtccgtggtcgtctactccctgcacggcccgcgcacccatgaggacgtaccgcccgtgctcaaggccgcggcgggcacgtagcgcctcgccgcggcgtgggtgctcaggcgggctgtgactcgccggggcccgtcatcacctcggcccgcagcgtctgcttcatgcccagcgagaacagggccacggtgagcaggtacacgggctcgatgaagaagagcaggggcccgcccagggacaggccatgcgtcttcttctcgaagacgacgtgcgcgccgacgacgagcgcgaagcgcacgggcatgacgcctaccgccaccgngggggcggtgcccaccggaaacctcgcgacgacgggctccgcggggagcagcgtgggcggcaagggcagcgccatcagcagcccc

SEQ ID NO: 840 - DNA, 5424 bp, Myxococcus xanthus
tctaactggtgggttcagcccgcgctgctcacggatgcgtactggggcctgggcgtgcgtccggacggggacgtctgggtcggcggcgccaaccggacgacacgctacttctacggcaccgtcgcgaacgatttctgggagggccagacgcgtacggagtcccgggcctccgcatggaaccgcatcgacatctggaaggacgcggtgggcgaggagcgctactcccgtccggagcagcgcacggatgacctggtctccggcatcgccgtcgtgggcacctccgcgtgggtgggctccttcggccacggcctcgcggagctgaacgacaacggccaggtggtgcgcacgctgaagaacgaactggccgcgccgcacgtggccagcgtggcggcggacctggccaacggcagcatctgggccggtcacagctggggcggcggcctctcccgtgtccggggcggctccgtctcccactacggcctctccgtgttcgggcgtgagctgtccagcatgcgcgtgccggacatccaggtggaccgctccggcccgcggcgccgcatcctggttgccttccagggctctacgctgagcgacggcaccgtgatgccgggcaccatcggcatctactccggggagtgagtggtccttcgaatggaacgtgggcggcggccgggcttcttcgcgggagcccggtcgtcgcctgttcgcggatcgtggctacctgtaccaggggtacgtcaggttggccgggagcaggaagccccaccccgcatcgatgacgataggcgcttggccgggcttgccatacacctgcaccggtacttgggtgacaccttccttgtatgggtactgcagcggtttgtccccctggaggaaatgcacgttccggagcaccacgcgctgttgctccgggctgtacagggtggcgacgaacaggaagtgctcgtcatctcccggcactcgcttgcgctccaccgtcatcagcaacgacgtccgttcatcggactccacgcttctcaccaacctccgcgtgtagcggggcgccagccagaaggcggccagaccgatgacaatcaagagactcccccagatggggagctgggcgctgaacggccatcggaaccttccggaatcgagcgcccgctggaacgatgacgcgccgtaaagcaccgccaacgtccccaacgccacgcccacgctggcccagcggaaggagcccgcgaggcgctgtcgcagcgcatcaatcaattcgtcacgattcccctgcacgggcttcaccttgggacgcgcatccgtcaccccagaggacctccaggttcactgacccgtgtcctaaaccgctccgcttcgtgccgatagcctgcgtcgaccgcgcaccggccctgccgggcgtgcaaattccgcccgtcgcgggccggcggacttccatgagccgccgtgcggcgacgccggactgcccgctcgccttcgtcacgccccgggagcccgccccgcccacctgcgaccggtccccgcctggccgactgctgggcgggcatcatcctgagggacaggaagtcaccacgaggcgcgaagccgtctagaatccccgccggccatgcccgcctgccccccgcacccatcccctctcacaccgtcattggcgcacggactcaaggggaacggctctccgcccagctcttccacctcgtcctgctggacaccgagcgcgccggcaccgtcttccccctggccaatgaagccctccgcgtgggcaaggccccggacaatgacgtcgtcatcgaccaccccaccgtgagccgcaaccacctggtggtgcgccgccagggggaccgcttcctcgtgcaggacctgggctccaccaacggcaccttcctggacggtgcccaggtgcgcgaggccttcctccgccccggcgccctgctggaggtcggcgacgtccggctgcgcttcagtccccaggtctccccggtccaggtcgagcccatcctggaggaccggctgggcgacctggtgggccgcagcctgcccatgcggcagattttcgcgctgctccagcgcatcgcgcccaccgactccaccgtgctgctggtcggtgagacgggctccggcaagggtgccgccgccaaggccacccacaagctcagcccccgcgcgggcgggccgctcgtcgtcttcgactgcgccagcgtgtccgactccctcatcgagagcgagctgttcggccatgagaagggcgccttcaccggcgcggtgagccagcgcatcggctgcctggagcgcgccaacggcggcaccctcttcctggacgaaatcgacgacctcgccctggacctgcagcccaagctgctgcgcgccatcgaggaccgggagtttcgccggctcggcgcctcatcccccatctccttcgacgcgcgcatcatcgtcgccagcaagaaggacttgtgggcggagacgcaggcgggccgcttccgcgaggacctctacttccgcctctccgtcttcaccgtcagcctgccctcgctcagagaccgcaaggaggacatccccctgctggtggatgccttcgcgggcgaaggcctgtggccccggctgccggagaagattcgcgagcagttcaccgggcacacctggccgggcaacgtgcgcgaattgcgcaacgccctggagcgcgcccggcacatggtggacattccggagctggccggggacaccctgctgcgcgagttcacccgcgaggcccccgccgccgccggggactccctgccggtggagttcaccggccccttcaaggtctgcaaggacgagctcatccgcgccttcgagcgcgagtacctcacccggctgttgggccgcgccaaaggcaacatcgcccgcgccgcccgcgaggccgagctggaccggaagcacctgtactcgctgctccacaagtacggactcgttcagagcgagacggactgaggcacccgcaggcgtctggcgcggcggactggcaaacagcggacggagtgtggaagggactcgtgacacccgtgcgagccgtggcatgttcgcggcgcactgggagtcaagcctcccccctctaggagacgtcaaagaatgaagcgtccgtccccctggctcgccatgatgttcgccggtttcatgtccatgcacgccaccggctgcttcggccagttccagctcacgcagaagatctggaacttcaacaagaacatctccggcaacaagttcgtgcagtggctgatgttcctcgtgctcaccatcatccccgtctacgggctgggcgcgttcatcgacgccatcgtcatcaacagcatcgagttctggacgggcagcaaccccgtcgccagcatcgacggcgcgccggagaccacccgcatcgtcaagctgagccccaccgacacgctgcgcctgtcgcgtgacgtggagacgggcgtcatgcgcatggagctggcgcgcgagggccaggagacgatggtccgctacttcgagccgctcgaggacggcatggtggtccgcgacgacgccggcgccatgctcatccaggcccaggaggcgacggacggcgcggtggcggtgacggatgccgccggaaccacgctgacggtccacgcccgtgacgcgctggccgtggcccgccgcgtgtacgaagagggtggcgcgcaggcgctcgcgcagcacgccgtggcccaggcctccgtgtcccagggcctggccagcaacacctgcgtggcccagtagtcagcacgtccgcagctcactgttcggaaatgtcgggacattcgcggcacccaaacccccgacatttccgaacagcagcctgcctgacgcgctctggcccctcccgctattcgggaggcgtgcccgcgtcgggaggaacgccgccgtcaagcaactggcccgggtccgggccgaagctcgcatcctgcgccaccacggagaacgtcccctccaggttgcggccagcgccaaagccatcaccccggctgaaggacatggagaagtctccgcgcgtgggctcgcccgggttgcctccagactccaactgcaagtcgcccttgttcaccggcccgaagacgcgcgcgggctcgcccgcgttgaggtgcaccaccgtggcccgcgcctgtcccgacggcgtggtgccagcgaggttcacctttgtcccgggacgcaggtccagcccttccgtggacacggtgaggcggacgaccaggtccacgtccaaatcattgttccggtagtagctgacctggaacgcctccgcgttgcgcagcacctccacgcgggacacctccagcgggaagagctcggacacgctgccgcccagcgagttgtccgcgaggccgcacgcggccagccccgccccggccatcagggccgacaagctcacggcagcgagcgtgcgggccgcgggcgtcatcgctccaccgcgagcttcagcacgcccttgtcctgcgccaccaccggcgcccggtacaggacgacgcgcttgccactggagaggtacgccagcttcggcgaccagccaccgccggcgtccaccagcgtctcccgccagatgccctggatgcgcgtggagatgaccaacgcgtcgtcgttcgggttgcagctcgtgtcattgcggccggactcggcggcgcagatgtagaaggcgatggacggctcatggtggaccgggtcgaaggccagcgacggataccagccgcccgtgccgttgttgaacacggggtccggcatggaccagtcccgctcggacgtgcaggatgtcgcggaggcgtcagcgcattccgtgaacgtcaacgtgttcgagttccggttcagcacggcgacgccgaacccctcgaccgagtcatacgcgagcgaggccccgagctgcgtattcggaacggcctgcacgcgcaccaccggcgaccacgtgagcccgtccgcattgcgccgctggaagtgcacgtccgtgccggtggcctgcgcggcctctggcgccttgtcgtgcaccagagctggctgggtccccgccatcaccatggagatgtgcccaccgtaacccatcttggtatcaccggaggccaccgcgactcggcgctgccagttcgtgggcccgccgctggcaatctccaggtcactggactggaagtcttgtcgctcgtactgcccgtttttcccatcccggtaggcgacgatcgcctcgctcccgttgaagacgatggcggggttgagccccaccaggaagcccacgtccatcgcgggattgacgggctgcgcctcattcgattgccgcacgacgatgcgctctgtccacgcaccggaggcgctgcgatacgacaccgccaggtcgctctggaaccagaacgacgagggatcttcccggtcgccgcccaggtacgtcaccaccggctgaccgtccggcccgaaggccacgga

SEQ ID NO: 841 - DNA, 6583 bp, Myxococcus xanthus
agcgctccaaacgcgtggtgcgcgaagccagcgtgcccgcccgcatcgagaacctggtggagttcgtctgcgcggacaaggacggcaaggaccaggtactggagcccagccgcccccaccggattccctacgagatgcgcaacacctgtcgcgtcatcgtgcaccgtcagcgcttgaagccggaggatgggaaccaggaggtcctgctccgcatcagcgtcacgaagccggatggctcggtgcgcggggagagcggcgtcgagcagcggatgttcctgcgtccgcagggagagcagcgcgacatccccgtcccgggcaacatggggcagtacgaccgcatcaccgtccaggtctcccacgtggcggacgagtcccgttacgccttgagcacgacggaccgtacgggcctgccttccgcgcagtggacggccatcgtcaccggtggcctcttccggctctacacgacggctgccattcccgcgggcctctaccgcgccaccgagcccaccgggcagctcgccatcaacttcggtgtcgtgtcgcgactggcgttgctgaacaacgaaggccaggaacgcctgctgggaatcgaagcgggtttgatgggactggggctcgtgccgcagtcgggtgacattcaattcccgccgacgctcgcggtcgtcttgggcctgggactgcgcgttccgattggtccgggcgctgccgtcggtgcgcaggcgtggctggcctacgagttccgcggagacatccgacgtcgcacgggaggagaccccacgctggacccaatcgttccgtcgagcaaatggtccttcatcttcggaccgagcatctctgtcggcaacgtgggcttcaatctctgagcgctgttgagtcgaaccggtcctcgcgaaggcacacctccgctgaggaccggctcccactcgcccatcccacatacccgagccgtgccaacccgtagcttccgcaggcgcgctcccagcccgtgctccgcgaccggcggcaacatcggcgcaggaccgcgcctccaacacgcatccaggaacggcgggagccgcggccggggcggcggtgaacctgcaccgtcacgctccggaccgcggccgtccccgtgcggcgtggactacttgttcatcttgtcgatggaagacgccatgttctcggtcgtcttctccacgttgaacttggtccggacctggtccccctccttgatttcacgccggaggtgactgtggatgtcgcggtgcttctcgatgggcttcccatcgatttgcgtggagtggttcacgcccatcgccaccaccgcgccgttctcatccttgatgaagaccttgtccttccgcagggccaccacggagccgctcagctcctgctggccctgcatctgacggccttgcatgccgccggacgtctgcgagccgctgctgggtggatgctgcatcgatgggtcctgctgcatcgatgggtcctgcggcatcgatggctcctgcggcatcgacggctcttgcgagccctgcgccagagccgcgccacccgacgccagacccgcgatcatcccaatcaccttgagcttcatgaccgacccctttcgtcctggagggcgcacctcgcctccgaagccaaccgtgaccatgcccggcggcgttgccacccggtgccacggtgcgacccgccccctggaacgcacctccaagctcgtccgtccctcctcgcggtacgatgaccgccgcgccccgttgaaacgcagcggccccggacgcctgctcagtccgcccggagcgccaccgcgggggagactcgtgcggcccggcgcgcgggcagcagcaccgccaggacggccaccgccaacagcaccgccgccaccgccacgtacgtcagtgggtccgtgggccgcacgccgctcagcaggtgcgtgaggccgcggctggtggccaccgccagccccaatccaatgaggagcccacacgccgtcagccccaggtagcggccgagcaccagccccagcacctgcgcctgacgcgcgcccagcgccatgcggatgcccagctcgcgggtgcgctggagcaccgcgtaggccacgacgccatagaggcccaccgccgacagcaccatcgccagcgccgcgaaggcccccgccagcagcaggtagaagcgcagcggcgccaccgtgcggtcaaccaccgaggccagcgtgcggacactgcctggcgccaggctcgcatccaacgcacgaatctccgcgcgagccgcgggagccaggtcgagcggcgcccccttcgtccgcagcagcaccaccatgctcgtggtccgcgcctgcacgtagggcacgtacacctccggcagggacggcgcgccaagcccttccagtgccacgtcgtccaccacgcccaccacgcgcccacccatggcaccactgccccagtccatgccggtgtccagcgtgcgccccaggggctcttcgccaggccagaagcggcgcgccgccgccgcgttgaccagcaccgcgcgcccacccgcgccctggtccgccgccgagattccccggccctgaagcaccttcacgcgcaaggcctccagcgccccgggcgtcacgatgcgcacgctggcctgccatggctccgtcccctccggaacgggccgcatggggtccttcacgggaacggtccaccgggccccatccagtggaagcccattcacggcaccaacctgctccacgccgggcagcgcccgcagccgctcgagcaacgtgtcatagaacgccgcgggcgcggcggtgccaaagccatagtgaagcggcggcaggtccaccttcaccgtcagcacgccctcggggtcgaagccgggcttggcccgttgcaggtgcacgaagctgcgcagcaacaaccccgcgcacaccagcagcagcaccgccagcgccgtctccgccacgacgagcacggagcgcgtgcggtgcccctgcgcgccgccacccccgccgcccaccacccgcttcaacccacgaaccaggtccagccgccccgcctggagcgcgggcaccagcccgaacagcagtgtggtcagcacggccagtcccgcggtgaaggccagcaccgggccatccagcgacacctcttcgatgcggggaatgtcctgaggcccccacgtggccagcgcatccagcgcccacatcgccaccagcaaccccacagccgcgcccagacccgcgagcacgccgcactccaccaacagctcgcgcgcgatgcggccacggctcgcgcccagggcgatgcgcacggagacttccccctcacgcgaggctgcccgcgccaggagcaggtgcgtgaggttcgcgcacgcgatgagcaacaccaaccccaccgcgcccagcatcaacaggagcgacggacggacgttgcccaccagcacgtcgcgcagcggctccacgcgcgcatccttgccctcgttcgtctgggggtactgccccgcgagacggtgggcgatggcggagagctcggtgcgcgcggactccagcgccacgtccgggcccaggcggccatacacctccagccagtgcgccccgcgcccctcgggcttcgtcatgccctcttcccagagcagcgggctccacagctccgagcgtgcggggaagtcgaagcccggcgccatcacccccaccacggtccacggctccggagcgcccaggtccaccgagcgccccagcacggcggcgctcccgccgaagcgccgctgccacagcgcatgggaaatcaccgccaccttcggagcgccgggccggacgtcatcggggtgaagcgcgcgccccaactgcacgcgagcgcccagcatcgggaagaagtcgcccgtcaccatccccgcctgcaccttctccggcaaggtgtccgcgctgtccgccgccagcgtcaccgccacgggcgccaccgcggacaggcccttcagcgtgcggctctgctcccgcaggtccatgaagtccagcacggaggtgggccccggcccctgcgtcctcaggctgtacatgcgcaccagacgggcgtcgtcgtgcatgggcagcggccgcagcaacacggcattcaccacgctgaagatggagacgttggcgccaatcccaagcgcgagcgtggccaccgcgaccagcgtgaaggtgggactgccacgaagccggcgcagcgcgaagcggaggtcctggccaagggtcatcgtcatgtccaggacgcccgagcatgccgcgtgccacaccggcgtacaggccatctggacgaagcgagaagcccggttgcacgggaatgggaatcggagtcccgcatccggacatcccgcgcgcttccgcgtgtcgtttctcgcaccccgtccagcgtccgcggttatccctccgccattcccgactgaaggagccgcgatgagcccgcaccgaacgaacgaagccctccagaagctgggcatccaacaccccatcatccagggccccttcggaggcggactctccaccgaacgactcgcggcggcggtgtcgaatctcggagggctgggctcgtatggggcgtatcagctcccgcccgaggagcttggccgcgtggcggaccggattcgggcgctgacggacaagcccttcgcgctgaacctctgggtctccgaccatgacgctggcggagacgcactcagccctgaggatttcgaccgcgtctaccgactcttcgagccgtactaccgcgagctcggcgtggagaagcccgccatgcccgagcgcttccaccaccgcttcgaggaccaggtagaggcgctgctcgaagcccgtccccccatcttcagcttcgtgttcggcgtgccccccgcctcggtcctggcggagtgtcggcgcaagggcatcctcaccgccggcgcggccaccacgctggccgaagccgaggccctggacgcggcgggcgtcgacctcatcgtggccacgggcttcgaggcgggcggacaccgtccttcattcctcgcgcgcgccgaggactcgctgatggggacgctggccctcacgccgctcgtcgccgaccgcgtgaaggtgcccgtcatcgcggcgggaggcatcgcggatggccgaggcattcgcgccgcgctcacactgggtgcccaggccgcgcaactgggaacggcgttccttgcctgcgaggaatcgggaacgacggacgcccaccgcgagctcctcttcagcgaccgcgcgaagcacaccaccttgacgaggtccttcacgggccggctcgcgcgaggcatgcgcaatcgttggactgaggaggtggcccatcaactgtcagcgctcgcgcccttccccatccaaggttggttcctgtcgaagctcaagcccgcggccgtcaaggcgggccgcacggacctcgtgtcgctctgggcaggtcaggccacgcccaacctgcggcaccggaccgtgcccgccctgatggactccctcatcaaggagctctcggcttcgtgacgcggcgcaccctccatcctttcgagcgcgcggcaacggcccgcacgcccggctggagtccaggaggaccggcgccactgcatcccgcgcacgcacgggcatggccaacgtgaggagatgtcccctgcgggggacttcaaggagcctcgcccatggcccaatcggacacgccggtccgcctcgacgtctggagcgattacgtctgccccttctgttacctcgagcttcccgtcctcgagcagttgcatgcccggctgggctcggcgctcgacatccactggcgcgcgttcgagctgcgtccggtgcccgcgcgaccgctcgccccggtgagtgagccccctcggtcggcctgggcccgctccgtctacccgttggccgagcagcggggcctgacgatgaggccgccgccggtgcaaccgaagagccggctggcgctcgaagccgccgagttcgccaaggacgctgggtccttctccccgttccatgaggccctcttccgtgccttcttcgcggacggccaggacatcggggacctgcgcgtgctgggggcgctggcggaggacgtaggcatggaccgcgagtccatgacacgcgcactggaggcgggccggtacaccgcgcgcgtgctcgccgacgaggaggaggcacaacggctggggatccgcggcgtcccggccatgcggctcgcgggcaatgggcccgtgctcctgctgaccggcgctcagccggaagaagccgttcgcgccgccttcgcgcgcgtccggccgggcccctccctgagtgccgtgcactgagcgcgcggccaccgccgtcctggcgggagcacttcgcgccgaatagggtgccggcatggagcaccgcccgacccttgtcttcgctgatggcgcctgttcaggaaaccctggcccgggtggctgggggagcatcatcgtcacgcccgacgggctggtgacggagctgggcggacacgagccggagaccaccaacaaccggatggagctgacggccgtgggcaaggccctgcgccacctggagcgcgcgccgggccccatccacatccacacggactccacgtatgtgattcagggagctaccaagtgggcgctttagagcacg

SEQ ID NO: 842 - DNA, 6301 bp, Myxococcus xanthus
agctgcgcgaagagcacgtccggcgccagggaggtgatgggcgagtcgtcatccgggcagtgcggctcgcccagcttggcgaacagcaggcgcaggtagtgggccacctcggtgacggtggccacggtgctggtggctcccgctcgcgaggtgcgctgctccagcgccaccgacggcggcagcgagctgatgcgctccacatccggacgcggcatggagggcaggaactgccgcgcgtaagggctcagcgtctccaggaagcggcgctggccttccgcgaacaccacgtcgaagacgagcgagctcttgcccgagccgctcggcccggtgacgacggtcatcttccccagcgggatgcggcacgacacgtcgtggaggttgtgctcgcgcgcgtgctccacctcgatggcggggacctcacccttgcccggcttgcgcaacttcaccgcgcggcccagcggcttgcgctcgccccgcagtgcctgggcggtggcgcccttgccgcgagccacgtcctccggcgtcccttccgccaccagccggccaccgtcacggccgcccacggggcccaggtcgatgacccagtccgaggccttcatcaccgccacgtcgtggtccaccaccagcacgctcgcgccgaagtccacgagcgcattcagcgcggtgatgacgtggcgcacgtcctccgcgtgcaagccagcgctgggctcgtcgatgaggaacagcgtcccctgcgcctcatttgccagcgcccgcgccagcttcaaacgctgcgcttcgcccccggacagcgtggacaacggctgacccagcggcaagtagcccagccccagccgcgccaccggccccagcgtgcgcttcagcgccgtgtcgccgccgaagtgctggagcacctcgtccaccgtcatctccagcacctgggccacgctgaagccctgatggcggacggccagcacctcttccttgaagcgccggccgcggcacaccgcgcacagcagcgccacgtcggcgaggaactgcatctccaccgtctcgtagccctcgcccgagcaagcctcgcagcggcccttgtcgacgttgaaggagaaatgcgccgccgtgaggccgcgcacctccgcgtcgggctcggaggcgaagcgctcgcgcagccggtcccacgccttggtgtacgtggccgcgttgccgcgcgaggtgcgccccagcggggactggtccaccagggtgatggccttcaccgcctccatgccctccaccgcgtccaccgcgccgggtgcctccacgtccttcacgcccagccgccgcgccaggtgccggtacagcacctcgtccatcagcgtgctcttccccgagccgctgggccccgtcaccgcgcacagcacgcccaggggcacctccaccgtgaggtccttcaggttgtgctcgcgggccccccgaatcaccaacgccccggtgcgcgtgcgcggcgtgcgcggcacctcgtccacgcttgccagcagccgccccgtgggcaggtcctgcttcttggccagcgcctccggcgtgccatcgaataccagccgcccgccctgcttcccggccccgggccccagctccagcacgcggtgcgccgagcggatgaccagcggatcatgctcgatgaccagcgcgatgttgccccgctccgccagctccgcgatggcctccgtcagcggcggcacgtcgcccgggtgcaggcccacggtgggctcatccagcacgaagagcgcgccggtgagggacgtgcccagcgcggccgtcagggacacgcgctgcgcctcgccgcccgacagcgtgcgcgcggggcggtccagcgtgaggtagcccagacccacccgctggaggtagcgcaggcggccggccagttcgcgccgcgccagctcaccctgtcccgtgatggtgcgcagcgcgtccagccgcgccagcgcatccgtcagctccaggtggtgccacgacggcaaatccagcccgcccactcggtacgcacgcgcctgggcgttgaggcgtccgccaccacagctctcgcacaacgtgtaggcgcgatagcgcgccagcagcacgcgcacgtgcatcttgtacgtgcggccctccatccaccggaaccacgcgcgcacgcccgggtaggcgcggccctcgtcgtagtcgccctcgccctccagcaccgactcgcgctgctcgggcgtcagcaggccccagggcttgtcccacggaatcccccgcgccttgcaccagcgctggagcatgccgcgctcccacgtggtggactggccggaccagggacggatggccccctccgacaggctcagctcggggttgggaatcaccttgccccagtcgatgccaatggtgcggccgaacccacggcacgcggcgcacgcacccaccggcgactggtagctgaagaggccgggccgcgcggcctcgaactcccgcgcgcacttggggcacaccagcccgcgccgcagccgctggggcacgctctgcccagggacgaagaggtgcgcctcgccgtccgcgcggttccacgcgtcctccagggcctgcgtcacgcgcgacaactgcgcgttcgtcagcttcacccggtccaccaccacgcgcgcgattccagccgggtcggtcgcctcggcgggacggagcgactccagctccttcacctcgccctgcaccatcagccggtggtagccgtccttcagcagccgggcccgcgcgtccaggaaggccgccgtgtcggggatgcgcagcgggaaggtgaggatggcctgcgcgtccgtgtgctcgcgaatggccgcggccgctgccacgcgcgcgtccgtccgcaccgcctccacgccgcaggtgccgcagacgggcacggcttcacgggtgaagagcgcggacaggtacggctccacgtccgccagcgtggccaccgtggagcgcgagctcttcacgggcgcgcgccggtccacggccacgcccgcggccacgggctccagggcgtccatgggcggccgctccagccgctcgaggaactgccgggcgtacgggctgaagctctccacgaagcgccgctgcccctcggcatacagggtgtcgagcgccaggctcgacttaccggcgccagagacgccagtgacacagacgaactccccttccgagaggtcgaccgacaggtccttcaggttgtgcgtgcgcgcgccaacgaggtgagtcttgtgcatacgggtggcaggtttaacgactggacacttcgccgccaatcacaactgagggagcacccgtgggaacccgcctccctggctggcgatgaggcggacacccggagcccggaggcccgctcaggcgcccgtccagcgcacccgcagggcgtaccccgcggtctgccgctccagcacctccacctggggcaacaccttggtgcgcagcaggacgccttccaccacgccggcgacgaagtccggcagcgggtccgggtccacgacgcggatgcgccattcccccgcctgcaccggctccagcagcatcttcatgtcctcgcgccccgcccgcagatacgtgggcagtcgcgtcagacacctttccgtccccaacaggggcgcggcggtggcgaagatgcgacccaccagtgtctgggcgaacccctccacatagcggtgccccaggacgcggttggccgcctcgggcggctgccccacgcaggcatagcgacgggccacccccagcgccgcccgccacaccaccagcgggtagtactcctgcgacgcctccatgtcgtagccaatgtctcgcaaggactgggcgaaggaccccgtgggcttcaacgcatggacgaagagcccttcgaagttccgccgaggcacctgcaccggcaacggtgggggcttccgcggctcggtggccgtcttgtcgtcaaagccccgccgttccatgagttccccctgtctccaccggtccaccccggtcctgaagccagtgtatcagcccgggcgcttcgtcacctgcacgccacaccggcacggcaccccgcttttacaacagcaaacgtcgtgtaacgatgagcgttcgtcatcaagaggtgtcccatgcgggtcctgattgtcacccaggggggaggggcggacctggcgccagtcgagtcctggctgcgtgagcagggacacacggtggtcaccgtgacgcgcgaggcggaggtgcccgccgcgtggcgcagcggaacgtgcgcgctggtgatggtggatgcccggacggacccctcccgcgtcccgctggtgcgcgcacttcgcagcctgcccggcggtgaggaatccgtgttgctcctcctgggccaccggggcgcgctgggcggactgcggcccgtcctggaggccggcgccgatgatttgctcgcgtggcccgtggatgaggaggaactggcgctgcggttggagctggcccaccgccgcttcgtccggcgcgagggccgcaagggcctgcccttcggagatgacctgaaggagacgctgctggccgtcagccccgtgcccacgtccatcaccaccatcaccgaggggcgcgtggtggcggccaacgaagcctacttcgaactcttcggctacacgcgcgaggaggtcatcgggcgcaccacgatggagctggcgctgtggcaggcgcccctgaaccgctcgcaaatcgtggacacgctgcggcgccacggcacggtgcgcggcgtggacgcgcagtaccgcacccgcgagggcgagctgcggcacacgttgctcttcatgggcctggtgccctacggcggcacgccccacatcatcgccttcttcccggacatcaccccgctcaagcgcgccgaggagagcctgcgccgctcggaggtgagcttccgcaccctcatcggcagcctgccggacatggtggccgtcttcgacaccgactcgcgcgtgcgctacgccaacctcaaggtcgccacggccctgggctacgagagtgcgaacgagctgctgggcaagcacttctccgacatcatccccaaggaggacttcgccagcgccaacgcgcgcatgcacgaagccatccgcaccggccgcgcggcgcaccaggagcggcggctgctcaaacgcgacggcagcgtgctgcacgtggagtccaccacctttcccctgcccttcgacggcgaggactccatcgttgccgtctcccatgacttgacggagcgctaccagatgcaggcgcggctgatgctcgcgcagcgcatggcctccgtcggcacactggccgcgggcgtggcacacgaaatcaacaaccccctggcctacctcaccgccaacctggccttcgcacgcgaggagctcaccggcgtgctgcccaccggcacccggaacatggagccccggctggcggaggcggtggccagcgcccaggccgcgctcgccgaggcgcagcagggcgccgaccgggtgcgcagcatcgtccgggacttgaagacgttcagccgggtggactcagcggagagcgaggaagtggacgtccggcaggtgctggagtccacgctgaacctggccaccacggagattcgtcaccgcgcccgcctggtgaagcagctcgacgcggtccccaccgtggtcggcaacgagtcacggttgggacaggtgttcctcaacctgctggtgaacgccgcccaggccattccctccgggacgccggagcgccatgaaatccgcgtcgtcacccgcctttcgggcaacggccacgtctgcgtggaggtgtcggacacgggcgccggtatcgccaaggaacacctgccgcgcctgttcgaccccttcttcaccaccaaggagcccggggtgggcaccggactgggcctgtccatctgccacagcctggtgacggccctgggtggggaaatccatgcgacgagcgagccgggcaggggctccaccttccaggtgctcctgaccccctcccagcgactcgggaccgagcgcccaccgcccgctccgccgcccgcccccacggagaaacggggcagcgtgctggtggtggacgacgagccgctcgtctgcacggccctggggcgtacgctgcgtccgcaccacgacgtcaccctcttcacccgggcccaggaggccttggagcgcatcgaggccggcgagcgcttcgacgtcgtcttctgcgacctgatgatgccgggcatgagtgggatggacttctactccgccctccaggcccgccaccccgagcaggcccagcgggtcatcttcctcaccggcggcgcggtgacgcctcaggcccgcgccttcctggaatcggtaccaagccccca

SEQ ID NO: 843 - DNA, 7190 bp, Myxococcus xanthus
tcgactacccgtcgctggagcggaagttccagtccgctctggaggcggacgggaacctcgccgaggccgactacaacctgggcgtgctcgccgagcgtcagggcaagctgaccgaggcgcgcaaccattacaagacggcgctcacgaagaagccctcgctgcgtcaggcctctgagaacctggcggtgatggagcagaacgcgggcaacgtcgccggcgcggtggcgctgtaccaggaggtgctccagcgctacccggatgacgcgcagtcacgcgcgcggctggcggagatcttccggcagcagggggaccacaccaaggccatggacctgacgcgcgccgcgctgatgcgcgacccgcagtccaccaccgcgttgaaggtgatgatccgcagctacctggatcgcaagcagctcgccatggcgaagctggtggccctgcgcggcgtgaagctggacgcggcggacccggagctccaccacgccgtgggcctcatcctcctgcaggaaggggacgtggatgacgcgcgcctgtccttcaagaaggcgctggaggttcgcgaggactacgtgccgtcgcacgtggagctggcgcagctggccctggccgcggagaactaccccaccgccgagcagcacctgcgccgcatcctccaggcggacgggaagaacgccgccgcgcacctggacctgggcgtcgcctacaagggcatgggccagttcgacaaggccatgcaggagtacgacgaggcggagaagctcgaccccgagctggcggccgtgaacctcaaccgcgccatcatcctccacaaggtgaaggacgcgcccgagcgcgcctcggagctgtaccgcaagtacatcgccatggccggcggtgaggtggcgctgcccgccgaggcccccgtgttcgccctgctgcgcgaagtggaggtcgtcgtcaacgcgaagcgcgaggccaagttcgccgaggagcaggcgaagcagatggaggagctgcagaagcagcagcaggcccagatgcaggccgcggagaaggcggccgggacggcgaacccgcccgccaccaccgcgacgccggcttccggcacgggccccgcgccccaggtcactcccgccagcggcaacacgccgccagcgcccgcccccgtaaacggaaactccgaccagaagaatgcaggctcggcggaacccggggagccggaagacgacctgctgtgaaagttgggacgcccccgagtgccttcgctgtggcgggggcgcgggggatgatgcgaaccttgtgtttccccctcatccggggattcggtgtgcgaaggggccttcgggtcccttccgggaggcagtgatgcggaaggcgttgatgctgtgtgcggtgctcgcggtgacgcccgccctggcccaggacgagggctcgaacccgggtggtccaggggagggcaatgtgcgctactccaagacgaccaacatcgacttcgaggacgacaccatcgagggcgacctcacgaagccggatggcgagtacatcgatgcgcgtgagcgggtgaagcactcgaacctcatccgcatccgcgaggacttcgaggacaaggtgatgcagtccgtgggcgagctgtagccagcgccacaacgcggcgggaacccaccgccgcgcgcgttgtctgacgccgtacccactttacgttggagcccccatggccgttcctctgacactcaaggtcttcaagggcgactcgctggtcgcctccaaggactacgagcgcgacatcatcaagattggccgtctctcctcggcgcacctgtgcctggaggatgagaaggtcagccgcatccactccgtcatcgaggtcgccagcgacggcgccatgtccatcatcgacatgggcagcgtcgagggcacgtacgtcaacggcaagcgcgtcaccaaggggctcctctccttcggcgatgaaatccgcgtgggtggcaccaccatccgtctggaaaacccggccgcggtggccgcggtgaacctggcggccgcggcggccagctcggaggtggtgacggagaagaatccggtcatcgcggcgccggcgccggccgagagcctggcgcaggccgcggtggccgctccggccgtgggtgccatcgacccgtccttcgccgccacccagcagaacccggtggccgctcccgccgagcccgcgccggcccccgtcgtggcagcgccggaggaagccgcgccgcgcgtgcgaacggttcgccgcacgaagtccagcggcccgttgggcgtgggcctgcgcttcgcgtggggtgaccagcgcgtgggcgagttcttcatggctcccggtaggaagggggccttcgtcgtcggcagcgccgcgggcgtggactttgtcatgggtgacgcccgcctgggcgccccgaagttcgacgcggttcgttcggacggccagtccttcaccgttcgcttcaccgcgaagatgaagggcgagctcacccgcaagggcgagacgctggacctgaaggccgtcatcgagtccggcaaggcctcgcatgagggcgaggcgtactcgctcacgctggacgcggaggacttcatctgggtggacctgggcggcgtgacgcttgaggtggccttccagcccgtgcccaagcgcatcgtggtgccgctgggcgagtccatggactacaccgcgctcaacatcttcctggtgctgttcttcatcgcgacggcgttcgtcatcaccgcgatgaaccgcaccgtcgcgggggacgaatacgcggacgagctgtcggcggacaacgcccgtatcgccaagctcatcatcaagccgccggaggcgcagaagaacaagttcctcgagcgcctcaaccagcagaaggagcagaagaagagcggggagatggcggcgaagaaccgcggcgacgaaggtcagatgggcaagaaggaggcgcccaagaccaacaatcgcaccgcgcccaagggtgacccgaacaagaaggacgaggcgcgcgcgctgacggcgaagatcttcggcggcggcaagggcggcatctccacggtgttcggcaagagcggcctgggcggcgacctgaagagcgccatgggcaacatgttcggcgccaaggcgggcaactccggtggcttcggtggcatggggctgcgcggcacgagcggcggcggcggcggcacgggtgacaccatcggcattggcggcattggcaccaagggccgtggcggcggcaccggcacctacggcagcggcgtgggcgtgctgggcggcaagcagagcgtcgacgtgggcatcacctcgtccgacccggaggtcatgggctcgctggacaaggagctcatccgccaggtcatccatcgcaaccgcggacagatccgctattgcttcgagagcctcctcaaccgcttcccgaagctgggcggcaaggtggcggtgaagttcgtcatcgcgggcaatggctcggtcgcctcgtcgtcggtggcgcagtccacggcggccaacgcggagctggagacgtgcgtggccggacgtgttcgcacctggaagttccccgagccgaagggcggcggcgtggtggtcgtcacgtatccgttcatcttcaagcagtccggcgaatagcgccgggtggcctttctccgggtgggcaggcctgacgcaggtctgcccaccgcgcctttccccggctcccactcccccgagggggccgggccaacgtcaggaccgcatgaaagccctcgcctcacttgccctgtgcgcttcgttcgttctccccacggtcgcgagcgcccagcagcccaccactgcccagggtgaccgcccggctgtcacgttcgatgaaatcgagcgaggcatctacttcgcggtgctcggtggccccctgttcatcaccaacccgccggcggccgaaggcacgccgcgtccgttctcctccgggcccatggcgcaggtggaggtgggcgtggacctgggcgagcacgtgtccgtcggcctgttcctcatgggctcgagcgtgcggacgggcgctcagtacgtgggcaactccggcggcgcggtgtcgggtgacttctccaccctgatccccggcgcggtgttgcgtgctcgcctggtggggttcgctgacagtcaggaagtgaagcgcacctggttctatctccgtgcaggtgctggctatgcgatgttctcgccgcagcggctcctccccgattccgacattcttgtgtttgccgggcccggagtggagtactacacacggctgcgccacttttccgtagggctcgaggtgacggggcagtacctcgtctccgggggctcgttcgggttcgcggtggcgccgaacattcgctacgcgttctagcgggagaaagacgtgcctcaggagaatggaagcggtgggccgcgcccgggtgggcgtggtcgtgacgggggtgcaccgggccaaggtcctcgccgtgacggaccgggtggttttggtggccgtggcgggcccggacgcggtgacggccgtgggcgtggagatggccgtggccgcgggcgtgatcgcgaagagggccccgtgggccctggccagcgcgtcatctccgagctgagcatcctggagaaggcgctctccaagacggatttcggggcggagaaggcgccgctgcaggccattgtccgctcgcttcggcctatgcggctgaagtcgctggacgacctggacctgaacacgcgtggccgcctcatcaccacgctgctgcgcgtgcagcgtcagccgaagccggccgcgcccgaggcgcccgccgccgcggaggccgctgctccctccgaggcgccggccccggtggaggccgccgcgcccaccgagggtgaggctctcgccgagggtggggcgcccgccgaggcacctgccgccgccgagggtgaggccgccgcgcccgccgaggccgctgctcccgccgtggacgcggcgcgagagaagttcgatgcgtggacggacgtcatcttcctcgtcggtcaggcctggcgtgccgcgggtgatgccgagcgcgcggaggcggccttcgcggccagcggccgtcagcccggtcccgaggccgaggagcccgtcgcggcgcctcgctccgaggagcgccgtgagcgtcccgagcgcggggagcgccgtgagcgtggccctcggcccgagcgcggtgagcgtgccgcttcgggtgagcgtcgtgagcgtccggagcgccgcgagcgtcctgcccggggtgagcgtccggagcgtgccgagcgcccggagcgtggcgagcgtccgctgccggagctgacgggcacctgggacgagcaggcgaagcagctcgagaccatgggccgtacccgcgacgcgggccggctgcacgagcgcaacaactccttcgcggaggcggctcgcctcttcgaggcgggtggcgacctcaagagcgccctgcgcaacgccctggccgggagcgacaacgacacggcccgccgtctggtggggacgctgccgccggatcagctcgcgcccacgctggagaaggccggcgcctacgaactcctcatggagcacttcgtcggcaagggtgacttcgagaacgtggcccgcctctatgagcgcgcccgtcagttcgaccaggcggcgctcgcctacgagcgttccgggaagctcaccctggcgcgcaagtcgtacgagcgcgcccgggacatcgccagcgccaaccgcatccgtgggctcgaggtgaagagcctggtggagcggggtgatcggcttggtgccgccaccctgttggcggccgtgggccagcgccgcgaggcggtggaggtcctcagcccgctgcctccgcccaaggccttccacttcatgcagcgtctgaagctggacgacgaggcgaaggagctggcgcagaaggagctggcccgggccgagcaggagcagaagccggccggccgcgcccggtggctggagctgctgggtgacctcgccgccgccgccgaggcgtgggagggcgctggccgcaaggacaaggcgctcccgctccacgagaagcttggcaacctgcctcgcgccgctcagctcgcggaggagctgcagcagcgtgacaaggccattgccctctacactcagctgaacgacagcgcgggtgtggagcgtgcgaaggcgcttccggagacgaccgcacctgcccaggccccccgcggcggatgcggcggacggaagcgagggtggcgaaggtggcgagacgccgcctgatgccccctcggccgggtagcaagaaggccaatgattcccgccgtttggcgggttttgcaggattgctcgggggcgctggcgaccggtagagttccggtctctggcgccctcgctgctttttctttccattccaaggcccgcccctccatgcaacagcccacgccctcgtcgcgtcccacgctgcgcgtgtccgatgaccgcaccttcgtcgaaaccgaagcggcactcgacaaggccggccgtgtcgaggaattgattcgcctctacgaggggcgctcgcgcgatgtcgtctccgatgaagcggtgcgcctgctgtgccgcgccgcggagctcgcgcatgatcggcagcgcaacacgcagcgcgcggaggaactgctcaagcgcgcgttgctggtggcgaaggatccgctccccgcgctccgaggcctgaagcggctgcacgagtcgcggcaggatggcgccgcgctggcggacgtcctggagcggttgggcggcgtcacgcagggcgaggagtgcgcgggccactacctgaaggcggccgacgtctacgagcagaagttgttccggcgcgaccgcgcggtgctgtgcctgcagcgtgcggcgcgcgcgaagccggaccgcgccaccttccggcgcgtgcgtcagttgctgttgtcggaagagcgcttccagccggccttcgaggccttggaacgcgagcgcgcggcgctgggggacgcgggcatggcggaggagtacgccgcgctcgccgagcggctggtggacgaccccaccgagcatgaactggcgcagcgggtggtggatgtcgcccaggcgttggagccgcagaacgcgcggctggagaagaccgcgcgcgcgttgcagcgcttcgagcagacgtggcgtgaccgcgtgcggatgctgcgcagcatgtcgctggaggagcgcgacaggaagagcgctgcgcgcctgtcgctgctcgtggcg

SEQ ID NO: 844 - DNA, 7553 bp, Myxococcus xanthus
atcgagggactgctgggccatctggagacgctgctcgacgcggcggtgacgtcacccgaccggcccgtggcgacgctggcgatgctcccggtcgaggagcggcaccgcttgctggagacgtggaacggagcgaacgagcccctgcctccggacgcctgcgcccatgcattgttcgaagcgcaggtcgcgcggacaccggacgccactgccgtggtgtccggcggcgagtccgtgacgtatcgcgagctgaacgcgcgggcgaaccacgtggcggcacgcctgcgagcgctcggcgtgggcctggagtcccgggtcgcagtgtgcgtggagcgctcggtcgagttgctggcggcgttgctgggtgtgctcaaggcgggtggcgcctacgtgccactggacccggagtacccagcggagcggctgggctacatgctggaggacagcggtgctcgcgtggtcgtggcacggcgggagtaccgcgagaagcttggcgaggcaccagggcgggtctggttggacgtggcgtcgctcacgccggacgcagaggggaagacgtccgagccgaccgccgtcgttccaccggaagccgcggcgtacgtgctctacacgtcgggctccacgggacgcccgaagggcgtggtggtgcagcaccgctcactggtgagcttcattcgcgcggagtggcaggtttgcccggtggagccgggcgaccgggtgctccagttcgcgtccatcagctgggatacgagcgcggaggagatctatccgtgcctcacgcgcggcggcacgctggtactgcgcacgcccgagatgctggacgtcccggaggtcttcctggcccggtgtgaagcggccggcatcacccagctcaacctgcccacggccttctggcatgaagtgacggcgagcctggatgaaggcaaggcgcgcctgccctcgggcttgaagtgggtggttatcggtggcgagcgcgccgtccccgcgcgggtgtcgcagtggcggcaacgcgtgggccacgcggtgcctctgctgaacacgtacggcctcaccgaagtgacagcggtggccacggccgtggacctgaccaccgacaccgaggactccgggcgcgaggtagccattggccggccgctgacgaatgtccgcatctacgtcctcgacggggagttggagccagtgcccgcgggcgtggtgggcgaactgtacgtcggtggtgaaggtgtggcgcgcgggtatctcggcaggccggagttgacggcggagcggttcgttcccgcgccgcaaggggacggggcgcggctgtaccgcaccggcgacaaggcgcgatggcggcgggacggcgtactggaatacctgggccggggtgactcgcaggtgaaggtgcgcggtcatcgcatcgagcccggtgaggtggagtcggcgctgctcgggcaaccgggcgtgcgcgaggtgctggtcgtggtgcgcgaggacgcaccgggcgacaagcggctggtggcctacgtggtgccgcgcgatggacgcctgctggagggcggcgaggtgcgtgcgggcctggagtcgcgcctgccgcggttcatggtgccgcaggcggtggtggtgctggagcggcttccgctgcttccaaacgggaaggtggaccgcaaggcgctgcccgcgccggaggcggtacgggagtctcgaaaggaggcgcacgtcgcgcctcgcacgcccgtggagcagatgctcgcgggcttctgggcggaggtgctgcgcctggagacagtggggctgcacgacaacttcttcgaggtgggcggacactcgctgctggcaatgcaactggtcgcgcgggtccgtgaatccttccgagtggacctacccctgcgcgacgtcttcgagtcggccacggtggcggcgctcgcggaacggatttccagggcggtggcgaccgcgggcattccggcgcctccgttgaagcggatggagcgcggtggcacggctccgttgtcgttcgcgcagcagcgactgtggttcctggcgcagctcgacccggcgaatacgtcctacaacctctgggcgcctgtgcgcgtgacgggggcgctggacgtcggtgcgctggcacggagcttcgaggcgttggtccgccggcatgaggcgctgcgcaccacgttccgcgccgaaggtggctcgccggtgcaggtcatctccgcggagacgcaggtgccgctggaggtggtggacctgtccgtgttgccagagggcgaacgcgaggcctcggcgaaggctcggactgaggcggaagtaggccgcccgttccaattggagcaggggcccttgctgcgtacggtactgctcaagttgtccgagcaggagcacgtgttggtgctggtgatgcaccacatcgtgtcggactactggtccatgggcatcctcgtccgggaggtggccgcgctctacgaggcattgtcccaggggcggccggcacaactgcccgagctgtccgtgcagtacgcggacttcgcgatgtggcagcgcgattggctcaaggggcaggtgctggagtcacagctcgcgtactggcggaagcagcttgccggggcgccgcgagcgttggagctgcccacggacaagccgcgacccgcgacacagacgttccggggcgcgaacctccatgtcctgtggccgaaggcgctgtggcgtgaggtggagtcgctcggccgacgcgaaggcgtgacacccttcatggtgttgctggccgcgttccagacggtgctgtcgcgctactcgggccaggacgacgtgagcgtgggggctcccatcgcagggcgttcgcactcggagacggaggggctgattgggttcttcgtcaacacgctggtcctgcggtcgaagttgtcgcccgcgctgagcttccgcgcgctgctggggcaggtccgcgaggtgaccctgggcgcctatgcacaccaggacgtgtcattcgagaagctggtggaggaactccaacccgagcgtgacctgagccgcagcccgttgttccaggtgacgctgactcttcagaacacccctgccgccgaagtccagctgaggggcatcaccctcaaggggctggcggcggaggagaagacgtcgaagttcgatctgtcactggttgtggaggaggtgctggacggcgtcgtggcgatggtcaactacaacagcgacctgttcgaggccgggacgatggaccggatgctcggacacttgagggtgctgttggaggccgccgtcgccgcgccggagcagcggctggccgagctgccgttgatggggagtgaagagcggcagcgactggtgaaggagtggagcgggacggcgtcggagtacccgcgcgatgccagcctgagtgtcctcttcgatgcgcaggttcagcggacgccggacgcggtggcggtggagtacgaggaccggcggttgacgtacgcggagttgagtcgccgtgcaaaccagctagcgcatcacctgaagggcatgggcgttgggccggaggtgcgggtggggctgtgcgtggagcgctcactggagttggtggtgagcgtgctgggcatcctgaaggcagggggcgtgtacgtgccgctggatgccagctatccgctggagcgactggcgtggatgaaggcggaggccggcgtcgcattgctggtggcgcaggagaagctggcggacgaggtagctgcgggtggcgagctggtggtgtgcgtggacacggagtgggacacgcagattgccctgcaaccggaggtcgcaccgagcacgcatgtgggagggggcaacctggcgtacgtgatgttcacgtcgggaagcacagggaagccaaagggcgtgggcgtgcctcaccgagcagtgtcacgcctggtgctgggaacggacttcgctcacttcgggccggaggaagtgtggctgcaactggcgcccatttccttcgatgcatcgacgctggaagtgtggggcgcgctgctgcacggcgcgaagctggtggtgtacccggcggggacgccgtcgctggaggagttgggccgcaagctgaagtcgtcaggcgtgacgtcgctgtggctgacggcggcgctcttcgagcagatgcaggcgcggcagccaaaggccctggacagtgtccgccagttgctggcgggtggcgacgccttgccggtgtcccgtgtgaaggagcggctggcagcaggtggcctgctcatcaacgggtacggcccaacggagaacacgacgttctccagcacgtaccggatggagaggccggaagaagtaggtgcctcggtgtccattggccggccggtgaagaacaccgtggcttacgtgctggacggggtaatgcgtccagttccggtgggggtgccgggtgagctgtacgtgggtggagatggccttgcggtggggtacgtgggacgcccggagctgacggcggaacgcttcgtaccgaatccgtacggcgaaggagagcggctgtaccgcacgggggacatggtgcggtggctggggaacgggacgctggagttcctgggccgagcggacacgcaggtgaaggtgcgtgggtaccggattgagctgggtgaagtggaagcggcgctggcccagcacggtggtgtcaacgaagccgtagtggtggcgcgggaggatggaggcgaaggcaagcggttggtggcctacgtgacggcgcaagagggcgcggaactggcgtccagcgcgctgagaagccacatgaagcagcggctaccggagtacatggtgccgtcagcgtacgtggtgctggagtcgttgccgctgacgccgaacggcaaggtcgaccgaaaggcgctgcccgctccagaggcacaagggccgaagacggcgcacttcgaggcgcctcgcacggcgactgagcagaagctggcgtccatcttcaccgaggtgctgaacgtcgagcgcgtcgggctcgacggagatttcttcgagttgggtggccactcgttgctggccacccagttggtgtcgcgcgtgcgcgagtccttccaggtggagctccccctgagggacgtcttcgaatcgccgacggtggagaagctcgctctccggctggaggaaatgcaggcgggagcttcatcccttcacgcaccgcccctgaagcggagccctcggttgggggcactgccgctatcgttcgcacagcagcggctgtggttcctcgaacagctggagccagggagccccgtctacaacatccccttggccatccggctttcgggcgctctgcgagtcgatgcactggagcgcgcgcttcgtgagttggtgcggcgccacgaagtcctgcgaacgacgttccgctccgagggcgggacgcccgtacagatcgtctcccaccaagcggagaatgcactgccggtggtggacctgtcgtcgctctcgtccgaggcggccgaagcggaggtcgatcgattgctgcgtgaggaatccctccgcggattcgacctccccagcggaccgttgctgcgcacgcgattgctgaagcgctccgaggcggagcatgtgctcctggcgaacatgcaccacatcgtctcggacggatggtccatgggcgtcatcgtccgggaactcgcggcgctctacggggccttccgcgaaggacagccgtcgccgctgcctgaactggacttgcaatacggtgacttctccgcgtggcagcgcgcgtggctggagagtggcgcgcttcagcggcaactggactggtggcgtcagcagctcgaaggagcccctcacgtcctctcgattcccacggacaggccgctgcccgcggttcagaccttccgaggcgcgaatctcccggtgagcatcccaccggcgttgtcctcaggcgtgaaggcactggcgcagcggcatggtgcaacgccgttcatggtgctgctggcgggcttccaggtattgctggcccggtactcggggcaggacgacctggtggtgggaacgcccgtcgccggacgtaaccgcgcggagacagaagggctcatcggctttttcgtcaacaccctggcgctgcgggcacgcgcgtccgctgagaagccgttcctcacgctgcttcgcgaggtgaaggatgcggcgctgggtgcctacgcgcatcaggacgttccattcgagcagctcgtggaagagcttcagccggaacgcacgctcagccactcgccgctgttccaggtgatgttctctctgcagaacacgccggtgccggaggcgctcgtgcccgggctctcgatgagcgcgatggacacggagatcggcgccgcgaagttcttcctgacgctggcgttggaggacctgccggacggcttctctggcgtcttcgagtacaacgcggacctcttcgaaccggccaccgtccagcgcatggccgcgcactggctcacgctgttggaggctgccgtggcctccccggaccgccgtttgtccgatctgccgctgctctctcctctagagcggcaccagctcctggtggagtggaacgacaccacaacggagtatccacgcgatacgcccgtgcacgttcagttggcggacctggcgacgcgcattccggaaacggtggcgctcgcttgggagggggggcagctcactttcgctgagctgatggcgcggagccgcttgttggcggcgcatttgcggagcttgggagtgggccccgaggtccgggtgggcctcttcgcgcgccgatcgccggagttggtggtgggactgctcgccatcctggaggccggtggtgcctgggtgccgctggagccggacgctccccgtgagcggctggcgcgcatcctggaagacgcggcgcccgcggtactcctcacccagcgggcgttgcgagacttggtgcccgcgacctcgatgcccgtggtggtgttcgaggatgaccttgggtcagtcgccgctggggcttgggaggcgagcgcggtcgcggacaacgccgcctacgtcctcttcacctcggggtccacgggacgtccgaagggcgtgctcgtctcccaccgcgcattggcgcgacacacggcgtggttcatcgccgcgttgaagctgggcacgggagaccgggtgttgcagaaggcctctgctggcttcgacgctgcggtgcccgagctgctggccacgctggtctctggtgctcggctggtcatcgcaccgcctgctgccgagagcgacaccgaggtgctgctggccgcgttggaacgccagcaggtcacgatgctccagttggttccgtcgcagcttcgcgtcctgttggcgcacgaagatgtggcccgagccgcgggcttgagggttctggtatccgggggcgaggcgctgccggtggagctcgttcatcaggctcgggagcggttgccgtccacgctcatcatcaatgcgtacggaccgaccgagaccacggtcgatgccacggcctggctgggaggcgacctgagcgaaggccccttcgcgcccattggccgacccatcgcgaacacccaggcgtacgtcctggatgcacagggccagccggtccccgtgggcgtcccgggtgaactctt

SEQ ID NO: 845 - DNA, 7760 bp, Myxococcus xanthus
caccacggggttgctgctcttcaccaacgacgaacgtttggtccaacacgggacgtcgcccgagcggctcctgcccaagcgctacgtggcgggcgtggtggggccgccaccggaggatgcgctccgccggctgcgtgagggcctggtgctggaggacggcccgacgcggcccgcgggtgcccggctgcgcgcgccggacgtggtggagctcaccctgacggaagggcgcaaccaccaggtgaagcggatgctggcggcggtgggacatccggtgcggaccctgcaccgcgaggccgtgggcggcgtgacgctggacgtgcccgagggcgcgtggcggttgctgacggacgaggaagtgtcccaggggttgtccttctccgtctcctgaggccgcacccgccgcgtgtagactccggggccatggacgattccgtggcccgtgcgcgtggcggcttccccgcacgggccttctggctcggtgtcttcggcgtcacggcggccttcagcctcttctgcctgggcgtcgagtacacgccggactcgctgcactacctctccgtggcgcgtgggctgctgtcgggctcggggctgtcgggcacgctgctcgcggtggacacggccatgccccggccgttggacttgtggccgcccctgtttcccatggcctgggccgccctgttgtggctggggccggatgcggcggtcatcacccttcacctgctgtgcttcgccgtgctcgccgcggcgctcttctccatggctcccgagggacagggcgcgcgctacatctggacgtgcgcggtgctcatcgtcctctaccgtcccttcgggcacgtggcggcggcggcgtggtccgagcccttgtgcgtcgcattgctcgcgctcgccctggcgcgggaggtccggggcgcggacagtgtcggccgttccttcctggtgggggcgctgctgggcctggcggtgctgactcgctacgcggcgctgttcgtcctgcccgggctcctgttgtggcgcttcgtccgggcgcgtgaggcgggggtaccgcggcggcatgtcgtgcatgcactggcgctgggtgcggggctcggactcgtggtggcgccgtggttcgtccggaacggtgtgttgttcggccgcgccatggggccgccgagggcaccacgtggcgcggggctcttgtcctcgctgctcagtggggtggagaccctgttgggggaggcgtccttcggcgcgttcggtgtgctctgcgtggcggccacggtgtggctgctgatgcccgcgctgcgcggtgttcggggggagcgcccgccggatgcatcgctggagcggctgcggcccgcggcgctgatggccgtgtcgtatgtcgtgggcctgttctggacggccacccgcacgcagatggacacgctggatggccggctgctggcgccgctgggcgtggggctggtgccggtgacggcggcggtgttggtgtcgctcgtggagcgttcccggttgatgtcacctccggtgctcatcatcactggcgtggtggtggtggcgggacacctctgggcgccgctgcacgcgcgcgtccgtcagccccggctagggctgcaacaccttcgcgagcgcgttgccccgctgccggcgtgggtagaggcccacgtcaccgagcgggacctgctcctggggccgcagctctggtggggccatcccttctcacgtgcccccgtggtagcggatggctaccccgagcgaggtttcctgacgcggcagacattgggggcctacctgctgcggcacggcgccgcctacgagcgtttcttctggttcgataccaggcctccgcctgtcgacgcggctgccttcgaggccgtcgaggtcgcccggttggagacgaacgcctactggtccaccgtctgggaaatccgtcccgtgggccgcgcgactcccgtggacggacgcgaggcgatacccgcgccgtaggcatccgccgcgtgggcctcagcgctcgcgcgccgcgacggcctcgacgaggctccggatgccctgtgccagcgccaggctggtggggagcggccggccgaggaggctcggtacaccggtggccacctgggcggagttggtgaagacgcaggcgctcacctgcgcgagctgggcgaacgagacaggccgctccacgatgggcagcgtccccacatgtccggcctccagaagcacttcgcggatgatgccggggagacacggcgcggacagaggcggcgtgacgagtaccccaccgcactggaagaagacgttggccgtgggcagctcgcagacctcgccggcctcattgccgagcaggggcaggcgctccatcacactgaactgccggaagtaggcgaggcccttgtgattcagcgtgggctcgccgcggcggtatgcccccggctcctgactgtccagggcccgtccctcgcggtgcatccgctccaggtctggggcgtgctcgcggaaggtgagcagcacccggccatcacttgccgacaacttgcccacacctcgaaacgcggggcccatcgcggcgtcggctcgcaggcagcgctcaatcgcttcgcgcaccgcggctttcgcgaggtgctccgacggtggcgtgcggacggcgccggggaaggcggccaggctcgcgcgcagccgcgccaggtgccgggcgaggaaccagggctcgccggcctcgatgcggaaggtggtgaagaagcccgcgccgaagaagaagccctgcgcgaagtcccgcaggtgcagttcttcccagcgccgtacctcaccgtccaccgcgaccgtggagaacatggcggcctcctgtgcgctcagtgcgccggctccaggaagttggcgagcagttggggcccctggggcgtgaggaacgattcggggtggaactggacgccttccaggcgcggcagctcgcggtgcttgaggcccatgatgagcccatcctgccacgccgtcacctccaggcacgccggcaggctctccgcgtccacgaccagggagtgataacgggccgcggtgaagggggcgggcagtcctcggaagacgccctggcccgagtgctcgatggtcgccgtcttgccgtgcacgggcaccggtgcgcgcaccaccttcgcgccgaacacctggcccaggcactgatgccccaagcacaccccgagcacgggcacccgcccgcccagggcccggatgacgtccatggacacgcccgcttcgtggggcgtgcagggaccgggcgagatgaggatgtggtcgggccggagcgcttcgacctgcgcgacagtgatggcgtcattgcgcaccaccttcagctcggcgccctgggcacccagcgcctgcacgaggttgaaggtgaaggaatcgaagttgtcgatgacgagaatcatcccggcctccccaccgatgccagggccaggagctgcgagcgcgccttgttgagcgtctccttgtattcctgtcggggctgcgagtcgtggacgatgccgcctcccacctgcgcgtaggcctggccgtccttcaccaccagcgtgcggatgacgatgttcaaatccaaatcacccgtgaaggacaggtaccccagcgagcccgtatagagcccgcgcgcatgtggctccagctcggtgatgatttgcatcgtgcgtatcttcggcacgcccgtaatcgtcccgcctgggaagagcgcgcccaccacgtccagcggctccacgcccggcgcgagctggccgacgacctccgattcaatgtggaggacgtgggcgtactcgacgatgtccatcagcttcgtcacctcgaccgagccataggtgcacacccggcccaggtcgttgcgctccaggtccaccagcatggcgtgctcggcgcgctccttctcgttggtgcgcagctcgtggacgaagcgcgcttcctcttcgggcgtgccccgtcggcgcgttccggcgatgggccgcgtggtggctcggccgttctccacacgcaccagccgctccggtgaggcgctgacgacgtggaagccgtcaccttcgagatagctggcgaagtggacggggttgatggcggacagcgtctcgtagagcgcgagcggctcaccgggaaagtccacctccagccgctgcgagagattgacctgatacgtgtcaccggcgcggatgtactcgcgcacgcgctcgactgcgtccaggtaagcatcgagggtgaagttggagcgatacgccgaggtgggcccatccatcgcgggtggcacgcgtggcgccgtgggcgtcgcggtgcggacgtggacctccaacgcgtccaacctgcgctcacagtcctcccagtccgagcccgtggccaccaggagcaattggccctcgtggtggtccaccgtcaggaaggtgtcgatgaatgacaggtcgatttcgggcaggtgcaggtcgtcccgtgggtgccggggcagggactcgaaacagtgcgcggcctcgtagccgaagaagcccaccgcgccgccgcagaagagcggcattccgggatgacgcacgccacgccaccggcgcagcagcgagcgcagcacctcctgcggcgtaccctgctggagcgcgccatcaatgaagcactgtccctctttcgcggtgaaacgcaggaagggcttcgcgccgaggaacgaatagcgcccctcggcgctgacccgggtgctctccagcaggaaccggctttccgctgggagggctcgcaggaggtccacgggacgcagcgccccgagcgggagccgccgcaccacgggcacctggttgtagccctgggccacgaacgtctcgaaggacgtccggtccgggaagcgcgtgggggagggcgggcggctcatgtcgaggcgcttgataccaggaacgttccgtccagttcgagtcgtccatggccccccgggcagggggggccggtggaatgaacgttccgtgcggtcagcgtgagccgcgttccagcgtgcggcgtgcctccttgaggatttcgtcctcggagagctggtcggtgcgaatcgcggagcggtccgccttcagttgctggaccttcccttcgcgcaggacatggaactggcccggcttctggccggggaggcgggtttcggcatcgatgcgggcctcggtgaacatgggcttgagcttcttcagggcgttgtcttccttcaccccgccgacgaaccaggtgcgcacgttctcccggcacttgtagtccaggtctcccgggctctgcgtacccagcatgacgcccacgcccgccgagcgcgcgcgcttgagcaggttctccatcggctgcttcgtcgcgggcttgctcgtcgcgggcagatagatgtcggcttcgtcgaagagcatgacggcctggagcctggaggcggggtgctggctggtccagcggttcgcctccagcagcagttgagacacccagaagcggacgcggctgaggtctcccaggtacttggtgctgatgatgctcaggcgcgtcttgcccggtgtgctcgcggcgccgagccccagcagttcgctgatgtccagacgttctccacccgttgccagcagggggcggaggtcgagccggagcacttcgaggtcctgggcgagcttggcgaacgtcttggttggcaggccccccgtttcctgccggagcgactcgtcctgctccgcgacgaacttctggaccatctccagggtcagttcagtgcccggaggccgctggaccaacaggcgcaaggcctgcgtgagcagcgcccgggctgccttgtcattggggctggtcttgtattcgagcatgcccgcgatggcgtccgcggcctgctgcacaccttgctcacgctcttccggcgacaggctttcaaggccgcgtggaatcacagggatggccagcggccgcccgtcggagcggcccggcgtgtagagcgcgacctcgacgcgctcgcgcagcaggcggcgccgctcgatgagggcggggtcgtccagatgttcctcccaggagaggtcacgtgcgtacgcggcgaggtcccccttccggtcgacgaggatggcgggcacaccgcggaggagcagttgctccaggacgttgagcgccagcgtcgtcttgccgcttcccgtggtgccgaggaaggcgctgtggcgggtcagctcggacgggtccacggtcaccacctggctgaacacaccttccgaggagccaatccgcagcggtcctgtgagtgtttccgggggacgtggggagggcgtcggagcggcggggctcgcgttgcccctgaatccgatggggggcttcattccctggggcggtgtcatggtgcggcccgtcagcatcggcgattcgatggtgatgtcctgcaacgggtcatccgaaagggattcggcccggccttgcctggcccgctgggcggcgatgggctcgcgggcggagcgcacgcctctcgcctccagtgcgctcgtttcggcgcgggccggaggggtggacttcgctcccgagaggacttgggccgggacaggcgttccatacggcaacgtcggtgggctgttgaacagctccgtctgtgccttggttgcggtgctccgggctccgacattgcccatcgggacacccgtgccacccttgggcggggcgtccggcttctccagccccaggatgtcgctcacggacttgagccgggtgatggggcgagccgtccggctccattccaggagggcggcttcacccgcatgcctctcacggaaattgcgcagggccatgaggtcccgaagctccgtgtctccgacgacgacccggcgtccgcccttgcggagcagcgcgcccaattgctcggcgacgacaccgccggggcgggctggagggaagtcggtggtccgcaccaccacaggtgtctttcccgcggctttcttgagcgcttcggtcatctgcctgccgaggccgccgccacgcgagtcccgctcacacagcgcgacgaggagcttgcttccctccgggtggacctggacgtccagcatctccttgtccttgggcttgacgtcgaagcgcttcgcgtctccgagctccttgccgccggcttcaatggcccaggccagcagttccgcgacacgcgcgggctcttcgggtgggtcaattcgcagggtggcgcggaagtccgtccacagttggtccatatccagcttggagacttgctgctgctgagccaaaggtgtcttcgccacgcccgggccctggggacgttgcagcgggaagttggcgggcagcttgccgtcctggatggcgcggtcgcggtagcggcggcactcatccaggacatcgcgtgcgcggtggccgcccagcgcgtcgaagccgttcgccggaatgggccaggtcgggtccgacggggagaccgcgaagcctcgctgttcaaacaggtcatgaagtcgccgcgccgcgaggtccctggccgtttcggccgtcacggtccgctccagcgtcacgggctcggggtcgttctcgatgcgatccaccgttccctggttgagcaggggcttcatcttcgcccagtagtcggcgaggcagcagaagaccacgaccgcgcgaggcaccttgctcgcgatggccgccaggctgttcatcgcgcgccggaaggagttctccatctgtgggcgctgctcgaagtcgctgacgtcctcgacctggtcgacgcagagcacgagcgcctggcccaggccgcccatcagtcgccccaggtgttccaccatccgcgccggcgcatcgtcggcggtccctttagagaacgg

SEQ ID NO: 846 - DNA, 5211 bp, Myxococcus xanthus
cgccgagcgtactccccttgagcaaatccttgtccacacggggcaacactatgacgccaagatgagcgacgtgttcttcgccgacctcggcctgcctgccccggacgtccatctgggcatcgggtcgggcagccatgcgcagcagacggcacgcatgatggtggagctggaaaaggttttcctggcccaccctccggcgctcgtctccgtggtgggcgacgtgaacagcaccatcgcggcggcgttggtgacgtcgaagctgggcatccccctggcacacgtcgaagcggggctgcgcagctactcgccacaccaaccggaggagatcaaccggctcgtcaccgaccgcctgtcggacctgctgctgacgccttcacgtgacgcggacgccaacctgctcaaggaaggcaccgacccggcccgcatccacttcgtgggcaacgtgatgatcgactcgctcttcgcctcgcgcgagaaggccgacaagctgccggtgctcaaggacctggggctcatcccccacggctacgcggtgtgcacgctgcaccggccctccaacgtggacgaccccaagactctgggcggcctcctgtccgcggtggcccacgtcgccacgcgcctgccggtcatcttcccggtgcacccgcgcacgcggaaggtgatttcggagcatggcctgaacacgtggttcgagcgcacgccgagcctgcggcccgtggagcccatgggctacctcgacttcctggcgctcacgtcgaaggcgcgcctggtgctcaccgactccggcggcctccaggaggagacgacggccatgggcgtcccgtgcctcaccctgcgcgagcagaccgagcgccccatcaccgtggaggaaggctccaacgaggtggtgggcaccgacccggtccgcatccgtctggccgccgaccgcgtgctggatggtgaaggcaagcagggccgcgtgcccgagttctgggatggccgcgccgccgagcgcatcgcggacctgttcgcgagcttcctgggcgtcgaggaccggccgattcaggcggcctcggcctgagggcaaatgacgggtgggggccccggcgttccgtgggcccgctcgctcgtccgtccccgcctgtgcaggagggcccgccgtggtagagcgccggcaggcccatgcacagcgcaccgcaggaagaagcccccgagggctacgtcgacatccgctacgtcgtcgagccgaactacgcgggttggcggctggatgagtacctgggggagaagctccgccggatgacgcgggagcggctccagggcgtcatcctgaggggtgtcatctgcgaggagcggcgcctgaagccgtccacgccggtgtacccggggctggccttccgcatccgccgccgcgccagcgaggagccggacacgcccacggaattgcccgtggtgttccaggacgactggctgctggtgctggacaagcccgcgggtctgcccatccaccccacggcgcgctaccacaagggcaccctcgtcacgctcctgcgagagcgcttcggtgagcgcttcgccgagcccgcgcaccggttggacagggagaccagcgggctggtcgtctgcgggcgcaccacggagtcctgccgggtgctggggcggctgttcgtctcgcgtgacgtgcacaaggagtatctggcgctctgcgaagggcacccgcccgaggacacgttcaccgtggatgcgcccatcgcggagggcaccgagctcatccgcatcgccgtgcgcatcgacccggtggagggcaaggagagccgcacgcgcttccaggtgctccagcgcttcacgcgggatggcgcgcccttcgcgttgctgcgctgcttcccggagacggggcgccagcaccagattcgcatccacctgtgccacgcgggcttcccgctcgtgggcgacaagatgtacgggcccgaccccggctacttcgaccgcttcagcaagcactgtctggagcccgaggcgtggccgcggctgcgcctgccccggcaagcgctgcacgccgcgcgcatcgccttcccccacccgggctctggccaggcggtggcgttcgaggcgcccctgcccgcggacctcacggacttcatcgagggccggcccgtggccttgccggcctgaaacgcgaaggcccccagcctggaatgaagcgggcagggggccaggggcgtgaagcaggtggtgacgtcaggcggtgagcttgctgggctcggcgcgttcttcgccgaagtcgccgatgaggtacttgccggagaagcaggcggtgcagaagctgccgcgctccgggtcgcccaccgcgcggcccaggccttcctgggagatgtagccgagcgagtctgcggtcacgtacgtggcaatctcctccaggctgtgcgtcgcggcgatgagctcctggcggctcggcgtgtcgatgccgtagtagcaaggccacttcgtgggcggcgaggagatgcgcaggtgcacctccaccgcgcccgccgccttgatcatcttcacgattttgcggctcgtggtgccgcggacgatggagtcgtccaccaccaccacgcgcttgcccttgagcacctgccgcaccgcggacagcttcagcttcacgccgaagtggcggatggactgctgcggctcgatgaaggtgcggcccacgtagtggctgcggatgaggcccacgtcgtagggaatgccgctggcctgcgcgaagccgatggccgccggcacgcccgagtccggcaccgcgatgaccaggtccgcggagggcgccggctgctccttcgcgagctgacggcccatttccttgcgcacttcgtacacgttgctgccgaacagcgtggagtccggccgcgcgaagtacacgtgctcgaagatgcagcgcgcctgacgcggaggctccgcgaagggcttgctggtgcgcagcagcccgttctcgatgacgagtagctcgcccggctccagctcgcgcacggtttccgcctcgatgaggtccagcgcggtcgactcgctggccagcacgtaggcaccttccttcatccgccccagcaccagcggccggatgccgtgcgggtctctcaccgcgacgagcttgttctccgtgagcaccaggaggctgtaggcgcccgtcaccttgcgcagcgcctccacgagcttctgctcgaaggtcgcctgcttggagcgcgccagcaggtgcaggatgacttccgtgtccgcgtccgactggaagatggcgccgtcggcctcgagctgctgcttcagctccgccgcgttcaccaggttgccgttgtgcgcgatggcgcactgcccgcccgcgtactgcacgaagagcggctgggcgttcttgagggcgctgcctccagcggtggagtagcgcacgtggccgatggccgcctgcccgggcaggtcggcgagcaccggcgcatcgaagatgtcggcgacgagtcccatctgccggtgagcgcgcagccccatcccgtcagaggcgacaatgcccgcggactcctgcccgcggtgctggagggcgtgcagccccaggtatgtcaggttggaggcctcggcgtgccccacgattccgaagatgccgcacatggcgcgctgccttactcctttcgagcggtgagcggaacaggaacgcatgcccctctggtgggtattccacccgacgccagagtcgtttcatgtgggcagtcaggcgtcccaaaggccaggccctgcggttagtctggttcccgcatggcatcctcgcgattggtccgctggcgttccctgtttcccctggtgttgctcaccgtgggcgccgcgtattcgctggcgtcctggaactggtgtggcagctgggctgaacgcgcgccagtccttgtgtcacaggtccatggcgaagggccgctgcgcgcgggcgcggcgaaggtggcgctctcgccgcccttcccggtggtggtggccggctatacgccgccacggcccgaggcggagcaggccgacgtgccgctctacgcgcgcgcggtggtgctggaggcgggagggacacaggtggggctggtgtcgttggacctgctcctcgttccggatgtgctggccacgcgggtgcgtgagcgcgcgcgggcctcggggctggaggatgtgctggtcctggccacgcacacgcattcgtcgttgggcgggtatgactcgcggttggtggcccaggtgtccggcaccgggcgctaccgggaagacgtggtggatgccatcaccacggcggcgggtgacgcactggcccaggcggccgcgtcgctcgccccggtgtcgctggaggtcggcgaggcgcgggagcagaagttcgtcatctcccgcagcggtggcgagaagccggatggcgtcctgacgcgcgcggtgttccgggggcaggcgggcccggtggcggagctgctgctctacgccgcgcacccgacgatggtgccgcgtcgccgcgcctacgtcgaccctgactaccccggccggctcagcgcgctgcgcgaggaggcgggcagcggcgtgacgctgttgctgcagggcgcggggggtaatgcgacggtggcgtactcggaagggcaggggctggagcgggtgtcgggcttcgcgcatgccctggcggagttggccggcgatgcgcccttgtcacccgtgggggagaccgtgcggctgtccctggcgcgcgctgatgcggccatgccacgtccggacgcttcgcggctggtgccggcgctgacgcgggcggcgggggacaacctgctgtgtgaatccgcgccgcgtctggcggaggtgggcgcgctggtgctggggccgctgaagctggtggcggtgccgggtgagcccagcgtggccgcgggcatggagttgctgcagcggaccggcgccacgggcgtgctgagcctggcggatggctacgtgggctacgtggagacggcggcgaacgtgcagggtggactgggggagtccaagcgccagtacttcgggcccgcgctgctggaccggctgagcgtggcggcggagttcgttgccggggcggcgggcttcacgcctttaggcggccgggcgccgcggaggactttccgcggcgcggccggcttgaggctggctagaacttctcgaacttggagtccatcttgcgcttattgaacacgagcgcggtgcggcccaacaactgcgcgagctccgcctgggcgccctccggcc

SEQ ID NO: 847 - DNA, 8060 bp, Myxococcus xanthus
cgtcgtgcaggtgccacccaacgcgcgccagctcaccctgaagctgaagtgccacaacgaggccgaggtggacgtcccggacgcggcgccaggcaatgagccggccaccgcgagcgtttccctcaagcggcagccgcgctgccgttagccgaaggcccgcttcccgagaagggggcgggcgcgccagctcccctgtgggcggagcgagaggaggcgggagttcgtgagcaaggtgcgcaaggtgaacaaggcggatcccctggcggatcttcctcgctgggcccagcagttggcccggaagtactacacgaagacggtcagcgccttcctgctgtacggggccgtgcgggacttgcagcccctgcagctcgaggagggcggccgcggcttcggcacgctgaagacgttcctctccgaggagctcttcggcggccgggaccacgtcatcttctatgaccggtcgtccggcatccgctccgcgacgccggagacgcagaaggacctgcagcgggccatggcgggctacgacgccatgtacggcacggactacgccaaggtcatgccgagagacccgggccgcgcgctccagattctggagaacttcatgcgcatgcgcctgagcgagggccgctcgctggcgctcatcgtcgacttcgcggagacgctcgttcccggcggagagatgagccacctttccagcgaggaccgcttcgtggtggccacgttggacaagtgggcgcacgatccgcagttcctcgcgtccgacgtgtccgtggtgctgctggcggagaacctggcggacgtgtcgccgcgcatcagccgcaacccgtacgtggcgcccatcgagctgccccttcccaccgaggaggagcggctggagtacgtgcgctacaagctggagggcaagcggctccagtccgtgtcggacgtgccgctggcgggcctggcgaagatgacggcgggtttgtcccgcatcaacctggaccgcgtgctcaccgaggcgctcgagcgcgaggtgcgcatcacctccgagctgctcaaggagaagaagcgcgaaatcatccaggcggagtgccacggcctgctggagttcatcgagccggtgcacacgctggacgccgtggcgggacacgccaaggccaagcagatgctgcggcaggccgccggggccctgaagaaggggcgcctggaggtcatgcccatgggctacctgctgtcgggccccgtgggcacgggcaagacgttcatggtgagctgcttcgccggggagattggaatccccgtggtgaagttcctcaacttccgcagccagtggcagggcgtcaccgaggcgaacctcgagaagatcttcaacctgctcaaggccctgtggccggtggcggtgatgattgacgaggcggatacgttcctcggcaaccgtgactccggcggagactccgggacgagcagccgcgtgttcggctccatcgcctcgttcatgggcaacacgttctaccgcgggaagattgtctggttcctgatgacggcgcggccggacctgctgcccatcgacctcaagcggcaggggcgcgcggaggagcacctggcgctcttctatccgcagacggacgcggagcgggacgagctgttccaggtcatgtccaagaagacgggcgtgtccgtggaaggcatcgaatccttctccacgctgattccggagggcgtgcgcgccttcagcggcgcggacatcgaagccgtcatggtgcgctcgaagttccgcgcgctggcggagggccgcgaggcggtgacgaaggacgacctggccgcggtgctcgcggacttcgtgccccccagctacccgctggaaatcgagctgcagaacctggtggcggtgcaggagtgcaccagccgcgagctgctgcccgagggcttccgccaactggaccgggactacatcacccggcgcgtgcgcgagctgaaggcgctgctggagtcgcagtatccggtgctgccttacgcccaggcgcttgtcctgggcgcacggcccgctgagacttgggacatggctgatggccccactgctccgcgttcctggttcgcgtattccctcgacctggccccggtgattgcgcacgagcgcctcccggggctcccgcccattcccgacgtgctggagggcgagctggccgaggcgctcgacgtggacgtcgtctacgacgtggcgtcggcggcctggggcgggaaggtggcccggctggtggatgcgccaggccacaagctccccggcatgctccgccgcgttcccgcggacgcctgggacgcgctggtccgcctggagtcagcaatggcgagcgccaccgaggtccggcaggtgaaggtgcgcaccttcaccggggccgtgctcagcgcccatgtcttcacgcccacggctcccgcgacgcccgctcaggggctcgtgagtgaggcgttcctcgtcaccctggcgctatcagccgaggaggccgggttgtccccggaccacgtggagcggctccaggccgaggcccgtatcgtccaggccctccagaaggcgggccccgaggccctgaacccttcgaaagccccaggaaagaagggttaggcgggtatccaggtgcgaagcgacccccaggttctttttcttcgtaagaaaacggagccgtgacgcaacttggcgcgccgaacggccgacgatgagggacggggctccacctcgtgcttcacctcgtcggccccgaggacattcaggatgacgctgcgacccaccacgacgcgagccgttcccccgcgcccggcatcggccgcttcgcccctcaatgccgtcaccacgccgggaggaagctggagacgctcgacggcccgcgaggtgcccatcaacgagctccaggagaagttcggctggaaggatgacagctggcaggtggggttgatgcaggccgctgacgcggcgggcagcaagacgcgcggtggcaacgggcaggtgtccgcggcggagctggagcgctacctggccgcgcccgaggacgggcagtacctgacgtccaccgcgcttcagcagaagcgctcctcgctggacgcgaagctcgcgcagggaaatggctccgcggtgggcgtggacgccttcgagagtggctggcaggccacggtggcccggcgcgcggacctgctggggggcaatggagacggccagctcagcgcggaggaactggacgcgttcatccaggcgtcgaaggcgggcaagcacgcggacacccgctgggtgccggaccagcagatggccgcgttccagagccgcgtggccgaagcggccggagagctggacccgatgcgtcccgccggagcgctgggctcggaggggctcagcctggtgaaggagtactcgcgcctggcgctggaccagggggcgaacgtccccaccttcgtgagctacatgctgtccgcgtccgacatccaggagacgcccgcgacggtgtcccggctggagagcaccttcgttcgcgaccccgagctggggcgcaccggcgtcaccgactccgactacacgcggacgggcttcgaccggggccacatgaagccggcggaggactcgcccacgcaggaggcgatgaacgagagccacctgatgaccaacatcgccccccagcacggcaaccacaaccagcaggtgtggcgcacgctggagcagggcgtctccggtctcgtgaactcgcagggcggcaaggcgtacatcctcaccggcaacctgtacctggatgacaagggacagccgctgcctccggagaagcgggagacgacgggggcgggggagcgccgcatcgccgtgcccacgcacaacttcaagacggtcctccacgagctgccgaacggcagcctcacgatgtacgcgtacctggtgcccaacacgaaggacgggccgtcgaagaaggaggacatcctcccgctgctcgattcgcaccgcgtacccgtggaccgcatcgaggaactgctggggcaggacctctacgcaaacctgcccaagcgggtgcaggacaagctggagaagggcacgtcggccgaaggcgtcttccagcgcaacagcctgtacttcgccgccagcctgttccgtttcgcgcccggcaactgacgcggggcttcacagcctgggcttcgcttccgggggaagcacgggcttacgccacgggacgcggtacccccaggtgtgggtcatccacgtgctcgacgacggccacgcggtctcccacggagagcgcgtcgtgcagcacgcgcacggcctcgttcgagtggcggatgcagccgtgcgagacgtccgtgcccaggagggcgggggcgttcgttccgtgcagctcctcaccagagtgccggccatccgcccaggagaggtcgagcatgcgcacgccgaagacatggcggtcattccacagccgtgcgccggccgcttcggtggccagttgatccaacttcgtgcggaccaccttgatcccggtgcgggtaggggaggccgcggcgcccgtggcgttggggaagatgtccacgagttgcccacgggtgtcgaagaggaaggtccggtgctcccggagggccaccaccacgcggacctgttgtccgtcgaagaaggcggaaggcaatccccgtgtctgcccacgcgtccctggcgctggcgccagtgcatccagcgcgcgtagcgtggaggcatccagcgcgcccgtggggaggacggcggggaaggtgcgcgaggcatggacctggaagttccgcagcgctcgggtggtgtgcgggccgtggtgtccgtctgcgccgccgtgcagggcgaagcccatgtcgagcagggtggcctgtacggcgcggaggccctcgccctggctgccggggccgaggatctgggcccctgacgcgacgtccgccagttggggcagtccggtgaagcgcgcgttgtcagggggcgctggagtgcgcgcgggccggtccacgccttccagaggcaagggcgtcccggaccgtggacgtgcatccagcgagggctgaggaccttggccgacggtgactcgggagacaggcttgggactgcgtgccgtcttcccgagggcgggtgttgatgccgcgtccgggacgtcaggcggaaggaacgagatacgtgactccggtggcgagatggatgaggtcatccccggcctcagtgcaaatcgctcgcccgacccaaccacgcgaggcctgcctttgaggaccacaccctccgccacgacgtttctgaatgtggacctcgaaatccgaagcccgcaccggcttgagggcctggttcgcgcgctggctccgggcgcgttcgcgcttcacgaggagccccacttcgcctgtctggagctggcttcctggccgacgagcgtggagtctgcgctgatggagttcgtggggctcatccaggcccttcccgaagaggcgcgcgcggcgtgggacggttgtacccagcggcgcttcgatatcgggattcatgtggggctggagccccattcgagcgccttccccgtgccggaactcgtcgtccagcagctcgccagtgtgggtgcggagctcgccttcaccgtgtacgcgccggagactacggggcgctgaggaggagcaccttccccgtggggagggtgcggtggtccttgatcttgttccaccgcatgatgtcgtccacgctgacgccgtagcgctgcgcgacggaccagagcgtctcgccctccgccagcgcgtggaccttgccagccttgcccgcgggcttggcgacgctcaccgagtgcttcgccagcaccgtgccgccgcgctcctgcacgctggcggtggccgtgttgccatcgggccagacgaacagcgtggagcccacctggagcgtcgggttgcgccgcttgaggttgttccactgcttcagcgagtccaccgacacgttgaacttgttcgcaatcacccagaggctgtcgccggacatcacgccgtacgtcacgcgcgtgcgcccgttgatggtctccttcttcacggggcccgcggccaccgggcctttgggcgtgcccgctggtacctcgtcctcgggccgcaccaccacgccgctgcggcgggcctgcgccaccttcgtcgccagcgcgccgcccgagctcttgccggcgggaatcggaatcaccagctctccacccacgcgcaacgtccgggccgacttcagctggttcatttggaggatggcctcggacgccgtgccgtacgtctccgcgatctgggacagggtgtcgccgcgcttcaccttgtggatgcggaaggtgagccgctccgcggggctgatgcgcttgtagttgtccgcgaactgcgtccctgcccccttgggaagccggagcgtgtagggcttcttggccgtcgccggcggggtgcaccagcgcttcagctcagggttgaggtcctgcaccaccttgacgggcacgccggccgcgcgggcgacgacgtccaggtccgccgcgtcggtgagctgcacctcatcgaagtcgagcacgggctcggggtcgaactcgttctcgttgaagccgaacgccgccgggtgcttggccaccagcgccgcggcaatcagcttgggcacgtagtgcttcgtctccttcgccaggccgcgctcttcggacaggagccagaagttcgtcgtcccgtgccgctccaccatccgccggacgcgcccggagccggtgttgtatccggcccatgccaggtaccagtgccccagctcgcgcttgaggtccttcagataggacgccgcggcgtgggtggccttgatggggtcccgccgctcgtccacccagaagtcctgcttcagcccgtactgcttgccagtgctggagatgaactgccacggccccgccgcgtgcgcccacgaataggcatgcgccgagaagccgctctcaatcatcgccaggtacaccgtgtccttcggcaggccgtactgctccaggatggggtgcatcaccggcacgtaccgggccgcgcgcgacatccacttgcggaaccagcgtcgcccgggcccctggaagaactggacgtactgggccaccagcggctgcatctccactgggatgtcgtaacggtcctgaatctgccccacgtcgaaagtggccaggtccgtgatgagcggaatctccggcagctcttcgtcctcgcggaaggtgtgctcgtcgagcgcgtccagcatgcgcatccgcagcgggttggcgaccccgagccgccgcagcgactgcatcacctccgcggtggagcgcgacgccgggtccagcgcggcgccttccagtgcacgcagttcctccaactcagcggactcggactcaaccgcgtcgcgcgtggcctcgccttgctcggaggcgtcctcggccaccatcggcgtgccgggctccagcggctccaaaccgggctcatcgacagcatcggtcccggtatccgcggcgccaggttccgtggcggccgttggttccttctcggccggagactgcgctgcgggtgcctgcgcaccctcggattccaccacctgagccttggcaggaacgggccccacgggcggtggggtgagccccgaggcaggggctgaggccagggcgagcaggagcagaggtagaggcggcatacagtcgcgggaacgggcgcccggaggcgggcgaaagcgggaagtaatcgcccttttccttgacagtcaaacaaggagtcgcggcctgcgcgtcttgtttggacgcagggtaggagcaaccgcccaggcgagcccctggattcctggatgactagggcttcccgtgtcccggccccacgatgcgcggcaggtacgtcgcgaaatcgaagtgaggcgagttctccgggttgtgacaggtgacgcacacgctctcgcccggcgaggcgatgatgttgtgggtgcccggcgcgtccgcgtgctccgagcccggaccgtggcagctctcacagcccacgtcctcgcggcccgccaccttgtccagccggcaaacgccgccgggctgctcccagccggtgacgtggcaccccacgcagttgaggtggaactgcccgcacacctgttc

SEQ ID NO: 848 - DNA, 4847 bp, Myxococcus xanthus
cgcatgacctgggcaacccactcagctcgctccaactgcggctgcggcgcctgtccatgcagagcgccggcacctccgacacgcggatgcgcgacggcctggccggagccgagggcgaaacgcggcgcctgggccggctggtgcacaacctcctggacctgtcccgcctgtcagcgggccgcatggtgctggacacggagccgctggacctggcgcacctggtgcgcgaggtggtggaacgtcaccgcgaccaggccagcgccgcgggctgcgccctcggcatccgcgtggaggaaggcgccaccggccagtgggaccggcagcgcctggaccgcgtcatcaccaacctgctgagcaacgccctcaagttcggccgcggccaccccgtggagctgcgcgtccaggccgacacccgctgcgtccgcttggccatccgggacggcggcatcggcattggcgtggaagcacagcagcgcctgttccgccgattccagcgcgtccatgccggcgggcagcaccccggcaccggcttggggctctacatcgtccgccagctcgtcgaggcccacgggggcaccatccacgtccagagccgaaccggggaaggctcggaattcacgattgaacttccccgcaggacaaacaaggaatcctgttcagtgaatgaagtgcaggtatgaccttgtgggtggggcagccctgcggggcaggcattcatctccttgaaaacacagcaggtttgactccaggtggattgttttcccagaagttgaacaaatctgttcgttgcagataatcttcgtacggctaaaaagacccgaaccggggaaacccggaaacgggagaggcccggcccacaccgccccacaggcgacgggtaacacggcccactggccccagacgccatggcggcgtcggcttttacacgtacgaggagttgcaccatgggtggacttggagccccccgggccctgctcgcgtcgctcgcagggctgatgctcgcctgcggcggacaggatgccccggacgcagcctcgctggacacgcaggcgccggacacggtctcgctggagacaagctcgctggagacacgctcgctggacacgcggtccgcggagaagacgctgctggacgcggatccccagtcgctgctcggtggctggccctggcccggcaacaagacgcccgcggtggcgctggcgctcgaggtgaagaacggcgtgggacagccgctgcgcgtgcgcgagggatccaccttcttcatcaaccagattgatatccgcaccttcgtcacctccaccaaggacgagggcctgcgcaacctcatcgcccagagcgacttcggcggcctggggtggtggggcgtgcgtcaggtggaccaggagtccatcggcgccccggggccctacacccgccgccgcttcttccggaacgcggcgtggatggacctgcccagccacttcatcgtggagccggtggactcgcgcggccggctcaccggcgtccccatcctgctcaacgcgggcaccgagcatcagcgccgtgcgggcatggatgacttcttcatccgccgcttccgcggcatccagacggcctccggctgcgccacgcccgacgactgctcggcctccacccagttcgaggaagaggccatcctggagctgcgcaacgcgtacgagcacgcccagcgtcagacgctcacgctgcgctccgacacccgcacgctgcgcctgcgctggagcctgcgtccggccgcgccctacgaaatcccggtcgagcaggtgcgcgacgcgcgctacacctacggcttccgcattggcgtggaggccctcaccccgcctcgcccggacggcacctatgcccccggcacggaaatcagcttccagctcaccctgcgggacggtgcgggcaaccggctccacgacaagggatacctgccgccctacaacgaagtggcccccgacggcaccgaatccgggctgcagtactaccgggccttcttcgacgcgacgaccacctactaccggcgcaagcaccgcgagcgcatgctgatgacgcaaatcatcgggccggcgcagaacatccagcccatccgctccatcgtcgcactggaggcgttcctggaccccgaagtggacgagcaggtggtggccacgcccgagcgcgacggcgtcttctcgcagttcgccaccctgcccttcgccaacgtcctcttcggcggcgccttcatcgacccgaacctctggaaccaacccaacacggacacctggcagttcaagctgccggacaacgcggcccccggcacctacctggtgacggtgaagggccgccgcgtgtacctgggcgaggacctccccgggtcgacgaccattgaaatccaggtggggaccccgcagcgcacccagcccaagcacaccaccggcccctgcacctcctgccacagcaagggcggtgagctgggcgtggtgctgcacgccaacgacaaccgcgccgcgtgcgccgggtgccacgccccgctcgccttcgagctggagggccccatcttcgtgcgcacccacttcatccactcgcggtccaaccgctttgacgcaccgctccagcagtgctcgtcatgccacctgacgaaggagagcatccagcgcaccagcaaggccgcctgcctgtcctgccataagagctatcctgacagtcacgtggcgcaattcggacccatcgagagcatgtatgtggggggcggcgctgagtctttccagcagtgcaccggcgcctgtcatactcggcaccctggaagcggcctctaacccccgctcacgcacctcggagttcctccatggctcaggtcaagatgcagacggctcgcaccacgctgagggagccagatgccgccgcggaggacctcctgagccaactgggcagcgacacgccccgcctggtgacgatgttcgcctcgcgggagcgtgaccagctcgcgctcaaccgcgccgtgcgtcagcggctgccggcggacacgcgcctgattggcgccaccaccgcgggcgagctggacaacaccggcatccacgagggcagcgtggtgatgagcgccctcttcggcgacttcgaggtgggcctgggcctgggcaccggcctgtccgtggacgccatcagcgcgggcgcggccgccatcaagcgcgcgtgcgaggacctgggcgtgcggcagcaggacctggacccgcgccggttcgtcggcctcgtgattgacgacggcttccgctacaagaaggaagagctgctgctcggcatcctggagaagtgccagacgctggtgctggtgggcggcggcgccagcgacgccaaccgcgacccggccaagcagtccgccatggtgcacgtggatggcgaggtcgccaccgacgcggtgctggtggccctcttcaagacgagcgcgccctgggccgcgctccgctcccactggtacgtgcccaccggtgagaagctcaccatcaccaaggtggatgaaagccacacccgcgcgctcgaaatcgacgggcacccggcggccaaacgctacgcggaaatcctgggcgtgggcgtggaggagctggagttcggcacgccccggggcttcgccgtgcgccccaccgcgctgcgcgtgggccgggagtacttcatccgcgccgcctggagcccgcaggaggatggctccatcctcttcgccaacctgctggaggaaggcaccgagctggagctgatgaagctgggggacatggccggcatgacgcgcagcttcttcaccgacgaggtaccccgcagggtccagaacccccaggccgccctgctttttcactgtggtggacgcatgtggtacgccagcgccaccaacaccgcgcagcaactggcggaaacgctgaaggccgcacccaccgccgccgggatgaacgtgcacttcgaaatctattcggggttccacatcaacaccacgctgaccgcgctggtcttcggggcgaactgagccatggcctcctcacagcctccctctgactctccggcggacaatgcgtcgctcctgctcgtggccggcgagcgtgagtgccaacgcgtggaggaagccctccagcacgcgggcgtgacggtggtgacggagcgcgccaccacggcggccgcggcggaggccgcgctgtcacgcacgtggggcttggtgctgtgcggctcggaagtccccgacatgggcttcgccgaggtccaggcgttgtggagcaagcacggcaaggagctgcccttcgtggtgctgtcgcgcgactggtgcgaggccacgctggaggccagcgtgcgcgccggagcgctcgactacatcaccgaggaccgcttcagccgcctggcgcccgtggtgcagcgcgagctccggatgacggcggaccgccgccgccacaccgccaccgcggtgcagttggagcgcaccaactacctgatggagaacatcatcgacgcgattccgttcgtcctcttcgtgaaggacgcggacacgcgccggttggtggtggcgaacaagacgttcgcggacgccttccgcgtcaccaaggaatggctgctggggaagctggaccacgactacttccccaaggagcaggccgagtcgttcatcgccatcgacacggagattctcgaaaccaagcagatgaagtcctttgaggaggtggcccgcgccgacggcgtggaccgcatcttcgccacgcgcaagctgcccctgctcgacgagcacggcgtggcccgctacgtgatgggcgtcaccgaggacatcaccgagcgcaagcatcacgaagagatgctgcgcgcgtccaaggcggagctggaggcggccaactttagag

SEQ ID NO: 849 - DNA, 5518 bp, Myxococcus xanthus
ctctaaagttctacgaagacttcggcttccagacgcagggcgacgtctatgacgaggacggcattccccacatcgacatggtgcggccagcgggcgggacgcgctgacgccgggccacggccagcgctcgccgctatgtcccgggtggtcagacgttacatggaccatgcgctgggaccgcgccccagccgaggagacgacccgacttgcgccacggcctcgcgatgggggcactgcttgcactgctcgccaccacccagctcgcgtgcgtcgtgggcccgcgcttcaccacgtgtccgggtgaaggcggccggccctggctgcgcctggacagcgaccactacacgctgcacacggacctcctcgccgaagaggcccgcgaggccatgcagcgcctggagcggacccgcgccgccatcctcacgtcgatgtggccgcagtccctgcgccaacagatgacgaagctggacgtctacgtgattcagagcccgcgcgagttcgaaggcctctacccacgccgcgtgcgcgcattcttcttccgctccgacagcgaggctctcatcgtcctgtcgggacggcccggcacttgggagcagaccttctccggcctctccctggcatcctcgtcgccgctgaaccatgagctggcccactatctgagcgcctatcccctgtcccgtcagccccgttggctttctgaggggatggcggagtacctggagacgttgcgaatctccaaggatgggagaacggcggtcgtcggagcgccgcactggacggccatcgcgcatatccgacccaggctcaacaaagtcctgcgagacgtggcgcaaggatggtcgatgcaacaagtccttcaatgggaccgcaccctggaggcccgcgagcaggacaaggaggtcgaggcgaactacgcgggaagctggctgctggtgcactggctggtgaatgaacgcccccagcccttcgccgaatacctggcactgctccaccagggcgtctcgcccgatgaagcgctcacgcggacgttgcccgaactgacgtcgccgtcgctcgacggcttgctctatcaatacgtgcgcaaacgccacttcgtggagcggaccgtctccgtgcctcccatcggaacggcgttcgtcgaggagtacctcgatgacgcccaagtccatgccatccgcgccaggctcgccgcgctgggggcacacctggcgcaccgggagcccttcatcaccaaccgccagaaggtggcgagggacgaactcgatgaggcgctccggctgaaccccacgggactcctggcgctgtccgcgaagctgcgcggcgcggcgccgtccgaacaggtggccattggccgaagcatcgtggaggcccatccccacgagagtgaggcctggctgctgctgggcatggcgatgcggcacgcccccgccgcgacagaggagcgcgaggccacctatcgcgaagccctgcggctcgatccgcgcaacgccaacgcggcgcgtgaactggcgtggatgctcatcaaccaggaccggagcgaagaagccctgccgctggcgcgctgggccgtggcgctcgcgccgtggagccccaacgccctggacacgctggccctggcgctggccggcaccggcgcctgcgaggaggcacggcaggcggagcaccgggcactggatttcatccaggaggacggcgcgccagagctggagtacctgctccgccagcgcatcgccgggctcgaggacggcaccctctgcgtggcgagcccgcccggcccctgaggcacggaggctggcgatgggccgacaacacttcccggacgccatctgtcgcgtacctcacgcgtcagggtggctggggcggccggcgacttcgtggccccatgacgcaatgcgcgtccatggctttcctgcggggccatgagccagtgcactcacatcgtcgacaatcccttcaccggagacgtcgccgcttcggtcgagcccacgtcccccgtgaagctggacaccgtgctggagcgagcccgcgccgcgtcgcgcgcgctgcgcgccctgagcgtggcggagcgcgtgaagctggtgctgcgcgcgtgcgaggcgatggagaagaacgccgacgccatcgcacgggacatcacccggcagatgggcaagccgctgtcccaggcccggggtgaggtgggcggcatggcgggacgcctgcgccacatggccgccatcgccgaggaatccctcgcggacatcgtcctgccgcccaaggacggcttcgagcggagaatcgcgaaggagccgctgggcgtggtgctggacctgcccgcgtggaactaccctctcctcaccgcggtgaatgccatcgcgcccgccgtgctcgcgggcaacgcggtcatcgtgaagcactcgccgcgcacgcccctgtgcggtggccacttcgcgcgcgccttcgccgaaacaggcgcgcccgacggcgcggtgcaggccatcttcctggactacccggggacggagcagctcgtcggtgacgcgcgtgtggaccacgtcctcttcacgggctcggtgctcggcggccacaagatgcagacggccgcgcgcgagcgattcctccacatgggcctggagctgggaggcaacgacccggcctacgtcgcgccggactgtgacttcgacaagtcggtggagaacatcgtcgacggtgccatgtacaacgcggggcagagctgctgtgccgtggagcgggtgtacgtgcaccgctcgctgtacgagcgcttcgtcgccgccgcggagccactcgtgcgcgcctacgtgctgggcgacccggagtccgagcagacgacgatgggccccatcgcccagccctggcaccccgccgagttgcagtccttcgtccaggacgccacgaacctgggcgcacggctcgtcacgggtggccgcgcggcacaagtgggaggacggggccgcttcttcgaacccaccctgctccgcgacgtgagcccccaggcgcggctgatgcgtgaagagtccttcgggccgctgctgcccatcgcgccggtggactcggatgaggaggccctggcgctgatgaatgcctcgcggctgggcctcaccgcgagcgtgtggacgtccgaccgggagcgcgcggaccggctggcgcggcaactggaagcgggcaccgtctacatgaaccgctgtgacgcgctggaccccgctctgccatggagcggcgtgaaggactccggacgcggcgtgacgctgagcgcgctgggcttcgacgccctgacgcgacccaaagcgctccactaccgcctgcgcttctgacgcgcggctacagcttgcgcagcctcacccgcttcaccttgtggtcggggcccttgaggaggatgaggcgcgcgcgcgaacgggtgggcgcgatgttctgggccaggttgggcccgttgatttcgccccacaccgactcggcgagctgaatcgcctgctcgtggttcagctcggagaaccggcggaagtagctgcgctcgtcgcgaaacgccgtctgctggagcttgaggaaacggttgacgtaccagcggcggatgtcgtgctcgtgcgcgtccacgtagatggagaagtcgaagaagtcggagaggaacgtcgccggcatctgcttcccctcctgtgccccggcctggaggacgttgagcccttccaggatgaggatgtcgggctggcggacgacctgcgcctcaccgggcaccacgtcgtagacgaggtgcgaatacaccggcgccgccacctccgcgcgtccggccttcagctccgccaggaagcgcaccagggcgcgccggtcgtagctctccgggaagcccttgcgcttcatcaagtcgcgctcggtgaggacgtcgttggggaaaaggaacccgtccgtcgtcaccaactccacgcgcgggtggtccggccaccgcttcagcagcgcctggaggatgcgcgccgtcgtgctcttgcccaccgccacgctcccggcgatggcgatgatgtacggcaccttctgcgtcgaacctcccaggaaggcttgctgctccgcccacagccgctgcgccgcggccacctgcaggttcagcaaccgggacaagggcaggtagacgtccaccacctcgtccaggtcgaggtgctctcccaggccccgcaggccgtcaatgtcctcggacttcagcggcagaggcgttgcggcacgcagcgcccgccaggcatcccgttccaggtcgatgaacatggctggggacagaccggtggctaaggccatggattccactccaggagctgaacatccaagccgccgcgtagcacagccgagacgttcacgctcggacgttcaggtgccagccgcgggatcccacccgtagaagcgcttcagttcctcatagaggtccggcgtcttctcctgcatttgccggggtttctcgaaaaacgattcggtggccaccgcgaagaactcggcctcgttgagcccaccgtagtcatccagcacctgccgttcccggcgctggccctgctgaagtttgtggaagtgctcgctcatcaccgcgctccaggcccggtaatgcgaatacgcgcgcaggttgggcgtgccatcgaaggcgccgtcggcccggtccaacacgtgggcgaactcatgcgtggcggtgtcgtgaccatcgcccgggttgcgcagccccgcgagcaccgactcccacgagaggatgacggagccccagttcttcgcctcgcccagcaccccgcccgtgcggtccgggattcggaaggcgctgggatagacgatgacctcccgcagccggtcgtaatacgaaaggcccaggtgcaacacgagttgcaccgcggtggcggatatcaccacgcgaatctcgtcggtgacctccaggccgccggcgccgatgaactccttctcccacgcgaacaccttgagcttgtccaggaagggctgccgcagctccggggagagggtgcggaagaagggcacgcgcgcgtcgaggtagcccagccaggcctccggaaaggggcggcgaagcagtcgccgacgccggaactggcggatgaaggagaacatgcgccctggcatagcagacgcgcatggcgcgaggagcacctcccgggacgaaactggaggtagattgcgcctggcgggcgcggccggcagcccctttcacggacgtgcaacgagtgatgagcagacgcgtgtgggttcgatgcacggcgctggggctgagcctcctggcgtcccaggcaccggcgcaaatctcggagtcagacccggtcgtctgaggaagtggtggtgcacggcccggataatacccatctgcacgcggtgcgagcttatgagcgtgtgcaggaactacaaccgctcccgctggaggcccggccccaggttgagcggcgcatggtcgccgaggccctcttacaggacgtgaaggtcatgtaggagccaaccggtccggccctgttaatagcgagtgtggagctgtaggccgaggcataggggtctttagagcaca

SEQ ID NO: 850 - DNA, 6637 bp, Myxococcus xanthus
ctctacgcgccgccgtccgagggacgcccgacttccccgcggagctggagcgcatcatcctccggctgctgcagaaggctccctccgcgcgataccagagcgcccgggagctgcgcgacgacctggagcgcttccgcgccgcccagcagtgggcgtctggaacgcatgagatggcggcgctcgtcgccgagctgtttccccccagcatcacgggccagccgcccaccgcgctgcccgcctccagcacctcccatggcagcaactccgccacgggccggacgcccccccccagcgccgagcccgagcgagagctgagcagcacctccgcggcaacgcgggcgcatggcgccgtggaggtgccgctcgacacgagcgcccaaggatttccgtggggaatcgccctggccgcgggctgcgcggccctgggcacagcgctgttctggttactggccccttgagcggctgccgcccggcgctgacggcgcggcaacgagaccctgatgaaacagaagacgtggattgccgtcatcatcctgggcacgctcgccgccaacgcggtggcctaccgcgtggtgcgaagccgacgcgacagcgcccccgaggccacgccgggcgccatcacccacacgccgcccaccccgccgcccaccgcgcccgaggaacctccgcgagaggacccgaacgacggcctggcccgggcccgtcgcgccgcgggactggccgccctggaggaccgcgactacgacgcggccgtctccgacttcacggaggcgctgcggctgcgcaaggacgaccagggcgacctcgtggaactgctgcgcatcgcggccgaattgcgaacgcgcgagcaggcgcgtcagcaaggcgagcaggcccgcgcccaacgcgagcccacgccggctcccgcccgctccgtccagcgcacgcgtccggcgcgcggtacagcccgggcccagcctcgccaggagtccccttccgcggacgaggcacgcggcgggttgctgctggtgacgtccacgccccccgggctgatggtgcgggtggacggcaagcccatggacctcacgccggcgcggctgccgctgcgcgcggggacgtaccgcgtggcgctcgcgcagggtgagcgcacgctggccgaggagacggtggcgttgggcgaggacgacgtgcgctccctcaaccgcgacctcaccgccgagctcgctcccgcgccaaggcccgccgcgaccgcaccggcctccgtggaggcgccgcctcccgccgccgcgcccgcggccaccagccccgctgccaccgcgacgcgcgccgaatcgcctcccaccgccgagccgtccgtggcccccgccgcccccacggcgacgggcaagggccgcctggatgtgacgtctcccggcctctacggcgaggtgtggatcaacaaccggccgtatggcttcccgccgctcgtcgcccagggacttcccgcggggcccgcgcgcctggaggtccgcgtcaatggcgtggtgaagcggaagctgaccgtcgacgtcgtggcggaccagagcaccgccgtccgcatccgctgacctgaaggccgttcgcgcggcgagccgcgctccctttccgcatcgaggtcgatatgcgccgctgccgtaggtggtccgaaccttcaatcggagccctgctcctcctgtgcgccagtcccgcgctcgcccaggacaccgacgcggggaacctgggtgacgaggagcccgaggttcacagccaggtggcctccttcgccgtcacccggctccaggagtcccccgccgtcgtcacggcgatgaacgcggaggagattcgcaactccggcgcccgcgacttgatggacctgctgctgcagattccgggcttcttcttcggcgtggacacccagggcgcggtcggccccggattccgcggcctgtggggctacgagggcaaggtgctgctcgtcgtggacggcaaggagatgaacgagcagctctactccacgatgcagttgggcaacgagttccccatcgagctcatcgaacgcatcgaagtggtgcgcggccccggctccgtcatctacggcggcaacgcggagctcgccgtcatcaacgtcgtcacgcgcggcgtccagggcagcacggacctgatggtgtccggcatgtacggacagatgggcaacgtgaacggccggcgggggctcaccgtctccggccgcaaggtcttcgagtccgcgccgggcctgatcatcttcacgtccgccggactgtcgcaggcccagcgcaacaacggcgtcttccaggacttcttcggcaactcctagcaactgggtggcaactcgcggatggacccgactatggtgcaagcgggcgtgggctacaaggacttgcatctcagcgtgctgtaccagcgctatgggacctcccccatcgtcgccttcgacgaggtgttggaagcgcccgcacccaccaactttgattccctccacgcggagctgagcgacaggttccgcccggacgagcgggtggaaatcatcccccgcctcaacctcaccttctccaagcccttcagtgactcggaccaggattcgcccttcttctacgacaagcaggtgctgcgcctgcgagggcggacgctggcgcgctgggcggcgctggactggctgcagctcaccggcggcgtggatgtgacgtccgaccaggggtgggtcaacggcccggtgggcgtgggcctccagacgggcttcggccccgaggaggccgacagcgtctcctacgtgaacctggcgggcttcgtggaggccttctccgtcaatccgttcgtcaacgtggtggctggcgcgcgcgtggagaaccacagcgccttcggcgagtccttcgtgccgcggctggtgctgctgcgcagcgtcgggccgttcagcggcaaggccctgttcagccgcgccttccgcgcgccgagcatcgagaacatcagcctgggcgccgacgtccggcccgagcgcaccaccgtgctcgagttggagggcacgctgcgcatgggagaaggccacgcactgagcgccaacgccttcgacatgggcgtggcggaccccatcatctattcatacgacgcggtgacgaacacggaggcctaccggaacctcggacgcctgggcagccgcggcgtcgagctggactaccacgtgcgcggaagctggggccgcgccgccctcaactattcgttctacacgccgtcaggccgcaatgacgtggaggactaccaggtccccggacagcccaacgccttcacgggcatgcccactcacaaggccgcgctcaccggcagcatcaaggtcctgccctggctcaccgtcagccccaccgccgtcctcgtgggcaagcgctacgccgtggatgtgccggatgacgagggcaacgcggcggtggaggagctccccacgcagttgctgctcaacctcttcgtgcgcgcgcaggacgtgggcacgcgcgggctggagattggcgcgggcgtctacaacctgaccggcacgaacttccgcatcgcccagccctacaacggcggccacgcgcccatgcctgtcttctcccgcgagttcatggtgcgcatcagctacctgctggaccctgtcagcgacgaatagcagcacgtccaaacctgacgtccgccacggcccaccttccctccggagggtggtccgtctgcctttgcagcaatgcgtcacagggaatgaactgccacagacttgcaatcaccggattctcgctggtactttcttcgccattcgaaataactcgcgttcgttcgcggctgctccacgcctttccgacgcgccgccccagtaaacgacgactctcgaagcacccttgtttcttcgcagtgggaatgaagtcttccagccgtggagggcagcgcatgcaaccgaacaagcgtttcgcgtgggcgtgggtggcggcgggcgttttcgcggtgtctggtctggtggcgggatgtgaccctgaagaggaccccacgccaacgcctgacgcaggacagcagcaccccgattcaggcacgcggcctgacgccggcacgcagccggactcgggcacacagcccgactcgggcacgcagactgacgccggcacggagccggacgcgggcaccgagcccgaggaagacgccggcaccgaggaagacgccggcaccgtccccacgctgcccctggccgtggacggcacctggattcccagtggctacatgggcgacggctcgcggggcggcgtcacctacgacggcaccgagtgtctgcctgggcgggcgggttcgcagcggggcgcctgccacaagttcacctggacgcctggcagcgacggttgggcgggcgtgtactggcagtacccggaaggcaactggggagacgagcccggcttccgcgtcccggacggcgccaacaccgtgtccttctacgcctggggcacggagggcggcgaaatcgtctccttcatggtgggaatgaacgccgccgacggtttcgaggtgaaagaagcgaacgtggcgctcaccaccaccccgacccagtacacaatcgacatcagccgcgtccggtatggacaggtggtgggtggcttcggatggaccgccgatggaaggacgactccgctcgtcttcttcatcgacgacatccactggcactgacacccaccccatcctcgcggcggaacggagcgagaggacgatgcgagtgggaacggcggtgacgacggtcgatgcggcgggcatgcgcgcgcagaacagcagcctgctgctcaacatgatctggcgcgagcgtcagatttcccgggcggagatcgcccggcggacggagctcagtccgtcgaccgtctccgccatcgtggcggacctggagcgctccggcctggtgcgcagcattggcgccggggtgtcccggggcggccgtcgccccaccctcatcggcttctgcgatgacgcgttcagcctcatcggcgtggagatgggtgccacccacgtgacggccgcgctcaccgacctgcgcggccgggtgcgcgcgtaccggcacgccagccatgcagtccgtgaggaccccaagggcacgctccagaaggtgcgcgagctggtccaggaggtcctggacgccgaacgcgtaccgcgccgctccgtggcgggcatgggcatcgccgtgcccagccctgtccacccgtccgcgcccggaaagctgtccccgctgctggtgccggcctggcgcgactacgacgtgcaggagtcactgcggagcgcgttcggcctgccagtgttcgtggacaacgacgcgaacctgggcgcgctgtcggagtgctactggggcgcgggcgtcaacggcgaggacctggcgtacatcaagctggccacgggcatcggctccggccacatcatccacggcgacgtctaccgtggcgcgggcggcaccgcgggcgaaatcagccacatggcggtggactcctccggaccgcagtgcgtgtgcggcctgcgcggctgcctcgtcacgctcatcgggtccgcggccctgctggaacgggcgcgggagctgatgggccgcaaggacaagcgcgccctcacggtgcgcgagctggtggaaggcgcgcgggcgggtgagcccgccgcacgtcaggtcatcgacgggctcgggcactacctgggcatcgccgtggccggtctgctgaacctgctcaaccccgccattgtcgtgctcggcggcgaaatctcgtcggtgggagacctgctgctggacccgctccgcgcgtcggtgcgcaagcgggcgctgtccacctccatggcggagacgcgcatcgtcacctccgcgctgggagaccgcgccatcgccgtgggcgcggccaccctggtgctccaggcggcgctgcgtgaccgaaccctcttccctctccaacacataggcaaacctgcatgacgctcccgcgcctcctccccatggccgtggccctcacgggcctcgcctgtgacccggccgccaaccgggtgaaccgccctggcaccccgccaccccacaccaacccgcagcccagcacggactgggagctggtgtggcaggacgagttcgatggaccggaggggacgccgccctcacccgagcggtgggtgcacgacgtgggggggcacggctgggggaacgagcagcaggagttcaacaccgaccggaccgagaacaccgcgcatgacggcgccggcaacctggtcatcaccgcgcgccgcgagcgctacaacggccgggactacacctccgggcgcatccggacgcagggccgctacgaaaccacgtatggccgcatcgaggcgcgcatccagctccccgtgggccgcggcatctggcccgacttctggatgctgggcgcgaacatccacagcgtcgattggccggagtgcggcgaaatcgacatcatggagtaccggggccagctgccgtccatcctccggggctcgctgcacgggccgaggtactccgccggcaacaacctcggccaggactacgtcgtcagcggcgtccggctgaacgaggacttccacgtctacgcggtggagtgggagccgaaccgcatccgttggttcctggacggcaccgccttcttagaggcgacgcccgcccagctccccgagggcg

SEQ ID NO: 851 - DNA, 9472 bp, Myxococcus xanthus
gagctttcatctgtttcgtgcccaagtcgttcgcgcgccggaagagccggtcggccatgctgcaacgcttctcccatttcgctcggccggacctgcgcgcgcagctgtcgttgcagcaggtggacatgctgcaggacgccgtgacgaaggtggtggtgcccagccacgtcatggaaggcgtggagttgctggcggatgcgctggagcgcgcgctcgcggcccaggtggcgaagctgccggactacgtgccgacgaagtacttctcccagcgctccgtggtgaaggcgctgtgggcgctgaaggccgcggtggtgcgggaccaaatctaccggcgccccgagcgggcgttggaggccactgtcgaggacctggattcgctgcgctggttcttcctcctgggcgggccgccagcgggggagacggaggcgctgctcaagtccgtggtggaccctcgggagcgggcgcagctcgaaatcgtccgcctggagcagcgcgccttcgacgaagcgctggcccagatacagcgggagctggggggcggcgtggagcgcgaggcgcaggcgctcgggtcctccgaagaggtgagttccgtcgagtccgtgagccgcaactggcagcccggcgttgtctccaccacggcgcgggccttgttggccaagctggtgcctgggccgcgccatgcgcagaaccggataccgctggtggcggcggcgcgggctctggtggcggcgcaggagcagcggctggcgcgtggcatggcagggcacggtgaggggcggggcggcatcgcactgctggtgtcgttcggcgacgtgctgacgctctgtcgcggcgtccccgaactgcggccgggctacggggcgttgtgcgaggcaacggcccgctttctggaaggcgcccaggagatgatcgccctgtccgcggagagcgtggacttcgaggacgggctcaagctggagggcctggtcgggctggcggacaacctggaggaggagctttcccagacgggggatctggcgggacagctgtcggacggcgcccccgccgcatcggagcgcctgcgcacgaccgaggctgaggtccggagccgggtcgtgtccgcgctgcgccggcgcgctgtgttctcgttccagggcaacctggcccggggacgtcgagagccgctcgaagcgctggcgggagattcgcgccgcctgacgcagttggagaatgccctggctggcctggaccccacgcaacagggcctcaagcaggagctgctgctcccattgggcatcgcctacgcccgggaggtgctgtcctccacgcccttcgaacgcatcgagcagtacgggcgcgcggtgcagtcggtggcggagaacctccggcgcgagggagtgtccagcgacgcggtgttcgccgagtgccgggagattatcgagtcccggctgcgcgagcatgcccatctcctcacgcgcgatgtgcccagcccgccgcccgcgtccacgtcggtgctcaacggggacgcctacgtcttctaccggggcgacttcgcggcgaaagcgcctgatggagagctggccgcgctgctggggttggatgggcaactggccgcgaaccacggtggcgtcgcgcctggcttcctgtcggaggccgtgcgttcggcggtggcccaggcggagctcgggttcgtccagacgcgcgtcaaatacctgcggagctggctgacccaactgctcacttcgcttccaccgcccgaatccatgacggagcgcgcggatgccacgcccgggaccggtgggcgcaccgcttccgatgctccttgaagaagcagctggtcggctgggggtgtcctcgcgttgctggggaccatggcccggtgacctgggcgaggggggctcgacggctgggaaggggcaactgcgccggcatccgacgaggacttcgggcgcttcagccggcaggtgctggcgcggcggtctacaccatgacccggctctcccgcgggcgacaggttgaagcggagaggggacgctgagcgtgttcgcccggcgcctcgcggacctccggcagcggctggatgcgctccaccagcccgcgcccgctcgcggcggttggcgggcgtggacgctgctggggcgacgtgctcgcgggcccgaggatgtcgcgctgccaatgctggcctcgctggaccgggacctggaccgggtgggcgtgcacacgtcggcggacgcacggctcctcaaggagctgggcctgcggaagggcagggcgggggcactggcgcaggggctgctcgacagggcccgtcaagcactcgaggaggtggaggcgtgtctggtgctcgtggagcgggcctggcgcacgggagcgccgcttcccggcgcggtcgcggtgctggagaagggcttcatccaactggcacgcgtggtgaaggtggcggacctcttcgcccgtcctccctcggagccggaggaggacgacgcggagctggaaatctacgggcgcaccgatgggagcactccgcgtcttgcgccctccagtgcgcgtctggccgtggcggagttcttcgcggagcgggcccgggccaaccccacggacgtcaagcagaagcgccgggacctggacctggcgcacgaactgctcatccgcctgggcgcggaccacgaccgcgagcgaggcatggtgctgcggcgccaggtggccgaggcccgcgagcgggtgcgggccgttccggccgtgcgctccatggaggagttgctgcggcacgtgcgtcacacggcccggcgcgagccccaggtggcctaccgctcgttgaaggggctctacgagcgggccttggaggctggggacgcggcgctggcggacgcggcccgggcggcgctgacaccgatgttgccggcaccttctcagctgtcgtcgctgatggagcgcgcggagctcgatggtctgtcgcactggttcggcgaagcgcccacggcgcctgacgaagtcccgggccctccgaaggccgatgagctgctgacggacctggccttctcactggagcccgagcagctctccacgttcgagctggcggcgggctgtgcccgctacttcgacgtggaggacgcgctgtcggaggaaatcgtcctggcggatacgcgcaccgcgcgggcggtgtcccggcgtgtcccgtacccgacgcagacgatgacctacgagacgacgggcagcctccatgaggtgaacaacttcgtcttgacggacccgcggatgctgctgcgcgacctggccgccagtcaccagttggtgcgcgcgtacctggacgacgagccgcccccgcgcccccggaaggtgaagcgcaccgcggtgcgggtctacgtctgcgacgcgtcgggctccatgcacggcgcgcgagcccgcttccgggatgccattgtcatcgcggagctcaacaacctgcgcgtcaaggcccgccggggcgagcacttcgacccgctgtacttcagcttcttcaatgacgtgcccaccgagctggcgcgcgtggactccgcgctggaggccacccggcagttggagaagctcttccgcgattcacccgcggaggggcagacggacatcacgctcgcgctgatgtccgcgttcgactccatccgcgccgcgcaggggcgggacccgtacctcgctcgggccacggtggtgctcgtcactgacggcgaggaccgcgtggacctggagctcatccgccgcacgcgcgcgcccatgggcgcgctggacatcgcgttgagcttcgtatccctgggcgaggagaacccggacctccgcctcctcgtccgggagcagcgggccgccggaggccgcgccttctaccaccacctctccgacgaggagattctgtgggcgcgcacggagttcgacacgccctggcgcacgttgctgccgcgtgacgtgccggcgtccggtgatgcgctggagcagctcacgccgcacctggaggcgctggaggcggtcgccgccgggcgggccgctccgcggaccgtggcggtggacgcttcgttcgatgcgctcttcccggagaagcccacgccgccccccggggccgagccgactggcaaggacgtcacgcaccgcgtggcggacatcctgggcgcgctggtggaggcggcgtcgctggcccccgcggatcggcgcgcggcggagagcttgctgctgcttcaacacctgctgggtgtgtacggattgaccccggcgcgctacctgtccgcgttgtccgcgggtgggcaggccacgcaggaggcattgcagcgcgtgcggctgttgtgccggcccttcgggtaggctgcgcccacgcccatgttcttcggcctgctgaggagacgaaagaaggagccgtcgcgcccagcggacccgctggctgctttcgaccagctcatcgaaaacctggagcgacaggccgccgaggtccgcaaatccgcggccacgctgctggcgctcaaggcggacctggtgcgcgcggaggagcgctacgcgcgccggttgctggagctcacctcgcggcgtgccaccgcgaaggagcgcggtgacgctcgggcggtgcgcgtgctggagaaggaccaggcgcaggcggaggacctcctggccagcacgcgtgattcgctggagcgagccgagtcggacgggcggttgttgctggaggccgcgagcgagctgggcgatcgcgtggtggagctgcgccatgaacgggagagtgcgtccgcgcggctcaccatgggcgggctcgtcaccgagtccctgcgcgagcgcgtggcccgcttcgaccaggcgctggtggtggacgcggctcgggatgaaatcgagcgcgcgcacgcattggcggacatctaccgcgaggagaagtcgcaggaggaataagcgcggctcaggtccggcgcgccgtctggtgcagctccaggacgatgttgccgcccttgaagagccgtaccgcgccggacgtctggctcacgaccagggcgatgcagcccgtggtggacgtcatgccggcggcggcagcgtgccgcgcgcccaggccgagcggaatcttcacggcctcatccgccgcggacaggtagcgccccgcagccaggacgacaccgtcctcgcggatgacgaaggcgccgtcgagcacggagaagttcttgatggcctcgcgaatcttcgggtcgagcacgttccgttccgcctcggagaggccctggaacgggttgatggtcatctgccggctcttctccatcacggtgttgtgggcgccaatggtgatgatggtgccaatggggtggccctcgaaaccttcctggccaatctgcagcgccaactggatgagggcgtccaccacctgggagttgaactcgtcgcccagcttcacgccttcgatggcgacgcggtcatcgagcgagccgccgatgcgcgtctgcatcagcgtgtccggcgcgcggcccaccttgcccgtcatgcacaggaccaggtcgccttccttgaacgctccctgggacagcgcggacacgagcgccacttttacgcgctcggtgcgggagtagtcgtacgcggggatgacgagcgcgcggaccttcttggcgaggtgctcctccgccagcttgggcatcgtgacggcgtaaacgagcttcttgcgagcaggccggccgcgaaactcttcagcgggaatgggcgtgtcgcagatatataggaagtgatcgacttcgttcttgccggccaacgagagagccgagcgcaggaactcccgatcaaacttcgtgttctcggtcaaacgcccctcccttcacccttggtcatacccacgtcagcttgacactgaagaccccatgaatgaagctttcgggccctttttttggggtgcagggccccaaaacctcgctgaactggagcgaaggctgtgaaccagaaagatctcaagcgttacaagaagatgctcgaggacagcaaggcgagcctgctcgagagcgccaagaagaccctggtggaggagtccagtttcgacacggacgaccttcccgatgagatcgacctggcgtcttccgagtatgcgcagtcaatggtcttccgtctgcgggaccgggagaagttcctgttgcagaagatcgaaaaggcgctggtccgcatcgaggacggcaccttcggcgtctgcgagcggtgtgaagaggacatctcgcccaagcgactggatgcgcgcccggtgacgacgctttgcatccgctgcaaggaggagcaggagaagaaggagaaatcctacggctgagcaccgaggcagtgagggccgcgcgggggatacccccgtgcggcccttggcatttcaggacgtgggcgcttggatttccacgcgcagcaactgacggccaatgaggaagtggtccccgttgtccacgaaggtggggcccgacaggcggatgaaggtgccgttggatgagcccacgtcccggacctggagccggtcctgccgcacctgcagcacggcgtgccgcccggacacgaagccgtcggtagggaaggtgaggtcgccttgctcgcggcccaggagattgtcgccttcgcgcagggggaaagcgccgcctcgcaggcctccctccagcagttgcaccagccgcagccggtagccgggatccggtgaaccccagacctgggttccacccggtcccgtggccgcggtgggaatgggctccagcaccaaccgctggcgtcccaggcgcagctcgccgcccgggggcagctctcgctcctggcgcaggcggacgaagacgccgttggcgccgcccacgtcttccacggccagccggatgccggagaagaagaagcggacctggagcggcatgatgaaggggtcgtccgtgagcgagatgtccgcctgctggccgcaggtgagggtgtcgcgctgcatgcggacgacggactcggggccgccatcggcgcgcaccacgcggatggagacctgcgggcgcgaagcgacgctggcgacggccatcaccatcgttccggagcgcagcggcgagccgcaagcccggcagacggaggcgtcccgaggattttcggtgtcacagcgggggcagtattccatcgcgtccatggagggctaggggttgtaccagggccggggctctgttgctcgacttgcgttgcacgcggcttgccccccacccgagcggcgtgatgaagtcggtgtcccacccctttggggatcgtttccttgcactgcccctcctgcggcgctgacgcccaagaatcttcccgtttctgtcccgcctgtggcgcgaccctcgtgcgtacgcccgatacggacgagtacgtcggcaagacgattgcctacaagtaccgggtcgaagccctcattggcgagggcggcatgggcaaggtgttccgcgcccggcagctctccctggacaatgtgggggtgctgaatgtgctgcagcacactctcctgtgggacgatcgcaccgaggcacgcttccatgacgaggacaaggacggcagacgcctcaaccaccccaacttcatcactgtgcttgaattcggccaggccgaggacgaggccttgttcatcgccatggactacttggcggggtacgacctgacccatattctcagccgtgagtggcccctgaacgcatggcgcgtggtgcgcatcgtcagtcatgtgctgagcgcgctgtcagacgcgcacggtgctcgcgtcatccaccgcgacctcaagccagagaacatcatggtggagccgcggcgcaacgagcccgacttcgtcaaggtgttggacttcggcatcgcgaagatcaccgactccacggacgacggtccggcgctcacccgcgcgggcttcgtgtgcggcacccccgaatacatgtcgcccgagcaggcgcggggctcgcagctcgaccaccgctcggacctgtacgcggtgggcgtcatcctctaccagttgatgacgggcttgctgcccttcgagtcggactcggcggtgggcttcgccaccaagcacctgaccgaggagccgccgccgcccacgcgccgccggccggatgcgcgaatctctccggccatggagcggctcatcctccgggcgctgtccaagaacccggcggaccggcccgccagcgccgaggccttcaaggccgagctgcaggccgtggacaaggaacgccgccggatggactcggcgccgcggcgctcggccaactcgtcggcggtgctggcgccgttgccgcgcaagtccgccgccagtccgcagagtgatgtccgggatgccacgctgcccgggtggggcaacgaagtgaccatggaggccacggtgcgcgccctgccgggtgtgctcgagccgttgcccgcgaacgccgacgcgatggccaccacgcgtgagcacacggactcgctggtccacacgcagccgggggccggcggcagcagcggggtggcgttcttcttcaagtcgctgaccatcctgctggtggtcgccgcgctgggcttcttcgcctactacttcttcatgggcgcgggcagcgggggcgcgcaggacctgccctacgcgctgcccacgaatgcgccggtgccggcgggggccaacaactccgccgtgggcgcgagccccgacgtgccgctctacgaccgggccattgtctcgggcgcgcgcaacgtcgagcgcgcgctggagctggcgcgagagggtgacaaggcactgcagcgcgcggacgtggggctggcggcgacgaagtaccgcgaggccttcagccgcagtggtgacccggagctggccctgaagctgggcgaggtctactggcaccggcagaatccggacaaggaagaggcccggggctggtggaatcgtcacctgcgcgagcagcccgcctccaaggcgcgtgccctcatcgagcagcgcctgaacggcgccgtggcgcagcccacgtcgccctgacgggggcgtcacgaggggcggtgtcggctcgccgctccgggacacggagcttcatgccttcagggcgccgggacgcatgccccacggcacagcctgcaccgcgtcagcccagcgtctccacctgaagcacatgctgtcccaggcggacgcggtctcccggccgcagcggacgctcgacgccgctcgcgaggcgcacataggtgcccaggcccccggacaagtccctcagcagggcaccggtgggcgttggggacagctcgcagtggcggcccgcgaggccctcgtcgccggggaagctcaagtcacagtgggccaggccgatggtgagcagcggcgccgccgtcatcaccgcgcgtcccgcacgggcaccgacgagcatttcctccacaccgtagacggcctgccccagtggcaccggggcgccgtagatggcggggcgtcccgtcacggggggctggggctccagccggcccgtgaagcggaacaggcgctggcccgcgctgaagtgggtgcgccgggtgagggcttccgtgcccccaacggtgacgaagacgccccgaggcg

SEQ ID NO: 852 - DNA, 6698 bp, Myxococcus xanthus
ggctgatgtaccttccccgcattcgcgcccaagtgttccgcgaggacgacgcggagctggtgcgtctggattacggagagaacgaagggccgcttccgcctcccttggtggagggcctcatcgccgccggtgtcgcgccgcgcgagcccgcaccgcagacagggctggccgaggcggtgtcggccttcctgctggagtcgcgcgcggtgcgctacgcgccggacgagctggcggtggcgccgggcgtgtggccgctcatccaccacctgggcgtggcgctgcgccagcggctgggacgcacgccgcgcgtctatgtgtcgacgccgtgctacggcgtgttgccgcccaccttcgtctccgcggggtgtgacgtggagcaggggccactgtcggggctgttggcccggcgagggcagggcggtggcgtgccggatgccatcgtcgtgtcgcagccgtcgaacccctccggtgtctacctggcccgcgaggagctggtggccctggccacctatgtggtggagcagcgctgtctgctggtctcggacgaaatcttcggactggtgaacctcaccagccccactgcggagacggttcccagccccgtgacgctggaaggcgcggtgcccggcatcggcgcccgcacggtgctgctgggaggactgtccaaggagttcgcggccggtgggctccgcgtgggatggctcgcgacgaaggaccgggcgctggccgcggcggtgcgtgacagcggccctggggtgctccacctgatgacggcgcgcgctgcggcgtacctgtatgcggcatatgcccgcagtccggatggccaattgctgtactccgcacggcaccgcaccctgcggtcctacctggtgaagatgcggcgggaactggcggagaagcgcgagctgctggccggggcgctgccaggggatgggcgctcggacgcgggggacgcgggcggactcttcttgtcgcctcggatgacgacatggctggggcaggaggtcgacggggtgcggctcacgccggagaaccttcctcgcgtggtgtacgagcacacgcacgtcgtcctgaatggaggctcgtggtgtggggatccagagcgggtgcgggccgtgttctcgattccacgggacgcgctgctccgggcgcgtgagcagctcttgcgcttcggcgcgaagctgcgcggcgggccgtccgagtcctgaagcgcgggccccgcacggacactgtccggggcacatcgcttgcctccgactgaaaggcgggtcgcgagcagatgggggcggccgtcacaattccgcctccgggcagcggcgccggtacctgggggggcgtgggatggccgagccggcgcagcgcaatgccatcgagttggtgaacgtccacaagtccttcggcgcccagcacgtgttgcggggcgtggacctggtggtgcccacgggcaccacgtgcgtgctgctgggcgtgtcgggctccgggaagacggtgctgatgaagcacctggacggcctgctgcgtccggaccgcggcacggtgcgcgtggacggcgaggacctggcctggctggatgccgcggggctcgagcgcgtgcgccgcaagatgggcatcctcttccagggcggcgcgctcttcgactcaatcaccgtcgaggacaacgtcgccttcccgctgcgcgagcgactccatctggtggagagcgaggtgcgtgagcgcgtgcagcgcgtgctggcgctggtgggcctggaggacgcggcgaagcagcgcccgggcgagctgtcgggcggcatgctcaagcgcgccgcctttgctcgcgccgtggtgctggaaccgaaaatccttctctatgacgaccctaccgcggggttggacccgctgaggacccagtccgtggtggacgtcatcctcaccggcaagcaccggctccatgcctcggcgctcgtcatcaccccggacgtggcctccgccttccaggtgggtgacaacctggcgctgctccatgaaggacgcatcatcgaacacgccccgcccgaggccttccgccaatctcaacaccccgcggtccaggccttcctccatgactggctggcgcgccgtgcgcgcgcttccgggcacacgtcaccgccgctgcattgagcgcgaggctgttcaccgggggacactcatcccgtcccatcgctggatggctctgaaccagtaagtcatgcatgctcagaaatcccggtgctttgtcacgccgggaggcccgtccgaaggacccacgcatccggggggatgccacatgcccaatctgctcgacatgcctcgccaggcattgatggacctgcgttcacggctcagccattcgacgctcgtgtcccagctaccgcgcaacgtcgtgccggacagtctgtccctgtccagtccggcgcctcaggatttcgcgctcgcggacccggagcgggtggagggatggcggagagcctgcgaacggtatgtgcggcccgggcaggtcgtcatggatgcatgcaccggaacgggcctgcggaccttcctggcggccagccgtcagccgaagaagctgtacgcggtggatggctcgcggctgctggacacggcgcagtgggtggcgcgtcgcaacgggctggagaacatcgacttcgtgcgcgcgcagccctggcagtaccagatgccggagaaggtggacgtcctgctgcatgagttgctgggcgacgccctcttcgacgcggggctggtccctcgcatcctggacctgcgcaaccgggtcctgaagcccgggggccgcatcctgcccaaccgcttcgaggtcttcgtggagccggtgcaactgcgggacgaggcgtgcatccccttcatctggagccagcgcttccccagcgtggactacagttgcctccagacgctgcgcgaggcgatgaacccgtcctacttcacgcgcgtcatccgctcctacgaggtggaccacctgttgtgcgacccggagcccgccttcgccttcgacctggagacgatggtggccgacggcctgccgcaccgcgtgcgcttctcccggccagtggtggacgaggggcgcgtggacggtttctgcctcttctacaaggtggccttcgacgcggagctgtccttcaacgtgtcgccgctgcgagggcagaactacgcggggatgatgctcttgcgcgtggactcgcgggagttcgagcgcttcgacacgctgtccttcgagctggacatggtggagcacgccgacgtgcgcacctggcgctggcagttcacctgagagcagagtccccacccgcagtgctggcgggtggacagctcccgcggtggggagggtccgcgcgagcagagggcgtggctagcttgcatcgaggcatgtcctcttctcgactcctccccgtcctgttcctggtgctgggcgccgcgcttccagccgtggcccagccgtcctcgccgcagcgtccgcgcacggtggccggcgtgtgcggcgccaccaactgggcctgcgtggccgagtgcatcgacgccgagtgcgtcgacacctgcatgcgtcaggactgtgagcaggcgctggagcggctcaagacgtgtacccagaaggcgggctgcgcgccgaacgataccgaatgtgggccgaaggcctgcctgcccatctgccagcgctccttcgagcccgccccactcagccccgagaaggaagtcccggcgccgtgcgagggcgtgacggcacccggggcggcgcctcccaaggcgttggtggggacctggacgctggtggccgccagcctgccggaagacgaaaccgtgcgggaggagcgcatcgaggccaggcctcgttcggactacgcgcgctcgttgcaggtgacgccgtcgggctgcttcgtgctgcgcacctcgctggaggccgcgacgctggggcagggcaactcgctggtggtccgcgcctggggcacgctggacgtgtcgggcaaggaccgggtgcggcttcgcacgcgggacggccaggcggtgggcccggtgtgtggcgacaagcgggtgattcccctgacgggaccgaagctcaagtttctagggaacgcctatgtctgggacctggagaaaggcgtcctcacgttgatggtggacgacgagacgaagcagaccttccagttcgaacgtgcgaccccggagagcggaaagaagtagaacggccttctccgggaggtcgtgagacatggcggcgcaggagcggatgtcgagtgtggacgcgctgtggttccacatggaggaacccgccaacctgatgatgattaccgccgtgctctggttcgagggccggctggacttcgagcggctgcggacggtggtgcgggaacggctggtggagcgctacccccgctttcgccagcgcgcggtggcgggactcgtgggcctgccgcagtgggaggaggtcgccgagctcgacctggactggcacctgtcgcggctcgacgtgcccccgcccggggaccgcgccgcgctggagtcgttggtgggggagtggatgagcacgcccctggagcgctcccggccgttgtggcagttccatgtcatgtcggccgcggacgggcgcgacgtgctgctggcgcggctgcatcactgtctcgcggacggcatggccctggcgcgggtgctgctgacgctcacggatggggcggaggcggagatggccgccgaggcgcccgagcccacgtcgaggccctcaaccggtgggctcgcgagctgggtgcgcggggctcgggcggtggcggggaccgcgcgcgcggtgtggcgcaagggcgcggagctggccgcggagccgattctcgtgggcgacctgctggtgcagggggctcggggcgccgcggccatgggcaagttgttggtgattccgccggacccgcgcacgtcactgcgggggccgctggggacgcagaagcgcgccgcctggtcggacccggtgccgctggagcgagtgaaggccgtgggccgcgcgctgggcggcacggtgaatgacgtgctgctggcggcggtggcgggcgcgctgcggcgctacctggagtcgctgggggagccacccgaggacctgcacgcgctggtgcccgtgaatctgcggcctctcgacgtgcccgtgcctcgcgaactgggcaaccacttcggcgtcgtcttccttcggttgcccgtgcaactgggcacgcctcagcgccgattgcaggagctggtgcggcggatggagcggctgaagcgctcgccggaggcggtgctgaccttcggcgcgctggagttgctggggtacacgccagcggcgctggagcggtgggtggtggataccttcggctccaaggcctcgttgattgccaccaacgtgcccggcccgcgtgcggcggtgtccctggcgggcagccggctggagggcctgacgttctgggttccccagacgggccatctggggctgggcgtgagcctcttcagctacgccgggcaggtgacggtgggcgtggcggcggacgcgggccgggtgaccgacccgcatgcgctcatccaggccttccacgaggagctggatgcgctcgcgacggagcgtgactgagggctgactacagcagcccgtactcctccagcttgttgtagagcgtgcgccggctgatgccgagcagccgcgccgccagcgtccggttgtcgcccgcgcgcttgagcgcatccgccatcgcctggcgctccatctccttgcgctgggactccagtgtccgggcggagtccgtgacaggcaccgttggcgcttccagggcgctgacggaaggtgtcgcggcgaagggggcgggggccaggcctggctggcgcgccagctcttgaaggacttcccgcccgccaatcacctgcgtgtcggagagcaccaccaaccgctccaggaagttctggagctggcgcacgttgccgggccacggctgggcccgcagcgccgcgagcccgtcggtcatgagggtgaagggcgggcgcccgttcgtcttcgcgtggacctccaggaagtgcagggccaacggctcgatgtcgtccgggcgttcgcgcagggccggtatccacacgggcaccacgttgaggcggtagaagaggtcctcgcggaagcggccttccttcacacgctcttccaagggctgatgcgtggccgccacgaagcggacgtccaccttcaccgtctgcgtgccgcccagccgctccagttcgcgctcctggatgactcgcagcagcttcacctggaccgcgggggagatgtcgcccacctcatcgaggaacagcgtgccgccatgggccagctccacgcgccccggcttgcgcgtggcggcgcccgtgaaggcgcccttctcgtagccgaacagctcgctctccagcagggtgtccggcagcgccgcgcagtgcagcttcacgaaggggccatcccgccggggactggcgtcgtgaacggccttggctgccagctccttgcccgtgccggactcgccgcgcagcagcaccgtggctgtaccggcggccgccttcgccagcacggcctgtacgtccgccatggcccggctccggccgatgaagccacccgtgggccgcacctgctggcgcgcctcctcgccctgcgcgcgcagcagcgccttgcggacggtgaagagaatctcctcccggtcgaagggcttgagcacgaagtccacggcgcccgc

SEQ ID NO: 853 - DNA, 6492 bp, Myxococcus xanthus
gctcgcattgcaggtcggacagtggttccaaggggccgtcgaccacggctgcgatgaaggctgtcggaagcgtggccgccgcgtggcgcttcacagccaggctgcccggtgaaacctggggtcccatcttcatgtaggcggtgacactcaggcccccagacatcacggtgttgagcagcgattcaccgaggtcgattcccatggagacctcgctcgacaccgccttcatgtcactctccttgggaatctccagggtgtcgaagagcttccacgcgggccgcacgcgtccggcgttggggtgaagactcgactccacctggaagtggacttcatcgaactccgggggcagctcgagcggaagccgccaccgcaccacgcggcctcccgcaagaggtggcagcgggaactggcccagcatccggtgcgcggagccctgtttctgcctgcccatcaccagcacggacgacggggtggtggcgaggggctcgaaggcagcctggaaccacacgacggcggtggcctgcccgagtggattgcgaatcacgggctccacgtgcaggtggacggaaccgaactctcggggtggacgtccgacgtggtcgaggacgtccgcgtagaagtcatccatgccgcgcatcctcgccgagccagcggcgtacggacaaacggcttcggcttcaagacgatgggccatttccaggatgggctggcgctggtcgtggagagtgggaagttcggcttcgtggacgagtccggtgcgtggatggcgggatgaggggcggcctctgacagcctggccgtgccccgtcacggcgtctctgggaatggtatccaagcgccgggactggcgctccgcccttggacgccccggcccgcgcaagtaggccagaacacgggcggggagggctggtccaacggctgcaccgggagcgggacccctttcacctgaaggttcatcccatgctgcgctttgtctcctccgctcttgtcgtcgtcctgtccaccggctgcgccagctcgacggtgattcgctccagtcccagcggcgcgaaggtccggtcgcgctcgggcgaagtgctcggccggacgccgtacgagtacagcgactcggccaccgtcaacaacacggagagcttcaccttggagttggacggccacgctcccgagtacgtcaccattcgacgcgatcaatggagcggggcgcgcaccgcgggcggcatcgtcggaggactgttcgtcttccccgtcttcgccaccctgttctgggcggcggactaccgggagtcgtaccacgtagagctcaccgcgctgcccgacagcgagccagaagcgcccgcgccgcctgtccgggcgcgccgcacgagcagcgagaagtcgcccacctcccgtcgctgaaggggacatggtgggcgcatgcgcgtcgtcctcgatgtcctgatgacagttgtccgggccctggtgtctgccgtcaccagggcccgcgtatcgctcgcgaggtgtctccctccaactccttgaaaccacagggaggcattggccacatcgttcgacatgggcatggcacgtcggctgcagtgggacaggccatcgctgtactgacccttccaccgaccttccgaggagcctcccatgtccccccgccgcatcggttcgaccccgccccgctccgcgacgctcccttcctccaagctgccccagtccaagcttccggcgcgcgcgtccacgctccccgcctcgacgcccacggcgacgcccacgaagcctgtggcgaccgcggtgacggccaccaagcccacggcgagccctcctggagcgactgcgccggcggccacggactccaagccgctgaagcacccgggcatgcccgagggggcgccttcctacagcccctgggagctgagcacgggccaggcgtcgagcgtgatggcaagcggtggtgacaacaagctcacggcgcctccggccgcgaagcagaagctgttcgtcgacaagccgggcagccccttccagaaggacgtcttcggcggaacggtgagcggcaacgtgggctcgatgcaggcctccacctcgagctacagcggcagtggcgtgcaccattactcggcccaggcggagctgcgtgggcctcacgtcggctacgaactgcagaagacgcacgcgggccggctgggtgtgaccagcggccaggtctccgccgaggccaacactttcaaggcgcaggcccaggcaggtgtgtcgctcgacaggaacgagcacgcctacacggccgcgttgatggccaaggcggagacgggagtgggcgtcacggcgagcgcgagccacgacttcaaccggcacgtgggtgggtacgtcaagggtgaggccaaggcctccgcctccgcctacgccgagggcgtggccagcctggacccgaagatgggcacggcgatgctctcggggcaggtgggcgcggccgccacggcgggagcgtatgtcacggcgggtggccacgtgggccggctgcatggctcggtcaccgggggcgcggtggcgggcgcggcggcccaggcgggcggcaagctcggcctggagaatggcttcctcaagcactccgcggacgtcaacgccgccgtgggcgtgggcacccacgtgaaggccgacgtggcggtcgacctgcgtcaccacctgaagccgggcattgcggcgggactgcgcccggcgctcgctggcgccacgagcgttgcctcgcccgcgagcaccatcgagccggagaagtcgcgcgtcgagaagttcttggccaaggccttccacaaggcctgacatgcccgccgagcggcggcctcgattcccgccgcctccacactcagaagctcagcaatctcatcgggttgctgggctttttctttgccctcgtgtccttatgttcccctgcggcgtccgcggcggccagtcccgaatcctgcgtcgtgggttcggaggaggcaggggaggaaagctccttggcggcatcgaatcgtcggcgtgtggcagcgggtgagcgggagcgtggaagagttcacgccttgagcgggacgtcgcgctgggcgcatgcattgaggcgctgtcattcgtgggggatagtcgcgccgatgctcatcgggattcccgcactcgacgcgacggactggtcacggctggtacatgcctatggccgcgccactgacacgcctgaacaccttcgtgccctactcaccgaggacgcgcgggcccgcggcgcagccatgcaacacctgtggtcggccatcatccatcagggcaccgtcttccccgcgacggctccggttgcgctcgtgattctcgggttgctcgacgacgcgaggctggatgcgggcgaggagcccgttcgcgcggagttgctcttgttcctggcgcgtgtggtggacgccttcgagcggagcggcgcgacgatggaggacctggagtcgatggcccggttcgacctggggccgctcctggacgcggacgacgatgatgccatctacgaggacgaggacgcctcgaacgcgctccatgcgcagtccgtgctggcgtgtgcccgggtggcgccgttcctgacccgctcactgctggccaacctggaccatccggatgcccgggtgcggatgcacgcggcgatggccgccaccgcgcatgccgcgtcaccggcgtcggacgtgcggccggacgaactggtggaacggctgacggagatggcgatgcggacggtggatgtggcggagcgatgctccctgctcctggcgctgggagagctcaacgtgtccctggagaacctcctgtcggatgcggagccctcggtgcgcctctgcgcggcgatggctccgtccctggcacggagcgaggtcgcgacacgcgagttgcgcaccgcgctggagcagcatgccgcgcacatcaacgactggttcccggtgaagccgccgcagcttccgatgcagccgcgcttcacggtcgttcagcgactcctggagcgcgtccccgacttcgacctcgtggtggacgcggccgtggcggtcgcgcggaccaccaagaagtcctgggtggacttcgagtggggccccctcctcgtccacgcctttccgagtggagatggggtggtgaggacagaagcacagcggcgcttcctcgccgcgctcgtggacacctcgcacctctgggacccgcgcttcggcaacgcaggggggcacttccggaaggcggggctcccctatgagcgcgaggcgtgcgcgaggctcgtgagcacggcgtgaagggtcgggcttccacgcgcccctcggctcggaggacgcggtttgctcacccgtccgaacggaacacgaggttcgcgctcgcggcgtgagcacgctccggcctcgcgctccgtcccggagagcaccgggacggatggaggccgtgtcgcctggcgcgacctcaggccgtgtcgccctcgacgtagaggcgcttgtggtcgcgaatctccatcatgtggaacgcgcccggggcaggagccttggcctcgggagcatccaagcgcagcttcatcagccgctcgtactcctcgatggagccgcgctcgcgccgcgagcgcgaacctctcgttgtcgacgccaccacccgaggccgtggcgtacttctctgaccgaggactgacgctggagcggcagttgcgcatgctccatctgtcgtcgctctcgtccgttggcttgtaaagtgagtccatggaggaggacccggagtgggtacgatgtcagggcatggccggtcagccgtcatggcgcgccaggtcaccagtagcgcctccccgcgctccttgctgtcgtgagacttcccattgagtcattcttcggacgcctccaatcccacgcctgccctccgcatcaacccgggcttcgtgctcggccaactcgctcgcgcgctgacaatgtccgcggagagtcccgaccccgaaatccgcgcacgcagcaccgcgaaggtggcgcattgggggaaggtgctcgaaggcatcttttctggcgcgctcgacgtcggctctcgcacgcccgttgtggacgcgcccgcgtgggccaccctgaaggtggtgacggggggctttgccaccggagaactcctcgccgaaggccccctctcgccgcatgagcaagcgtggctgaatgagcttgggcccagtgccagccacagcccgcgcgcagcactcaacgcgtacttcctcagtgaggagggacttgcgttactcggggagatgctggccaccggggcctaccgcgtcgacgtccccgaggaaggtgccttcctggtcgccgcatggctgctgcgtcacggcgccgccgagcaggcacgcacgatgctcgaggaattggcgcccttcttctcccggctgcggttctacccggtcccccacacgccctccaccgaggacgggctccacgtccatctccagtccgtggcggaaaccacgaagcaactccagcgggtccgcctgcccctggacatcgagcggggacgcgagtccgccgaggtctggaccccgctgtacgacgaactcgtccagttgttcctcgaaacgcgaacctccgaaggggtctgccggcactttcctgccacgtggagcgaacgcggctcgaagctgctcgaaacggtggcgcgggcccgggcgaaacaccttctttgcaagtggccccaccactcgaagagccacttctcgaagctgtgcgacgtgctcgcccaggcggtgaaggagccggccgcgttgacaccggggcaacagcgacgcgttcagcatgtcctcgacgacatcgcccgagcgcgcgggctgcccggcagtgaccggttgcatgcacttcgtacggcgcagcaacgcctcgcgtcgcggccgacacaccaggacctcgcgagggtcctcgtggcgcgacttggcgcttactccagcggcgagggtctcgatgacctggagcaggtgacggcctcggtcaccgaggtggaggcatctcgtcagggtgtggccgcgggcgcggagttcccttcatccctgatacgaaaactggtgcgctgcgcgaacgcatcgctcgaggacctgatcgcacgaaaggtcgtcacctccagcgaggtgctggccagggtgctcccccaggtctccgcgcacgtggcggcacagggtgtgaatgaccccgaactccggcggctgtacgggcatatctacgcggctttccgccggcggcggtccctgctgctgctcgaccttcaatcgcaggtcaagctccaggaactgccctggtgccgcgccatcgacgcccaccgcacgccggacctgggccagcaggaggtggcggcccagacgttcgagcgcatctcctcgctggccatctcggcgttccccgccgtgctcattcccaacaagttgctgcaagagttgagggcgctggcgcaagcggcgggacttaaagtcccactggtggaggaactggcggcggacatcttcatgaatgcgttctcgccgaagttcga

SEQ ID NO: 854 - DNA, 8704 bp, Myxococcus xanthus
  unsure (1)..(8704): unsure at all n locations
tgtgctctaagggcgcccggcggcacgggcgtcagcgccatcttcgccacgcggccgttgatgctgacgcggccggcgcggatggcgtcctcggcttccttctggggaaagacgcccgcgcgggccagcgcgcgcgacagccagtccggcttctccttgccctcccagcgtttgtgttgcggcggcggcttcggcttgtcgggcttgcgagacatgggcgcggcactgtacccggccgggcctcgggcgggggcgggagttgtatgggccatggcggcgctgtcgcgatgaggccatctggccggggggcgcccggccggcaggtccgtgtccacgcggccggcgtggcccttcgggattgcgggcaggaacgtgcgtcggtggacacgttccgaacatgcgcacccggattccatacctgacgcttctggtccccgttctcgcgttcgcccagtcacgggcgcgggcgcccatcgccggggagcccgcgcctgcctcatccacgtggctgtgggtcctgctgctggtcgtggccgccgctgtcctcgcctggggcgcggtgcgcatggcggggcgcaaggggccgccgacgtccggctccggggggattggcgtggggaaggggacggggctgccgcagaagccgcgctccctctagggcgcgggctgacgcttgcggaggctgtgcagcgcggccagccacaagcgggcttccttccgcgtcagccgtgagcgccgcagcggtgcgaacaagtcccgcaccgccgtgcggcccggctgggcgtccacgaggaagcctcccgtcgtgaggacggattccagcgtggactccacctgcgcgagctccgcgtccgtggccgccgcgggcagcgggccgggcggcgtggcggcggcctccagcatcgccacgcggacctcgtaggcgtacagcagcacggcctgcgccaggttgatggagggctgttcgggcgcggtcggcacggcggacaggtcgtgcacgcgctccacctccgcgttggtgagtccactgcgctcgtcaccgaagacgagcgccacgggcccttggggcgcccgggccaccagctcctcacccaccgcgcgagggggaagccggcgcttgccttcgaccttgcgcgagctggtccccaccacccagacacagtccgccacggcctcttccagcgtgtccgcgcgccgcgccgcgtccagcacgtccccggcgtggacggcgagccttcgcgccggctccaaatcctccacctccgggcggacccagacccagtcggacaggccgcagttcttcaaggcccgggcggcggcgcccaggttttccgcgttgcgggggcgcatgaggacgaatcggacaggcagcaccatgcgcggggcaccttagcggtttctcgcagcctgaggaccgcggatggaggtcccgccgcgtcgcggactccgctagcctgggggcctcgaaagccttcgcaggcgcccaggagccacggacggtgtggctccctggacaccctgcgggtccgctgacgcgcgggggacgcgtcagagccgcgggcgcctgaccacagccctctcttcctcggcgtgtcctcgtccggcacgccgtgtgaagaacacgcgtcatcttctggaggaatcatgggttcgcagtccgtcgtcacgcagcggccatcgtgggcgaaacgctcgcgctggctcctcgcggccatgttggtgagcgccacgctcgcaggctgcaagaaggaacaggagtccaccgagccacccgcgccgcagccccaggcgcccgtcgccgcgcagccggcggactcggggacggccgtggcgcaggcgccgacgccccccgcgcccgagctgctgacgcccgtcgtccgcgcggtctccaccagcgacgtgctgccgcaggacatcgtcatcgagttcccgcgggaggtgcgccccaacgatggctcggtgttgaaggacaccgtcgtgaccatcactccggaggtgccgggcagcctctcctggtcctccccgtccacgctgaccttcaagccgtcgggcgcgggcttcgccttcgacacgaagtacgccgtctcgctggcgtcggtcgggctggattcgggcgtggtgaagccggccgcggtaggggactggtcgcacacgttcaccacgccgcccttccagttcgtccggatggtgccgcgtcagctcgacacggtgaagggccgcgtggaggtggaggtcgtcttctccggtcccgtggacatcgccgcggtgcgctcgcgggcgggcttccgggtgggtgggcaggctgtgggtgacgtgaagtggcgcaccctgcccaccacgcgcaacgtcgtcagcgcacagctgaccagcgggctgctcaagcagggccgcacggtcgacttcagcctccaggcgggactgcccgccgcgtcgcaggcgaaggcgacggcccccgccgcgcgcagcgcgttcgagctccgcgccggcaagcgcatggacatcacccgcgcctcggtggagcagggcaccacgggcttctacatcgaggtgagctgccgggacgtggacggcgccgagccgccctccccgcgcgagacggaagggtatgacccgtactactgggaccaccgcaacaagggctgcacgctggatgacggcgtcgccgcggaggccatccacctgacgcccgccgtcaaggtctccgtcgcgccgtcccgccgcggcttccgcatcttcggtgacttcaagcgcggctcctacgcgctgcgcatcgacgcgggcacgtcctcggtgggcggcggcatgctgctggccacctacgaggaggccttcgccgtccccgcgcgctcgccgcagctgtccttcgccacctccggccgctacctgccgcgcagcgcgtggcgcaacctgccgttgcagcacctcaacctggactcggtggagctcaccgtccgcaacgtgccgccggagaacctcgtcttctggatgagcgacgactaccgcgagcgcgcggacgagcgcacctccaacgtggtggcgaagcggacgctggcgctcaagtcgcagccggatacgctggcgaccacctacgtggacgtggccagcctggtgccggcgaacacgaagggcctggtggaaatcaccgcgaggcagagtcaccacgcggcggccagccgcatcctcctcaccaacctgagcctggtggccaagcgcggtgaggccgcgccgggctccagcggcgccggtgaagtctgggtgtgggcgctgggcatcgagagcaccgatccgctgtcgggcgtggaggtctccctggtgaagaagagcggcgagtcggtggcccgctgcaccacggtggcggcggatggctgccggctccaggtgcccgcgcccggcgtcgacgacagcgcgcccttcgcgctcatcgcccgtgacggcgaggagctgacgtacctcaagtacagcgagctgaagacggagattgccaacgcggacgtgcatggcgagccctaccgttcggagaaggcctaccgcgcgtcggtgtggtcggaccggggcgtgtaccgcccgggcgacacggcccacatcgccgcggtgctgcggggccaggatgacaaggcgccgccggcgggcatgcccgtggagttggtggtggtggacccgcgtgagcgcgagctgaagaaggtgtcgctgaagacgaacgaggcgggcctggtgccgctggacctgcccttcgactcattccaggacacgggcagctaccgcgtggtgctgaacgtggcggaccgcgaagtggcaatctactccgttagcgtggaggagttcgtcccggagcgcatgaaggtggaggcgcgcacggagcaggccggctacctccagggtgacgaagtcccggtgggcgtggaggccgcgtacctcttcggcggctcggcggagggcagcccggtggagctgacgtgccggctgattccgtccgccttcaagccgaaggagaacgcgcagtacgcctacgggctgtggcgccaggacggccgcgagccccgccccgtcacgctgggccaggtgcagggcacgctggacgcgaagggacaggccgtccttcgttgcccggcccagggcgccatgggggccctgcggggcgccggggcgctgagcgcgctggccagcgtcttcgagtcgggcagcggccgttccaccctgggcagcgtgacggtgccggtgcacccggaggcgtactacgtgggcctccagggcagcacgggcaaggtgaaggccggcaagcccttcacggtgaagggcgtggtggtggattgggacggcaagctgctggccgcctcggacaagacgcccaagacggtggacgtggagttcctgcgcctggaggaggagtacggctccttctatgacgagaacgagggctacgagcgttaccagcgctacctgcgcccggtgcgtgagggccgctccacggtggcggtgaaggatggccgcttctcgctggacgtgacgccgggcgcggactccgcgggctacatcgtgcgcgtgcgctcgggtggggcccagacggacctggagctggaaggggagggccgctactactggtggggggaaggctcgcgcgtggaccagacgccgcgcccgctcaagcccacctcgctggaactggcgctgccggcgaaggggcgcgtgggacaggccatcaccgtgaaggtgaagtcgccctacaaggggcgcatgctcttcaccgcggagacggaccgcgtgctcgcctcccactgggtggcggtggagcccggcgaggtgacgtggagcttcacgccgtccgccttcgcgcccaacgtgtacgtgagcgccttcctggtgaaggacccgcacctggagtccgccgaggccttcatgccggaccgcgccttcggcgtgggcagcgtcacgctggagccggtggagtacacgcagtcggtgacgatgaacgtgcccaaggaggttcgctccaacgacaccctcacggtggacctggagctgggcccgcaggaaggccccaccttcgccaccatcgcggtggtggacgagggcatcctctccctcacgcgcttccagagcccggacccgcagaagcagctcttcacccggcgggcgctgggggtggagacctacgagacgctgggctggacgctgctggtgccgccgggcggcgcgtcccgctccacgggtggtgacggcgagggcggcgcggatggccgtgtgcagcccgtcaagccggtggcgctgtggagcggcctgctgccggtgccggccaacggcaagctgcgcgtgcccttcaagctgccccagtaccgcggcgcggtgcgggtgatggcggtgacggcgggcccgcagcgcattggccgcgccagcgcgcaggtgttggtgcgcgatccgctggtgctccagacgacgttgcctcgcttcctcgcgcagcacgacgaaatccaggtgcccgtcttcgtcaccaacctgtccggcaaggcgcaggacgtgaaggtgacgctcaacgcggagtcactgccggtgccagggctggtgatgcccgcggcggccacttcgccgcttcagctgctgggcaagagcgagggcacggcgcgggtggcggacggcaagtcccacaccttcgtcttccaggcccgcgcggtgcaggcggtgggcgcggcgcggctgtcggtgacggtggagggcggcggctacacctcgagtgagtcgctggacgtgccgctgtctccggcgggcccgcgcgagcgcctggtgcagcagattgaactggcgcaggggacgacggacgtctcgcagtacctccagggctgggtgcccacgacggagcgctccacgctgtgggtgacggccaatccgtacgcgcgctcgctgcagcacctcgcgtacctggcgcgctatccctacggctgcgtggagcagacgacgtccgccacccgtccgttgctgtacgtgtccgagctggtgaacgacgtggaccccacgctgacccagggcgggaccgtgggcgacatggtgctgtcgggcatcaaccgcatcctggccatgcagacgccgtcgggcggcttcggctactggccgggcgccacggagccggtgggctggggctcggcgtacgccgcgcacatgctgctggacgcgcagaagctgaagtaccccgtgccgcaggaccggctgaacgacgcgctcacgtggatgtccaccgagctgaacaagctcgagagccgccagggccgcgacgacatgtacacggacagcgcggaggcctacatgcactacgtcctctccgtggccggcaagggccgcaaggcgcgtgtgcagaagatggtggacgcgctgtcggagcgggcgaagcagaaggcgctcacgggcgaggagcaggagcgtgactacatgctcaaggcctcgttgtggctggcgggcgaccggcgctacgagaaggagctgcgcaaccccgacctgtcgcccgtcaccgaggagcggaagaacgactggtccttctactccgaccggcgccgccgtggcttcatgctgagcacctaccaggacttgttcggcaaggacgcggcgggtgagccgctggcgcgcatggtggccgaatcgctccaggcgcactccagcggctggtacacgacgcaggagttggtgtggggcatcaccggcctgggcaagcggctgcaagggacgtccacccagttctccgcgccggtgctcaaggcggacggaaaggtcatgacgccggtgcaggacaagacggtgcgttcgtcggaccggacgtggtccctggcccgcgccagcgagcggcagggccttcagttggaggtgacgtccaaggacgagggccggctgtacctcgtgctcagcagcgagggcgtgcgctcggacagcaagccccgcacgggcggcgagggcctggcgctcacgcgcacctggcgcaagctggacggcacggtgctggccatggggcaggcgccggtggcgttggcggacctcgtctacgtggagctggagattcgcaacacgacgggcgagcgcgtgcagaacatcgccctggtggaccggctgccggcgggctgggaaatcgagaacgcgcgcctgggccggggtggctccaccgactgggtggaccctgcgtcgctgtggtccgcggactacgtgaacatccgcgatgaccggatggaggtcttcggcagcctggggcctcgcgagtcgaagaaggtcgtctacgcggtgcgcgcggtgacggcgggttccttcaccctgccgtcggcggaggcggaggccatgtatgacccgcgcctgtgggctcgtgagccgggccggacgattcaggtgtccgggccgtggaaggacaacctgctgtagcgcgcggcgcggggagacgctcctagtcgagcgtctcccacagcgcgtcgaacgcgcggttgaagggctgcaccagccgcgcgtcgtcggataccaggacgttctcgtggttgtactcggcggccgagcgcgtccagttgtagctgcccgtcaccagcctcagccggtcgaacacggcgaacttgtggtgcatgtgcgcggacgtcctgtccaggcggatggggatgccggcgtcccccagccgctccatgtcggagcccgggtccatggccttgtcatcgtcactcacgattcgcacccgccccccgcgccggtgggcgtacagcagcgcgcgggtgatgcggtcatccgtcacggtgaagacgcagacgtcgatggagccgcgtgccgactggatttgctggacgatggcgttgagcggcccctcgcccggagagaagtgcgcctccatgcgcgacgtcagctcgggctggggcgcgtgcagcgcctgcaccgtctcctccagccaggagatgatctcccgggagcgtgcgtccttcatcgacgctcgcgccagggcgaaggcccgggagcggaagagggtgagcagggcctcgccagcccgccgctccgccaggacggcctgcaacgcctgccgctcggtgggggtcagccgccggtcgtcgagaatggacgtcaggatggcgtcgacttcaaaggcattcattgcgcgtagtatatgcctgggattcaccgtctcatgagccgtgcccgtcgaatcacccggaagctcttgcccgtcggcctggggttgctaggcctcaccgtggccgcgtatgtggccgcctggcgcgtacccctgccggcccgtctcttcgcgcccgcatcggtggtgatggagtaccgggacggcacgccggcccacgtcttcctggccccggacgagcgctggcgcatccccacgcaactggagcgcgtggacccggactatgtccaggccctgctggccctggaggacaagcgcttcttccaccacccgggcgtggacccgctggcggtgctgcgcgcggcgacacgcaacctggccacggggcggcgagtgtccggtgcctcgactttgacgatgcagttggtccgcgtgttggagccgcggcctcgcaccttcacgtcgaaagtcatcgagtccttccgggcgatgcagttggaggtgcggctgtccaagcaggaggtgctcgcggcctatctccagttcgtcccgtacgggcgcaacgtcnaaggcgtggaagcggccgcgctggcgtacttcggccacacggcggcgaacctgagccccgcggag

SEQ ID NO: 855 - DNA, 8090 bp, Myxococcus xanthus
gcgtgctctcaaggcagccggaggatgatgcagttccagcaggagcacggcacgggcggcagcggcatggcccaaccaccgggcgtggactacgacgagatgggcggccgcgaggagccgggctccgcgggcgcgccgtcggtgccgtccatcgccagcgtgcatgactcaccggagggtgtcgtcatcgtctacaccgccgtcgacccggcccggcaggacaagctgagctccgaaatccaccggaacgcgaagtacctggccacgggcaaatgcccggggatggcggcggactgagcgcgacccgaggccagcgcccggggtcctgccccccgtcgtccaggtaggccgtgcgctggcttcccccccccgaagtcgcccgctgtcacgccagtggcggcaggtgcgtcaggagccgctgcaggtccggctgaagctcgtccggtgacgcgcccgcgagcacgtccaccggatgcgtgccccaggtgacggcataggtccgcagccccgcggcctgccccgcgcgcaagtccaacgcggtgtcccccaccatccacaacccgcccgtgcccagggctgccagcgcgtggtggatgacgtcgggcgcgggcttgtgcggaaagccatccgtgccctggacgtggtggagcagcgggcccaggcccatggcgtccacgaacttgcgcgccatgtcgggacgcttggtggtggccaccgccagcaggtagccccgctcgcgcagcgcgcgcagcacctccaccacgcccggatagggccgcgagcgccggtggaagttgagcgggtagtgctcacggtaggccacgcacaacgcggggacgtggtccggcgcgaactggctgtacatccagtccagcggatggccgatgagcgcacgcacctgctcgtaggtcggcgccggaagccccaggtgcccgaaggcgtggaggaagctgtcgatgatgtccggcagcgagtccaccagcgtgccgtcgaggtcgaagaggatgccgcgagaagaggaagcgctcacgcaccttccataccccctctcgcgccccctgtcctccctccggactcagggcgaggcgtgctccagcggagcagcgggcgcctgctccaggacgcacatccacagccgctcctcctgcacacagcgcgtaccgcgaatggcgcggaactcatggagccgctgcggaatggagaggtagatggtctccgggtcgagcttgcccgcccggatatcgtcgtcgagccccaggcagtagggctgcgcgcgcgcgtcatccagtcgcgcgacgtagccgctgttgaaggtgagccccagcaagtaggcgcgataagcccagcggtggaagtccatgggcccggcgcggcagccccgcccggagccgtcatgcatctgcggcgggtagagcaccaggtgcttgcgtccagcagcggcctcgcgcagcgcatcggacggctgtgtgttccaggccggcccttccttcgcttgatggccccgccccagattcacatcgaaggcttgcagcaccagcgccagggccagcagcgacggtgccaccgcgggccgaggcaggcggatgagcgcgagcgcggagcccagcgccagcaggtagtacagcggccacacgaagcggccggaggagcggaagggctccacccaccgcatcaccggcgcgtagaggcccgtcaggtccgcgacgagctcgccttgcagggtgatgcgcgaggacagcgcgaagaagcccaggcccagcgccaccagccccaccggcaccagcctgcgccactgccgcgcgacgagcggcgcgtcccgcacgagcaggatgagcgcggcccagagcgcgaagagcacgcccagccccaggtagccgaagccttcgtactgggcgccctgcctcggcagcggccccaggaagcgcgaccaggagtcccggtagcccatcggattgacgaacgccaggaggtccgcggagaacccaccgaaggcgtcggcgcccagggtgcggacggtgccgaggtagcccagcacgtagaagagcaccagcaccacgcccacgttcaccacggcgcccagcaggggccaccgccagggcagccgctgctccagcgcggtccgcatgcacagcgccagcgcgagcggcagcaccatggcggtaatcacggggtgcacgcccgcggcgaacacgcacagcgccagcgcgatgcccagcgcctgcttcgcctcgcgcgcgtcccgctgcggaatcaggttgagccctaccagcagcacgatggtccagtgcgcgcacagcgcttcgtgcgccatgctcatgcgcgccagcagcgtgggcgacagcacgagcagcgcgcccaccagccactgctgcggcaccgtcgcgcccatccgccgcgccacccacgcggaggaggcgccctgcagcatcaggcacatgcacatccacggaccgatgtattggaagtcggcgggcagcaggctggagaacggccgcagcagcagcgccacccaggggatggcgtccatgtagccgagcgtcgtcccgagcggatgcaggtagccgtcgatggcgcccagcgggaagcggagcggctcgttgcggaagaacaaccagcccagcaggtgctggctgaagtcgtcacggatgagccaggccaggcgggtgggattcagcgccgccggaccgtagatggccaggaacgccaacagccccactccggcggcccccagcgggcccgcgttcgccacgatgaacgatgcaaccgtgtcctggatgcgccgcagccgctcgggcagggcgggcctcatggacggcactcacgcgaggcgacggagacgaaggtgacgcgcgcttcgggcatggaagcgccgcttgaagcacagccgtttcaggggcgtcaagcagccccggcgcagacaggggcgccccggccctccacctccagtgcctccacgtcctccggctccgaggtgagccgccacaaggcttcctccagaaagcccagcgcgccgcgcaggtccgacgaggcggcctctggcggggcgctccgggctcgcgcgatgcgccgacgcaccgactcgaaagcccgctgcgcccgcgcgacgtcgtcccgggccgcccgtgcctccgccaggtccaccgccgcgcgaagcagcgcggccagctcgcgcagcaccgggtcgtcccgcagctccggcgcgccctccagcacgacgaagctcgcctccgccgccgctgcgtctcccacgcacgcctccaccacggcccggtacaccgcgaagcgcagcacctgcccgcgcgacacgcgccccaggtcggacaccgcctccgacagccgggcccaggcttcgctccacgctcccagggccagctccgcgcgccccaactcgcccagcgcggtgccctccagcagccgctgcccaagctgccggccaatgcgcgcagcggcaagcaggtgctcgcgcgcctcctgcgggcgcccttcctccagcaggtagcagcccaggttgaggcgagccagcgcatgccccgcccggtctcccacactggccgagcgcgccatcgcgtcctccagcaggctcatcgcctcgcgcgtgcgccccatctccccgatggccaccgcgcagttggacaggaagcccacctcgaacgtcacgtcgcccacgccgtggaagagcgcctgcgccgcgcgcagatggggaatggccgcctccgcgccgcagcgggcctgctccaccaggcccaggttgcccacggtgtaggcgtccaaccagcggtcgccctccgacgacaacagccgcgcctcgcgcaccagcgcccaggccagggacagctcaccttcgtgacgggccacaatcgacaggtccaccagcacgcgcttctcgcccgccaccgcgcccagcgtcctcagtgatgcgcgtgcgcactccaaatccctgcgggccgacaccaggtcgcccgcctccaggaacacgcggccacgcaccgccacggcctcggccaccagcctgggcgcgcccatcacccggtccgtcagcgccagcgccgcgtccagccgttcgagcaacagtcgcaccgggccccgcgtcaccacctccggctgcagcgccaccaacgcctgcagcgcccgctccaccgagcgtgacgtcgcgggcgtcacggccagggcgttgtcacacgccgccaggaggttctcccgctccagtgccagccgctgcaagggcctccgcaccgccctgggcttgcgcacctgcgcgcgcagccggtaggccagcgacaggtaccaatccgcgtgccgctccgccaacgcggccgcattgcccacgccctcttcggccagccgcgccgcggcatactgacggatgctctcgtactgacccagccgggagtcaccgccgggcaactccgcctccagcacgcgcaagatcgacttgacgcgcagcgactggagcacgtccagcacggcgggcccgtccggcggcagccccagcaccgcttccgccgcctccagcgtgaagccgccacggaacaccgagcagcgcgccagcgcggtccgctcctccggttccagcaggttccaggaccagtcgatggctcctcgcagcgtcgcctgccgcgcgcggccatcaggccgtcccttgcgcaggagctcgaagcgacgcgtgagccgctcccgaagctggctcacgctcaacagcgccatgcgcgcggcggccagctcgatggccagggcgattccatccaactgccgcacgatgtccgcgaccatcggcgcctcgccggccgtcagctcgaagtagcctcgggcttcacgcgcccgctgcgcgaacaggcgcaccgcgtccgaccggaccagttcctccagccgggactcgccttcctccggcaccgagagcggcgccaggtccagcagtcgctcaccgggaaggcccagtgcctcgcgcgacgtcgccaggaagcgcgcgcgaggcgccagttggagccagcgccccagcgtggcgggcaggtgctgcacggcctgctccaggttgtcgaggatgagcagcacgtcgccacagtcgttcagcgcgcgtcccagccgctccgccggctcggtcgggtcgccatccgcgcgcagggggattcccagcgcatggcccaccgacaggcagagcgcctccgctgtctgggcctcggccagctcacacagccacaccccgccctcccattcccccgactctagttccagcgcaccaaaggacgtggccagccgggtcttgcccatgccacccggccccagcagcgtgacgagccgcgcgccatccgcgagccagcggcggagctgcccgagttcggtgcctcgccccaccagtccctcttggagcacgggcacgttcccctggcgatctctcggcgcacgaggaactccgaagcgccgctccgacaggtgcgcgggcagcacctccaccagggccacggcatcatcgatgcccttcaatcggaacgcgcccaggggacgcaccgcgggccggcccagcggctccaacacctgcgcgacctgcgcccaggcgccgccacttaccaggacctgacctccatggcccgcggccgccacgcgcgccgccacgttcaccatgcggcccaggtagtccgtccgtccggagcgcgcgtccacgcggcactccggctcgcccacgtgcacgcccatgcgcacccgcaggccccggaacaacaggcctccgggtcccacctcttcggcggcctcgggctgggagaggatgtccaccggccagggcgcgcgcagcagcacgtcctgcgcctccaggcaccacgtcagcgcatccagcaccgaggggaacgcaatcatgaaggagtccccctgcgtcttcacctcgtagccggtgctgccgaccagcagggaacgcaggacgcggtcatgcacctccaacgcgtcacgcatgcccgcgccacaacgctcccacagccgcgtggagccctggacgtcggtgaagaccagcgccacggagccctcgggaggcgtcgcggaggccggctgggactcctggccgggcagtgccctcagcatgcccgccgcggcgcctgccagccttctggaggacacatcacccatcgcacgctcctgcgatgccagttcccgcggaagagatgacaccacgcggatcgaacaccgcccatgcgtgacgggcacatgctccgggcctcaacacagacagcatccggcacgagacgctcgcgcgcggacgcgtccacaacgccacggcaccctcgccccgggaggcaccgccggtgtgaactccgagcccaccttcagcacgcctcgactgtccgcgactgcaaacattgcccgcgggtacgggttgcccgcacgcatccctggtgcaatttttcgcgccggccacccttcaccctgcccgcactcctcggggtggccccacccggacacttgcaccgcgagccgtccggcgacctggacccactggggagtcgatgaaaaagacactgcttccgaagacgtttccgatgctcgccctgacgatgcttggcattgctggctgcgagcctccgccgccagacgccgcgtccccgaccggcgcgcggacgcaggcgcaggagtcgttcaacgggctgtccttcaatggcctgtcattcaacggcctgtccttcaatggcctgtcattcaacggcctgtccttcaatggcctgtcgtcggaagccttcaacacctggttccaggccaatccctcactggccgacatggcgatgcgctacgtggtccgctgcgccgtgcccgcggggcagacgcgaacctacacagagcccgcgatggagcagtcgtacacgtgggaaggcggcctggggttggcgccagactgggctagcggaagcccggccacgctggccgaacagcaggtcgtctccgcgtgcctggcggcccacgccaaccggctgggagaggagttgctcatctccatcctcggcctggacggcgctggcgccgtcattccctacacggcgcaggagctcgccacgcattcccggcaggagtcgtgtttcttcggcaacctcttcaacgccgaaggcatccacgtgggcgcggagcgcgctccgctgggccctcaggagagcacctcgcgcgcctgcgcgggcctgctccacgatggcacggagacgctcgtgccctgcgcccccatggtgtacgtgggcgcctgcacgtcccactgcgcgctggactcgagcggcctctactacgagacgtgcacgctcggcggtgtcacctaccgccccatcaccacgcggctgtctcccacgaatgtgaatgtgtgtggagacagcgtatgtcaggccacggagcagtgtggcacctccaaccggtacgacagttgcgcacaggattgcggcccctgcccgtgaggtgagccgcgcgagcgtctgctgttggacgcttgacgcgtgcgcgtggaggaatggattggaaggcgcatgggcgtgactacttccctctctcatgcacctcaccccatcccgccccatccccctgggcctgccccgcgcgctgctcgtcacgagcgtgctgctggcctcgacgtcccacgcccaaaccacgccgctggaggacaacaaccgcatcaccgcgggctacatcgaactggcctatgaagtcggcgggctgctggaccccaccctctccccgggtggcaccagcgccgtgcggcccaactggttcgtcttcgcgccgcatgcctctcgcaccggcggcgaaggccttctcggcgcgtcactggcccggagcgtcatccgcgccgcccgcggccagccatccctgtcgcttcagcaggcgctggggcgcgtgggcctcacgggcaccctgcatctgtccgtccagcaactgggcctgcaactggtgctgtcgggcctgcccttcgacgtggcggcgtcgctcgcctcgctcaccacggcgctcaatggcgcagccctgctggacgcgcgcacgttgctcaccaccacggcgcgcttcgccgcgctctacgcgagcgcgccaggtgtgctcccgctcgacaaggcggagcgcatcgtggacacactcagcgc

SEQ ID NO: 856 - DNA, 6930 bp, Myxococcus xanthus
tgctctcaggggggccccgggccccggtcatgcgcaagcaactattgcgctcgagttctccgtcgccggaggtgacaccgcgtccgcactggccgagggctgacccgtcagtcaccaaggcccatcccacgcacctcgatacgtcagagcgcgcgggcctggccatccgcgcggacgtggaggaatgggggctggatgaaggcgtgttctcgctcctgttcgacgcgggcacggaggtgggcgcctcgctcgtgagtcaccccgccatccgcgccgtcggcttcacgggctcgcgtggcggaggacgcgcgctgatggcgctggccgccgcacggcctgtccccattcccgtcttcgcggagatgggctccatcaaccccatcttcctcctgccggaggcgctggccgcccgtccccaggcgatggcggacgcgctggccacgtccatcctccagggcgcgggccagttctgcacctcgcctggcctgctcgtggcggtggagggcccggggtacgaggccttccgcgcgcggctcgcggagaagctgggggccgcctcggccgcgcccatgttgacgcccgccatcgccgagcgctttcgcgagggcgtgagccgtctcgccgctcgcacggacacgcggacctgtgcacggggtgagtcgagggccgcgctgggcgccgccgcgctgttcgaggcggaggcccgcgtggtgctcgccgagagcgcgctcacggaagaggtgttcggaagctgcgcggtgctgacggtggcgcgtgacgcggcggagctggtgcgcgtggcctccaggctggaaggccagctcaccgcgacggtgatgatggacgcgggagacacggcgctggccgccgagctgctccccacgctgtcggaccgcgtggggcgcgtgctgatgaatggtgtccccacgggcgtggaggtctgcccggccatggtgcatggcggtccctttccggccagttcggatggccgcttcaccgccgtgggcacgggcgccatccgccgcttcgtgcggccggtgtgctaccaagatgtgccggacgcgctgctcccgccggagctgcgcgatgcgaatcccctgaacctgtggcgaacggtggagggggcactgaagcaggagtgactcccaggtgccctgtcttcacccgggagtcactcccgggcttcacggcgcagtgtcgaagcgggcctccagcttcacgcccgcgaacgccgcgcgggccctcaccatggcgtagtagtagacgccggtcagcggcgaggggatgtccaccacctcgtcgttgccggccagatacggccggtagtcatacgccgtcgtcgacggccactgattggcgcggacgtagaggtccgcgttgcccgtgccgccgctcatctggaagcgcaggttgcgcgcgccggcgggcacccagaggtagaagtactggatgtcgttgccagccagcgggccccggtagcagccgttgtccagcatccgggtgtccgcgcccgtgcactgcgtgccggtgccaggccccgggcccgggtccggattcgcgcaggtgctcgggtcggtcgcggtggagacgcagtcaatccactggtggaactccgcgtcgttcgccgagcccaggctgtccagcgacgtgcgatacccggtgtagttccccgcgcggaactggctgacgaaggtgtccacctgcgccgggtggcgctcgaacatgaagcgcaccgcgaggtagccccagtagtacacgcgctcggtgccactgttgtagtcgttgcgcagaatctggctgagctggaagcgcttgctggtgcccagctccaccgcggacgcgttgtcgtccttcttggagacgtactcccccagcccttcaatccaccagatggtgggctggctgatgctgtcaccgaagccgcccttcatgttgaagcggccatccaggtagtggacgtactcgtggcgcaggttccagatttcgaacgcgggccgaacccactccgcctcgtaggcgatgaagcgggcctgattgccggacgccgccgggtctccctccaggtacatgccgccgttgttcgtgtcgatgccgaacagcgcgccggcatacgtctggtagtccaggctgctgtcgaagatgaccatctccagcgacgtgttgttgtcactggcgacgggcaggcggcccgtcttcagcttgtcgtggaagtaggactcctgcgttgcgagctggtcgcagctctgcgcgagctgcgtggccgtcatctcctgggcgcgcatgcgcagcgtggcgccgcagttgtgcgtcacgcggagcaccgcctgctccagcgtccgccggaagtcgcagatgccgtagtacgcgcagttggcgccgtcgtagaagtcggccatctccgcagcgcccacccagacgcccgcggtggggcccgtcatcgagtggctggtgatgagcgccttcaccttggggcgcgtcttcgtctgcagcgtccccgcgtactggaggaagcgggacagctcgcgggccgcgttgacggagaggtactggttgtccgtgcccagcaggtgctcggtgcgcaggccgaaggagtccagcgagtcgatgatggacgggtcctgctgcacggccgccacgaagtcgtcgttgtagtggcctcggaacagtccgacgaacacgttgttggtggcgctgcgcatgtaccagaaggcctgggtggtgtcgttgaagcggtccagcaggcccttgaaggtgcccaggtgccgcgcgttctcccccgcgctgtcgatgagcgtgacgaactcctgcagcaccgcgccgtggtcgtcgttgacgtcccggaagtggctgttggccacgaaggcggccagggccgggcggatggcgttggccaacgccgtgccgtagctgcccacgacgtccggggcgtagtactgcacgtagtaccccgcgcgcaggaacatgatgagctggagcgtctggccgttgttgttgcccccatagccttgcgcgctggaggtgagcgcgttggcgatggtgaccatcttgctctcgatgaacacctgccgggcgagcgtgcccgtgacgctgaacagcgtgttgatgcactccgtcgtggagcccttcaccagcgtgacgagcgccgtgccggtggcggacccgaaggccgccgtgtcacacgccagcagaaggcgcttcgatgccggtggggtgagggcctgacgtaactgctgcggggggacatccggctgccgctcgtcgggttggatgcgttggtgcgcgtgctccagtccatggacgcgctgagcaggctcgaccgggagaggacctccggggcgcgcctccgctccaggtgcgaacagggcgagacaacagatggcgaggacgatgtgacagcgacaccaatcagcgattggactgcgcatggcttcgtgctcctcgaatggggggggcttgccgcacggtgtcgtccgtttcgagtgacaccgacgtgggtttcacgcggtgttcaaggtattcatgagcacgtgtgacattcttgtgtctttcccatgtggggacgaatggaaaccaccaagacgcgtgaaaccttggagcactggcggatgggcttcatggggcgggtggcgaatccgctgttcgcggaggagctgttcgaccgggtgccggacatcgtcttctcggtgaaggacatccgggggcgctacgtgtgcatgagcgaggcatgcgcggagcgctgtggcctgaagagcaaggcggcggcggtggggcacacggcgcacgagctgtttccccagcacatggcggaccggtacgtgcgacaggacgagaaggtgttccagacgggacgcgcgctcgtggacaacctggacctgacgttgttcaacaaccgcaagccgggctggtgtctgacgagcaaggttccgctgttcgatgccacgggcgaggtgatggggctggcgtgtctgtccaaggacgtgcacgagccggggcgcgcggggctggtggacgagcgcttcgcggggaccatcgattacatccaggcgaactatggggagcggctgcgcatcgactcgctggcgcggcgggcggggatgtccgcggcgcagttcgagcggcggatgcagcgcatcttccagctctcagccgggcagttcatcatgaagacgcgcatcgacgcagcggcggagcggctggtggaggatgcgcagcccatcgccgccatcgccctggcggtgggtttctgtgaccagagcgccctgtctcgccagttcaagcaggtgacggggttgagcccgcgacagtaccggcagctcgttgttgccacgtccgtgccgggagcgccacggggcaagcaggctcgctgaagccaggccacctggcgtgaagttcacgccggtgtagccacagcaacccgcttagaaccgccccgcccgagcctggtcgaagtccacgcggtgcttcatgtacagcgtatccagcatgtggttgctgatggggttggcattcccatccgtgaaccggtgcaccaccgcgcccttgcccgcgtccttcaggaaggccgtcgggtccacgctcccgcccaggcccgtgagcgtgggcaccgggtccgcgttgttgacgtagtgcacatacttgggcccatccacataccgcgtggacgccgcgccaaacgtttccacgctcagcttgcccagcgtcttctccacctgcgcctgggacatgccatcctcgatgcgcagccgcttcgccacgtcatccagcgcccgcgcggtgatgaggccgccctggctgtagcccatgaggtgcacctctcggcccgccttcaactcgctgtagagcgtgtccgccagtgcatccaccgcggggttgtggcccttgtccagcttgtccgccacacactgcgccaggtccgccaccaggccctgcgtcgcgttgtggatgcccaccaccttcgcgtccgccgtctccgcgatggcctgcatctcactcaactgccccgacgtcggcgtcatgatgccgttgacgtagagaatcgtcttcgacgggttcgggttgtccaacggtgtcacgcctgggatctccttcagcggcgtgccgggcggaaacgtctgccccttggcccccacgaacttcccgtcattcatccggtccggcttcgcatccccgccgaagatgcgcttcagctcattcacatgcgcggcctggaagacgtccttgcccatctcgatgaagcggggcacgtcggcgatgccgcccttgatggcatccaccaccccgcccaccagggagttcttcggagccgccgtgggtgccttcacagtcgtaggggtgacggcgctgcggctgcggtcgatggggctcacgagggcctcctgcccggtgggggaagggtgttctccccatcttctcaagctcccagagggaagttgcgtcctcccacctcgcgcgtgtcaatccatacggagggcacgcgacatgccgcgtcaatgcgacacgggcggtgagggctcacgcgtttcggggtcatggtggttcagcgtctgctccgcctgctcgcgatggaggcgcatcgtggccgtctcctcctcttccgtccgctgacgccgcttcaccaggccctgcgtctcatccacgaaccagaacaccacccggaagaaagccgagatgaccgtgatgagcagcgtggacagcacccaactgagcacgtagccgggccagcctcccacggacacccgaatgacgttcgtccccgtgagcggcaccaggacgaaagccacgtagtgcgacacgcaataggggcacgacaccaggtagcccagccacgagtccttgccccccagccgcgcgcgcagcggcgcgaagatgcgctcccgggacagcgtctgcgacacgcccatcaccacggcggagactgcgaagagctggaagaggtcccccatgtcgccaaggtggcgatgactcgccgggcaagaaacagcgggccgccatgagggcccccgcccgcccgctccccctgcctgccccccggcgccaacggcgccgttggccagtcgacgttcggaagagacttccgtggggctggctgtaaaaacgaccgattaccgcccatatgcatgggccggctcggatgcaaacccctggattcacttggaaacgatggtgccaccccttggcacgtgggtcgcaaagggcaaccccccgtagcgtcatctcgctcccccaaccagatctctttttccccgagagacaccatgcaggcttccaactccttctcctcccctgattcgctctccacctacctgtcggagatcaaccagtacccgctgctcacccagccgcaggagcaggagctgtcgaagcgcttccgcgcgggagacctggccgcgggccaccagttggtgacggcgaacctccgcttcgtggtgaaggtggcctacgagtaccgctcctacggcctgaagatgtcggacctcatccaggaggcgaacatcggcctgatgaaggccgtgcagaagttcgatccagacaagggcatccgcctcatctcctacgctgtctggtggattcgcgcgtacatccagaactgcatcctgaagaactggagcctggtgaagctgggcaccacgcaggcgcagcgccgcctcttcttcagcctggcccgcacgcgccgcgagttggagaagatgggcgccggcgacgcgaacgtcgtcaacgccgaggagattgcgcgcaagctgaacgtgaaggcctccgaggtgcgcgagatggagcagcgcatgggtggccgtgatttgtccctggacgcgcccatgggcgaggacggggacgccacgcacctggacttcgtggagtccgagtccgtcttcccggtggacgaggtcaccgaccggaaacaggccaacctcaccctcgtagctattgcacgcg

SEQ ID NO: 857 - DNA, 8030 bp, Myxococcus xanthus
tttgaagccaaacccccactggggcgtgggggccgccccggaaactcctgtgggcccccggtacaggagcgcgcccttgtccccatgcggcacgggctgcacggagccccgcgcgtccaccgtgagggcggggtcgcccaggttgtagacggacactgaggggttgccctcgccgaagaggtggcgaggcaccgtccgggtgaacatggcgcccaggtagccgcgcaggccggcctgggtgctgcgcagcggaccggaggcggcgagctggttcttgaagtcctgaatcatctccgcgtcccagcccgtgccggcgaagggggccaccttgccctccacgcgaaccagggcgaaggggcgcaggggcggcaggcgctcgcccacggcggcgatctgcttcaaggcctccgcgggccggggcgcgccggtgacgcgggcccaggcgttgccggtgcccatcgggagcacgccaatggccggcagggccacccccgcggtgcgcagctcgttgagcagccccgtaatcgtcccgtcaccaccgcccgccaggaggagggagggcggattgggccggagcgtgtccgaaatccaggcacgggcctcgtcgagcgaacgggtgagcgccacgcgtgcccggggcaggaagcgctggaccagccctcccatgccttcggagccccggcgtgcacgcaggttgacgaggacggcgatgtcattcatggcgagcgggactctctccacgctttgtcatggcccggtcacggcgcagcaaccggtgacgcgtcgtgacgcaaaaaggaccctcatactcccagtgcatgggcgaaacgggccttcagcccccgtgcctcccgcttctttccgagggagaacgccgccgcggccacgcccccggcgaccaacagccggcgcagccattgcttgcccgccgcgtggtggccccccgaggtccccgttccctccgccatcggacggaagagcgtcccagaggtgtggccctggcgctccttctcaaagtgatgggcctcggtgacgccgttcatggtgcgctcgaaggtgcggggcagcaggccgtgcatggcggcgaagctccgagcggcggggccgacgaagacctcgtgcttggggctgcggaggacccggaggatggcgcgcgcgacgcgctccggcgtgtagacgggctccacgggacggatgcgccagccggtgtagttggcggtgtgttgccacagcggcgtgtcgatggccgcggggagcacggtacacacgtcgatgccggtgccgagcagttcctggcggacagacgccgagaagccgcgcacggcgtgcttcgaggccacgtaggcgctgacatacggcgcggcgaccgccccaaaggtcgaggagacgttgaccagagtgccgtagccctgccggcggaactgggccacggcggcgcgagcgccgctgacagtgccgaagaagttcgtctccatcacctgtcggaaggcgtcatccggtgtctcttcgagacggcccatgaggtagacgcccgcgttgttgatccacgcatcgaagtggccgaagacgttgcgcgcctcgtccgctaggtgctgcacggcggccacgtcggacacgtccgtgggcacgacgtgggcctggacgccgagcccccggcactcgcgagccaggtcctccagcggctcctcgcgccgggcggccaggacgacgtgggcccccttgttcgccagggccagcgcggtggcgcggccaatgccactggacgcgccggtgacgacgacgacttggttcttccaggctcgcttcatgtccgcgttctccttgtcgggccgagccccagcgcatggcctgagttcccctcgcgaagatggcgattgcacacagcgacgcaccgggtcatcgaacacctggttggagggcaggcggcagagcggcgcgagggtccacgtcccagaccgccgccggggatgggggtccactgccgggacgggggctgggcgcgaagtgatgcgtccgcacgggacgtggaggcggggtggcacgcgggtaaggggtggagatggctcggcttttcgcggagcacgggtgggttggaggaagcggagcgggcttggtatgtgcgagcgactgtcgggcaggaaacggaacgcaacctgcactcggcccgcgagccatgaacatctccgaacgcttccttccgccgccctggacggcggccgtcgtcctcctgtgtgcgtccgcgtgcatcaacgtgccggccgtcgagcccgcacaggcagaggtgcgaatcaccgcgccggcgggaacggcctacacgaatggtgtggtcgaggtccgactcgacgtgacgggccatacgccggaccgcgtggaactgctcaaggacggcgaagtgatggcagagctggcgccgccatacacgtacacctgggacacggcgggagaagcggaagggacgtaccggctggaggcgcgcgcggtgctgggagatgtcgcgtacgtgagcgcgaaccgcgaggtggtggtggaccggacgccgccgcgggtggtgtcacgcgtgccggaaccgggcgcccaggaggtctgggtgcagagccccatccgcgccgagttctccgagcccgtgaagcagagcaccgtgacgacggagtccgtgcacctgacggtgggcgacatattcgtggcccacacggcgtccctgtcggaggatgggaagacagtgacggtggtgcccgtgacacagatgaccgcgccgagcaccgtggccctggccttctctggaactgtgacggacctggctgggaatgccgctgtgaatctggaggaggcgtggagctgggctgttcctgagttcgtgccgtatccgacgcactcaatcgttccacgccatccctatgcgggagttactgcctacctcaagcttggcccaagcgggcaccctacagttctgacacatcggtttgatggtcaaacggggaacctgttcgtgagccgatgggatggtgactcctgggaacagctcggaggcgggctgaaaacgagtccagaagaattcaccatcttttcccccaatctccaaatcctcccaaacggaaatccaatcatcgcttggacggaaaacctcggcgcagagttcaacaattacatccacgtcgcacaatggaatggcgaaacatggaaacgacttggaggcagcgaaggaatcgttcctgaacgaccccatgcctgggatgtcgcactcgcgctcaccagcgacggtcggcctgtcgttgcaaccagcatggacccagaagacgccgagggcggtatccaagtctatcaatggctcaatgagcagtggcagcgaattggtcctcctgtgtatgactccctctactgggtacggacgccccaactcgcgctcgactctcgtgacaaccccacgatcgcccttgcgcatcccgcaactgagatgcggggacgcatcgtcgtttggcgctggacgggaagcgagtgggcgcaactaggagagtccgtcaacagcagcgcaaaccaaacctccaattcctccggtctcaggtcactccttttcaactcagctgatgaacccatcatctcctggacgggaagcagcacaggcacacaagatgacctgttctccagcatttggtccaacaaccaatgggtctcgctaggaactccgccgcggacggacgcaacgagcatccgaacagtccgtgggagcactctcaccaccaatgatgcgctcctcctgatgtcgaccgaacatgacaccctggggggaatgatcaacatccatcgtcgagagaacaatcaatggcagctcgtatggaacagccgggcggcctttcccgggacgcaaacctccataggagcacacagcttcgacgcagacacctccggaaatctggcattggcttggaccgagccaagagaagaacaacacgtcgaaattgtcgtatatcgcagaaacaaataaatcaagcctcagcccatcagctacgtatccaagagagtcaaagatgaggatcgcaacagcaattgtcgcatgccttgtgtccacgactgcatactcggccccccgccgcacggtggtggccagtggtgactgcaaggacgcggagctgagcgggcaggccaaggcattcctgggtgccctcgcctcgcgccccgagcaggacaccctcaccgccaaccagttcagcgaccggctcttcccgcagcccaccaagagctacgaggacatccagcggcagctcgaagcggcccaagaccagttctacgaaggccgcaacgccaggacgctccaagccgtcgacgaagccctgcagcagatcactcggctccctgtgggagacgcccgctggaagctctacgtcgaagcccagctcctccacggcctcaactaccgcgccatgggcaagcccaaggagagcgacaccgcgttccgcaacgtgctgcggctccagcccgagtaccagctcaacccggactacttcgccccttccgttcgacagaacttcgacaagctccggaaggaactcgcccagacgcgcaaggtgaagttgtccgtgaagtccacgctgcccgccgcggacgtgtacctggatgggctcaagcttgggcagacgccgctgtcactcgatgccgtcccgggtacctatcacctcacgctcgtcaaaggcgccaccacgagcttcccacggcacatccaggtgcagggcacggagacgccgctgctcgtcgacgtcgcctatgagggcgctgtctccgcgagccccttcccctgcctcgccacctcggacggcaatgacgagcgcacgctgagccatgcggtccggctgggtggaacgctcggagtggaagaggtcatcgtcgtccggctcgagcgcccgagcagcgggcccaagtggttcgcggccaccgtcctcaatgtcgaaggaggacagaagctccgcgaaggcggcttcaagacccagggcgcggacgctccggacgaggcactcgcggcgctggtcgacttcgtcacaaccggccgctcaccctccaacctcgtggtgatgaacgccaatggaaaggccccgtgggaatcttccgggaacgtgggccgaaacgggagcgcgtcagcaggcggtatggacctgacggcccccaacctcatgtcagagggcgacgcgtccagaacacgctccacctccggactccgcacggcctcgtatgtcgcgctgggaacgggtgtggccgcattcagtggcgcaggcatcgtccgccttcttgctcagaaggatgtgaacgcactggagaagcggctcgacaacggccggattctgtccagcgacaaggaggcgatggggcttcgcgactcgctggttcagaagagcaacgtcctcaatggattgctcatcggtgggagcgcggcggttgtcacgggcgcggtgctctacctcctgtctcctgattcgaactcggcgccgcccgtgtcggtcggactctccgcggacagccacggcgcggcggcctcactgtccggttcgttctgacgcactattcacgaatccaaggacacgcattccgcgagaggtggaccatccgagccagtccacctcttgagcaggcaagcagacacgtcgagtgctggatgggaaaggagcgtcaacacacacccgcgggcgaccacggcgcatagagtgccgcccatgatgcgagccctcttcgtcctgctgctggccacgagcgcctccgcggcctctccccgaaccctccgggtcgactacttccacaccgggaacgccaccgaggaacggttcagcctcgacaaggtcgtcatcgagccgctgccctggcccggccacccggaacgagccatcgacgagacgaacctcggcaagtacctcttcgaggtccgaggccgggagaacaaccggctcctgttctcgcgaggctttgcgtccatctacggcgagtgggaggtcacgaacgaggcgcgcagcagcaaccgcaccttccatgagtccctccgcttccccgcgccggagcgccccgtgcaggtgctcctcaagaagcgggatgcccagaatgccttccgcgaagtgtggtcgctggttgtcgacccgaaggacatgttcgtcgacgcctcgtctccccccgcacccgggccgctgctgaaactgctggagaacgggccgtcagcgcagaaggtcgacctgctcatcctgggggacggctacacgaaggccgagcacgccaagttcgagaaggatgcccggcacatggtggacatcctcttcaccttctctcccttcaaggagcgcaagtcggacttcaacgtgtgggggctcgtccccgccgcggcccagtccggcatctctcgcccttcaacgggagtccaccggcgctctcccatcggtgccacctacgatgcctttggcagtgagcgatatgtgctcaccttcgacaacaaggccttccgcgaggcagcggccttcgcgccctacgagttcgtggagatcctggtcaacggcaacacctacggcggcggcggcatcttcgggctctacggcaccgtcgcctcggacagcctgtgggcaccctacgtcttcgtgcacgagttcggccaccacttcgccgggctggcggacgagtactacacctccgaatccgtctatgcgcccgccgcggaccgcctggagccctgggagaagaacgtcaccgcgctccactccccggaaggcctgaagtggaagcacctggtgtcaccaggaacacccctgcctaccccctggaacaaggagggatacgaaaagcatgccaccgccgtgcagaagcagcgcggccacattcgggcgcagcgaaagcccgagtcagacatggacaagctcttcctggcccagcgggactgggaggaaaagttcctttcctcacagaagtattcaggccgggtcggagccttcgagggggccatgtacgagtcgaagggctactaccgaccacaggtcgactgcgtgatgttcactcgggatcgcgtcccattctgcgcggtgtgtcagagcgccatctccgaagtcatcgacctgtattccggccctccggccatgtctcctcaggccaatccctgaacgcctgaaaatccgggcaccccttgtgtgaaatgcccatgtcaccaggagcggacattggattgccctccggttcaggtgtaagggggacgcaacctgcttcccatggaggggaactcatgcagagacgattttggctcccggcggtcgtcacggccgtgatggtcacgatgggcacgggatgtggcgacgaatgcgttgaccagtttgactgccgcacggacaagggcacgccggccgctggcaagcagtggacctgtaactctggaacgtgcgagcagcgcgacatcacccagggcccggatgcgggcaccgaggaagacgcgggcaccgagccggatgccggcgaaggcgacgcgggcaccgacccggagggctgcaccagcaacgcgacctgcggtctgaccgagacctgcaacaccacgacgagcacgtgcgaggactcgggctttgtcacgccggtggcgacgaccagcacgcagatccaggcggtccgggatgcggcggatggcgcgctcgaccccgcgctggccatcgagggtgcgttcgtcacgttcatcaagcccgcggtgacgggcagcagcgagctccccggcttcttcgtccaggccgaggcccagggccccgccctgttcgtgtccgacgcgacggcgctggccgcggtcgccgtgggtgaccgggtcagcttctccgtgtcgtcgaaggcgaccgacggcggtctgcgctccgcgtccgccgtcaccggaaccacggtcatcagccaaggccacccggttcagacccagtcgacggccacgccggccggcctcgccgtgaaccgctccgcggacacgtcggacacgctggtgaccggtctggactccgtggagtccgagctcacctacctgacgggcacgattgcggcggccggcagtt

SEQ ID NO: 858 - DNA, 5843 bp, Myxococcus xanthus
caggtgtccacgcccagcgcccagagcctgtcatagaggaagcggcgcacgtcaccgacggtcgtcttccccggcaccaccacctccggagagaaagcctccttcaccacggcctccgtcagcatcaccagtcgctggtagtgcagccactcctcggggatgcgcgtgtccaggtactcctcgatgagcggcgcggcgctcacgaagcgggcctccgcctccgcgcccagggaatccaccaggaaggcgtagctgtccttcgtcaggctgcgcgtcaccccgcgcttgccgccaatgcccagggcaatcgtccggggctgatagcgcgtgttcaggtccgccaggacctcctgcggcttgcgcccttcttcgggcagctcgaagaagcgcgcgagcgtggcctccgagtagccggagagcgcgacgcgcttgagcccctcgggcccggcgtcgacgaacacgaagatgtcccggttacctgcgtagggccgcggcggcgcgatgaactgggtgagcgggtcgtcgtggaactcctcgttgacgaccacccacatgcccacgccatggcggcgcatcatgtccagcagcatgccgtggcgcttctccagccaggcttcgcgctcggagatctgctccgaccaggacatgaggcgcggcggcgagtcgtcagcagcgccctggcgccccgtggtggcacaggcggccagcagcaacagcggcagggccgcccacttcgcggacttcatgtgaggactcccatcgagaaggaggccgcaccgtatcgcatgaaagccagggggcctccgcctccagagcccttggattctctggagacggagggcctggggcgcgccccctccctcactccctggaagtccgcactccagcgcctctccggatgagcgcgtcctcgacgcccgcatcatgtggtcgtcggccccccggtcccgacgcggccacccttcgagatgacggctgtcccccgacgccgtctgctggagcggggcttcgttccccgcgcgccgaactcagaagctggcgatccggaactcgaagtcgccctcgtcggacgcctccagttcctgcccccccaggtcctccgcgtccccccccgctttcacgggcactccgcgcgtcccccggaccgccccgctccccccagttggagctcctgtccgaccaggccgcccatcccccgcccatcgccccacgcccctcctcaggtgcccagaaaccgctcgcatccccttggccccgcgcgtcaccacgaaacatctctccccctcttctcgggggctcgcgaccaacgccccctcaatctcagatacggacccagccttttttattgtgcattctgttcaaaaaaatccggggcgccccgagcggaggcgccccgtaaaacctgtatcgccagcgcgattcaggacaatccggaaaactgtcacttatttacgacatgcattgtccgagccgtccggatgagacgccgtattcacggacgggacgacggacatcctcgccgagaacggcgggtgcgccgtcagacccggggtgggctccggcggtgggtcatgcgggttgatgctcaccaccgtcccatcgcgcttcgactttttcgaaagcttcttcaccatcgcatccccctgtgcgcggcaccggcggggcccagcggcatgccatctccccgcctccgccttggtactacgcaccaggtcggattccttggccatcattcgaagaggaggatgccgtgaacccagtccgaggagggatgggccgccagccacgtgcgccgcgcgtcgcggagcgcgagggccgccggcgcgccgctccggatgcgctcacgcaccgcttcgaagaagcgccccgccgagtcggggatttccaccgtggaggccagcaccgtggccgcgcctgcttcgatgaaggccaccggcaggctgaaggactcatgaaggaaaggcgtggctcgggccgcactgcacgtggccagaagcacgagcggcgcgcgctccagcttcagcgcgcggacctgaggggcggacagcgcgtatcggccatcgggttcaggcgccagcaccaccagcgaggcgtctgacatctcggggctgaaggcgccgtgcgcgtggatttccacctcactggcctgcgccatggccgccagcacccgggttggcgtggcttgcatgcccgacagctcgattcgctgcgggtccggtgcgagcggtggctccagtggaagcaaccgcgggaggcccagcgccgcgggagcctcaaccccattgacgaccaggtgcggcccgctgccacgagccggcacgggagacgcgcctccgggccgccccacgcggtagctccaggcgagctccgcgggcagcagcccccgcaggccatgcaccggcggcagcgcgagcacgtccacccgctcgcagcccttcaaggcggcctggagcgacggcggaaccagcccggaggcgtcccgccccaggggctccgcgcggctggcgtcgaagtgtccctgcagttcacccgtagcgccccgcagcgcgaccaccgagcgctcgtagtccacggcgacgcccagcacacatcgcgcagggacctcgacctgaagcgcggcgcccatgagcgccagggcctcacctggggcgtccgtgcggcctgcctcgtgcgccaggacgttgtaggcccccatgcgcgtcttgcgcgcgtccacatcgttgggaagggactccgccagttggatggcgccgcgaagcagctccagcccagccacgcggtcgcgctccagcacgaactgcccctcggcgaagcgcatctgcgcgagcttgcccggggagggctgcccccggtgcagctcggccagggtgcggcgcaacaggtccgcgtcctggctgtccgcgccgaagcgcgccaggtatgacaacaacagcgcgccgggcaaccccagtggccggccacactcctgcgccagctccagctcgttccgcgcctcgtgcgcgtcgaactccagccacgacaggtaggccaggttgcggtgcacgtaggtgcgctgctcacaggcatcgggcgttcgcgccagggactcgcgcaggtaggcgcgcgcgctggtgacgtccaagcggtagcgcgcgatgtgcgccagttcctggaggaactgttgctccagctcccattcctcctgctcccgggacgccagccagccactccaggcctgctcgaaagcctccgccgggcggttgagcgcgagatagaggtccgacagccgcttcttcagcgtggcgcagcggtaggacagccccttgccctgacaggcccccacggccgcgcgaagccgcgcctccgccttccaccattcgcccgcgcgctcctcggcgcccgccaactcccgctcggccagcagcgacaaccaggggtcctcggccgcacgggccagccgcgtgaaatcctccaggtggcgcgcgcctgccgtctgattgatgagcccgcccaggtacaggtcgtcctcgcccgaacgccgcagcgtctccaggaagcgcgctggcgaggacagctcgccccgcacgagcttcgcgtagtccgccgccaggggtgcacggcggctgaagtcccgctccgccacacgcagcacgtagccgcgaagcacctcgccgccctggacgccgtccaacacgtccgccaacggaagcaggcgcagggtccactcccgcgacggcgcggccctcaccgcgtcgtagaacgccagccggacgatgccaggaaagcgcttcgcctcctccagcgggagcctcgcctgcgcgtccaccatcaggtcccgcaccgccgcgcgagcccccttccaggcccgcccacgcgcctgcgtctgctgccggagcgctcgcgcgcggatccgcgcctcctcgctccagcccggctccccgcgcttcaccaccgcgtcgaacgcctccgcggccagcagcgtcagccccatctcccgcagcaccagcgcccggttccactgcgcctgggcgtgctcgggcgcttgtcgtaataccccgtccagcagcgccagcgcctgttccggatgcccctgctccaacgcgacgatggccaggtcgctgtcccggtccggtgacggcgacatccgatggaggaagtcggaggcttgccgcaggtccttgcggaccaggtacgcggcggcaatgccatgcaggtccccctggtcctccagatccgccaacgcccggagcggcaatgccgagccagccccgcccggagggccactgacacccgcacgtaggggctcatagggccggtgtccgtcggcgcgtgcataggcaaccctcgcctcgatgaggcgcgacgacgtctgcgcgagccagacctcctgctgggaaccccgcacaccggcgctcttgacgacgagcaccaggacgatggccgccgccaccgcgcccaccgcgaacggggcccagcgccaataagggcgccgcggcacttcggccgtgtcacgtgtcgtgggcgcatcggacgccatccaggtttcgggcgcgtcctcctgctcgtgcgccaacacccgcgggtcccccatcacatggaagcccagcagctccaactgcatggcttcgtgcaggccggacgcgcaggggtcacagcgagcgaggtgatgccggaagttctcctcgtccacgggcggcagctcgccatcgaggaagagggacagcctgttacagagcgtccccatcacgcgctgcctcctccgtcgctcccggtgagcggcagcagaagcgccttcaactccttgcgggcctgatagagccagctccccacggtgccttcggggacgcccatgcgcagggcgatggcgcggtagcgcagccccgaggcatgcagcgaatacgcctcacgcaccctgggattcgacaactgggcgatggccgccttgaagtccttcgccgagatgtgctcccagacctccatggcctccggctcgggggccgccactccctcgcgcaccagccgcagctccggacggtcctgctccagcaactccgagcgccgcttgcggcactggtcgaggaaatgattggtcatcgcccgacacaaccacgccctgtagacgggctccggctgcgcagcgagtgccccgtgatgcagcagtccgcgcgtgagcgcctcctgcaccaggtcttccggatcgatgcccccctgaccgcacaaccgtctcgccagggccaacagcatgggcctgacacgatgcgcgaactcctcgaacccgtcgggatgcacatccgtactgtaggccacaggaatgcgaatgactgtggcaatgcgttggccgctcatcgacccggactccttccacgcctatcgaaacgaagtccggggcaatccttggaaggccgtcgtgaagcagactcaatcgcatcaaattgcgcccgctcaccgacatccctgccgtcccgcgggccagggacaggccggcgtcaggccagcgcggcggaaatcgaggcaggctgcgccacgggtaattccaacgtcaacgccgcgccccccagggcttccgagcgtcccgcactcaaacgtccgccatgccgttcgacgatgcctcgtgcgatggccagccccaagcctgtccccggccgaggtccctcgcgcttgcggcccgtcacgaaaggctggaagagccggggcagcagttccggtggaatgccaggcccgctgtcctccacccggacgagcaaccggccgctcgcctgctcaatggatgtcctcaaccgcggtgcgggcacgtctctcagggcgagcaaggcattctccaacaggatgaccattacctgtgagagctgggactggtcggcctc

SEQ ID NO: 859 - DNA, 5872 bp, Myxococcus xanthus
  unsure (1)..(5872): unsure at all n locations
gctctacagctctcatccgggttgttgaagccctgcgcgcccttttcggccagcaccccgatgacctcgaacggaatgccccggatgcggatggactcgcccaccagggatgcggtgtccgtcaggcccagctgcgcaccggccagggcgcccagcaccaccacccggcggcggcccttgtcctccgcgtccgtgaagagccggccgttcgtgatctgcccctggttgacgtggaagtagtccggccaggtgcccacgacggacaggttcgcgttcttcgcgccgtactccacctggaagcgcgactcgatttccggcgccacggcctggatgtggcgcgcgttctcccgcagcgcctccgcgtcgtcgatggtcatcgacgcctgggcgcgaatcatgccgcccgtgaacgcctgacccgggcgtaccgtgaggacgttggtgcccagtccctggagccgctgggccaccgagcgctgcgccccttcgcccagcgcgaccatggtgatgacggccgcgatgccgatgacgatgcccaacatggtcagcagcgaccgcagcttgttggcgaggaccgcatcgaatgcgacccggatgatttcacccatgacgtgtcctcctgatggggctggggttagcgcggcccgcgcgggccaccacccgcgccgggaatcacgccgcctgacatctggcgcatccgctcggtgttctgctgctgctgcttctggagcttcgccaccgtgatgagcaccaccttttcgccatcctccaggccactcaccacttccgtgctctcccagtcactcaggcccagggtgacgcgccggggctgcggaccggtggggctctgcacgaagacgacgccctgccgcgtatccgtcgcgccctggacatcctcgcgcgcccggcggcccgcgcggccctggcctccgccgccctggccttcacccatgccgccctggcccctcgcgggcaccgcgcccggcccggcgccattggccaccgcggcggtggcgcccacgccggcttctcccacggccgacaccgtcgtcggtccggacggcgcgcccgggcggttcggggctcccggcggacgcattaccgcgcgcagtgcttcctcggaaacacccaccgcggcggcggagctccgggcatcccgcacgcccaccaccgnggtgttgggcacggtgagggcattgcggcggcgggagatttcaatggccacttccgcgttcatgcccggccgcagcaggccgtccgggttgtccatccgcaccagcaccgggaagagggtgacgttctgctccaccagggcctgcggttcaatcttcaccacctcgccgatgaaggtgcggcccgggtaggcctccatggtgacgcgcgccttctggccgggcttgatctgcccgacgtccgtctcgtccaccttggcgcgcacctgcatcaccgacaggtccgccatcttgaacagcgcggtgccaccggacacgttgttggtggcggaggcgatgatgacgcccggctggatggtccgctccaggatggtgccggggctgcgtgcgaggatggtgacgtcccggctgcgctcacgcgccaactggaggttcgtctccgcccgcaccttggtggcccgtgccgtcgcggacgcgtccacggccgtctcgtattcctgctgcgtgacgtagccgtccttgcgcagcgcctccatgcgctggcgctgggcctccgtcgtgttcagccgcacccgcgcggactccaggtcggcctgggcctgcgccagcgcgttctgcacgtcgcgcggctcgatttccgccagcagcgtgccctcggcaacggtgtcgcccgtgtcgtagtggaccttcagcacttcaccggaggcctgggacttcacctccacgacgcgcagcggctccaccaggcccgcggattcggccaccacttccatgtcccggcgctccaccacggccaccgccgccgagcgctcgttcgtcttgggctcctcgccgcgctgggtgacgtacacgcccgcgccgagaaggagcgccgcgctgcctgagatgatccactttttcgtcttgctcacgacgacctcccgttccctggcccacgcagcgagcgtggcgaatattcagtcccgattccgctcgtcccgctcgatgacgccgtccttcaggaacagcacccgctgcgcatgcgccgcgatgtccgattcgtgggtgacgagcatcagcgtctggccctggccatgcagctcgccgaagagggccatgatctcctcacccgtgcggctgtccaacgcgcccgtgggctcgtccgccagcagcagggcgggctgcgtcacgagcgcgcgggcaatggccacgcgctggcgctgaccgccggacagctcattgggccggtggtccatccgcgcgcccaggcccaccttgtccagcatcgccgccgcgcgctcgcgccgctccttcttggggatgcgcgcgtagatgaggggcagggcgacgttgtccagcgcggaggcgcggggcagcaggttgaagctctggaacacgaagcccagttcccggttgcggatgcgggccagcgcgttctccgacatgcccgccaccggctggccattgagccagtactggccttcactggggacgtccaggcagccgatgaggttcatgaaggtagacttgccggagccggacgggcccatgacggccacgtattcgttgcggcggatggtgaggtccacgccgcgcagcgcgcgcaccacctcggagcccatcgtgtagtccttgcgcaggccctccacgcggatgaccacgtcggagatgtcccgcgcggggcccgtgcccgcctgctgctggggatgggtggacgtgctcacagcggcctccccgcgagcgcttccagctccgcgcgcgcaatccggtagtcgaagcgggaggccaccaggttgatctccgccgtcaccaggttctcctgggacgtcagcagctcgatgatggtcgtggctcccagcttgtagcgctcctgctgcactttcaggtcctcctgggccaccgcgacggactccgtggccagggcgatgcggttcgacgccagcttgagctggttcagggacgttcccacgctcgagcgcagcgcgcgccgggtatccgacagcgtggcctgggccaccgacgcctgcgtccgcgcactcaccacgcgctcctcgcgaacgaagccgtcgaagatggggtaggacaggcccatccggaccgaccagctcgtgcggcctccgttgagcgcgggctcgtcattgaaccagtcataaccgccggacagacgcaccgtgggcaggtaggacgacctggccaccttcacgctggcttcggccgcccgaaggtccgcctccgcggcctggatggacggcgcctgggcggtgatttcgtccgtcagcgcctcgtcggtgagcgcgaaggtggacacgtcctggagctccaacggctgtgcgtccaccggtccgtcctcgccgatgagccggcccagcgagagggccgcggcggcgtgctgggtctgcgcggagagcagggcctcctgcgcggcggtgaggtcgtacttcgcccgcagcacgtcggagcgcgtcgccgagcccaccgccagtcgccgatccgcggcctccgcgttctgcttcgcgcgctcgatgcgggacacggcgacctcttccaggcccccggcgcggaggacttcgtaataggaacgctccacgtcgagcaccgcggacgcgcgctgcgcgatcagtccggcccgcgcggcgctagagcgcgcctgggcctgcttgctggtggcgccgcgctggccaccggtgaagacgttccacgaggccgacaagccggcgctgtacgtgtcgctgggggcgttgaacaccgcccccgtggtggggtccaggcgctggctgctggccagcgaggtgttcgcgctcgcggacaggttggggaggtaggctccaaacgcgctgcgctcggcggcccccgtcgtggtgacggtgccggcggcttgcgccacctgggggctcgtcttcagcgcccgggcgatggcttcctccagggagaccgtcgtcatcgtcgtcgttgcctgggccagacccacgccgggcgccgtcaccagcccgaggaagcccagggccagggccgtcatccggtagggttgccgcttccaccacggtgtctgtgcgtttttcatcgcaagccgggccactgcatttgccttgccacggcccaacccgtggaaatgtggagggaaagtggcgccgggcctgcgggaaccgcagtgcgagtgcggattccgcatgcgatgccggccatcttcgcatgcacgcctcggggcctccccagggcccgcgcgcttcgagcctgaacagcgggcctgggccccgtgattgcactgggcagggcgacctgtgggcgcgccgaggtttcgcgcctgctccttcgccctgccagcggccacatggccgccctccacccccaggagaacgccccatgcaccctctcatgctcggacgaccgacggctcccgaggcgcgcggcaccgacagaagagagtgcggattccgcactccgcatgcagagttcgcagcctgtggaggtgtgcgatggagttggagtccccacggcggaggtcggcggtgagcggcgctccctggtggcggccgcttgggcctcgagcgccctgggtggcggcggtgctcatgtgcgcggtgctgatatccgcggcgctgttcatccggaacaccgcgctggagtcgtccgccctggtcacccggggcatggccaacgtcatcatggtcgccggcttcgaggccttccgcgacacggaggggctcccggacccgtccgcgctgaacgccttcctggcagcccaccgggagggcggcctgcgctacgtggccgtcgtggatgacgaccaggtgctggcgtcagccggggaggtgaagctggggcggcttctcttgcatgagggatcgccgctggtggtcgaaggcgcgcgcgcgcgcctggtcagccgcctccgccggccccgtcccgccttcggtcccctgacacaggaggaggtccgcgccatgtcggcgcagggcgattccctggagccgcgcaagcacctgcgcattgtctacgagttcgagccgctcaccgccctggcgttggagtcgcgctcgcagcgtctgctgggcgtggcggtggcctcgtgcgtgggcatcctggtgttggccttcgccttctcgcgctcgttggcgcagcgggaggcgctgtcggaggaactggagcgcggccggcggcttgcggccctgggcaccatgtccgcggtgctggcgcatgagcttcgcaatcccctggcctcgctcaaggggcatgcgcaactgctcgccgagcgcgtggagcgtgacgccgtcctggcgcccaaggcggaccgggtggtgtcggaggccgtccggctggagcagttgatgaatgacctgctgggcttcgtggccagcggtgagcttcgccgcgtggaggcggaccccaacgacgtgctccgcgcggcggtggagagcacgggcgcggcgcgtgtggaggctcgctatctgccggaccgcacgccctggcctctggacgcgggccggttgcagcaggcgctggaaaacgtgctgcgcaatgccgtccaggccagccccgaaggccagcgcgtggaggcgaccgtggagcggcaggactcgtccctggtgttcacggtcaaggaccacgggcccggtatcgccgcgggggaggaggagcgcatcttcgagcccttcatcacgggccgcatgcgcggcgtgggcctggggctggccatcacccgccgcatccttagagcacgggaa

SEQ ID NO: 860 - DNA, 7826 bp, Myxococcus xanthus
  unsure (1)..(7826): unsure at all n locations
acccgctgtcccccgccctgacgcccgtcacccggcgctacctggaagcccgctttggcggtcgcccgctccagcagggagaggcgacgcggctgctgacggacttgagacgcgctgttctcacggagtcccagcacgtcgccagcgagggtactcgcccgccccaagcgcgcgcttcctgacacccggacctcggtcctcgcgcctggccgccaggccgcccaccgcgcgtgccggcggcccgggtgtgtcagcggcctgaggcgtcgttacgccttttcccgcgggcggccacgtcgtgtgacgggcatcgctccaatggccgcgccctcacagggagcacggccctgcgcagcccccgggaggcttgaatgcgaacagttctgaagctcctacagctagcgcatccggcgattcatgccggtgcgacgtaacggttacaggattgcggcgctgtatgcgccgctggagcacgccaacccctcgcagacattgggaatggcccttcggggcaggttggcatttctgttgctcaagttcccttcgtcacgtcgtcagacgaaatccatccatcccggcctcccgtgaggcccaccggcggagaaatcattcatgcaggcatccaccgagcagtcgtccaactccggctccctggcgatgtacctctcggagatcaaccactactccctcctcaaggtggaggaggagcaggagctcgcgcgccgcttcctcaagggcgacctggcggccgggcaccggatggtgaccgccaacctgcgcttcgtggtgaaggtcgcctatgagtaccgctcatacggcatcaagatgtcggacctcatccaggaggggaacatcggcctgatgaaggccgtgcagaagttcgatccggacaagggcatccgcctcatctcctacgcggtgtggtggattcgcgcgtacatccagaactacatcctcaagagctggtcgctcgtgaagctggggaccacccaggcgcagcggaagctgttcttcagtctggcccgcacgcgccgcgagctggagaagtttggcagcggtgacgccgcggtgaacgtggatgacatcgcccgccggctccacgtgaagccgggcgaggtgcgggagatggagcagcgcatggggggccgggacctgtcgctggacgcgcccatgggcgaggacggcggcaacagccacgtggacttcgtggtgagcgccgcggccccgcaggacgacgagttcgcggacaaggaggaggcgggcctcatcaacgcccgcgtccgtaccgcgctgatgcgcctggatccgcgtgagcgcttcatcatcgagcaacgcgtcatgaacgagcgccccatgacgctcaaggaactgggtgagcacttcggcttctcgcgcgagcgcgcccgccagttggagattcgcgccaaggacaagctcaagtcggagctggccgcgctcatggccgaggtggaccccgaggccgtcgccgcccagcagtgagccgggactgacccggcccggcgacccggcattccggggcaagcccgcatcaaggcgcctccgccctactggcaggggcgcttgtcatttgagggcgttgtttcaccgccagccgggggcctgctagaaagggccggtttccctttgaaggagccccccgcttggcccacggttcgccgccgatctccgaggatcgcgtcccggtcgcgcagacactcgcgacagtcgcccataccccgtacgtcccccccgacaagtctccggcggagatgacgatgcgagccctggtgctcggctcggtgttgggcatcgtgttcgccgcctcgtccgtgtacctggccatcaaggtgggcctcacggtctccgcgtccattcccgtcgcggtgctctccatcgccatcttccgggccctgggcaactccagcatcctggagaacaccatcgtccagacgacgggctcggccggtgagtcgctcgccttcggtgtggccgccgcgctccccgccctgctgctcctgggctacgacatcagcctcacccacgccttcctcacggnggcgctgggcggcgtactcggcgtgctgatgatgattccgctgcgccagggcctcatcgtccaggagcacggcagcgtgccctacccggagggcaccgccagccagcacgtgctcatagtcggccagcaggggggcacccacgcgcgcgctgtcatcagtgtcttgattgtgggcggtgtctggtagctcgcctactccggcatgaagctgttccgcgaggtcctgagcacgccgctgcaggggctcaagagcgcgaccgtctcccaccgaggtgagcccggagctgctgggcgtgggctacatcatcggcccccgcgtggcggccatcaccttcgccggtggtgtgctgagctacctcatcctcatcccggccatctcgttcttcggcagcgggctggagacgccgctgctgatgcacaacggccagctcatccgggacatgtcgccggaccagattcgcaatgcgtacgtgctctacatcggcgcgggcgccgtggcgacgggcggtctcatcagcctcatccgctcgctgcccaccatcgtcggggccttcaagcgcagcctggagacgctgaaggcgtcgcggggccagggcgccatgccgcagctgctgcgcacggagcaggacctgcccatcaccgtggtgctgggaggcagcgcgctgctggtgctggccatctggctggcgccgccgctggaggtgaacctcatctccgccatcctcatcgtcatcttcggcttcttcttcgtcacggtgagcgcgcgcatcaccggtgagattggcagttcgtccaaccccatctccggcatggtggtggccacgctgctcatcacctgcctcgtgtacctgctcatgggctggacgtcgtccgaggaccgcttcatggccctcaccacggcggccatcgtcggcatcgccgcgtccaacggcggcaccaccgcgcaggacctcaagacggccttcctggtgggcggtacgccccggcgccagcagttggcgctgttcgtcggtgtgctcaccagcgcgatgttcatcggcctggtgctggtgacgctcaaccgcggcgccaccgtcaccatccccgagccccacccgggcgtgaaggtgacggagttctccaacgagacgcgcgtccagcacaccttctcctgggccgtctccgccgacgcgctggcggcccgcggcctggacgaggcggcgctgcgcaaggccgtctgggcgcagggctacgagctgaacacgcagagcggcgcgatggagctgcgcagctggcgcgacgtgtcctcgcaggacctgggcgcggtgacgctcaacgtctccagcggcgcccccatcaaggtggcggacctgggcgccgtcacggacggcccgaagcgcacctacaaggaaggctacgtgcgcggcgcggacacgccggtgcccgcgggcaagtacctgctcgatgagtccgacaccatccagtacgtggtggacccgggcatcggcggccgcatcagcgtctatgaaggccagcaactgacgcgctacgcggcgcccaaggcgcagctgttctctctcatcatcgacggcatcctcacccagaagctgccgtgggacctggtgctcctgggcgtgttcatcgcgctgatgctggagctgtgcggcgtgtcctccctgcccttcgcggtgggcgtgtacctgcccatcagcagcagcgcgccgttcttcgtgggcggcatggtgcgctacttcgtggaccgcatccgcggcggcgagtccgacttctcgccgggcacgctgctctcctccggtttcatcgccggtggctccatcgcgggcgtgctcatcgccttcctggaaatcgccaccgacggagcaggcacccgcgcgctgaacctgcctgccctgctgggcaaccagggcggcctgggcggcttcctcaacatggtgggcgagagcgagcacgcccacccgctgtggtccaacctctggggcctgctcttcttcgccggcctgacgctgttcctgctgcgctccgccctcaagggccagagcgccgccatgtcaccgccgccgcagaaggaggcgtaggccacgtgcccgggcctcctcctgggggccgggtgaaacaccgctgagacacccggggcggcgaggagcaatcctcgccgcctcgctcatttccagagcgggtgcggcgtgcctcctgaaaccccgtccaggaggcggcgagcacccacccgggccgtctcgctcagagcggcgagtgggaggacggcacgggctcgggccgcacggagccagcggccgccgcggcctccgcgcacacgtactccgtgcgcaacggcgcgacgatgccgaaggtcgccgcgtagacgacggggctccaccacggccaatacacatccacgcgggagaagccgtgctggcactccggcgccaccacgttcgaggtcgtcagtccggcgaccaggctcactccggtctgctcgtcgggcgctcctccgcgcggcgctccggaacggaggctcatccggaaacaccccgtcaacgaaaccagcagcagcgagcacgtcagccaccgcgccatggacgtcgccccgttccggcggatgacgcatttggcaacacaaccaggaatccccgtcattctcatgccccgtcacgcggacgtcacccaagccatgagacttccacggaccgtctcctgggtggccgtccaaaatcgggttaggctcgggtgacagcatggcccacccccctaaagccatccaggaatccaacgcggagccccagctttcgcctgaggcacgtgagaaggttgagttggcgaagacgttcgccttccacctgctcaagggcatcaagcagatcgggatgtatcgccacaacgagtcgcgcttcccggagttcctcgggaaggcgctcgagtcgattgccacctacaccgacaagttcggtcccctgtcgatgaaggtggagcaacagaacttcctgctcctcggcgagtcgctgttctccgaggacaccccgctgccctacaagttcttccgcgacggcatccggcagctcatcttccgcccgggtctcacggtggaggagatgaccaccttcacgctcatcgccctgtccgagccggagcgcggcgcggaggacgtgctggcgcagctgtggcgcgcgagcatggagcacgtggagtacgtggtggtggaaggcttctccatggagaacgccagcgaggaggaagtgcaggtcgaggtggacaaggtggtgggctacctctactcgcgcctgcagacgaattcggatgactacctgcgcttcgcgcgcgtgtccgcggaggacctggacgccaagctggacggcgtggagcagattcgcggactcgtggtgggtggacggcatgcctcagacgagctgaaggcgaagctgcagcgcgaagtctccgaggaggagaacgcccggctgttccccaagctggtgagcgccgtgttccaggtggtggaaggcggcgtggatgacgcgtccctgctcgaggaaatcttcgtgcagttgctggacatgctcctcctccaggacgacttcggcaccatcaaccagatcgtcctcaagctgcgcgcgctgtcccagcgcgaaggcagcgaggacctggcgaagatgttggagaacttcctccacaagatgggcgaggagcagcgactgatgcggttgggcgagtcgctcaagtcgacgcggccgaagaaccccgcggacgtgtcgcgctacctccaggtgttgggccgggactccatcatccccctgctgtcggtgctggagagcatcgaggtcgccgacaaccgcaccctgctctgtgacgccctcgcgggtttcgcgcgcgagctgcccgaccccttcgtcgcgcggctgatgtcagagcggccgcagacagtacgcgacatggtctacatcctggagaagagcaaccacccggaccgggtgaagatgttcggccaggtgctcaagagccccaacctggtggtgaagttggaggtgctcaacatcatcggccgcggccgcacgggcgaggcccggcgcatcatcgcggacgcactcacggactccatctcccaggtgcgcatgctggcggcgaagctgctgccggagttcgaccgcgacaagggctacgcggacctgatgcgcctggtgcgggagtccggcttcgacaagaagacgcccgacgagcgcgccgcggtgtacgcggccatcggctccacgggcaccccgggcgccctgtcgatgatgcagcagatgctcgcgacgaagccctcgctgctcaacaagaagcgcgtgctggaggacaagctgctggccatccacggcctgggcggcgcgtgctccatccagggctacaagctgttgcaggcggtggtggaggacaagaaccagccgttggaggtcctcacctcggctcgcaaggcgatgtaccagacgaagaaggcgctcttcggagactcggcgctgtcggaggaggcataggcgtatggccgacaacctgaaaatcacccaggcgcaggacgagaacaccaacgagttcggccgcgagcacaacgagaagctccagggcctggcgcgctcgctggtggccggcctgtacatgctggtgcgctcggtgaagatgtatgacccggagaacgcggtcttccagaagccgctgcaccagctccaggacatcatcaatcaaatcatcagcaaggaaggccgcctggagctcacgggcgtcaaggagtcgttctacctgaacggcatgctggtgaaggtggacctcaactccatcgagaaccagcgatacctgctgacggagctgcgctcgaaggacgtgggtggcttcacgctcaccaagcccgtcaccgttccggagctgaagaacttcatctggatcttcagcaaggagcagacgaccgcgtccgaagaggacggcctgtccaaccgcaagctgctcaacatgcgggtggccaagttctccaagctgaaggagaagctgaacaaggacctggacaacccgggcgaccagaaggtggaccgcaagaagtacgcgatgaccatctacgcgcgcgccgtgttcttcctcacgaagtacctggagtcggtgcgcgccgggaagcccatcaacgcctccaaggcgctgcgcctggtgcaggacttcgtcgacatctcctacgagcagcggacgcacttcctgggcatgacgaccatgcggcgcgaggacgactacctcgtgtaccaccaggtcaacgtgtgcctcatgagcgtcgtcttcggcgcggagctggggctgacgaagccgcaactgcgcgacctgggctacatcgccctcttccacgacgccggcatggccacgctgtcggaggagctgtcgacgaagcgaggcgcgctgacgcccgaggagaagcagacggtgcagcgcgcgccgctcatctccgtgcgcaacatcctgatggagaagggcttcagccgctccacgctgctgcgcgtggtgacgacgttcgagcacaagacggacttcggtaccgccgtgcgcgactcccgcggcaacatccagatgatcatcccgaagacgaacctcggggtgtacgcgaagatcatcgccatctgcgacgcgtacgacgccctcacctccaagcgcccgtaccgggatgcctacggcccggaggtggcgctgatgctgatgtggtcggagatgcggaacaagttcgacccggagctgctgtccgtcttcatgcgggtgatggccatcctttagagcacaaagg

SEQ ID NO: 861 - DNA, 7151 bp, Myxococcus xanthus
tgtgctctaaaggcctgcgcttccttcttttcctcggccgtctcctcggccttctcctcggcgccactgctggcaccggcggccgacttgcccgcgcccggggctcccggcggcgggggccgcttggcggcggtggcggcctgacgaaccagctcgcgggccttctgcgccaccttcggcgtgggcgcgaggatcatgaacatcagacgcccttccatgcggggcatctgctccacgacggccacgtccttcaggtccttggccacgtcgtcgaggatggccgttccctgctccctgtgcgtgatttcacgcccgcggaactggatgacgaccttcgccttgttcccgtcctcgatgaaccggcgggtattgcggaccttgaactcgtagtcgtgctcttccgtcttcggacggagcttcacttccttgagcaggaccgtgacctgggcacgcttcgcttccgaggccttcttcttctcctcgtacttgaacttgccgtagtccatgatcttgcagaccggaggactggccatggggctgatttcaacgaggtccagcccctcggtccgggcacggtccagggccgcctcgagaggcatgaccccgagctggctaccgtcagacccgacgacgcggacctcacgggcacggatgcgacggttggttctctggtcgcggctcccgccgcggctgcttctctgttcgcgaatgatggtgactctcctccgaattgggtttcaggcctgcccccccaaaggtgtggcaggcaggtccgcgacaacaagggaccgtacacatatgtgaagcgccccgccctgcttgggacccacgcctggcagtgtaacccgcgggcgcaggagtacatcccagtgcccgctcgcccggcaggaaggggagccctgggtgaactttcctctttgggagacggtaacgccagagataacgcccgacctgtccacctgccgtggaaccatgcccccaatgtaccccccagaggccacctgagggtgacacccctgcttggcccgggggggctgggaattgccgggtgggaaacaaacgggcgtggacggaacgtttcttccagcccggaccgggagtcacggcaaggggcccacgccccgctccgcccactcgcttcccggggcagtgcgcaggtcgtccactggcggggggtggcgctcgcccggagcgcggcggatgtgcgaaacccgggggatgaagcgtcacgccccggccacggaacgcaatcgcgagcccctgctcgctgtcctccgcgaagtccttcccgcctccggcagggtgcttgaggtggccagcggcaccggccaacacgcggcctggttcgcccgagccctcccccacctcgtctggcagcccaccgacgtggacgcggagtcgctggagagcatcgaggcgtggcgcaccgcggaagggcccgcccaacctgctgccgccgcgccagctcgacgcgagcgcggcgtcctggccggagacggccgcggacgtcatcctcaacgtgaacatgattcacatcgccccctggacggcctgccagggcttgatgcggggcgcgggccgggtgctgcctcccggcgggctgctcgtcctgtatggcccctacttcgtcgagggccgcgagacggcccccagcaacctggagttcgacgcctccctccgcgccagaaacccggcgtggggcgtgaggtcgctggaggccgtcaccgccgaggccgccctgcatggcctggagcgcgagcgcgtggtggacatgcccagcaacaacctcaccgtggtcttccgcaaaccccgtcctcaggtgtccccgcactgaaggccgcccgacaccgcgccggctgagtgcggaccgccgcacacgcccgcggccctggaacccttcacgcccgacacgcacgccactacccccatcccgtggcgagacgcgggcggggagggggcacaccatgccggacgcagcagcgaaggcccgcatgccagaggatgttctgttcgcctcggccttccgtggccacgagacagaggcctggagccgccaacgcacgctgatgctggtcctggccgtcatcggtctgcacgccgcggcgctcaccggcgcggcctcgttctggcacggcacaccgcgacggctcgaaggcgaaaccacccggggagaagtcctcgtgctccgcctgaccgccatgtcaccttcggccccggtgggggacgtcaccgggccagctcccgcgccccttcggccccggaccgcgcgcaggcctcgcccctcgcgcgccccctcaccgccgcgcaccgccgcggcgccgcgcgcctccgaactcgcggagccgctgtccgtcgggcgccccgccagcatcccagcccatgaccgtgacagcctggcgggccgcgccgtggcaggcatcacccagcgcgccctggggcccggcttcccggggttgctcgtggagccgccgcccgccacggcccccgacaaccgcgaggacatggcccggcgctacttcgaacagatgttccgcgaccgcttcgaggacgttccctacccccacgaggcgcggatggcgggcatcgaagggtccttggtgctgcgcatctccgtgggcgtgcagggccagttggtggccctgggggtgctgggcccctgcccccaccccctcctgtgcgaagccgcgcaggaggcggtgcggcatgccgcgccctttccgccgcctccgccggcgctcggcgaccgggtcaccgtcgagctgcccttcaactaccacctggaatgagcgcgcgttcgaagccgcgctaggggctgtccctgattagcgcagccaaagaagcatggatgcgacgtgcaggacggcgaggtagctcgtcgccgtcttgtcatagcgggtggcgacggcccgaaagcgcttgagatcgtggaagaagcactccacccggtagcgcatccggtacagggtgcggtctaacggcaacgcccgcttacggctcgggtttgaatggatgacaggcttcatcccgagctttcgaacgttggcgcggatgcggtcggcgtcatagccggtatccgcaatgaaagcggcgccctcggcgtgcaccataagttcttcggccattgtggactcgtgctgctggccgggcgtcagcgcgacgtggagcggcttacctcccgtcgtagtgacggcgtgaactttcgttgaaaaacctcctcgagaacgccccaaagcattgcttcggatcccccttttccgcccgcggcgtcctgatgcgcccggacgaccgatgcgtcagcaagggagccaagctcatccacatcgagccgcagcgccttgaagatggcttcccagcgcccagtcttcgtccagcgatggaaccgattgtagaccgtcttccagtgaccgaaccgctcgggcaaatcccgccattgcaccccggtcttcacccgccacaccacggcgttgatgaagtcacggtcccctcgcttcgagcgagggcccgtcctggagcccagcaggggctcgatgcggctccactcgacatcgctcagttcatgtcggcgcacagcccgcgttgatcatgcctagcgccaggcagcaactccgattgaggccctgccccaacgtgccagaaaggccggcacgccgggtcgactctcgaacacgagatcagggacagcccctaggcacacgctgatttcacgcggggccgggcgcacgccgttcaggtgcgcccggtctccggcgcgaagctcacttgcgccggggcggagcgggtggcgcctgctcctgcgtgccagagatattctctggggtggcgagccgcatgtctccctcgggcgtgatgactacatccgcgcccaggcaggagacgaagaggcgcccatcggatagcagccctgagcgtcgcggtgcacccgggagtacccgccacggctccgccacgtaggccccgtcacggggaacaatccggtacagcatcccgtcgttggtgacgatatgggacaggcccgtcaccgcgacgatgtgttcgccgaccttgtggatgccagtggcgttggcgtccagaatcttcttcgcggcggcgtcagtcgggatgtgcatgagttctccaccccactcaccccgacttgcccccaccagatgcccattcgaaacgcgcaatccgaactgcggtgcctgtttgatgggagtgcgacgctccccatccacccccaccgagcggacctcgctctcgtacgtcaatggcccgaatgaagcttcagggagttcatccggcgccgcaaccagtgccggttcgagggatgcttgctggtcgaagcgcatgcggtcgccagcgaagtactcaaacgcgaagttcgggttgcccgccgggtatgtctctttgccattgatgaccttcgtggccttgcgagcagcgtcgcggacaggtggcgcccagtgcttcgtcgcgacggccttgagcggtgccaaggcccgcgtggcccggagccttccgagcgattcggccgcggcaaaggccatcctccagtccctgacatcgcccagcatcgtgatgagcgcgtcggtcgcggctgtgaactggatgtagccaagcgttcgcgcagcggcgaagcgcaactgagggtcctcgttcttcagaagcgcgacaaccgcactgcccgcccccttcccccgctcgcggagttccgccaggtcgcgaagcaggtacaccgtgggcttcgtgcgcaggtgctcgacgaagacgggagtggcggcagcaggccccatgcgcatcagcgcgccatcaaccgtctttcgcagggcggcattcttgcgcagcgcctgcagcgcgggcaccgccgccgcagcggagggaccgatgcagcccagcacctgaatggcatgggcctgattttcaaggagggactcgcccccggtcgccaccctcaagaggggcgcaacggcgggccccgagttggaccccatctcatggaacacttcgcacaccgcgctggcgtagagttcgtgcacgggcgccgccgcgccaaagggttcggcgagcaaggcggctgccttgcggcccgcgatgaccagggcatgagtcagttgcgattgcgtctggggctcatccttgaggtcttcgacgaggaatgcgatggcgcggggggttccaatgcgagcgatggcgggaggaatccatccgtccccatgaagccgggcctggatgagggcattgaggtgttcctcggtcagcccttcgaggtcgcgcaggatgtagcccgcgaagtcacgaatgggctccgattcctccctgaacagcgggaggaggtacggaatcgccgccgcgccatgcgcctggatgcggctcgcgagttcttgcgcgtccgtgccgattccgccgccgtcatcgacgacctcggggatgcgctccacgagctgctgaagcgaggtgctgccgccaggcacgggtgcgctggccagcgcgagcgcgacgatgagcgcggcgttcatttacctgcctccaggacgtgagcgagggatgaatccccgacgccaacattgcgccagggttgctctgcatcaaggggttccattcagtggcgacaggccctccccgcgcatgccacgccctcgtcgacccgtttgaagttgcgcgcagcccgctcgcggcagcgcccaccttggtctccaggtgcgccgtgtggggccttctggggaagaacgcgcccacccagctcgaaagaaccaagaaagcatcggactctcagaattcttccgcaccatgaggcagacacagcgccaccgtgggggccggctcggtctcgcttgcgggaagtgtggtacgagaagccagtttccgcgaaccggaggattgctttgacgttgtttcgaatgtgtctgacttcgctgctggtctttgtggccgcctgcgggggggattcggatcccgtagtgactcctgacgccggccagacgcgaccggacgcgggcggcgaaacgccggacgcgggggaggagacgcctgacgccggtgaggaaacaccggacgcgggtgaagaagcgccggacgcgggcgaggaaaccccggacgccggcagcgagacgccggacgcaggtgaggaaattccggacgccggcagcgagacgccggacgcgggcgaggaaatcccggacgccgggagtgagacgcctgacgcgggtgtggagcccgaggtgagcgtcatcgacaactggggcttcgaagagtggcccggtgcgcttccggagatgtggctcgggagcaagtcgaacatcacgtcggacagcgtgcagaaggtgaccacgaacgccttcgagggcgtgaacgcggtccgcctgaccaacacctccgggacgcaccggcgcttcaccaccggagcgaagtcgatgcccgcgggccgttacgcctgcaccttccaggcgcggggcaccggcgaagttcgaaacgccttcttcgacgacgactactccagctactcgtcctacacggccgtcgacagcgcgacgtggacgcaggtggcgtacagcttcaacctcgccaatgaggtcttcgacaccttcgagctcatcttcagcatccgcaacaccagcggcgagcacctgagcatcgatgacgtgcgctgcacgcgggccgccgagccgtgtgacgcggtcagctgcgagtcctgggagcgctgcgtgaatgccaccgcgacctgcgagccgctcgccggccggtgcaacgctgccgaggactgcagcgagtggcaggcctgcgacgagacgaacacgtgcgtggtcgccgccgaccgctgcacccgccacgcggattgcgcggggacgccggagacgccggtctgtgatacggccagccacctctgcgtcgaaggcgacccttgcgccggcgtcgtgtgcaaccacccggcgacgagctgcaaccccacgagcggcgtgtgcgagctgtccgcgggagcctgcttcaccacgtacgactgcgtgggtgagctgccggcctgcgacacggcgaccggacgctgcgtgtccgccgaccaccccgcgaacatcatcctcaatggtggattcgaaagctggagcaccacctacatcccctaccacggcaaccatctcatcccggactactggtacgggctcgacaacggcatctgagag

SEQ ID NO: 862 - DNA, 6898 bp, Myxococcus xanthus
tgcgcccggaaatgccccttcatgtccaggtagcggtgcggtgacgtgtcacggcctgcctggcgtgccgcgccgccttccgcgtagcgcaggtccgatgcacccgggacgcccttcacatccagatacgcacggggccctggccccctccccgcctcgtgagcgtccccttccgcatgacgcatatccgaagcccccggtgcacggcccagggtctccaggtagtgcgacacgggagcagtcacgggtccacgcacctcgcgcgcattccgcagcgccgcaaccgacagatagcgctggtccgaagcccccgccgctcgccccaccgagtccgcgtaccgttggtccgaagccccaggcacgcgctccaccgactccacgtactgctggtccgaagcgcccggcgctcgcgcggggccctccaggtgcgcctccgtcatgtccctgccacgacgctccctgtggacttccggcacatccagcacgccaccactgcccggcaggttcacccggcgccatgacacgtactcgcgctcctcttccggcggcgcttccacgaccgccgcgggcagcgccgcctcgagcggaggaacccgaaggaaacgcaccgtcaaatccgtggagacacccgcgggaggcagcgtcacgcggttgctcgaagcaccgatgcggcagctccgcccatcacgaccgacaaagtgcgcctccacgcgatacgtccgccccgacggcaacccttggatgtagaagccgcgagcctccaccgtgaagtccaactcccgctccatctgttcgtcaccgaacacacgaagcacggtacgcggcgcctccagtgcatcctgcgcccgcagcagggcccccaggctgaagtcccaggacacgaagagcgtgtgcgggtcccttggcaacaggaggacggcgtcgtcctgataccgctccggcagcgcacccaatccctcggcatccacagggggcggaggcggaaccggcgcgctctccaccagatggtggctgcgcgcctcctcctcgccagccacgcgcgccacgaagaagccctcctccacgggctccgcgggcttttgcacgggcgcgggccgtgtgacgggccgcggcaccggctccggcgcgggaacgagcggcctcgtgacagaaggcatgacgggcgtcaccggctcacgcgcccgttccactcggggcttgggcgggaacgtgaccaccttcgcgggtttgacagtcggcttgctcccgggcttctcggaggcccgcttggcggccacccgcttgggcgcggacaccctgccctggtcttgcgcgccgtccgtcttgggcttcgcggcggtcggggacttcgacttccggggcgccttcgcggcgtcagtggcgggcgtcttggccttcctggcggcgggggcccgggcaggagatgcagcgggtttcgtggccgagcgcttgggaagcactcggatgcccgccaaccgggcgagcttcgccagggcggggacataggcggccagggctgcgagcagctcctcttttttcatacgactgtagccgctccccaggtgcttccgtgccaactccctgaggtagctgaccgtcacgctcttgaggtcttccataggcaaaaccggcctttaggtcgctggtcgtagagggtcaacgtgccagcattacatgtgttcttcgcccgaccccctttctcgtttcatcacccgatgacactcagggggcggctaggtatcctgcccacgcttgagcgacctgcccagactgctcctgtgcagtttcgacgtcatccccggtccgtcgggttcatcccggcgtttgaccgaatacttgaaggcgttgccggaccgcttctccgtggtggtgctatcggcgaagacgcctgaccactcccacatcgagaagtaccagggcgcccggctgcttcgcgtcccggtaggctcgggggacctcgcttcgcgcatccaggccttcgagcgggctgtgcgccggcagctcgaaagcgaggactacgcgctcgcccacttcacggaccccttcggcggatacgcattgtgcgagctgaagggagactacgggtaccggctcatctacgaggcccagacgttcccctcgcaggagctgcggtacacccacccacagacggagggggaccggcgattcctgacgaagattcgcaggcaggagctgttctgcctgatgaacgcggacctcgtcgtcaccgggtcggaaacgacgcgcgcctacatccagtcgctcggcgccagtgaggagcaggtccgggtgctgcccgcgccggtggacctccagcccttcacgcccgaggtgctgggcgccccggacggcgaaccgctccggatgatgtacctgggcagccaggtggggtggcagggcctgtccacgctgctgcgcgcggtggaggtggcggcccgggaggaagaggtgcgtctgtcggtggtgggcgcgcgccacgcggactgccagccgcacctggatgacctggtgaaggagctgggcctgagcgaccgggtggagttccaacccccggtgcaccacgacgacctggccaaggtgctcgcgctcgcggacgtgggcgtgctgcccatggatgacgtggagcgcaatcgcgttcagggcgggccgctgtcgaaggtgtcggagtactgtgccacgggccgccccatcatcgcggcggacctgcccgtgacgcgggagctcatcccggctggcgcgggcgtcttcttccctccgggcgacagccaggccttggccgaccgcatcatcgagctggcgcgcgacgtgaagcgtcggatggagctgggccaggtggctcgggcacacgcggaggcggcgctcgacgcggggctcatccgcggcaagctcctggacctgtatgactcgctgctggagaagcggtcggagcccgtctccaccacgagcgaggacaacctgcccgcgctcaccacggtgacgggaacgcccacgaaccgactggcggcgctgctacctcccgagcccgcccccacggcggcaccggtctccaagaaggcgccggagcctcggaaggacaaggacgcgcctgccgcggggcgtgcgcgtgaagacctgccgctggtcatggggcaggtgctcgatgaggggctcgacacgcgcctcatcaagacggaactcgagacgaatcccatcgagccgcccgtagtgatgggcgcgccgctgcgagagcgctccgcagcggccgccgatgccgcgaccaccacggtccgcgagagcgaggcctccgcatccagcgtggccggcaacgacgcgacgccggaaggttccgcgcacgacgcgagcgacgacgacgattccgaaaacgcgcttcccatcgttcaggcaacggaggtcgaagacgcggacgaacccccgtcgccgacgcccatcgtcaaggcgccgattccgtcagcgcaggcctcttcgacggtgagcggcgatacgagtgagcacgcggcgacgacgcccgtcgtgaaagcgccctcctcctcgggccggttctcctccgtgcagagtgacgacggcagcgaagcctcggggacaacgcccatcgtcaaggcgccatcgtcgtcaggccggctgccgtcggtgctgaacgaggacggcagtgaagcctcggggacaacgcccatcgtcaaggcgccatcatcgtcaggccggctgccgtcggtgctgaacgaggacggcagcggagcctcggcgacgacgcccgtcgtcaaggtccccccacctccgggccggtctccttcgcccgtgggcgcggattccagcgaaacgtcatcagtgacgcccatcatcaaggcgcccgccgcgctgaaccgaacggacgtgggcaccagcgaagcttccggggacgctgatgaagcccccgcgccgaccccggtcgtccgcagccccgtcatcgaagcgcgctacgagccaccctcgcacacgccggtggtgcgctcgccctacgaccgccagcgggacgaaccacccgcgccgacgcccatcatccgcgtgcccaccgagctgcaccaggagctcatccccacgcgcgcatccagcagcggcggaacagactcctcaagccggccggaagagtaccccacccccacacccatcgtccccgcgccctcctcgctgtcgagccggagcatctcggcgcgaatggagacgcccgtcggacggatgacggcactgacgccccagcagcggtccacgaacacggaacggccgccgcccatctcccgcccgggtgcctccgaagcagagcgcttgccgcccatccgaggaggcgcgtccgcgaacacaccggagcgcccgcctccgatcctccacccgagcacctcgacgccggaagccgaccagccccccgccctgcctccgcgcgcggcggcgcccccgcccgttcccccgcagcgtccgcctcggctccagtccgtggacggccccccccggctcgaacccgtcagcccgcaggcgttcaaggcctcggtctcggtccccggcggcgaggacgaagagcccgaggaaatctccgaggacgaagcccagtccatcgacgagggggacgacgacagccactcccgcgcgcggccccaacccgaggagccggacgaaatcagcagcgatgaggtggaggaagcggagatttccgccaccagtgcagcgcagctcatcgaatcggacgacgacctggaggaagccgacgccgacgtcgcccccgagccacacgatgacggccccgctccggagcccgtcccctcgacgctgaacccgtggttcgcccagctcgcgcacgggtactgcccccccgacggaatccgcttcgaccgacacacgccccccacgacgttccccggtcgcgacgagcccacgaaccccgcccacccgaccccctcagtccgttcggaagtcgtcgtccgcggcaagggctcgtgaggctggcaaccgagctgctcctggaaactttccaagggtcacaaccgcccgataggatgttccggttttcacagcactttttccgggacaaagggcttcatggagcgtcgggtcctcatcgtcgaaagcgagcatgattttgcgctcagcatggccaccgtgctcaagggcgcgggctaccagacagccttggctgagacggcggctgacgcgcagcgtgagctggagaagcgccgaccagacctggtcgtcctccgcgcggagctgaaggatcagtccggcttcgtcctctgcggcaacatcaagaagggcaagtggggtcagaacctcaaggtcctgctgctctcctccgagagtggcgtggatggtctggcgcagcatcgtcagacgccgcaggcggcggacggctacctcgccatcccgttcgagatgggcgagctggccgccctgagccacggcatcgtgccgccgggcacggatgacaccggcgcgtcgctggatgccgcgctgaacgggacgcgcgaagcaccgccgcccatgcctccgtcgctcaaggccgccgcggggggcccgccgaagctgcccaagcgcgagcgccgcagcgcgatgacggaagaggaccgcgcgttcctcgaccgcacgttccagtccatcgcggaccggaaggcggagctgctcgccgagtcccgccagctcaagcgtccgccaccgcggcgcgagctgatgggcacgcccgagggcaagattcagatcctccgcgacgagctgaagacgcgcgaggcccagctcgcccgcctctctgaaatctggaacgtgcgcgagcgcgagctgctctccggcgaggaccgcatccacgagaaggacgtggagctgcagggcctgaagatgcaggtggacgacctgctgcgccgcttcaacgaggcccagcaggccaccatccagaaggagcgcgagcacggcgccaccgtcgatgacctgctcctccagaagttctccgcggagaaggacctcatcgaggtcgtcgcctccaaggagaaggacatcaacctcctgcgccgggaagtctcccgcgccgaggaggagctgagccgccgcgccggcgagctggagcacggccgcaacgagtacgacaagctggagaagcacctcggcgtggtcacgctcgagttcgaggtcaaggagcagaagctccaggacaccgtcctcgcgaatgaaggcgaaatcgcgcggctgacgaagcgcggtgacgacttcgaggccgagctgaaccgcaccatcagcgagcgtgaccagcgcttcgccgagctggacggtgaaatccaggccctccaggagcggctgcagcagactgagcaggagcgcgacaccaccgtgcgcggcctggaagcccgcgctgcccgtgccgaggagcacggcacccaggctgacgcggaaatccaccggctcaacgccgagcgcgatgcgctggaggcgaagctcagccagcaggtcgcggacctggaggcggacctcgcgcgaaccatgggcgagcgcgaccagctccggctggacaaggacgcccaggaggccgagctcacccagcgcatcgaagagcgtgacgcgaagctcggcacgctcgagcgcgagctgtcggagaccatcgctcggaacgagcacaccgaggcggagctcaacgccaacatccagcagcagctggagcgcatcggcgagctcgagggcgaagtcgaggccgtcaagacgcacctggaggaccgcgagaatgagctgaccgcggagctccaggcgctgggacaggccaaggacgagttggagacggacctcaacgaccggctccaggccctctcccaggcgaaggacgcgctggaggcggacctctcccgtcagttggaggagctgcgctccgccaaggccgagctcgaagcggacccagagagca

SEQ ID NO: 863 - DNA, 7598 bp, Myxococcus xanthus
tgccgcatacccatcccgctgctggcggacttcgagatgccggccgaggagatcgccgagggcatcgcccaggccagccgcttcgcggaggcggacccgtaccgcgcggccacgcacaacaagggcgtgatgaacggcattgactcggtggccatcgccacggggcaggactggcgcgccattgaagcgggcgcgcacgcgttcgcctgccgcaacgggcagtaccggccgctgtccacctggtacctggaagagggccacctggtgggccgcatcgagctgcccatggcgctggggacggtgggcgggcccatcaagatccacccgggcgtgcagatggcgctcaagctgatgcagaccacgtcggtgcgagagctcgccatggtgttcgcggcggtgggcctggcgcagaacttcgcggcgctccgggcgctgggcagcgtgggcatccagaagggccacatggcgatgcacacgcgctgcgtggcggtgacggcgggcgcgcgaggcgactgggtggagaagatcgccaacctgctggtgaaggcgggccacgtgaaggtggagaaggcccgcgagctgctggccagcctccccgccgaggatgccgcggccgcgaccggcaccacggtctgacgccgtggctcctcgtcctgaatccttgtcggcctttggcgccggcaaggtcatcctgttgggtgagcacagcgtcgtgtacgggcacccggccctggccgggccgttgtcgcagggcgtgacggcgcgcgccgtgcccgcgaaggcgtgtcagctcgcgttgccctccacgctcagccgcccgcagcgggcgcagctcacggcggcgttcgcccgtgcggcggaggtgacgggcgcgccgccggtgaaggtgtcgctggaggcggacctgccgctggcggtgggcctgggaagctcggcggcgctgtcggtggcgtgcgcgcggttgctgctccaggcggcggggaaggtgcccacaccgaaggacgcggcgcgtgtggcgtgggcgatggagcaggagttccacggcacgccgtccggcgtggaccacaccaccagcgccgcggagcaactggtcctctactggcgcaagccgggggccgccaaggggacggggcaggtcgtggagagccccaggcccttgcacgtggtggtgacgctcgcgggtgagcgcagccccacgaagaagacggtgggcgcgctgcgggagcggcaggctcgctggccgtcgcgctacgagcgcctgttcgcggagattggacgggtgtcctcggagggcgcgaaggcggtggcggcgggagatttggaggcactgggcgacgcgatgaacgtcaaccagggcctgctcgcggcgctgggcctgtcgtcgccgccgttggaagagatggtctaccggttgcgggagctgggggcgctgggcgccaagctgaccggagctggtggagatggtggggccgtcattggcctgttcctggagcccaagcccgtggtgacgaagctcacccggatgggcgtgcgctgcttcagcagccagctcgcgggaccgcgggcgtcgtgagtcttcccatgaaagccacagctctggcgcatcccaacatcgccctggtgaagtactgggggaagcgggatgacgcgttgattctgccgcaccagtccagcctgtccctcacgctgtcaccgctgtcggtgacgaccacggtggagttcggcgccgcgagcgaccaggtggagctcaacgggcacaccgcgaagggcagcgagcgcgaccgcgtgctgcggcttctggagttggtgcgcgcccaggcgaaggccgacctgggccccgcgaaggtggtgtctcgcggggacttccccatggcggcggggttggccagcagcgcggcgggcttcgcggcgctggcggtggcgggacgcgcagcggcggggttgccgtcggagccccgcgcggccagcatcctggcgcgcatgggcagcggctcggcgtgccggagcgtgcagggtgggttctgcgagtggcagcgcggcgaacgtccggatggagaggacagcttcgcggtgcagcgcttcgacgcggcccactggccggacgtgcgcatggtggtggcgattctcgaccgcggcgagaaagaggtgaagtcgcgggacgggatgaagctcacggtggacaccagcccgtactacccggcgtgggtgaaggacgccgaggtggaggtcgtgcaggtgcgcgagcacatcgccaggcgcgacctgcaggccctgggtgagctgtgtgagcgcaacgcgtggcggatgcacgcgacgtcgttcgccgcgaatccgccgctgagctacatgagccccggcacgctggcgctcatcctgcacctgaaggagcagcgcaagaagggcatcccggtgtggttcacgctggacgcggggccaaacccggtgctgctgacggacgccgcgcacgaggtggccgcggaggcgctggcccgcgcgtgcggcgcgctggatgtgattcgctgcgtgcccggcggtgacgcggagctgaaggcggagcacctcttctgatggagcgcgccctctccgcgccggggaagctgttcctctccggggagtacgccgtgctgtggggcggcgtggcgcggttggccgcggtggcgccgcgcaccgccgcgtatgtccgccgccgcgcggatgcccgggtgcacgtgtgcctggaagaggggacgctggcgggaagcacgacgccgctgggcgtgcgctgggagcgtgaagtccccgcggggttcgccttcgtggcgcgggcgctggacgaggccctgcgcgcacatgggcgcgcgagccaggggttcgacctggcggtggcgccgtccgcagtggggccgaacgggcagaagctgggcatgggcggcagtgcgtgcgcgacggtgctggcggcggaaggtgcgcgctatgtgctggaagagcgctacgacgccctgaagctggcgctgctggcgcacacgcaggggcagggcgggaagggcagtggcggggacgtggcgacgagcttcgccggtggcgtgctgcgctaccggcgctacgacgtggcgcccttgattgaggcgagcaacaccgggcggttgcgcgcggcgctggcggagtctccgtcggtggacgtgtggcggctgccttcgcctcgggtgtcgatggcgtatgccttcaccggcgagagcgcctcgacgcgggtgttgattggacaggtggaggctccgctggaggaggcgggccgccggagcttcgtggagcgctcggacacactgggccatgcgattgaggacgggctgagcggcggagacttccggggccttctcggaggccgtgaaggcgcagcacgccctgctgctggagttggggccgctggagacggaaggcatgcgccgcgtgctggcgctggcggccacgtacggcgccgcaggcaagctgtccggtgcgggcggaggggacggctgcatcctgttcgcgccggatgcgcaggtccgtgcggagatgtgcaagggattggaagcccggggcttccacaccctgccgctggacgccgagtctggcgtgcgcggcgaggctcaggcggaggtccgtctccggacctgggtgcgcgcgctgagctgagtgcgtttctcctgggcttgtcggctatctggcgcgctaccccgggagtctacgccctggaacccggttgctttctccgcactgcttgggcggtgaatatacttggcatgggcagtctctctgcggtttggttttccagaaagaaatgagccaccggatcgctgcactgtatcgtttcggagcttccgaattggtcgtttcggaactcaggaacgtacttcattgcgcaggcgcctctttggtgcatccgcagcatggatacatctttgtacttgatgcagagggggaccaggttctctcaaccgaggcagccttgtttcagctcttgcatgaacagggggaggtgagttttcaatggtggctggacgctatgccgagtgtctactgccgtgtccgagccattggtgatgtcattgtggtggagtttgggcttgaggggctgacgtcacgggagcggtcgcttatcggagaggcactgctggagtacgtccgaagcgagcgtgagcatgtcgttgcgttcgtctatgaccccgagggggtgaccgaggattgcgacatggacgcccacttcgtacgaggagagattctcgactggcgccggcctgacgttggtttcccagacgtcttggtggttcgcgagtcagttcagtttcggttgaagaacgctccatcgaatgttgagagagtctcggttgatggtcttgttgtaatgaaatggaggcagccagggtaggacgcccggacgagttggcttggggggggggcgagcacttgaagagggttcaagacgggagcgctgcacgaagggagggctttttcgatcgcggggcgagtcgcaggtaaatgtcgcggccggtatggcaagtgctgttgcctgggggatgccactcgctcgtgccggtgtgtctgagaattcagatggcgagatgatcgcacggtccggaaacttcgagtgcatccttggtcccaacggtgtcgtgtctcggcagcggttcgtttcgggcggagttgtcacatgcacgccgaatcaggtcgtacggtgaggacgcggcttacttggcgcgaggttctcttcggcgtcgacaacgaactcttgtcctccgaggtgccggtcgaaatggctgtcgagcaactcggcatcgaggattggcctgtgcgggcgctcgccgaactggcggacctggagccgtggaagtcgcctcgtagttgcgtggaggcactcgcgggaaccgaagcaagtcaggacgcagaggcgataaaaagcaagtggctctacctcgtgttggcctgggtgttcatcaacagggagcacttctccgatccacttgagatgggtgagaagatttatgccgattttgggtacccagagcgtgtcgcccggttcatccgatacatgccttctgacgagcccgatcttggtagtcgcgagatgaatgagcggaggctctacagccagtggaagagctacttggacgaactgtcttcagagtacgctccccgatgagtcgcgctcggtgcggaggctggggcggaaactggagggccatggccggtgagcgagtccacgcgcattttcccgtctgagtgtgagagctgctgggtagcactctcgcgatgggatggcacttgggggcggggcttcctgagcgcgcgctgcggggcgtcgtcctgtggcgcaagcggaacttcggcgcgcagaggatttgattccagcgtctcgcgggacttcgtcgtcatcagccacggggcgcacgccgcgacgggctcctcaacacctctgctgaacggttaccttgcatcagcttgggggcagacatcgacgttgagttcaacagcgtcaccctcgatctcgatcacgtctccgctctgaatctcgatttcaagtcgctgccacccgtcttgaatggacaggtggcggacttcgttgatcgacacgcttgggccccaaggttgctctcgggaacagcgaagcagcgtcgaacccgtgacatgaatttcggcgtggcgtgcagcctcctcgctcagccgcacccgaacgtgggtctcgcccgatgcccactcagtggtcacggaaaccagagttgcatcgtgaaggcggtcccatccgatgtttgcgacctgcatggcgttcacctacggatgcctgatggggagatgtgccgccgatggctgaaagcacccgtacagggtagctcaactcttggccgtcgtccgtttccagtgcctctgcatccagagcatcgaggagatccgcatgaacgccagcctcagcgtcctctctcctcggccttcaggccgaggtccgcaaggacgaggtgcgctccacttcggagactggcgctaccggagccatgccctgggcaagaatgccggcttcgagcagctcaaggtgctacatcgtcggggaggagtcgaacgagctcgtgggctccatggcggcggttatccggatgcttgacgaactgttggccatcatcgtgcagtccatgtcggcggcaggtaagatgagcttcatggcgggggtgctggtgcccgaggaggaccgcgtgaagtacagcgccgtcaccggtctcaggtggaacacatgagtactttcgagggtgcgcgagcgctcgatgagattgcaagacggtgggcgctgcacgacgggaggattctgtcgatagcggcgcgtgccgcagagcactgcggagtgctattggagctcgtgtgctccccgaggccggaaagccccgtggcagagttgcgcatccgctttacgggtgtgacccggatcgaattccgatggtctgaggaacaggcattctatttcgttcctgggtacaaggcgctcgttcagccgtcgggcatggtctatctctccctcgacccttacgatgatacagtcgcagcaatcgatccgagagatgccagcgtcattgaggcgcgcgggatccttgctgagttcgtgatgaagccctcttggcccgggtgagaggcgtgggcgctgattggcaatttctttcaatgctcctgtgagtgccttgttcctgctctgtcatggcagggctggtttgatgtgtcagaagtattatattctcaatgtccgatagttgcggtgcgctgtgcgtaaggtttctctcactattggtcgctattggtaggcaaaacgcgtaaaacacttcgcacctcgaagagcgtcggccgcgtaacccactgacaaaccagccccgctggcatcacccatgggttggcctattgattgaattgcgacagtcgttctgctgcatatgttgcacagtggcacgcagctgcgggctgcgcggtggggctcatgcaaaagctgtcaatgactgtcgtgatgctgtgcggaacgctcgtgtcagggtgccagggaggagaggaggagcagccggccctcgaacagtcaggtggccccggtatcgcggcgtctgtcgcgtcctcaagtcaggcggtcgtctctccggccctcgcggcatcgctctcgtgtgtcgagacgtacgtcaatgcggggacctgcgactgggcgcactggagtgagatgtgggagacctgcgagacctacgagcaccccgaacttgaggacggagtcttccttgaggcagtgcaggtagaagactgcacggtggccaactggtctacgttgcgcgcacagcttctcgcaccgcgcacgcctttcgtcagcgtgcgcgacagttgcaatggggagtcccagatgatctacgaggccgcgtccaacggctgccactcgttggatgcagccgcgggcgcatccttttttgacgtaccgatcggcaagagcgtgacgctccattctggcgcgcactgcactggagactcggtcgccgtcgagaccgacgcgagcctctgtgagacttcgttcgacagtggtgcaatcgcgaacgataacgtgcgcgcgttccgaatcagcgacatctaggcaccctccc

SEQ ID NO: 864 - DNA, 5605 bp, Myxococcus xanthus
gcgccgcgcgaacccacaggaacaccaactatgagcaccacggccgtccccttctacattgtccccatcaaggtgattgatttcagcaacgccaggctgtccttggacctcggcaagaaccaggtcggcagagcccaaccacagctggacatattccttcccggcgccccccatcggcagttgagcgctttgctccacacctatgccgccagcctggagctgaacaccccacccaacgagcggtggctcattcggaccgactgctgcgtggagccgaaccacggccgcatcttcctggagctggccgagggggaccatgccgaggctatgcgcgggatgatgctcctcaacgccctgctgctggactgaacggcaggggcaggggaacccgcgccgcaccaccgcgcgggctcctctcccaatcccgtgacactgaaacaccacgcgaaacacgccgcaatcctcggcacaaactacatccagcacaaaacaccagacacgacttgcttcgcacccccacgtagggatgtatgcgtttcgcgacgaacaacaaagcgccgcgccaaccccaaaggaacgcacaccatgaagaccacccccaagccccctcgccttggccagacgacggcaaccgccccccagaacgccacggtgactctgagcctcagcaagaaccgatacggcacgcctcagccgcaggtggacttcttcctcccgcgcggctccagccatcgggagacgagcgcgatgctctacacgttcgccgccagcctggagctgcgcacgcctaccagcgagcgatggattgtgcagaccgagcgcctcgaggaggcgaatcacggccgcgtctacctggagctgtccaagggggaccatgccgaagccatgcggggcatggcgctcctcaacgccgtgctgccgcgctgagcagcagaggaagggggaacccgcgccgcagcaccgcgcgggctcctctcccaatcccgtgacactgaaacaccacacgaaacacgctcccaaccctgggcgcagaccacattcgacacaaaacaccagacgcgacttgcttcccatccgcacgcagggatgtatgtgtttcgcgacggccagcgacggccccgccaacacacggagaaccccatgagccgccccatcgtgattgtcgagagcccttacgccggtgacatcgagcgcaacgtcgcgtatgcccgggcggccctcagcgactgcctccggcgcggcgaggccccctacgcgagccacctgctctacacgcagcctggggtgctgcgggatgaggtccccgaggagcgcaaccacggcatcgaggcgggcttcgaattccgccgcgtcgcgcaggccacggtggtctacacggacctcggctactcggaggggatgaagctgggcatccgtcacgccgaggccctcggccaccccatcgagtaccgctcgcttcccggctgggccacccaggcgtaagcgccgggacgcagcggcagggcagaaggagccaaacacctcggccgcgccctttcgcagagtcaacgcggagccccgcagactcaacttgaattgcatccccacaagagcgcgtatgtctttcgcaacgggcaacaccccgccctacggaacgcgaggacaacgatggccacgacgagccagcagttaatgatggtaggacagcgcaccgcgcgccatggaattccccagccgtacatcgaggtgcgcttcccgaaggacacgcgccagcgcacgctggacgccgccctccatcgcctctacgccgatatcgagctggcaaccccggaaagcgagagctgggatgttcgcatcgaacaactcccggatgtgttcagcttctccggaggccgcgtgtacctggagctggcggagggcactccggtcgaagccgagcgcgcgatggcgctgctcaaacgcctcgtgggttgagccctcctgagcccctcagcaggcaccgcgtgcggcgcgcgccggtcagcggtccagcgccggagggaggctcctccggctgagccagcggacgccgcaggggactccgcgctggcacgttccgccaagcccccgcctgtctcatccaggggcaatcacacacactggaattccgcctacagcccccagcccaggcaggctggccgcgtcccggccacgggggagcctgcgcgaaaccccgcgaattctcgcggcaatttcagacagccaaatccacatcgccagccgccgaagatgacttgcttcattcgcacaccagagcgtgtatgtgtttcgcgacgggcgccacagccccgcgcgaacgcgagaggcaaactccatgaagacgctccggtttggaattgaaattgagacggttggcgccagccgccagaagctggcccatgcgattcagagcgcggtgggcgggcacgtttccggcgactaccggggctggcaggtgacggacacccagggccgcatctggagggtggtatcggacgcctcgctgagcggaggcgagtacagcggcgaaatcgtctcccccatcctcacctaccaggacatggacgccttacagcaggtggtgcgcgccgcgcgcgaggccggcgcacgcgccgacgcctccaccggaatccacatccacgtcgacggcagccgcttcgacgccaagggcgtcaccaacctcgtgaagatggtgcacaagcaggagcgcctcctggagacggccctcggggtgagtgcggcccggctcgcccggtactgccgccccatcgatggggccttcctccagcggctggaggcccggcgcccgcgcaccctgcaggatgtgaatgaggcttggtacgggcgccgcaacagcatgcccaaccgctacgactccagccgctaccacggcctcaacctcaacagcctcttcttccggggcaccatcgaattcaggtacttcaacggctcggtgcacgcgggagaggtgaaggcctacgtccaactggtgttggccctcgccgcccgggccctggcctcgaaggccgcctctagcaagcgccgcgacttcaaccccgccaccgccaagtacgacttccgggtgttcctcctccacctgggactcatcggcgaggaattcaagacggcccgcctccacctcctcaagaagctggagggcagcgcggcctggaagggccagcgccgtgacaggcgcggctcgggcgggggcgaggacggctcgaccggcagcgagggcacacagggcggcgcagggggcagcgcgcccaccgaagccttggctgccgcgtgacggggccttcgcgggcgccacggggccctggcgcccgcctgcgctcgcggcagggcccgggaaaatccgggcgccgggctcgcaccttcctgcggtccccgctcctcgcaaacagcgcttgcttcaatggcgaaccagagcgtgtatgtctttcgcgacgggcgaaggccctcgccaacacaagagacacagcaatgaaagcatacggaatcacccgcaaggacagaggctgctgtccggggcacggcaagttccctgtcgagaagtaccgcgggcgcctctcccggaaggcgcacacccgagggacacgcctcgcgcaccgccgcgctcgggccctggcgagggtggagctcttcaacgagaggcgcgacgccccccgcgtcagcaacgagaggtaggccccaccgcgctggacggcgagcccaacccagtacgcccccaccatggaggcaccgcgccagagccctgcaggtgccctggctggcaatgacaacggcgggccaagagtccgccctcaacaggaggaaccccatgctctacttcgcctacggctccaacctcgacagggcccagatgcgcgcgcgctgccctggcgccaccgtcgaggcccgagccaccctttccggccacaccctggtgtttggcggattcagccaccgctggggcggcgccgtcgccaacctccagcgcgtgcgcggcgcccacgtcgaggggctgctgtaccgcctcacccccgaggacttgcgcgccctcgacgtcttcgaggggcaccccttcgcataccggcgcgccattcggctggtgacggacagggccggccaccgccgccgcgcgctggtgtacctccagcccgagggacgcttcgaatcctggccgcccgctgtccgctacttccgcgtcctctggcacgcctacgggcgcctgggcttcaaccgcgccgccctctcgggcgccctgggaggtgcggcgtgaagcacgcttcaacctcgacgcgcgtcttcgtgtacgggacgctactggggggcgagcccaaccaccgcctcctgcgcggcgcacgccttatcggcccagcgcggacgcagccccgcttcaccctctatgactacgggcccttccccgccctcgcctccaggggcaagcacgctgtcgagggcgaggtgtacgaagtcgacgctctcatgctggcggcgctcgacagactcgagagccacccgcgcttctaccgacgcacgcccattaccctcgacgacgtcggccgcgtcgaggcatacctgtttcccaaggagcggttggctggccgccccatcatcgagtccggttgctggcgtcgacacctacaggagaggaagccatggtaatcgtcatgcgcgacgggcgtgtccttcagggcacggccgtccaaatcgtgaagggaatgcaggacatcgccttcggtgtggagcgcttgtctctgggcgagtacatcgactgggtggtaggcaatgcccagcgtttcgagtccgtcgcgctgcgtgtccagggtgaaaccgacgaggagaaggccgcctcgctggtggacgagatgctgcgcgagggcctggcaacgaaggggtgagggcgcgcccgccaggcgcgctctctcatacggcgaaagacggcctcagccgcgcgccgtagcgactccgcttcgaaggaatcgctcagcggacacaggccgcgcccgccgcttgcggcgcgtgcctcgccactcctcagccacctggccaccgtgtgcagcgacgtggctttcagccaagaggcccaccgtggcgcgaagagggccttcaccagcaccacacgcctccaccagcaccaaggcttcacgggcgcccagcatctgcaacgctgcggcctctgccagtcggtactcggctttcgcctcggcaagccgcgtccgcgcttcgggactcccgtccaacctcgcgtacgcccgctgcaactccacctctgcccgccccaggcgctccgcgagcgcccgccgcttcttcatgctcatggccgaaggtggaaagcaggtggcatgccgcgcctccacggacgcctcttccctcggggcatggtgagcgccggcttggtgcccccgtctctcgacacgcactccccagtccggcccggaagacgccagtcgctgtcgcccacgggccgaagcgttggcgatattggccgtgagttgccctgccccgaagggcgatgtcactgagcggctctgctccaatcaagccacgctgccgccagcttcgttcacaggctgacggtgacttgccgtattgggtttagtgcactttgtctttagagcac

SEQ ID NO: 865 - DNA, 6935 bp, Myxococcus xanthus
gggtgcccgcctgcgggtcgcgctggggcggaggaaacacgtccaccaccgccggcaggccgatgagcatccgcagctccacggcggagggcgccccccgcatctccatcagccgccggtagagcagcagcacgcgcgactgtcccagcaccggcacgcgcgcggcgcggtactggccaccgccgtccgacagcgcgcacacgtcgctggcgagcagcgcctccgccgccgccacgtcccccgtcagcagcgcacccaggaagccctccagcgcggcgcgggcgcgcgcttggaactcccgcgtcggcaggcagcgggcgcggtcgtacgccgccatcgccgcccgcgcgcggtggtgcaccaccttcacgttggactcgcgcaggttcagcgcctcggccacctcgcgcaccgagtagtcgaacacgtcgcgcaggagcagcaccgcccgctgcttgggagacagcacctccagcgcgagcaggaaggcgaaggagacactctccagcagcgcgtagcgaccctccgtggagccgcctcccggcagccgcgcctccacgccagggggcggcagctcctcctctcccgtgtccagcggcgagggcagccaggggcccacgtagccctcgcgcttgcgccgccgcaacgtgtcccgggccaggttcaccgccacccgcgtcagccaggggcgcagcgcctccgttcgcgcgggcggcgaggccagggcgcgcacgaaggtctcctgcaccaggtcctccgcgtccgccgacacgcccgtcatgcggtagcagagcccccacaggaagcgctcgtgctcgcgcacggcctgcgccagtccttcgcgcgcggagcggtccatgcgtcagcgccccactgcccggcgtgacgccacctgctggcccgggacgagcgcgcgcgccaccgactccgcgctggcgaaggacgcctccgcgagcaagccctccggccccacccaatctcccacgcggtacaacccaggcacgtgcggcacctccaccgaggggcgtccgcgcaggccgcccgtctccgccgtcggcagccagtgcgacaccagcagggagggccggtaacggcgcgccaccacggacgtccgccaaccgggttgcagcgcatccatcacttcctccaagcgggcctcgctcgcctccgggcccctgccgcccaggtattgcatcacatgcaccatcgcgccgccttccggcgccagcttcgccaccgcggagtgcaccgacgcgtaccaggggccatcagtcccgagcgcgaacagcgcgtccggacggggcaaccgggacagccccagctccagcgtggccgccatcaccggcacggcgcgggccgcgtcgtgcgccaggagcgcgtcagcgggcagcagcgccgcgatgtcacccggcccgcccgccaccaccaccgcgtccgccgcgtgctccgtcccatccgcgagccgcacgccacgaacgcgcgcacccgtatccgctagcaggaccgcgctcacgcgcgcggagagctccagccgtgtgcccgcatcgcgcgcgcgggtctccaactcggagacaagcgtgctccacccgccgtccacgtagagcaccgccggcttcgcctggagctgggcgacggcggactgggcgctcatcgcgtccacgtccgcgcagtaggtcatcacccgcaccagcgccaggatgaaggcgcgggcgtccgcgttcgacaggtgctgctccacccagtcgcgcgtggtgatgttcgccagcggcgccaggtccacgcgtcccagccccgcgagcagcttcgcgagctccagcttccccggcagtccgagcgcgtccgtggtcagcagggagaccagcccgcgcggcatcgtgtgcaggcgtccgccactcagcagatacgagcccgcgccgggcatgccacccgcgggcttcacgcccagctcgccaagcactcgcatccccgcgcccccctggtacagcgcgtgagcgccgaggttgaagcggaagccctccacgtccgacgtctgtccccggcctcccaggtgcttcgagcgctcgaagagcgtcaccgcgcaaccgccccgtgccagcagcgccgccgccgacaggcctcccagccctccaccgatgaccgccactcgaggtgccttcatgtgccgtcctccaccgaaatggcccggtgaaacgccgggcattcagcgacaccacgaaggcggcggccgaaaggttacgcgagcccgtgttgcacggccgtgacagacgcgccgcctgcgcgagaaccttccgtccacggtgcgtttttgagcgggttccggctgactctccgctctgaaaaccgggtgcacaccaaccccgcaagtcacctacagcgaggcaatgtcagaggtagtcgtagacttctccatgcaccggcggactttcccgccggagagcctcgaggcattcacgcatgagaaagctcctcgccgccctgctcgctcttcccgttctcaccgcctgtggtcccgcgccggagtccgactcgaatgacatgcggctggcacccgagggcgccgaggtggcctccaccgagcaggagctgttcggcacgccccgtgagcgctccgtccgcctgcgcaccggcgtgacgctgcgctacgtggagcaaggcctgccgctgggccccgcagtggtgttcctccacggcttttcggattccaaccacacgtgggacctgaacctgcgcaccttcccgcgcaaccaccacgtctacgtgctggaccagcgcggccacggggattcgacgcgcccggcgtgctgctacacgcagcagtccttcgccgcggacgtggacgccttcctggaagcggtgggcgagcgcagcgccatcctcgtcggccactccatgggcagcttcatcgcgcagcaggtggcgttggacttcccgcggcgcgtgaagggattggtgctcgtcggctcggcacccaccgtcgccggcaacccggtggcgctggagctgaagtccatcgtggacacgttcgagggcacggtggatccggagttcatccgcgcgttccaggagagcaccttcgtgcgccctgttccggcgtcgtacatcaacacgatggtgtcggagagcagcaaggtgcccgcgcgcgtgtggcaggacgcgctggacggcctgctcgcggaggaccactcggcgcggctgaaccacatccgcgtgccggtgctcgtcattggcggagaccaggacggcttcttctccgtcgctgaccagcaggcgctggtggacgccctgccggacgccgagttcaagctgtacccgaacaccggccatgcgccccacgcggagcagccgcggcgcttcaaccaggacgtgcaccgcttcctgcgcgaagtgacgcgctggtaggaggaggaagtcgcgtgcccgggattaaccgggcaccgcccccggagcaccgcctcccgcgggcggctccggggaggcgcggggcacatcggcgcgggccagcatcaccgcggccccgaggatgagaacgcctcccaggacctggcgtggggtgagccgctcgtccaggaagagcgcccccagcaccaccgccgtcaggggctccaggttggacaccagcgacgtgttcaccgggccgatgcgctggatgcccacgaagaagaggagcaccgcggccaccgtggccaccagcgccaaccccaccaccgcggcccagcccgtgacggagccggggaaggcagggccacgcaccagcatggccacgccgaaggagaaacccgccgagcacaggatgacggtgctggaggccagcggccccgcccgaccggacacccggccgctggcgacgacatagacggtgtagaacagcgcggacagcaggcccagcagcacgcccggcagcgtggcgccgccctgggacaggtcggctgtcagtaccgtgccgcccaccgacaggaccaccgccagccacttcacccggcccaggtgctccttgaagacgactcgctgcaccagcgccaccagcgcggggaaggagtacagcagcagggccaccagccccgcgggcgcgtgctgcagggcgaagaagtagaccccggactggctgaagtacccggcggcgcccagcaacatcaggacgactagtaccccaccccgaggccaccgctggcggcgcagcaccatgacgctggcgagcaccgcccccgcgattgagaagcgaaggaacagcagcgtggccacgtccgtgcccgccgcataggccaggcggccaaagaggcccagcgcgccgaaacacacgcccgacaacgccacgatgaggaagccagccgtgcggctcatggccggagggcgaaccctgctccaaccgggcgcccgtgtcacctgcccccggttggctaccagttcttcacggatttgaggtcgaagacgtccgggaagccgttggcgcgcagcaactgcacggcctgggcgctgcggccacccgcggcgcaatacaccaccacgggcgtgccgggcgggcccacctcggccagccggcggggcagctcctgcacggggatgttccgggcgggctcggggtgcccttcctgaaattcctgcggcgtgcgcacatccagcagcaccgcgccttcagcgacgagctgccgggccttctccgagagttcctggggtgtcatgcccccactctaagcccgagcgggcagggggcgactggccgaaaactggaggtgtccgccatggacgctacagttctgtaccacccatgcgactcgacaagcatgcactcctgggccagctcgcggaccgcctccagcagagcgaccggctggcccaccgcgccgaggcggaggcccgcgaggccgcccgcagtctggccacggagtccgagaagaaagaggacggccgcgccgccctggagttcggcagcctcgccaccggacaggcccagcgggcccgccgggtccaggaagaactccaggcgctgacgaagttcggtcaggcggaggtcccccgtttcccccggcaggggccggtggcgctgggcgccatcgtggacgtcagcaccgaggacgaggagggcttctccgagcggaccttcttcgtcctgcccgcgggcgccggcaccgagctgacggggccgggcggtgacggcttcctgtccgtcatcacccccgcctcccccgtggggcgcgccctcatgggccgaaaggcgggggatacagtggaagtgatgctcgcgggcgaggtccgcgagtggacggtgctcgaggtcgcgtgatgtcgagccttcgacgaaagcccggggggcactagcacccatggcgcccgtcgcgcgtgaatccgaaaagatgtcttcttcgccttcaccgcaaatccaggcgctgcccccacctgccctcctgccgctcacctggcccgccgccgtcgtgggcctgatgttcggcgtgctgatgacgtacgtcccatacgagttccgggtggcctccttccggccgctctacccgtatgtgcgcatgctgggcctcacgtacctgacgggcagcatcatgctgatgggcgcgctgctgtacccgcgcgcgccacgctggctggacgtcacggggcgcctgctgctgggcgcggccatggcgctgtactggtgggtgctcaacgtcctgccgggcagcttcacgggcatcattctctacccggtgctcttcggcggcgtggtgctggaggcctggcccgccatgcgccagcggcccgtgctgcgcaccttcgcggcgctcaccggcgcggcgttcggcgtggccatgctggtggtgcccgagcgcttcccgctctccgtctacgcccacctcgcgccccttcggcccctggtgggcctgctcttcgccgtgtgcggcgtgggcctgctgctgccttcccactggctccaccgccggctgccggccctgttcatgggcgggctggcggtgcccttcgccctgctcgcgtacgcgctgggccggggtgcttcatggctgggcgccagcgtgtatgcggtgctcaccctggcctgtgtcgcgcaggccctggactggcggccgcgcgcgcctcgcacggtggggtggaagctgctgcgagggctggccttcgcggggctggtgccgctgctggcgctgggcgggctggcggcgtacctggcgcagaacgcgattgaacagcaggtgcgcgacgacacgcagcgcgccgccgcgggcgaggccgacttcctgcggcgctacctggacgacgcgggcgagtccctggcgctgatgctggagtccccgggcttccgcgccgccttcgccgcggccgcgccggagcggctggagccctacctggtcaacctggcggcccaggagcgcgccttcgacgcggcgctcgcggtggacacccagggccacatcctggccgcgtctcccagcgtggaggggtggaacctggagccgcgcgacttcctgcccccggccttcacccggggcgccgaggtgtctccgcccttcatccgtccgcccggccagcccctggtcgcggtgacgcagcccttccgcgaggacggcgaggtgcggggcatgctggtgggcctgctgtccctggagcgactgagccaggccaccacgcccgcgtcgcggcgcttccacgtgcaggtgttggacaggcgcggcctcaaggtgctgcgcgacaccgcgcccggagcgccgctgctgggtgaagcccacctgccggacgcgctcagcctgaagctgctgcatcccggcatcggcgtgctggaggccttcgacgcggaggaccgccgaatactcgccgccgagagctcccgtgcaaggcacagagtggaacgtgctggtgactcacgagctggagctggtctactcgacgattacgcgcatctgcgccagcgcggaggggctcgtgctgctaagagtcctcat

SEQ ID NO: 866 - DNA, 6339 bp, Myxococcus xanthus
gcaggcccgagctgcgcagcaccaacgaggagctccaggagaaggcgaagctgctctccgttcagaagacggaggtggagcgcaagaatggcgaggtggagcaggccaagctcgccctggaggagaaggccgaacagctgagcctcacgtccaagtacaagtccgagttcctggccaacatgagccacgagctgcgtacgccgctcaactcgctgctcatcctcagccagacgctcagtgacaacgtggatggcaacctcacgtcgcggcaggtggagttcgccaagacgattcacgcgtccggcgcggacctgctggagctcatcaacgacatcctcgacctgtcgaagattgaatccggcaccatggcggtggacgtgggtccgctgcgcttcggcgacttgcgcgagttcgtggaccgcaccttccggcaggtggcggacaaaaaggggttggagttccacatcggcctgggggattcactgcccggcgagctggagacggacgcgaagcgcctgcaacaggtgctcaagaacctgctgtccaacgccttcaagttcaccgagtccggctcggtgtcgctgcacatcggtctggcgaagggcggctggtctccggaccacgccatgttgtcctccgcgccctcggtggtcgccttcaccgtggcggacacaggcatcggcatcccgaaggacaagcatcaaatcatcttcgaggccttccagcaggcggatggctccaccgcccgcaagtacgggggcaccggcctgggcctgtccatcagccgtgaaatcgcgcgactgctcggcggcgaaatccggctggagagcgacgtgggcaggggcagcgccttcaccctctacctgccgctggccttcatggcggagcgtccgccggaggagcatgcgcgctgggactacaacccgctggccaccacggtgctccccgcgcccatcgcggagccagtctccgagtcgcgggtgtcttcgctgagccggatggacatcgacgatgaccggagctccatcctgcctggagacaaggtgctgctggccgtgacgcacctggcggaccatgccgcgcgcctgcgtgccgcggcgcagggcacgggcttcaagctgctggtgtctaccgaggtggaggacgcgctggacgccgtccgcaacacgcggccagcggccgtggcggtggacctggacctgccggagatggcgggctgggtggtgctggaccggctgaagcacgacgcgtccactcgcgcgctgccggtgtacacggtgtcggtggaggaccaccgcgagcgctcgctcaacctgggcgccattggccacctgcgcgcggcggcggacccggaggcggcggtggccgcgctggagtccctcaagcgcttcgtggagcgcaagggccgcgggctgctcgtggtggaggacgaccccgtccaccgccagacgctgacggagctcctgggcagtgatgacgtgcagacggtggcggtggggaccgcggcggaggccctggccgcgctggccgagcgccgcttcgactgcatggtgctggacctggggctgccggacatgcccggcacggagctcatccgccgcgtccatgaggcgcacggcgcgggcgggccgccgctcatcgtctacacgggccgcgagctgacgcgcgcccaggagacggagctgcggcgggtggccgaggccatcgtggtgaaggacgcgcagagcccggagcggctgctggaggagacgagcctgttcctccaccgctcgccctcggacctgaccgagcccaagcgccgcatgctggagaaggcgcgcgagaaggaccccttgctggtgaaccgcaaggtgctggtcgtggacgacgacgtgcgcaacatcttcgccctcaacaccgtgctggagcgctacggcatgaaggtggccttcgcggagagcgctcgcgagggactggaccagttggagaaggacgccgacatcgagctggtgctgatggacgtgatgatgccggagatggacggctaccaggccatgcgcgccatccgccgcatggagcgcttcgtccatctgcccatcctggccctcaccgccaaggccatgaagggggaccgggagaagtgcctggaggccggtgcgtccgactacatcaccaagccggtggacatcgagaagctgctcagcctgctgcgcgtgtggctgcacgcgccgcggggcatgccgccgcgcggttcgcgcacggaggtctccggatgacggggcccggcgcgcgcggcgcggagctggaggcgctggaggtggacctgctgctggagggcgtggcccggcaatggggcttcgacctgcgcagccgctcccggccgcagctcttgcggcggctgcggcaccacctccgcgaggagcggctggacagcttctccgcgctccaggcccgcgtgctgcacgacgccgaggcgttggacgcgctgctgcgcacgctgtcctgcacaccgcccgccctgttcgcggaggccgccttcttccgcgacttccgcacccgggtggtgccggtgcttcgcacctggccctccgtgcgtgtatggcacgcgggctgtggaaccggcgaggacacgtacgcgctggccatcctcctccatgaggaagggctgtggggcaagtgccggctgtatgcgtccgacgcgagtgaagggctgctggcggacgcgcgcaccggcgtgctgccgctgcccacgcaggaggacgcgcagcgctacctggaggcgggcgggaagggcgcgctctccgactactacacgcgcgatggcaactgggcgctgctccagccccggctgcgcgacggcatcttcttcacccagcacaacctggccacggatggctcgttcaacgagttccacgtcatcgtgtgccgggacacgttgctgaccttcaatcgtgcactgcacgaccacatccacggccgcctcttcgagagcctcgcccgcttcggcttcctgtgtctggggcgcaaggagtcgctggcgcgcacgccgcacgcgggggcctacgagatgctggatgactgtggtcgcatcttcaggagggtggcatgaatcccttggggctgctggtggtgggggcgccgcgctgcgcggcggcggacgtggagtcggtgctggcgctgttgcctccgcacctacccgtgccggtggcgttggcgctgcaccggggccctctggacgcgctggccgcgccgctgggccgccgctgcgcgctgccggtggtggagccggacgacaaggacccgctgctgcccggcgccgtgtacctggcgcccgcgggctaccacttgctggtggaccggggctgcgtgtccctgtccgtggagccgcccgagcatgggcagcggcccggcctggacgcgctcttcgaatccgcggcggacagccatggccccagggccgcggggctgctcttcgcggggcacgaggatggggtggcgggcttgcaggtgctccatgcgagaggcgcccgggtggccgtggtgagcacgctccagacgggcggagcgggtgaggagggagcgatggcgcaattgacgttgggttccgtgggagggtggctcgcgcggctggcctatgtgccgcgttctaaggtgctgccttgagcggcgcgccgacgcgcgagcgcctgccggcgattccggcggagcccgtctgcctgctgctggtggatgaccagccggagaacctgctggcgctggaggcgacgcttgcgcccctggggcagcggctggtcaccgcgagcagcggccgcgaggcgctgcgtcacctgctgacgcaggacttcgccgtcatcctcctggacgtcgtcatgccggacatggacggcttcgagacggcccagctcatccgcgagcgagagcgcagtcgcggcacgcccgtcatcttcctcaccgggctgtcgcgggggccacatccggagctgcgcggctatgccatgggcgcggtggacttcctgctcaagcccttcgagcccgccatcctgcgctccaaggtgagcgtcttcgtggagctgtaccgcaagacggagctggtgcggcggcaggcggaggcgctgcgcgaggcccagcagcgcgagcacgcgcgggagttgctggaggcgcagcggcgcgtggaggccgaacggcttcgttcagaaaccaaccgaaaccagcagcgctggctggaggcggcgattgccgcgctccccatgccgctggcgttggtggagccgggaagcggccacaccctgctggccaaccgggcggcgcaagggctggcggggggctgtctggcctaccgcgaggcgcgcgcgctgcatgcggacgcatgcttccgcggcgcggatggccggctgctcgcggatgaagacctgccgctgatgcgcgccgcgcgcggtgaggtgttccaggcgttccccgtggagtggaacgtgggcggccagcgcggttcggtgctcgcttccagtgagcggctgcctcgcatgcatggacgcccggagaccatggtgctgggcctcttggacgtgacggcgctccgagccgccgctcgccacgactggctccccctgccgctgacggagcacatcgctacactggaggcgcagggggaggacacaggcccgctcactcggctcatcgaggtgctgcggaaccttccgggcttgagcaccgggagccccggacaggagcgcgaggagggctccttgctagcggaagagggcagccaggcgggcaaccctcctcggcccgcgcgctgaacatcgccggtcgagaaatggttgacgcacaaaataacatgggcaaggtggccgtgtgagtgacgccggaatcccacagcgggtccagcgcttcatctcgacgcacatcgactccctggagaagctggaggtgctcctcctgcttcgggcgcgcgcggacagggagtggacggcatcggcggtgagtctggaactgcgcattacagatgcttccgccgcctccaggctggaggacctgacgaaccgacgcatgctggtgagcgatggtgcctcacctccgtcgtatcgctacggtcctgagtcgtcggaggatgtgcaggcggtgacggagctggcggcggtgtacagcgcgaagcgcgtcagcgtcatctccttcatcttctcgaggccgctggacaaggtgcggggctttgccgaggcattcatcctgaagaaggacaaggacggccatggctgaagcagtctacatcctgtgtgcgttgacgagcgtggcgtgcgcggtgctgctgctccgggcctacaagcgtacgggcatgcggctgctcctgtggagtgggctgtgcttcgtgggcttggtggtcagcaatgtgctcctcttcgtggacctggtgctgctgcccgccaccatcgacctgtacatgccgcgcgccatcgccacgttgtccagtgcctctgtcctgctctatggcctcatctgggacgcgtcctgaggtgccatgatgctcaagcccatgctcaacggtgcggtggcgatggcgtggctggcgagcgcgctgttcttcctgcgcttctgggtccagtcgaaggaccggctcttcgccttcttcgcgctggccttcacgatgctggcgggcaactcggtggtggcggcgttgctggacgtggatgacgagcggcgccactacatctacgtggtgcggctcttcgccttcctgctcatcctctacgccatctgggacaagaaccgcgcgaaccgccacggctccgggtagggccgcgccgttgtctggcaggtcatctggctgacacttgcctcgtacctgcgtccgggcaccgttgtcgcaggtggaggggcgtcattatctccgacaccccatgtcgcgccgcccttcttcatcctcgcggcccgcgtccgtggacgagcgcgaacccgagcggtccgtctccacggaaccggacgcggtgtgtccgccgcgagggctggagtcccaggtgggtgggggtggggccgggaatgccgtccgcttgcgcggcagtgacgacgcggaggagcgcctcgcgttcctggccagcgcgggcgagctgctgtcgtcctctctggattcgggcacggtgctcaagcggctggcggagttggccgtgccgctgttggcggactggtgcgcggtggacgtgctcacggcggacgggcgggttgagcgggtggccgcggcgcaccgcctggcggagcaggtgccgctggtgcacgagctggcacgcctccagcccctggacctgacggccgagggcggtatcccggaggtgctgcgcaccggcaaggccgccctccttccctttagagcac

SEQ ID NO: 867 - DNA, 8048 bp, Myxococcus xanthus
gacgacttgaagcgcctgttcgccgggcgcgaggcgcaggtcatccccaccgccacgcgctcggtgctggaggcggggccggacaccgccgccctgcgccaggcgctggagcggcacctggcgccggcgcgcgccttccgcgctactgcgcgcccatcatgaactgatcgacgtcgaccgtgttcttgtcgggcaccgcgtccttcggctcggtgcccttcttgaagaacatcagctccgaatccctggagcccgcgggggcaatcttccccgtcttcttgtcgatgtggagccgcaccaggtccatggactgccacgggtagaactcggactgcggccggccctccagcgcgctcttcatgtagttgagccagatggggagcgcggcgcggccgcccgtctcgtagcggcccagcggatgcgggttcaggtcgtagcccacccacgccaccgtcaccaggtcgcgggtgtagccggcgaaccacgcgtcgaaggagtcgttggtggtgcccgtctttcccgccgccggcttgcccaggcgctgcgcggggccaccggtgccctggagcaccacgccgcgcagcaggtgcgtgaggatgaagccggcctccgggctcatcacctgctcgcccggctcgaagaggcgcgcgtagccggcggccacgcggtcctgcaggggcgcccacgcgtcgtcgaaggccgtgtggtcctccaacgtgcggccccagcggtcctcaatcttgcggatgaagtacgtgggcttcttgcggccgtagcggttgaaggtggcgtaggcgttggccaggtccaccgggtacacgcacgaggagcccagcgccgcggagaagtccatgttcatgggcgtggtgatgccgagcttcgtggtccacgcggccatgttcttcacgcccaccgcgccgaacgtcttcaccgcgggcacgttcagcgagttgaccagcgacgtgcgcagcagcacctcgccttcgaacttgtcgctgtagttggccggcttccacgacaccttggtgtccgggtcgtgctccacaatcggcgagtccaccagcacggtggcctgcgtccagttcaactgctccagcgccgccgagtacacgaagggcttgaaggagctgcccggctgacggcacgcctggaaggcgcggttgaactcgttgtcgtcgaagtcgtagccgcccaccatcgcggtgaggtactggcggtgggggtcgatggagacgagcgcgctctgcgcttcgggcgtctgctccaggcggaagagcttcaccccctcgctggggatttcgtccgcgagcttcttgtcccactgctccttgtcgtccgtcaggtccctcttcgtgacgtggcgcaccacgacgacgtcgccctcggagatggccttcttcaccgaggtaatcatcatcgccgggtagtagccctccgggttcaccttgcgcgcccagcgcatgcccaggagcggcagccgcccggtgtgaccgcccacctgcacgtccgcgcccttgccgtccccgtcaatggacgtgacgacggcgacgtagagccggttctccaccagctccttcgcgcccatgagcttcttcgagcggtcgacgaaggcgcggatggcctccttcgacgcgagctgctccaccgggccgcgccagccctggcgcttgtccaccgacagcaggccgtggagcaccgcgtcctgcgcggcgcgctggcgctcgctgtccatggtggtgaagaccttgaggccggccttgagcagcacggggttgccgtaccggtccaccacgtccttgcgcacctgctccacgaagtacggcgcgaactcgtggaacacgtcctccaccgggtacaccttcacctcttcggcgttggcggtgtcgtgctcctcctgcgaaatcatgccctccaccaacatgcggcgcagcacgtaggagcggcgcttgcgggccgcctccgggcgcaggaagggcgagtaccggctgggcgcctgcggaaggcccgcgatgagcgtcatctcgcccagcgtcaggtcgcgcacgtccttgcggtagtagttctccgccgcgctctgcacgccgtagctgtggtgcccgaggaagacgttgttgaggtagaggtagagaatctcctccttcgtcagcgactcctccaggcgccgggcgaggatggcctcgcgaatcttgcgggtgagcgtcttcgcggtggcggacttgtagccctccgcggagatgagcaccgccttcgcggtctgctgcgtcagcgtggagccaccctggatgccgcccgagcgcagccccagcttggagctcaccgtcttgaagccggcgcgcgcggtgcccagcacgtccacgccgaagtggtcgaagaagctggagtcctccgacgcgatgaaggcctgcaccaggcgcttcggaatccgctcgtagggcaccaccttgcggcgctcttcgtagaactcgccggccagcaccgcgtcatccgtgtagacctcggtgacgatgggcggccagtactcgtccaccttggggatggcgggcaacccatccgcgtacacgtagtacacggccgtcacggcaatcacggcgcccgtggccccggtcagcgaaagccatcccgcggtcttcaggaggaacttccaccagcgcttggaggggacgccgtcgagcaccagcttcgagcggctgcggtcagcggatttagggtcggacatacgcgtttcttttgtgcctcgcgggcgtcagggcaccaatgcggcccgcttgagcacatctcggagctcgacggcgaggggagcctcgacagccaccttcgcgccgccttcgggatgcgggaattcgatgcgctcggcgtgcaggaacaaccttttgagcccccagcgcgcccgcacgtcgcggttgaaggcgaagtcaccgtacttcttgtccccagccaccggatgtccgatggccgccagatgccttcttatctgatgcgtgcgcccggtctcgatggcgcaggacaggagcgccgcctcgctcgactgcttcacgaccttccaccgggtgacggccgcctgcatgttcacccctcgacgggccttggactcggccgtctgttggtgttctgacagcggcaggtcgatgaccccggagtcccggggcatcttccccttcaccagggtgagatagcgcttgcgggacaggccgtgggtgaagacctcggtgaaatgcaccatggccgggcgccgcttggccaccaggatgacgccggaggtctcccggtccagccggtgtgcgggcgaggccgcgaagtcgttgcggacggccttgggccccaggtaggcgcgcacgtagtccaccagcgttccgccggtgatgccgctgccggtatggacggccattccgctgggcttgtccacggccatgagccagtcgtcctctcgaaggatgaccaaccggctggggtccaccggcggcggaggcgggtccactttcggacgttccgcccccacgagctgctgctcgtcgccgcggatggtgagcacgtctccttctgacagcaactgctcgggttgcgcacgcttcccgttcacccgcaccttcttggtgcgaatcatcttgaagaggtggctcaccggaacattggggagccgtttgcgcaggtgcttgtccagccgcatcccggcggtgtcggcttcgattcgatactcgatcatttgtgctggcgcatggaccagaccatacgaataatcccgggtccatggcgaaagcccccagtatcgagaagcttcttcagagtggctcggcggaatggaaccggatgcggaagtccggccaggtcgccaccgaccataccggcgccaccttcactcaactgttctccgccaacaccgacctgtccgggctgggcctcatcggctcggaatgggaccggtgcgacctgtccaaggtcaacttccgggacgcggacctttccaatgcctacttccacggcggccggctccaggactgcgactttcggggtgcgaacctcgaaggcgcgacgttcgagaagctgaagctgctgcggtgcgacttcacgggcgccaaggggctcgacgacatcgagatggacgacgtggacatggaccgcgtcgtcggtctggacggcgaggaggccccgccgcctcctccgccccccgcccagggcatcaccgccttcacccgtgagcaacgggagaaggcgctgggcgtacaggccgccgcggcgctccagggtgagcccgttggcgacgagctgccccccttccggccccaggaccctcctggctcgctcttctttcgggcgctgaagcggatgggcgtgcccccgctgtgggtgctggacgtgccgggcctgcgcccgctcctgccgcagcggctgcccccgggcagctcgatggagacgctctaccgtgaggcggtgaagacgcggctggagaacaagaagcccgcggcggatccggcggtggtggaccgcgcgcagaaggcgctccgcatgggcgccaaggacgccccggtggcggccatgtacctgcgcgaggtgggcgtgctgcccctgttccgcttctccgcggcgcaggtgctgaagggtgcgctgcgggaagaggtggaggtggatgacctgacgggctccatcgacccgcgcaccacgggcgcgctcctggagctgcgcttgacgcacgaagtcgtggagcacctgcaggaggcgcggcgccggctggcggccacgcagctctacacgtcgctgctggaggcgggcttcaacccggagaacaactgggacgaggcgctggagtcgagcgacgcgtcgatggagctggcgcagctggccacgggtgaggaccgcaatgccctgctggagggcttccaggtcttcgcggcgctgccggacgaggcccggctgcggcggctggcctacctggccgagtccgtcaccaacctggagctggtgagccggctgccggagggcatggagccgtcatggctcacgggccccgagacgcgcgagtgccacgagcgggagatgacgtacgtccagtcgctgaaggcggaggagattcccgccaaggtggcggcgctggcgaaggaagagctgggcgtgcccgagggtgaagttcccgaggaaagcgacggcgaccttttcgtccacctgcgctgtgacgtgtgtggcaaggagaagctcatcgtccaatcaccggaggagtaaccgtccggtagaggccgaggcccgcggggccgcggggtccgggatacgctcccggacctggcggccccgtggtgtttctgaagcacgggttcgcggtgctacacgccggacgaaggcagcacgtacgtcaccggcctgggcagcaccaccttcacggtgtctcccgcgcggatgatgccggggcgctccacccaggccaccaggccccggcgctgccatgcggccttcacgaagcggctcgccagcttctgcacgtccggatgatgggcctcgatgacgcgcccggggccgatacagggctcgttctccccttccaccaccagcgtcgtgtcctccgggaagaacagccgcgtgcccggtggcaggtgcgtcagccgcggcacccccgccacttccaggttcgcccccagccatgacgccagcacgcgcggaatgccgagcgtctccgcgacctgggccaactcctcgctcgacaccagtgagaactgccgcgtgttgcggatgggcgtccccttggggaaccacggcgtgcgcacgtccgccgcccgcgtcaggcccgcgtggcggtcaccctccaagccctcgaaggacacccgcgcctcgggcagctccttcgtgacgaagctcttgcgctcggtacacacgaggacgcgcacgatgcgtccttcccactgcggcgtcttgcgtgccatcgctccccttctaccgaacccagccttccaccgcgcgtcagaacagtccgagctgctgcggcttcccgcccagcgggcgcgcatccatccccgcgtcgcgcagcgcctgcgccagttcctccgcgaagccgtggcacgtcagcacctcccgcgcccccgtggacttcgcgtaggacaccagcccggggaagtccgcatggtccgacagcgggaaggccacgtccgcgccgtaccgtcgcaccgcgccccggtccaccgcccagcccgtcagcaccgccgtcgcccgaggccacagcggcgccagcgccccgccccgcgcgtggtgcggcgggaaaaagagcacctcgcccggctccaccttcccgtcgtagcagcgcaggttctcaatcggcacgcccagctccgcgtagagctgcgccacctcgtagatggaggaatgcgccaccagcgggaagccgcgccccgccaggtgcttcatcgcctcctggctcttgcccagcggatagcccagcagcaccggcaccgcgccgcgctcaagctgcatccgcagccacgtctccacctgccccagcacctccggacgcggcgggaagcggtagcgcggatggccgaaggtggactcgatgacgagcgtgtcgcactccgccacctccgtcgcctcggcggtgagcgacggcgccacgttgaggtccccggtgtagacgatgcggcgcccatccggccgcgtcacgcggagctgcgcgctgcccaggatgtgccccgccggcagcagctccagcaccagcggccccagctcgaagggttgccggaaaggcacctcgcgcggctcacgcaccggccccaggcgatgcgtcatgaaacgcagcgtcgccgccgtggcgatggtgctctcgtgccgggcaatgtggtccgaatgcccatgactcacgaagcacagcggcgacttgcgcttcgcatccagggacaggggggtgcccgtcaggtgcatcccgtttcgccgcagctccacactcatgggaagggccccgggtatagcgcgtccactcgtcggtggccgccttcacttcaccaccctgcccgcccggctggtggacaggccccagatggctgcacgcatgccccgcggcagggccgctaccgcgccggcgccctcgcacgccaccacacccaggccgccgcacccacttccgacatcaacacgcccgacaggatgagcgcgccgcccagccactcccgaggcccgagcgtctcgtagcccagcagcaccgagtacagcgcggcgaacaccgactccaacgagtagatgagcgccgcgcgcaccgccgtggtgcgcgcctgcccccatgtctggaggctgatggccaccgcgctggcgaacacaccgcagacgagcaccgcccccacgaaggacggatgccacgccacgcgccgctccacgaagggcaggcacagcgcggacagcagcgccaccgtccagagctgcaccgccaccagccccatcaccccctgcttcggcgcatgccgctccgtcatgaggatgtggcacgcgtaggccaccgcgccgcccagcgacagcacatctccggacgacaggccaccactgccaagccccccgtccggctgcgtgaagaagtagagccccaccgccgccacgcccacccccagcagcgaggtgaacttcggcgccttccgatagagcaccatcgacagcagcggcaccagcagcacgcacaacccggtgatgaacgccgagcgcgaaggcgtggtggtggtgagccccaccgtctgaagcgagaaccccaggaagaggaaggtgcctagcatcgagccgatgcgcaggttgcgcgcgatcagcacctgcctccccgccaggacgctcaacaccaccgcgcccacgataaagcgcagcgtgaggaagctgaacgggtcgccgtgcccgagcgcgtccttcaccaccacgaaggtgatgccccagaacgaagtgatgagcgccagcgccccatccgcgcgaagtcgctgcgaccgcgacgagggctccgtgcctccccccagcatgtcggacgtcgaggtgctcatatcgcgcggtccaccggagaggatgacgccgggctcgccaggtgacgtcacggctttagagcacacggg

SEQ ID NO: 868 - DNA, 7874 bp, Myxococcus xanthus
ggacgcgtggtgcagcaggggcggctcgcggatttggaggcacggcccgcggatgacttcgtcacccggttcatccaggcgcagcggcctctgcctggcggtgggctgggaggcgcggcgtgagggggtggctcctggtgttgctgctcgtgggggcgtgtggcggggcgtcctcgtctggggatggcgtgccccaggtgcgcgtgggctccaagaagttcaccgagtccgtcatcttgggtgaagcggtgacgcagctcgcgcggagcaccggtgcgcgggtcacgcatcggcgggagttgggcggtaccgccgtgctctgggaggcgctgcgccggggcgaactcgacgtgtaccccgagtacacgggcacgttgcgacaggagttgctgtccgggcgccacctgccggacgacgcggcgctgcgtgcggccctggctgagtctgggcttcggatgagcgagccgctgggcttcaacaacacgtatgcactgggcatgaaggaagcggaggccgagcggctgggcattcgccgcatctctgatttgcgtgcccatccttcgctgcgcttcggtttcagcaatgagttcatggaccgcgcggatggctggcccgccttgcgagacagctaccggctgccgcagcgggacgtgcgcgggctggaccatgatttggcgtaccggggcatggagagcgggtcgctccagctcacggacctgtactccactgatgcggagattgaggcctatgggttgcgtgtgctggaggacgacctgcgccacttccccgcgtatgacgcggtgctgctgtatcgcgacgacctggaggcgcgggcgcccgaggccctggccgcgatgctgcgtctggaaggccacgtgtccgaggcggacatggtgaagctcaacgcgctggcccggctggagcgcgtgtcggagggccgcgtggcgtcgggtttcctcgccacggcgctgggggtcacttcggaagtgcgcggggacgggctggcttctcgcgtgtggaagcggacgcgtgagcacctgttcctggtgggggtgtcgctgctggcggcgatggcgctcgcggtgcccttgggcgtgctggccgcgcgacggcctcggctggggcgcggtgtgctggggctgacgggggtcatccagacggtgccgtcgctggcgctgctggtggtgatgattccgctgctgggaatcggctcacgtccggcgattgccgcgctgttcctctacagcctgttgcccattgtccggaacacagcggccgggctcgcgggaatccctcccgaggttcgcgagtccgcggaggcgctgggcctgcccgcgctggcgcggctgtggcgcatcgaattgcccatggcggcgccgtccatcctcgcgggcatccagacggccgcggtcatcaacgtgggcactgccacgctgggcgcgctggtgggggcagggggctacggtcagccgattctcacgggcatccggttggatgacgtgcggctcatcttggagggagcgattcccgcagccgcgctggcactgctcgccagtggcctgttcgacgccgtggagcgtgtggtggtgcctcgagggcttcggttgggcactgcggtgcgttcgacgcgttagtcttgctcgtcgagccagaagaattcgtctccgctcgcgagagcacgctcaagaaagtcgctgaatgagtcagcgatcttccgaacttcacgggggtacgtctcgtgataggcatcgaatagcgggtacgggccgccagtgttcgccacgttcacgaggacgaagtcggagtcctggcagtccacgagtggatacaaagacgcggtctcactcgctccctgtgcacgctggcgcaatctgggagtcgctgctgcgatcccctccaacgagaggatgctgtagttcgcgtcaggaagccttctgaacaactccgctccatcacagtgcaggtagaaggcgcgcaggtcgtcgtccaggcgccagcccatctgcgcctcgaaggccgctatcctcgctgccgtcacagggggatgtgggaaatgcgcacgcgagatttccgtcagcagggattcgatggccatggtcaatccacgtagggcctgtcgggccccacagtgctccaccggccaccgcggctatagcaagccgggtaagctccgttgaaggtgtcatgcacgagcggaggcactggcagtacgttgtctggcgacgtcgggtgccccccgtggaacaggtcgaaaatgtgatggcctggccagttccgtccttcggactgcggccatgcaccaaactcgttgctccacgtttcgcggtagccgtcacgcgcgttattccatgtgcggcggcgctgctggaggtcgctgaccgtcgggtaatcgcagcagcagtgggtaatcgccagcctcccgccggccgcagctggcagcgccatgaagcgaccatgccagtcgcctttgatgtccgcgagccagatacatcccagcaagggggcatgcccttccgcgacgcaccggcgctcacatcgtgcccgaagcgagacgctgcacgaccagggcccgtagtagatggtcgttcggacggttccgcctgctggactcgggacggcgggccccacccatctcgccgaaggcttcacgccagcggcgcctcctgtggctgagccgcacccgatagtggcaaccagcagtgacatgcatgcagctctcaatgggaggtggaggctcctcattcgacgcagattagcggagcccaacgcggggaaacgccttttcaactcctcgtcgcagtatgccactgcgcatcatgattgaaagtgagcaccgcagggcggcgtgagagggcttccctatcaaaccgcgctacccctttgcgtgctggcgtgaggtccggacgcaatggctattcagggaaggccaccagcacaagaggaagggtgacttcgtttcgagtcaggacagccggaatcgtaggggttgaccgcacggggcgtgataccgttgcgggaatggcacacatggacatcaagggtgagcagcgaccgattcaaaaggtgttctgcgacgactttgtcttgcgagtgccgcactaccagcggccgtacgcctggaagctcgagaatgctcaggaactcctctccgacctgttggcgttcatgggcggcggctcgaccaaagttgacgagctccccccgtactttctcgggagcattgttctcgtaaaggacgacgcgtggcccgaggcggaggtgatcgacggccagcagcgcctcaccacgctgacgatcctcctcgcggcactgcgtgcgtcgacgggggctgcgttcggcagcgacctgaccaagtatctgtaccaaccgggaagcctcgtggaaggtacgccggaccagtaccgtctccggctgcgcgaccgcgacgccgagttcttcagggagttcgtccaggccgtcgatgggccagcgaagctgaaggcgctgacgcgcgaaatccccgatgcgcagcaacgtattcgggagaacgcgctgttgttcttgcgcgaactggacgcgctgcccgttgagcgccgacagcgcttggcgagctatctcgtgcggcgctgctatctggtcgtggtgtcgacgcccgacgccgactcggcgtatcgcatcttctcggtgctgaacgatcgcggcctcgacctctcgcacgccgacatcctcaaggccgacatcgttgggaagattgacggcgaggccttgcagaaggcctacgccacgaagtgggaagaggtcgaagaagagattgggcgcgacgcgttcaaggatctcttcgggcacctccgaatgattcatcgtcgggcgaagctcgaggggaccgtcctcgccgagttccgaaagtacgtcgtagacaaggcgcccgagcccaggaagctcgtggacgacgtcatcgtcgctggcgcttgggcgtacgaccagatccgtcggtgcagttgggatggccaatccgatgacgcgacgcaggcgaagatcgaggagctgcttgagtggctcaatcgcctcgacaacgaggactgggttcctcctgcgatccgcgtcatgcagttgagcgctgacgccacgaaggtgctacgccacctcgaggcgcttgagcgtctcgccgcgttcctgctcatcaagcgctccaacgtgaacgagcgcatccacaggtacgcgaacgttcttgaggccatcgagaatgggacagccattgacgcggggggcccgctccttctctccaccgacgaagagaagcaactcgtggacgcgctcgatggcgaggtctacctcgagcagaaggtgcgcgtgtacgtccttctccggcttgaccgagccctgggcgacaagggcgcgaagtacgacgtcgacacgatcaccgtcgagcatgtgcttccgcagaacccgcgtgacaagagtgagtggttgacgaatttccctaggcccgaagatcgggcgtggacgcatcgcatcgtaaacttgctcctgctgcctcgccgtaagaactccgaggcgagcaactgggacttcggcgagaagaagatgcggttcttcacctctaagaagggggtgagcacgttcgcactcacctggcaggtgctgaaggagtacgcttggacgcctgacgtggaggcgcgccaccagaccgaggccatcgacaccctcaagaaggtgtggtcggtcatgtagcaggttcatatcgcacgcattgaacgggctgttcctcggctgggacgtcagcgcctggaaccgcgagagccatcagggcctgtgctcgttggcaagctgtggcgtaggaatgtacgggaccttccccccttgcgcacggaggggggcgcgctggtcggcgctctcctttgacgaatcgagctcagccccgacgatgcgaggcacgtcacgatcgccatcgacatgccgcacgcgtagccacggaagacggtggagaaggccggtttcggcgcggcgtaggtcgctgggccctccgcagctcctgaggatcgtcacagcgggccactcgaagctgaatgcttcgggatagcccccaatatgcgggacgcgctgccgacggcagggctgttcaggacacttgccctgtccaaccttcccttctcctcttccgccgttgcgcatctctttggggagcaaatcggggaactgaatagctgcgtcacagaacgtggggcgctgttggtgctttgtgatggaacgcgcggactcctgcgctacgcctcattcgaggtgggcatctcgccggaggaggccgcctaggcgagccaaggcgttgcgagtgccgccgagttgctcgagttgctcgcgaagcgtagacgcgtagacgcacggcgcctgtcgcgtgccctcgtcgagccgaataggctccaggaggcgggcgaccttgatggggcacgcgagcctctcctggacctccttgatgttgaggtcgttccgttctaccgcgagctgcaggtccagttggacgctctcgacgagccgtaacgcgaactgccgcacgccagtcgtcgcgctcttggcgttgttacggctcctctgccatgtcttcgagctgaccctctgcgatttcgcgatagagcggcaccacttcaatggcgagcacctcccgcatttcctggcgggcgctgtcgaagtccccggcctttcggtggcgcttggcgcggtaaagcgcgtcgacaatgcggtcggagccttccttgatgcggcgcgcgcattccagcagaagggcctcggccttttcagccgtggcaagggctgctgccgcgtcggctttgccgatgcctacctccggcgcggtgcgttccagcatttccctcacctccgccgtgagcgtcaggcgttcaccctcccgcacgcgccgcgcgagggctcgtacgggctcccactcaagttcatccgccatgccctgttacctcttgccccggcgggggcggcacttgttgatgggccattcctgctggccctcgcagtagcggaagcaggcgtagcaggagccctgccagtcgtcgtccttgcactcgcagtaggtcgcgatgcagcggcgcttccactcgggcaggttggtgttgtgggcgtcatcgacgtccggcgcgtcggcctccgccgcgacctgggagcctgccatgagcacagcggcttcggtggcggagaggccacacgcatccgggccgaatcgctgaatgcaacatgtcgcgctgtccagacaggcggcttgagcgtacgcgtcttgaggggccatgtcgcgacggctggagatgccggtggcgctgctggagcatcccagtgcaagtgccgcgagcgcgtacgcaagggaaagacgggtgttccgattggacatgactgccacatgtatcgggttcgtcaccctgcgcgtatcaccctggctgagtacttcggggcggggcgccgccctccgtccttgcgtccgataacggcgaacgccgtcagacgggctcggcgctcgaagcgggcgaggcttcagccaccaccctgggcgcatccgccgccaggcccgccgcgcacagcaccacgaccgccatccacacgaagtccgccagcagcaggtgcaccaactgcatccacaccggcgccagcagcagcaggttggtgacgcccgcgcccaactgcaccgcgtagagcacggtgatggcggacgccgcgcgtcgcacgtcctccgatggccgcacccgcgccacccaccgcgacgccagcaccaggaacgcgcccacgctcaccgccagcagcgggtgcagcacccgcagcttgatgaggatgtgtgccgtctccgaaatatcctggcgcaagccctccgccagcgtggtggacgggaacagggtgtcccccagcgccgcgatggcgccactcacgcccagcaccaacagccccaggatgctcaggcccatcagcgcgcccggcagcccctgtccccgcaggctcaggggggcgcgtccccgggagaaccagatgaccagcgtctgcgcacccaccagcaggaaggtgttcaccaggtgcacgcccatccacagggcccggcccacggaggcgttgtccgccacgtacttcagcagcacgatgcccgcgccgacgagcgcctccgtcatcatgaagaacagggcccaggccgccgcgctccgcaccgggtggcccttggcgtgccccttccgggcccagacgtagagcgccaccgccagaatcatcgccaggccgctcgtcagccggtgcgtgtattcgatgagcgtctggacgctgggggcccgggggatgacctcgccgttgcacaccggccagtggtctccacagccggcacccgagcccgtggcgcgcacgaaggcgccccacagaatcacgaccagcgtgaaggcaagcacccccaggctgaaggcctggaaccggcgggacgaggcagcgtgggtcatcacgctcccccttaacccacttccaccccccgccgctgtcccacacgtctcttgggtgctcaccccggccatcagcgcggctgctcggctgtcgggccggctggacatccagtgtatccggaatgattcagatggatgctgccctgcatccattggatatgcccgccccctgtccgggcgcgcggatgatttccatttgagtcaatccgcctcccgggcactggcacgccgggtgcttaacacctcccacagtgcatccggtgccgcggtgggcgctggagacacacatctttcgcatgaggccgcttcggtggtctcggcaccccgggttggagtttcccccctcttcgacccgtgggtgtgttcttccagaggcgtggacgcacgcacctctggagccgcttcccacaggggtgtggggaaacaggg

SEQ ID NO: 869 - DNA, 8170 bp, Myxococcus xanthus
cgggcctgctaacttcaggggagcgtcgccagccggactacggccgggccgggttctcctcgccgaagctggacgtctccgagaaggcccagtccaccatcgagtgggtgtcggccccctgatagcgggacacgctctgggtgttctcctccaccacgccccagtccaccgagacgtcgagcgccgtcagcggagcgctgtcgtaggcgcacggcaccggggtggccgtctcaccgcggcagtccaccggactccagtggccctcctcctgggcggcccggaggacgacggggtagttgggcggacgggcggcggtcatgctcttgtgggagaaggccaccacgtcctgcgtgtcgccctgcggattcgcgaggcgcagcaggcggtcattgaaggtcggatggctgctggtccccgtcacgacgtcccacgcccccgggtagaacgtctcgtacgtcttctcgtccttggacagggtgtcattgcccgcagcgagctcggccgagttcggacggaagtggatgacgatgaggtcccccgcggccaccgtcacgtccggcagggtcgccagccgggacacgctggtggcctcctcggtgagcgtgatgccctcgatggcccctgccgtcacggccttgagctcgatgaggtcgcggttgttcgtcgcggagacgcccgtggtgatgttcgggttcacctcgttgatgacgagcagcgccggcacccggtagcccttgaaggtggccgtcccactcacgctgacgccggtgtagctcttcaccgacgggtccaccgacagcgtgtactgcgtgccgggctcctgcgcggtcgtggtgagcaccagggtcttctcgtcaagcgtgtagtcggagacggtcagcacgctgtcaccgaaggtgaactgggtctccacgtccaccagggtgaccgggtcgatgccgggctcgaaggtcacccgcaactgcgtgggcgacagcgggaccacggtctgcaccttcagggtgatcgccgttcccgagcaatccaccgagaaatccgacagcgagaaggccgtcaccaggggcatggggtagtacggcgtctggggattgggggtgttggtcgcatcgtcgtagcgccacatcacgcccgcctcgacggagacccggcagttcagcccgacgccgacgaggtcggccagcccggtgggcatgcgcagccgcggccccaacccgcccgtgagcggggtcccgtccatcgcgaactgcgcgatcttatagccggtacccgcctgcttgccggcgcccgccgtggtggtcaccctgccggtcacccggacgagccggctctcgtaggtgtcgaggttcaccaccgcgtcgtcggtgacgtgcgtcaccaggccgccgtccgccgcgagcttccgcacggggtggcccgagctcagcttctggaagtcggagatgacgctcgcggtgtccagcttgtaatccgccgcggcgttgccggactggaggatcttcgtgaccaccttgaaggagacccggtcccccacggccacctgcaccgcgtcggagtggctgacgaacaatgcggggccttccgccgtggcctgcacgaagaagccgcggggctcagcggtatccggagtgatggcggtgacgaaggcgccctggagggacagcggctcgggcaggtcgcccgtgggggccgcgtggaaggcggcaatctgcgcgttcgcctcgtcgagccccgtcaacgtctcgcaccttccagctgcgttgcagctctgccgcgcggtgcactggccgttgtcgatacactccacgcactcgccctgcccgttgtcccgagcggtgtcgcacagtggcgtctcaccaccgcactgcgcgctctcggtgcagccgcacacgttgttgtcgctgcacaccggctgggcgccgttggcgcagtggctgttctccaggcactccacgcacacgcccggggtcccgggcttgcactgcggcgtgccctcggcacactcggcgttgctgccgcagccctcgcacacgccgagaccgccgttgccgccagcgttgcagacctgtcccgtcagacagccctgggcgctgccatcggcgccctcgagacacgtcttgcagctcttgctggtgatgtcacagacaggcgtatcaccgccgcactgcgcgtcgctcaggcactggacgcacacgccacgtccgttgtccgccgcttcgtcgcacaccgtgccgctgccacatcctgccgcgcagggcgagtcgtcgggcacgcatttctcctcgacgcacacgtacggggtcgcccccgtcgacgcacagtccgatgaggtctcgcactcgggcgagcaacccgtcaccccgagggcaacggccagcacgccgagtgcagccaagacacttcgttgtctgctcatgttgggtatctccaggttggctgcgcaattctcatacgcgccgccgcagcaagcgtccatgcacttggcctccaacgcgggccagtggacgtgtcacgcgccggagtcacaccgcttgtgcatcaggaaccgtcggcgagtgctgatggcatgcgtggctttggcagcccacgcagcggatgtccccgccactggatgtgtttagatagagagtggcgccagacttgcgactcatggaaggccggagagcctccagcacgccctgcgtcacggcctgacgcgccgcctccaaatgactgccccatgccgaggccctacccagtcggccccttcttctgcttcttggggtccgcctcatccccctcctcccagacgggaggcggtggcggcacgtcatcgccattcatgagctgcacctcttcgttctcttcggcgctcgcaggcggccccaggaacttgcgcttcttatggttcgacggcgcaacctgtcccgagcccgagaaggactgcgacgacggggcgcctccactgaagcccgagttcgagaacgccgaagtcccccaggccgctgggtccatcgcctgggtgacgtcgtcgtcatcccagccctcgacgacgacgcctggcttcttgcgcttgattccctcggaggaagtacggccatcgccggcggacaggaagtccaggtactgcgactcctcgacgacctgccccttccacgtcgcgctcttgacgtggacctctgtacagcgcctgcacaacgcctccaggcgctcgcgcagataatccagcgtccgaggcgcgtgtttgtcgagcttccccaattccgtgccaagaacgatgcgcccctcatcgtctcgttcgagcacgagcctgcggtactggccgctctccaccttctgggtgagcacgtccaggtcctcgtcgaacatcgccttgttcttctcgtagtccttgtccgacagcagccccgtctcaggggaagtcgcgccggagaagagcagcgttctcaacgagaccacgttcggctgccacaagacgctcgtgctggagtcatcgcccatggaggcagactggctcatcacgtccgagacctcttgcacgtggaggtccgacgcctgctgccgcaccacggcaggcacgagcacgttcacctgcgggacgaccagcaccgtacccaggtgctggtttgcccagccgatgagttcgtcgatcttcttcgtcaggtacgcccacgtcttgggcgcattgcccggcaacctggcgacgcccgtcccgatgtccacatggccgcgcgagtggttccacggcaccaccagtgtggtgtacttgccgctcttcaggagctggacggcctcggcacagtcctcatcgatggcctgctggttcttcgcgaggtccgcgtcctccatccccttgcccggcacccagcacgtgcgaatcccgagcgcgttcgagttcatccggatgacggcctgggtgtccggctgggggtatctggccttcttcgcgacggcgttctccccgaagaggaagagtgcgtgcgggtggtgggtgggtgtgtcgaactggaagtagcacgtgtgaggccacttgcagaccgggcccaccgtgggcggagccgacgtggcggtggcgctcttcgtcgacgtcgccgctgagcgcggagactcgacggtcttcgaaccaggcggaggtgtcggcccctcatcgcggcggcggcgctcgctgagcgccgccagttcggcggggaatgccgcggccgcgggaagcggcgcatccgtgggccccaccgcctcgtagtgtgcgttgcccaggttcgccagccggagcaggggccgcgccgcgtgtccctcggtgcgcggcacgaagtccaccaggtccgtccagtacgaagtcgcccccgtccgggcgaacatctcgaagcgcacctggaacaggtgggacgccgccgccagcaccacgtggtcgccccaaaccctgtcccggctcatggcccgcaggtactggcgccaggggtccatgcccgccacgcggcgataggcgggctcgtgaggccaggcctcacggtgccagtcgagcagcagccccatgtcctgccggaacgtcgccgccgtcgcgggccccaccattcccccgtcgtccagcgactgcccggcgagcaggtcctccaggtgattgaccaccgcctggcgcacctcgcggtggtgcgcctcggtgccgaagaacaactgggacagcgagcggaacagacagtcccccccgcccgcgttgtggacccgcccctggtggatggagcccaggtagctgtccagcgagatgccctggccgcccccctggtccgtccccatctccgactccagcgcgggccgatggtcccagtacgcctcccggtcgaagcccgcgctccgcagcgcggcgaacgtctccctccactgcatggcctccgccacgagcgcgttggaacgggcatggtccgaagcggggaccttctccgcggcgtccagaatcgcgccgagcgcctccgtggcttcgtcatccgtggcctgggacttctgataggcggcacacagcgctgccaagtggcccagctcggaggacccagtctcggtggtgacctccacctcctctacgaccagcgcctcctcgccgctgtagatgagccgcaggtcggagacgagcggcatgtggtcgctcagcttcttcgcggcggccatgacttcttcccagcgcgcgtcctccgagcccgtgagcttcacgcccggggcacgcaggtggtcgaagagccgcttgtcctcgggcagcttcgcgtcctccagttggatgagccgccagaatggctggaggtgcctgggcagcaggtcgccgtggatgaaaaagagccccttctccttctcgtccgcgagcgccatgggaaacgggatgacgtagaccgacgactgctccagcatccagccatcggtccgccgtgagtacacgagaatcttgtcgtagccgctcgccccgtagcgctgctgcggaggcgtgatgaacgactcgatgtgggccagcacgtcctccgcggacgagaacattggccgcaactcgtggcccgtcgacatcttgaagggggcgaacatctccggcttcacgcggctgttgacgaagcttcggagcgtcttgagcgagccgtccccgaacgccttctcgctgtccacggcccaactgccgaacttgctcttggcgatggtcgagagctggggcgccatggcgtacagatggctcgcatccgcccccggccccagcagcgtctggaagaactggtggaacgacaggcgctccacacaggtgtcgatgtacggcgtgccatccttcgcgagctcggccttgggccgcgcggtgtcgatgttcaggtccgagagcaccacaccgagcaccttctcgcggcgctcgtccttgcagtactggaggaaggcgcggaagtccgtgccgcgcgcgttcttgttgcggtctcccggcgcggggggatgccatgccaccacgctcacctcgggcgcgttccgtacctgcgccagccgcaccggaatccggatgggctcacgcttgctgtagagactcttgacggtctgcgcctgctcttcctccgcctcgtcccccatcgtggtgtcgatatccatcgatgaggattcgccacccggcgagcgcttcgccacgtaagcactgaggtacgagatggccgattcgtccacgtccagcttggacttgcgccacaggacgccgtacgcctcatcctgggtgtagagccccttgacgggcttgtcgggcacctccgcgggccacgacgcatagacctcctcaccgcgcgccttgcactggtcgttcagcgcatcacggatgcgaaggaactcgcgcagccccgcgtgcgactccggcgcgtcctccacctcgctcttgcgctccaggtactcggcgagcttcttcttgtagacgcgctgcagatgcgcgtcgttggagcggtgcaggatgttctcgaggacctgctcctgcctggccgggacatcctcggcgtccaggcccgcgatgaccgccaggtagcggtggaacaggatgccgcagtgctcgcggaggagcgcgacgccaagcttcgccaggtcgtcccgcttcgccttctccttcgcctccgcgcctcccttcttcgagtccttctccgtagacgagtagcggttctcgtggggctggagccagtcgtagtagccctcctccacgagcagccgcacgcagagcaggcagtaggcatccagcttcgccttcttcttcccgtgcacgtcgatcgacgtcgcgacgagcgcctcgggtggttcctcgtcttcttcgccgtcctcgcccttcgccttcttcaccggaggcctgccgaagcgattcacgaggtctggctcacatgccgcccaggccgcatcgagccggccctcgatgatgcccagcttgtcggctcccagcgcctgcgaggtctcgctccactcgatatgggaggggtcccacgcctcggcgcccgtgtcctgctcgtctcgtggccagatggtccgccgcacgtgctccgcgaagtacttcgccaggtcgttgaggagccccgcctcctgctccgcaatctgaccgaccagcgtgtcgggggcagtcttgacctggtagccattgggctcgacgaacgccgacgccattcgcatcaacaccggaagcttcgtcccgctgcctccgcggcccgtgtgttgcttcatctggaccggaggcttgggctccaccagacggatgccacccttcttcttcagctccaggatggtgacgatgtcggcgttcgccgtgcggatgacatgggccagggcggcaatggtccacggcttgcgcaccgggagcgttccactcgggcctccgcccaggtccgcgatgttccacaggagcgtccgcaacgggaagctcggcggaacgacgggcttgtcggagacggtggtctccgagcccagcggaacacagcgctcctcggcgacgtcgtcgcccatcgtgttggacggtggcgactccgggggcgagatgtcgtcggtgaccagcgaggcccggagcgtctcatcacgcatctcgttgctggagagtcggtacggctcctcgtcgtccaggaagtcgtccaggacgtcgtcgtagtcgccgctctccagccgctcgacctcggtctcaatcgagccgtggaaggggggagtgatgggaggcgccgggaccagcaccgcgccgcattccaagcagcgcggcggcgtcacggacaggtcgcgcatcgtgccgagcgcgcagttggggcactgcatgacgaaagacctccggtgctacgagcggtgcaacaggcccagcgcggcgcaggtcgcctcgtcggcctctccgctcagaggcagcccgagcgcgtactggaaccactccacggccaggcgcgtcttcgggccgaactggccacgctcgccgccacaggagaaccccaggttctccagccgctcctgcaagccctccggagcgctcgtcgcgcgcagcgccgcgaagcgcagcgtcaccttgcgctcgtcgtcgcggccgggcgacaccgtcacctcgccccgcgccgcgcgtgcgggcagaacctgcgccatgcggccctccgcgtccgtcatgccctcgcgcgcgggcaattcctcctcgtcgtccagccacaccttcaacaggtagggctggtgcgctcgggggtggtgcgagccgtaacgcagcacc

SEQ ID NO: 870 - DNA, 7518 bp, Myxococcus xanthus
tgctctaaggctggcgcgctcgtaccaggagggccaggcgcgcatcgacggcttcctggaggactacggtgacctggcctcgggcctcaccgctctctaccaggccaccttcgacgtgaagtacctggaggcggcggacgcgctggtgcgccgggccgtggacctcttctgggacgcggagaaggcggcgtatctcaccgcgccccggggacagagggacctggtggtggcgacgtatggcctcttcgacaacgccttcccgtccggggcctccacgctgacggaggcgcaggtggagctggcggcgctcacgggggacaagcagcacctggagttgccggagcgctacgtggcgcggatgcacgacgggctcgtgcgaaacaccatgggctacggctacctggggctggcggcggatgcgctgctggagggcgcggcgtccgtcaccgtcgcgggcgcgtccgacgacgtggcgccgctgcgggccgccatggaccgtgccttcgcgcccacggtggcgctggcctggaaggcgccagggcagcccgtgcctgcgttgctacaagggactttcgaaggacgtgagcccgtgaagggacgggccgccgcctacctgtgccggggcttcgtctgcgagctgcccgtcaccgagccggacgtgctgacccagcggttggcggcgctcaccggcccctgagcaggggccggcgcgccctgcgtcacttgacggccgtcaccttcagcgcgccgatgagcggcgtgatttcggcgttgccttccttgccgaaggcgaagtgcgtggcgtccgccaccacctggttgaaggtggggtccaactgggtccactcgcccacgaaggcctccacccattcgtgccagtagagggcgggcacgccgtcctggttcatcatgtagatgacgccgtccacgcgccgggcgggcacgcccgccgcgcgcagcagcgccacggacaggagcgagtgctccgtgcagtcgcccttcttctggctcagtacgtccgtggcccggtccgcgctggcgccgtagtccttctccaggttggagtacacccaggtgttcaccttctgggcgatgcggtacgcatccttgtctgtccccacaatctgcttcgccagctcgcggatggccggcgcgtcgctctccacgacgagggtggacttgagattctctccaccctccgggtccttcagcggtaggggcttgcgcgccttgggggcggcggcggacagcgtcacttccacgctgccgtccgcctgcggcttgaactgctgccggtacgtctgctgctggaacttcgcgggcaggccctgcaccaccagcgtgacgtggccgggcacggtgcgcgcggactcgggcagcggcttgggcagcaccactcgggtgaggccgaagacttccaccaggtccagccgcttcgcgacggcctccgtctccttccgggcctgcatcgtcgtgccgtagtccaccagcaccatctccccgcgctgggtgatgtacgaaacgacggggaccttctccttctccgacacggtgacggccttgcccagcttcacctgtacgccgttgatggtccgctgctcctcgggctccacggtggtggagaggccgtaggactccaggtccattccatccagcgagaagcccgtcaccttcgctttgcgcagcagcgccacgcgcggcgggtcggcgtcctccacccgctccttcgtcggaggccgcttgggcagcgtctcgtcggggcggcccgggcgcttgcgcaccacctggaagccgtccgcggtggccgtgcccaccagcgtctgcgtgccgccgtcacccgtctgcttcacgacgaaggacagcaggcgcccaccgggcttcgcctcgtagatgcgctcctcgtcgtgcatgcgctccgacacgcgcgagcccaccatggccttgaagacgagctggttggtcgtcttcacccgcgcgggctggcccggcaggacttccaggtcggtgaagagccagccgaccttcttgtccatgaggtacaggccgaagaattcgccgcccttgggccgggcggccttcaccacgtcggagacgggggcctgtgtggcagtggccttggccgccggggcgggcgccctcgcgagcgcggacggtgcgcccaccagcagggcacacaggggcacgagggccagcaaggtcggtcggtgcgtgcgagtcatcgtgccccttctaacgagggaaggggccgttgtcttcacccgcccggcctcgcggcgtagggattacagccgcttggtgaggatgatgaggtcgtcccccaccttgtagaagtcccggatgcgggcctcctcgccgtacttcatggaggcgtagaagccgcgcgtggggccgtaggcctcggtggcgctcgtctccacgcggatgaggcgcccgttgcggcggcgcaggtcgccctccatggcggacaccagcgccgcgcctacgccctgaccgcgaacttccggtgcggacgcaatccagtacaggtcgtaggtgtcctccgtcatcggcgtggggccgtagcagatgtagcccacgagctcgccgtcgcggtccgcgacgatgatggcgtagtccgtgttgcccggcgtgagcgtggtgttcgccagctcgatggcgacctcaacctcctgcggcgagaaggtttcgatctttcgaatcagggcggcgattggcgcccgatccttttcttcgatgggacggatgtccatgtgctctctcgagcgcgacctccacgagccgggacgccagggccggatagtccattccggcggccagggcggccttggcgaaccccgcgctcggatgaaggtcgcagttggggttgatgtcgatgacgtagggcacgccctccggggatacccggaggtcgacccgtccatagtcctgacagtccagtgctgcaaaggcttccagcgcgacctgcacgcaacgggactccaggttcgcgtccagtcggcacaatccgctggtggtgtcccggtactccgccgacgccgcctcccacttggcgttgtagcacacgatgttgggtctgtcctcgaacgtacgaccgaagacgatttccgtcaggggcagcgcctggcgcggccggttgccgagcagcggcacatagatttcccgcccggggatgaactgctccaccagggccggctgatgaaactcacggagcaccgcgtcacaggcgcggaccagcgcggcgcgctcgtgcaccacggactccgacgtcacgcccatgctggcgtcttcccgcgcgggcttgacgatgagcggccagggcaggtccaccgccaatgcatcctccaggcgctccaccacgtggaagggcggcgtggacacgccgcgcgcggtgaggacttccttcgccttgggcttgtgcagcgccagccccagggacagcgcgctcgagcccgtgtaggccagccccagcacatccagcaggcaggggatggccatctcgccccggctgtcggccgccaacgactcgcagaggttgacgaccaggtccggctggcaccggcgcagggtgtccatgaagtcgagccggtcaccttcgatggcgagcggttcggccagggtgtcgccccggttgagggcgtccgccatggaggagacgacacggaccacatcctcccgggcctcccgcccagggtcgtcctcaaggaggtcgtggtcgcggttgtgcagcaggatgatgtgcattcggtggtgcgggagggttaccacgtcccctgcctccatcacagtccgcacgtgaggccggctgccccccggaaaggttcgcggtacgtttgatgacgtccccagggggtatccaggagtatggaaagggaatcatgcgcatccgtgaccccatccacggcaccatcgcggtcagcgaccccgagaaggccgtcatcgacagtcggcactaccagcggctgcggtatgtccgacagcttggcttcggggacctggcctttcccggggccacgcacacgcgccacatccattccctgggcgccatgcatgtcgcctcgcgcgtgttcggcgcggtggctgcccgctcgtcgctgccggaggatgtgcgggagcgcttctgtgcagcggtgcgtctggcggtcctctgccatgacctggggcacatgccgctgtcgcatgcctcggagcgcatcgccccgaagcgctcgctcctgcgcctgccatcctggctggacggcaccgcggagggcgagctggccacgcacgaggactacacggcgaaaatcctcctcgacagctcgctgacgcccatcatcgagaagcacttcggcggcatggggattacgcccatggcggcggtggcgctggtgtcgggagcgaagccgccgaaggacccgggcttcacgcaccagggcgtggactggacgccgctgctacgcgccatcgtctctggtgagctggacgcggaccgcatggactacctgctgcgcgactccttctacacaggcgtcaactatggccggtacgacatggattggattgtcagcaacctcaatcccgcgatgaaggacgggcgggcctacctcgccctcagccgggcggcggccttcgccttcgaggacttcctcctcagccgctaccacatgttcgtgtcggtgtacctgcaccacacctccgtgaacttcgactacatgctgcggcgctactacgaggagtcgcccggtgagttcgagattccttcggatccggaagagttcctgctctgtgacgattcggcgctctggtacacgctgcgccgctccaagaatccgtgggcccagcgcatcagccagcggcagggctacaagctgctggcgcagttcacggagcgggacacgggctacgacctggacgtgctgcgcagcgcgctggtgtcccacaagttcgaccactacgtcgtcgagtcccagaacgtgctcagcaagtacacctccgggccgtctggccgagggccgagcctgtacatcatcgacgcctccaccggccggctgaccgaggtggcgcgctacacgccgctgtatcaacgctacagtggagcggtgcggctcgtccggctgtacgtccggccagaccaggcggacaaggcacatgcgttgatgggccgggtactcggccaggcggtggagtcatgagcgagcgtcttcccagtctgggcctgggcctggacctgctggcccacagtccggtggaggcccgcccttcttccgtggcgctgttgtaccggcgcgcgggggagggcgtggaggtcttctgggtgaagcgcggcaaggcgcttcgcttcgcgggcggcttctatgcctttcccggcggcaagctggacgcggccgacgcggacgtgccggtagcgggcgccagcggagaggaggcggcgctgcgttcggccgcggcgcgcgagctcttcgaggagacgggcgttctggtggcccacggcgccgaggcgctgtccgccgcgaaggtggcgtcgctgcgcaaggcgctcctggacgggacgctggggtggggcgctctgttgaaggcggaggggttgtcgctgagcgcggatgacttccgggccgcgggccggtgggtgacgccgccgtcgctgcccgtgcgcttcgatacgcgcttctacctggtggagatgcccgcccacgcgcgcgcggagtggtggcccggcgagctcgcggagggcgcctgggtgaagcccgctgatgccctggcgcggtggggagatggcacggcgctgctgcacccgcccgcggtgcatgccttccaggtgctgggcaccttcacggatgcgtccgacgtcctggcgcgcctggcgtcgcctccgttctgcccgggttacgtctcgcagcgcatcgaattccagcagggcgtgcgcgtggtggcgctggagacgcccacgctgccgccggccgcgcataccaacgcgtatgtgctgggcaacggcgagctgctcatcgtggacccgggcgccgcggacgtgaagcagtacgcgaagctgctgtcgctggtgtcgggcctgaaggcggagggactgcggcccgtggcggtggtgcttacccaccatcacggggaccacgtgggcggcgcgcgcgcggtgaaggaacgcttgggcatcccgctgtggtgccacgcgcgtacggcggaccgcctggacttccccgcggagaggctgctggaggacggtgacgtgctggagctggcgggcgaggtgccgcagcgctggcgcgtgctgcacactccggggcatgcacaggggcacgtgtgtctcgtggacgagcgcagccgctcggcggtggtgggggacatggtggccggtgtggggaccattgtcatcgacccgccggaggggcacatgcgggactacctgacgcagctcgcgcggctgcgggactggcccgtgagcacgctgtatccggcgcacggctcaccgattccggacgggcccgcgaagctccaggagtacctggaccaccgggcggcgcgggaggcactcatccttcagtccgtgccacccaacggcgccacgctggcgcaggtggtatccctggcctacgcggacacgccgccgctgctgcaccccctcgcggagcgcagcgcgctggccaccctggagaagctggtggaggaaggcctcgtacgtgaggagtcgctccagtacttccgcgcctagaagcggccggcgagccccagcgccccgcctcccggggccaggctcaccgtgggcaccatcaccacggggcgctcctgctggcgtcgccgctcgtaggcgccatgggacagctcgaacgcgaggatggacgtcgccacgggcacggcgaaggtggcggtgaggaccgcccaggatgcttcgtccgacagcgccacgacggccaatggcgcggccgttcccaccagtccgcccagcagcgtgggcaggaatccgccgcgtgcatccatcagcgagcctcccaggtacacacctgacgccgcgccgagccccatcccaatcgaagcgctgatgaggctgaggttcctcccggaccggcactcgctgtagccgcaggacacctggtccgacacgaggacgcctccgaggaaggtcaccgcgaggccagaggcgccaatcagcgcgccacccaccgtttcgcccaccaggcgcgcgcccagcgggaacggcgcatcctgggacggatgtatccggggagcggccggtgatggacggcccaccgcgggccgctgctgcgtggccgtcacgggccctggcatccgcggcgcgtcatccgttggctgggcgagtgcgagggcgggcagcaggagcgtcagcaggatggggcggttcggatgggagagcatgggcgctggtgctcgtagtgagagcacggtgcgggcacggatgccatcgcctccctgatgggtttcgcgctgaacggacggcgcgcggcgtctcgtggcgccgcgccgccggcgcgcctcaggaggactgcagcgcggggcgggggcgagttccgtggg

SEQ ID NO: 871 - DNA, 8578 bp, Myxococcus xanthus
tccgtccgcctccgcgccctccggagcggcgcgcaccggggcgtccggccacgcccgcagcagcgcatggagcgcgcttgcccccgggggcatcgaaccacccggactggcgcgagacggcgctcgcccgtctggcatcacttcctcatcgcgaccaggcgtccgggctcggcgtcggcccggggccggagccgcccggcgacctccgccaccgcgtccgccacctgctccagtgccagttcctcatcgcggttgatggcggcccggccatctcgccacaccagcagcatcgcacccagcacctcgccgtcggcctcgagcgtgatgcggacctcgaatggcacccccgagcccgcgggccgctgggcttcgaagacgacgttgtccgcgagccccgtgggacggacgcgctggaagtgcaactcctggcgcgacaagcccagggcatccgccagcgggcgcaccgcgttccacaccacctccagcgaaggcgacgcgcgcacggcgcgggtgacgtccttcaccatggtccgcagccagaggttgcgctgacgtacctggtgcatgcccctggcgcggcccaggtccaggtaacccagccgccgcatcagcagcacgatgagcacgcccatgccacacagcagcatggcgctctgtgcgctgttggcgaagttcagcgccagcgccaccagcatgaagaggccacacaggccatacagcaccagcacggtagcgcggtggctgagcaccaggtggctcatcagccggtgatggatgtgctcccggtcggcgctgaacatcggccgccccagcaacgagcgccgcaccatggccagcagcgtgtccatgatgggcagccccagcgccatcaccggcaccagcatggccaccgccgtgccgctcttggtgctcgtcttgatggacaccgcggccagcacgaagcccaggaacatgctcccggtgtcccccatgaagatggaggccgggttgaagttgaacaccaggaacccgaggatggcgcccgccagcgccgccaacagcaatgacagcagcacgtcgcctcgcgacagcgcgaggatgaagttggtgccgacgccgaagaaggccacgccgcccgcgagcccatccaggccgtcgatgaggttgagcgcgttgaccacgcccaccacccacaacacggtgaaaggcagactcaacgcgcccaacaccaactccgggccgaatgggttggcgatgacgtcgatgcggaaccccatggcatacaagccgaacgccaccgcgaactggacagcgaacttcagacgggcgcccgcgccccgcaggtcgtcgtagaggcccagcgccacaatcgccgcgccgcccaggaacaggcccaccaccagctccgtgtgggagcggaagtggtaccccacgccagagtccaccaggaacaacgcgcacagcggcgcgaaaaatccaccgacgatgcccaccccgcccagccggggaatcggccggacatggaccttccggctggaattcgcctggtccagccatccccacgccagggcccggtcgcgcaccagtcgcgtcagtgccagtgccaccagcagcgagacgaagaaggcgaccagaagcgtaatcatggggcgtgcaccgtccgcgcatcgtggcggccggcggctccacgcgtcaatgcacgcgggagtacgataggtttgtgaagcaatgggcctttgcgtccgcccgcagtccaaccaggcaagcgccctttctagacggtccgcggcgagcggagaagcgactcgtaaaggattgacgtgcgctcggcaatgtcccgccacgtcatgtcccgcaccgcggcctgcgcggcttcacgcaaccggagcaggcgagcgcggtcctccgccagcgagcgcagcgccaccacctgcgcggcgacgtctcccatcggtaccaaccaccccgtctcaccgtcacgcacgacctggggcgccacgcccaccggcgtagacaccggcgtgagcccgctggccatcgactccaccagcgccatcccgaagccctccgaatggctggggaagaacagcacctcttcgtcccgcagcaggcgcggcagctcggcgcgtggataacgaggcaccacgcgcacgtgctcgcgcgccccagcgggaaacgccgccagcacctccgcctccgggttgcccgtgccgtacaacgtcagcgtgaaggacacgccttcggcatgcaggtgggtggcgacggccaccatctccgcgcgccccttgagcgccagccagctccccacacacgctatccgcagcggcgcaccaggcgcggaaggcgtgggcgaaggcagcccctggaaggccacatccagcccatgggggatgacactcaactgacgcgcgggcacgcccagccgttccgtcgcgtaggcggcatcctgcgtgttgagcagcaccgcatggtccgcgcgcagcagggtctggcgcacctcccagaggcgatagccgccatggtacagcgggtacttccagctcagcgccaggtgccccgcacgcgcgtcggcgcgcagccgttcggagaaggtgtgctccaggccgtggctgcgcgtcaccagggcatggcgggcccgcgcccccggacggcccaagcgcatccagggccacgcatccccagtggtgatgtccagcacgtcgtaccgactcgcggcccgcagcaggtgtgcggtgagcatccaggggaaccgcagctcgtgcaccgtcgtgtggtgccgcaggccgggataggcgtcgtcgtagctgaagtagtccacctggcagccccgcgccgccagcgcctgccccagcgcgagcgtcacccccggcgcccccatgtccgggttcaggggatggtggatgccaagcaggatgcgcatgagaaggtggcggacttctagaacacccggagggggcctgcctgcttttcatggatgagcggcgtgggcgagaatggcaccgttccccatccccatgtccctgcattccgctcccacgttgcaggcgagcctcgactcgcgtcgcaacaacctggacttcctgcgcttcgccgcggcgacgtgcgtattgctcagccatgccttccccctgggcgagggcaaggggacggtggagccgctggagtccttcacccggggacagttctccctgggacggctgggcgtcgcggtgttcctcatcatcagcggcgtgctcatcacccggagctgggagcggacgcccgacgcggcgcgcttcatctgggcccgggtgctgcgcatcttccccgggctgggggccatgctgctgctgacggtgggggtgctggggccggccttcacccggctgtccctgggcgactacttcacggccccggacacggccctgtacctgctgggcaacttcgccctgaactggccccagtggcacctgccgggcgtcttcgaggcgaacgcctacccccacgccgtcaacggctcgctgtggacgctgaagtacgaggtcggcttctacctgctgacgctgggcctgggcctgacgggcctcttgcgcaagggcatggtcatcttcggcctcgtcggcgcggcggtggccaccttcgtcaccggacggctgggcttctggccggagctgtacctgtacttcggcggcggcgtggcgctgtaccagtggcgcgaacacgtgcgcatgagcccctgggtggcggcggcgtgcgtggtggggtggctcatcacggcccggctcggatacggctgccgcatcgccaccggcctgctgggcggatacgtcgtgctgtacctcgccttccggcccatgggggcgctggcggacttcgggcgccggggcgacctgtcctacggcgtctacctctacgccttccccgtgcagcaggccgtcaccaccctgctgggcgggcccacggcgtggtgggtgaacgcagcggtggccttcccctgtgtgctgctgctggcggcgctgtcgtggcggtgggtggagcagcccgccttgcggcgcaaggacaggctccccgcgtgggtgaggcgtccggcggtctccgtcacagcggttccgaagacgccgtcccggccggctgggccgcactgaagttgtcgcccgccagccggtcatacgtgagcaggcggtagcgccgcatccagtcctcccatgagcccggctcctgggccttggggaccttgtcgcccgcgggcaggtattcgccggaggcgttgcgcagcaggtctccccggaccacgggcagcaccttggacaattcggagacgaaggcgaagaagcccggaggccgcagccccgccgtctcgaggatgcgcggggtgagcatgctgatgctcaggtggatgtcctgccggggcacggggaagttcgtccagaggacgacggggacctccgccatgcgctcgcgctgcgcgtccgtccatggctcctggaagtagccggcctcgcgataggtcgcgtagtccgagcccagcatcggcaggtggtccccgaagagcaccagcagcgtcttgcgtttgcgagcctccagcttgcgcaccagccgctccacggccgagtccatctgccgcagcttgtgcacgtagttcttcaagagcagccggttgtccggcgagagcttctcgccctgcacctcgatccgctcctcgccggtgagcggcaggttgtagggcccgtgggtggacatcgtcacggccatgatgaaccgcggctgacgctcgtcggagagctcgtggaggatgtggtcgacgacctcctcgtccgacacccagggcccttcgagccggggggaagtgaagtccgtgagcgactggaacgtgtcgaagcccagcaacgggtacaccacgtcgcggctccagtagaacgcgtggaacgggtggatggccagcgtctggtagcccgcgcggcggaacagcgacggcagcgcgtccacgggacgcatcacatagtgctggtagggaaacgcgccgtccggggcgaacgacgaggacatgcccgtcaggagttcgaactccgcgttggccgtgccaccaccgaaggccgggctgatgaggttgcccgagctgtggcgctccatgagcgaccgcacgaagggcagcggatcctcgctgaaggggatgcccagccgcgtcgggtcccagagcgattcggccatgaagacgacgacgtcgacgggctcctggggcgcggcgggcaccacgcccggagggccccccagggccgcgtgcacctgcgcctgggagtactcactgcccggctccagccgcagcccctcccagttccagagcatcatcagcgtgagcccgttcatctggaagttggagcgctggtcccacacctggtcgtagatgccgaagcggttgaagacgcgccgcacgggcaggtgctgttggaagatgatgaccagcaggtacgccaccgccgccagcgccaggttgcggcgtccggccttgggcaacgggtaccggggcgtgccgcgcgccaccgcgcgccacatgacggcgagcatggccaccagcagcagacacgagccaatggccgccaccgcgccgccgccgggcagcagcgtgggcgccagcgatgtcacctgccgccactccaggaagtcccagggcatcagcggccggtcgatgagctgcaccttccggatgtgcagggtgacggtgaagagcatcgccgccgccaccagggcccccgagattcccacccggttcgtcaccgcccacagcaggcccgtcaccgcggagatgacgcccacgctgaggagcatggagtagacgttgcgctgggtgatgccctccaggcccgaggacgagaagacggcgatggtcagctccatggccccgacgagcaccgccgaggccaggatgacgcccaccaacggccacaggttggaggggggccgctggaagaacaaggtcttgggaatccgtgcgcgacgtgccaacgacaggtgcctccaggagccgaccagggagcgggagggcgcggagactacccgacaggccccctggcgttccatgcgcctggggtcggggttctgccgcctgccacgctgtgtgcgggcgggcatccggcggagcgccccatgccccgtgtacccaggctcacttcatgggtggctgggccagcagcgcggcgccaatggcaccggaaagttctcccagttccgcgacgcgcacgggcggctggcgctcggggacgaagatgtgcgggcgcatggcctcgtggatgcggccggcgaattcaggccccagccgcgtgcccaggcctccgcccaggacgactgcctccacgtccagcaggttgatggcggaggcgagccccgcgcccagcatccgcaccgcgcggccgaagagccacgtggccagtgcgtcctcctgcgccagcgcccgggcccagatgctgctggtcaaccgggtgcggcccttcttccgcatcaagtcgaagagaatcgtcgtctcgccctggcgcacggccttgtgcgcacggcgctccatggacgcgcggcccgcgtaggcctccaggcagccgcgccggccacaaccacaccgggcaccgcccggcttcaccaccatgtggcccacctcgcccgccgcgccccggcctcgccagggcacgccgtccagcaccagcccaccgcccacgcccgttccccaccagacgcccagcagggagcgaaatgcgcggcccgcgcccagccggtactccgccgccaccgccacctggacgtcgttgcccagcaccacgggccggcccacccgcgcgcccaggtcccccgccactgggtagggcgtgctccagccccggcccacgttgctgacatgtcccagcgtgccctcgttggcgttcaccgcgccgggcgcgcccacgcccacccccaggagctgacgggacgtcaggcccgccgcgtgcgccgcgccctccaaggcgtcgtggatggcgcgcaccacgtcgccgggctcgccgtcggcgggcgtgggctggcgcatcttccccaggacggtgccggcgcggtccaccaccacggcctcgattttcgtcccgcccaggtcgacgccgccccagcactccagggtgtcgcgctccgccgccttccctcgcgagcccaccgcgttcgcctcccgcatgacacgcctccccaacgaagatgcgcagtccgccacggaccgggtgaaggcggcgggaaggcaagggagcggccggcccgcgtgccgcccggcctgtccgtgagcaacgattccccaccaacgcttccacggcgcctcgcggggcccgctagaaaggcgctccacacagacgcgcgacaggaaaggggcaagggatggacctcatcggacagctctctcagcagctcggagtgaatggaacgcaggcccaggggctggcgggctcgctgctgaagttggtgcagggcacggtgcaggagaagctgggccccgacgccgcgaaccagatgggccaggccattccagagatggagagctggcagcaggcccccagcaccacgtccgcgccccagacggcgccggatgcggggggcgggctgatgggcgcgctgggcggcctcatgtccggtcaggagggcagcacgggcggcatgctgagcgcgctggggggcgtcgcggggcaggccggtgatgtggccgccgtggtgtccctgctgggccgcttcaacatcgacgcgagcaaggcgtccttggtggcgcccctgctgctgaacttcctcaagtcgcgcctggaccccgcgctcgtgggccgcatcctctccgtggtgccgctgctggccggcgcgggcggtggtggcaacacgcccggcggtggcggccttggggggatgctgggcgggttgttgggcggcggacgctgacgcccgcgccgtcagcggcccgacacgcgctggcgcacggtggtggccagcgcccacggcgggaagcccagcatgtagcgccagcgcggcaccgccaggtggagcggcaggccgcgccggtacaagtccagcgccaggtccacgcggcgctgggacaacaaccagtgcgtcacgtggcgcaggctgtagagcagcatctccagccgctcacgcctgcgggccgtgcctcccgggtagcgccccaggcgctcctgctccaggagataccgcgtaccccggtagccggactccagtgacgtggacgtggagcccacgtgctgccggtagcccaccaccacgggcgcgcgcacccaggcgaagcccgggtccgtgcccagccggtacagcaggtcgtagtcctcgccactgatgcgcagcggggtgaagccccccacgcgccgcagcgcctccgtgcgcaccgccagcacgcacgcggtgcgcggcgtccggtcctccgcgctggccagatagtccgcgaagcgcagcacctggagcggctcgcggctcacggtcgccagggtttcggcccgggagaacagcgccgccgtgcccagcaccagcgacgtcccttccgcctcgagcacccgccggtacgtggccagcgtccaggggaaccacacgtcgtcactgtccaggaaggccacgtatgtgccccggg

SEQ ID NO: 872 - DNA, 4176 bp, Myxococcus xanthus
gggaaggaaaaaccgtcccgccccccagtcccacatgagcgttggctgtacgacggctcgcccgccaggcgaggcgccgggacaggaggggtgctgacgcgcgacacttgtcagaactacatctgcgggtggagcgttgagggcctgcgacgactgcccccctgagctagaggcgaccgacacgtgctgcgcattctcttcttcctgatgtcgaagctgccagaaggcgcccgccagcagatggtccgcgccctgatgaacggcgtctgggacaccctggcgaacgagaaggtcctggggcgggagaacatcccggaccaaccctgtctctttctctgcaaccacctgtccaacgcggacggcttcacgctggaccgggccttccggccgcgcaaggtcgtcttcctggccggggtgaagctgaagagcacggtgatgacgcgcctggcttcggagacgatggagaccatcgccatcaagcccaactcgcccgacatcgaggcgatgcggcgggcgctggacaccctcaaggccggcaagtcggtgctcatcttcccggaaggcgcgcgcagccgcacgggcaccctcacccaggcgaagaagggcctgtcgctgattgccaagcgcgcgggcgtgcccgtggtgccggtggcgttgcagggcacggagaagctgatgcccatcaacgactcggacatgggcggcgagcggctcttcaaagccgacgtcttcgtgcgcttcggcccgcccttccgtgtggaggcgctggaggccgaggtggcgggcgccgaggacccgcggcaggccctggtggatgcgatgatgcgccgggtggcggagctgctgccgcccgagtaccgcggcttctacgcggatacctccgctccggcggctccagccccggacctggagcggccttccgcgcccgcgtcctgaatgaagcattgcggcgcgcgccgggacgcggacaatggacgctcccgtgacacgcgcccgcaccgacgaacagctctttgtctccaccctccccggcctggagcccgccctggaggcagaagcctccgcgctgggctggaagccccgccgcgtggacggtggcgtggagctggagggcccggccggcctgcaccaggacgccaacctgcgccttcgctgcgccagccgggtgctgctgcgcctgggccacttccgcgcgggagactccgacaccctctccgaccggctggctgaactggacctgtctcacgtctgggatgggcgctcgccaccgaagctgtcggtgagcctgaaccgctcccccgtgccagggcccgacgtggtgttctccgcggcggcgtatgcgtggaacgtgccctcggtggagcgcgcggggccgctcgatgaagagggcggaggcccaggcctgacgttgctggtgcgggtggatggcgacgcgttcaccgtgagcgccgacaccagcggggatgcgctgcaccgccggggctaccgccaggaagtgagccgcgcgcccctgcgtgagacgctggcggcgggcatcctccggctggccggctacgacggcacgcagcccctggtggacccgatgtgcggctcgggcaccttcctggtggaggccgcgtggatggccatgcgccgggcgccaggactgctgcgcgccttcgccttcgagtccttcccctccttcgatgcccaggcctgggccgggcgcaaggcgcgcgcggaggcggacgcgctgcccgcgccaggagcggcgattcacggctacgacatcaacgcgggctcgctgggaacggcgcggcgcaatgcccggcgcgcgggggtgacactcgcgttggagcggcaggacgcgcggacgctgaaggcgcccgtgaaaggcccggggttggtggttgtgaatccgccctatggcaagcgcgtgggcgaagccgaagacctgcccgcgctgtaccgggccctggggaacacgctgcgccagggcttcgcggggtggcgcgcggcagtcatccttccggatgaggcggcgctggtgaaggcgctgggactgacgggtgcgcgaagccttccggtgaagaacggcgggctcaagtgccgactgctgctgtcggggctggatgtgacgtgaggcccatgtaatgcgttcgaggtcatccgctacagcaaggcccctggatacgccgatgcgcgccggcttcgcgtccgagacagccgggcaatccggccccgattaaggaacgatgaccgccccgccgctcggggggcaagcgccgagtcctcggtggagcgcccacgaaggccgccatccggatgcgccgcgccgccgtgccgtggtaacgcgggcctgtggaaacgtggttcacgcccttcgagccgaagcccctcgcggacgaactccccgggcgcttcccaaaccccttcgatgagggcgcgccccacgcgctggcgcgccgggcagcggaatggctccagcgggagctccgggcaggccacctcgcgcctggactcgaggcctcgtgcctcgacacgtccgagggtggaaagatgttcggcatcctcgtggtccaggcgcctgacggacgtgtcggattcctccgcgccttctcgggcatgcttggcgggcgatgggacctccccggtttcgcgccgcccctcttcgcccgtgatgagcgcgagcggctggagcccgcgggtgacgcattggtgaagcgcctgatggcccgtgaggcgtccttccgccagtcccccgagcgcgcctccgtcctgaccgcgcacgacgcgttgcaagcgcgccacaccgaggcccgcgcggcgctgcgcgccacacacgacgcccggaagaagcagcgccatgcgaggcgcacggacgtcatggcctcggactcgctgagtgaggaggcgaaacgagcggcgctgcatgcgctcgaccaggaaagccggggggacaaggcggaactgcggagactggaggcggaacacgacgaggcgcagcgggcgctcgcgccccagcgggaccgcatggagcggcggcttcgcgccatggagcgactgcggcgcatcgtctgccgtgcgctgatgaagcgcctgcacgacacctacgtggtgcccaatgctcgcggagaacaccggcacctgcgcggcctctacgccagaggcgagcccccatcgggcgcggcggactgcgccgggcccaagctcctggcgcatgccctcacccagggcttccgtccgctcgcgctcgccgagttctggtggggggctccgcctcccgcgggaggccgggccgccggcgcgtactaccccgcttgcaaggacaagtgcgggccgctgctgccgtacatgctggacggtctccctgtctccgcgccccggcccttcacggtgcccgtgctgccatcacgagggctggacattgtcttcgaggacgaatggctcgtggtggtggagaagccggagggcctgctctccgtgcccgcgaaggacgtctcggtggaggactccgtgctggcccggctgcgcgcgagagctccggaagcagcggggacgatgctcgcgcaccggctcgacctggacacgtcggggctgctcgtcgcggcgaaggacgcgcgcacctacgcggccttgcaacgccagttcgccgggcgcgaggtgcacaagcgctacgccgcatgggtcgaaggcaacgtccagggcgaacgcggcactatcgactttcccatgcgcgtggacttggacgaccggccccggcagattcacgaccccgtgcacggcaagcccgcggtgacggagtggcacgtgcttgaacgcagccacggccgcacgaaggtggccctcttcccgctcaccgggaggacgcaccagttgcgcgtccacgcggcccatccgcttggccttggcgcgcccatcgtcggagaccgcctctatggccacccggggccccgattgcatctgcatgcggaggccctgtcgttccagcaccctgtcacggggcagcgcctcacgctggagcggccggctcccttctgacttcgcgtatctcgcccgcaagcccgcgctgcacgagggcgccgcgacgcccggagcaccatcgacgcgggcccccggtgagggctcccgacctcgctgttcggaaatgtcgggagttttgcgccacgaaatctcccgacatttccgacttgagag

SEQ ID NO: 873 - DNA, 8738 bp, Myxococcus xanthus
  unsure (1)..(8738): unsure at all n locations
gtgcgggggcgcgagcggtgcacgccacctgaaagataagggctccagtggcgtgttcgacggtttccggttcaactccgggttgccgtagtaccgcacgcggccggagccgcccagaagccctgccgccacagcgccacccagccaacgcttccagctcacgagccgcatcgtcatggcgtgtgtttctaccccgcgtccggaacgggtgcagccgccggagcctccggggcaggaaccttcacaccttcggacgccagcaccgccaggcgctcaccggcctgacgcgccgccgccgtgttcggctgcgtcgtggtcagcttcgacagcacctgggccgcctcttccttcttgcccaggaggatgagcatccgggccttgtggtagtcgcccatgcccaccaggaacgggccacccgcggcgcccatctgctcgaaggccttgatggcgtcctcgtacttgccgtccggctcgagcgcgtagccctggccctcgaaggcctccgcgcgaagcggatcgttctgggccgcgcccttgaggtactcgccgaaggccgtctgcgccgcggcgtagttgcccagccggaactgcgccttgccctcggccagggcggtcgacaccgctgttcggggtgccgccgtgctgctggcggaactcgcccagcgacttcaccacggcctcgtcgcgctccttcaccgacttgaaggggggctccgtgtcaccgggctgcgcgggctccacgccctccacgggccggtcgagcacggtcagcgcctgtcccagcgcctgagaggccttctcctcaccgcgcttggacacttcgctggcgatggccacgcccacgccgcccaggatgagcacgcccgcggcgagcccgatgatcttctggcgctgcgcaagccagtcgctcgcctcggtgcccaccttctggaaggagtccggctggctgagctctttctggcgaatcttctcggtcttggtggttccggccacgtctggaaacctcttttaaagagcggcgcactgtatggagcgcgcgccgcgagtgtcaacgcactgacgcctcagcgcttcccctggcgttgaggccgcttgcgggcctcgcgcttggcctgcccgggccggcccttgaagatgagccggatgggcacgcgcaggtcgaacgtcttgcgcagctggttggtgatgtaccgcttgtacatgtccggaacgccgtccggatgattcacggtgatggtgaaggtcggcggcgccgcggccacctgggcgatgtagtacatgcgcagcggcttgccccggacgatgggcgccgggtggttgtccaccatgtggtccagcagccggttgagctgtggggtgggcgcccggaagcggaactggtcggcgagctccgtcgccacatccacgaccttctccaccttggagcccgtcagcgcggaggtgaagaggatgggcgcgtagcccacgaacttgagtgagtgcttgagggactcgcggtaggtctcctgccggcgctggtccgcgcccaccaggtcccacttgttcaccacgatgaccagggcgcggccccgctcctcggccaggcccgcaagcttggcgtcctggtccaccgccggctccgtggcgtccatcagcagcaccgccacgtcgctgcgctccatcaccttgagcgcggccacgacggagaactgctccacgcgctgggcaatggacttcttgcgccggatgcccgccgtgtcggtgagcagcagcttgcggtccttgtacgtgagctcggagtccaccgggtcccgcgtggtccccgccacgtcactggccaccacccgcttctccttcaggatggcgttgaccagggtgctcttgcccacgttgggccggccgatgatggccaggcggatgatgccgtcgtcgggcggcgcctccgcgtcctcgccctcttccttgggcggcagcctggcgacgaccgagtcgaacagctcctgcatgcccaggccatgctcggcggacagggcctgcacgtcgcccaggcccaggcggtagaactcaccggccagcgcctgcatctgcccggacgtgttgtccagcttgttggcggccagcaccaccggcttgccgctcttgcgcaggtagttggccacggcctcgtccgcggcggtgagtcccgcccgggcgtcggtgacgaagacgatgacgtcacactcgtccacggccagttgcgcctgctcccgcacctgctggaggagttggtcctcgtcaccgggcacgaagccgccggtgtcgatgaaggtgaactggcggccttcccactccgcgtccgcgtagtggcgatcccgcgtcacgccgggctcgtcctgcaccagcgcgatgcgccggcccaccagccgattgaacagcgtgctcttgcccacgttggggcgtccgacaattgcgaccaggggcttcatttcagtcgtatcccagcttcttgaggccttcggggcgctcgctccagcgcggctccacgcggacgcgaaggtccaggtacacatgcgcgcccagcaaccgctgcacggacttgcgcgcgtcagtgccaatggtcttcagcatctgcccctgcttgccgatgatgatggccttctggctgtcgcgctccacgaagatggacgcggcgatgcgaatgagcccgcccagttggttcggcggcgtgcccggccggggctcgcgctcggattcgtcgaagatgtccaccaccacggccgtggagtacggaatctcctggcggcagtgccgcagcacctgctcgcggatgtactcggccaccagcgcgcgctcctgctggtcggtgagcatatcctcgtcgaagacgttctcgccttccggcaggtgtcccaggacggtgtggaacagccgctccacgccgtccttctcccgggcggagatggggaccacctccgcgaaggggaactcctggcggtacaggtcgatgagcggcaggagctgcgacttggggacgctatcgatcttgttgatgaccaggaaggtcggtttgccgatcttctgcagccggtcgaggatggcgcggttgcccgggctcacctcgggcttctcgctcgctggcggctcgatgaggaagaggaccaggtccacctcctccgccgcctggagcgccacctcgaccatgtagcggttcagctcgcccttggcctggtggatgcccggcgtgtcgatgaacgccacctgtccttccggacgggtgacgacgccgaggatgcggttgcgcgtcgtctggggcttgggggagacgatggcgattttttcgcccgtcagtgcattgagcagcgtgctcttgcccacgttggggcgcccgatgagagcggcgaagccgctgcggtgtgtcttggggggggccattgcttcggaggtgatctgggacgccgcgtaccgcggaggcccgaaaagggaacgtctggacagcgcctataacaacccaccgcccgcccggtcatgccaggacgggcggcgatcggacaggctacggctgggtcgtcgaaatggtcagcttgttgatgaccacgggctggcgggggcggtcatccccgtcgcgcggaacgccggcgatcttctccaccacatcgtagccgctgagcacctcaccgaagatggtgtgcttgttgttgaggtaggtcggcttggacgtggtgatgaagaactggctgccgttggtgttggggcggccgatgttcgccgtggccagcagacccactttgtcgaaggtccggccgctctggtactcgtcgtccacgttgaagcccgggccgccgcggccggtgcccgtggggtcaccgccctgaatcatgaagcccggaatcacgcggtggaagatgatgccgtcgtagtacgggcgctgcgtcttctcacccgtcttcgggtcctggaagggcagctcgcccgtcgccaggcccacgaagctgctcaccgtcttcggcgcatccttcgcgaacagcttcaccacgatctgcccctgcgtggtgtcgaaggtggcgtaaaggtcattgcccgcgcgggcctcgtccaacaatcccatgctaccctcccgtgtgggggcccgtccgaggacgaacccggtcatgtgtcacggccttggtgaaaccgtcttcgcgcccgcgtccttcttgggcgccgctcccttgctcgccgcgggggccgtcacgcccgcgggagccttgtcgcccagcaccacgcgggtgagcaccaccgcggtgcgcgggcggtcccggttgtcccgaggacgattgctgatcttctccaccacgtcatagccgctgagcacctcaccgaagatggtgtgcttgccggcgaggtgtccgggcgtggaggtggtgatgaagaactggctgccgttggtgttgggccccgcgttggccatggccagcaggcccaccttgtcgaacgtgcggccgctctggaactcgtccgcgaagcggtagcccggatcgccgaagccggtgcccgtggggtccccgccctgaatcatgaagcccggaatcacgcggtggaacaccgtgccgtcatacagcggctccttcgacatcttccccgtcttcgggtcccgccatgccttctcaccggcggccaggcccacgaagttggccaccgtcttgggcgcgtccttggcgaagagccggacgacgatggtgccctcgctcgtctggagcgtggcgtagaggtccttgccggccgcggccttccgggtccatttgccggaatcagcggcgaggacggagcccgccagcaggcaggtcaccagcgcgagcgtctttcggagggaggcggggggcatgtcggcgcggcaccttacgcgccgccccctgccccatccaaggggtttcacgccggggtgtcgtgtcgcggcgttccgggcgggggggaggtgggacacgcagcgtcttcccgcagcttctccagcgtcgcttgcgcggcggactgctccgcctccttcttgctccggccggtggcccgggcgaaggccgtctcccccagcatcagctccacctcgaacaccttggagtgttccggaccggactccgagacgacgcggtagcggggctggagcttgagccgctcgtgggccatctcctggagcagcgtcttgtagtcgagccgcccctggccgctggagacctcgtccagcaggtccgcgaaataccggtccaccagcgtcaccgcggcgtccaggccgctggtgaggaacaccgcgccgaagacggcctccagcgcgtccgccaggacggagttcttctcccggccgccggacatgagctcgccccgccccagcagcagcaggtcgcccagcgggatggtccgggccacgcgggccaggccgtcctcgttgacgacgcgggcgcgcatcttcgtcaggtcgccttcgggcagccccgggcagcgcgccatcaaccggtggctgacggccaggttgaccaccgagtcgcccaggaactccaggcgctggttgtccttcagctccttgtcccgcgtctcattgacgtacgtcttgtgcgtcagggcctccagcgccgtctccatccgggagaagctcaaccccaaccgcgactccaacaactgcacccgctcggacgggctcatcttgtccgcaccactcaaacgcatcactcctgaggtgcgtccgggcccaccagcctcacggccgcgggagggaccttcaacaggtccgccaccatccgcacgatgcctgggaactcatccagctcgaaccgacccgcccactccttgccctgcggccccgccagcagcccccggaaggtgcggcccgccaccctggcggcggcgaagcggtacgggcggccctccacctgcaactgcgccagcagctccaggctgctgcggggaggcaagagcgcctccgcgccgaacttctccacgatgtcggagaagcgcaccagcccggcgcccaccggcgcggcctgaggacgggccgccggctcaccaaagagcgcgaccaggtagcccgtcagcgccgcccgctcgcggaactccgacagctccagcgtgtggccgccgcccgtggccaggtcttccttcccccgggccacgcgggccacgcggaagttgcccagccggtccgacaccaacgtgacggccagctcaccgtccacgacctccgtggacagctccagcgtctccggctccacgcgcggcgtcagccccagcacctggagctccgcggagcggcgctggacgtggaagatgtgctcgttgaatgcgtccgcgagcagcgcctcgatgtcggcgacgtcgctgagcgcgcccaccagaatgggggccagccccaccacggcgggcggcgcgatggggatgagacggtcccccatcacctggaaggtcacctctgggatgaaggcccgggtgacgggattgaccagcggggacgactcaaggtccagcaccgcctcggtgccggccgcgtcctcccgcaactgcagcccgagaccttccagccgcgcggtgtccatcaagcccctttgaaggtttcccgggcgatgattgtacgctggatctcgctggttccctcgccgatctcacacagcttggcgtcgcgcaggtagcgctcgaccgggaattcgcgggtgtaaccgtacccaccgtggatctgcacggccttgttgcaagcccgcatggcggcctcggaggcgaacagcttccccatggaggcctcgcgcgagtacggcttgccttcgtcggccagcttggcagcgcggtggaccaggagccgggcggcgtccagctccgtcttcatgtccgccatcatccagcgcagtccctggaactcgctgatgggctggccgaacgcggtgcgctcgcgcgagtagccaatggactcctccagggcgccccggcccagacccaccgccagcgcgccgatggtgatgcggccgcggtccaggatcttcatcgtgtcgatgaagccgtggtccagctcacccacgcgcgccgagtccggcacctccacgttctccaggacgagctcggccgtgtccgacgagcgcatgcccagcttcccgtggatggcgcgctggctgaagcccggcaggcccttctccagcaggaaggcggtgatgcccttctgccgcttctgcggcgaggtgacggccagcaccacgaacacgtcacccaccgtgccctgggtgatgaacatcttggcgccgttgagtacccagccgtcgcccttgcgcatggccgtggtcttcatgctcgacgcgtccgagccggaccccggctccgtcaggccccatgcgcccaggtactcacccgtggccagcttgggcaggtacttctggcgctgcgcgtccgaaccgaagacgcgcaggtggctggtgcccaggccgttgtggctggccaccgtcagcgccagcgagccgtcgtagcgggcgatctcttccaccgccaccgccacggcgagcgagtccatggccgctccgccgaactcctcggcgacgagcatgcccatcaccccgagctgccccagctcccggacaacttccatggggaacgtctcgtccttgtcccactcacgggcatacggcttcacccgccgttcgcagaagtcacggatggaggactggagggcgcgatggctttctggaaggtcaaaatccatggtgtcagcaggatctatagcagacggcccaagcgcagcccgggccttggaggtggggtaacgctacctactcaaaccggatagacaccgtgtttcttttccgcacggggctgatgccgctgggagtagacgctgtagcgctgggtgagctcttgacgcagccggtcacccgggacgatgtcgtcgatgaccagctcgctggccagcttgtagatgtccacgtcctgcttgtactcgtcgcgcagcttctggacgtaggcgggccgctcggcctccggcagctcctggatcttgttgtagtagacagcgttcaccgccgcctccgggcccatgacggcgatcatcgctccgggcagcgcgatggtggcgtccggggcgaagccggggccgctcatggcgtagaggccggcgccgtaggccttgcggaccaccacgcagatgcgcggcacgctggcctcggacaccgcggagatcatcttcgcgccggcgcggatgatacccgcgcgctccaccttggtgccaatcatgaagcccggcacgtccgccagatagagcagcgggatgttgaaggcatcacacagccagatgaagcgggccgccttgtccgcgctgtccacgaacagcacgccgcccttgtacttgggctggttggcgacgatgcccaccgggcggccgtcgatgcgagccagtcccgtgacgagctcctgggcgaagagcttcttcacctcgaaccagctcccctcgtcgatgagctcgttgatgagctcatgcatgttgaagggcttgttctggtcgacagggacaatctcttccaccttcttgccgccggccttgggggccttgggctcggcgcgcggcggcgcctgggagaagttctccgggaagtagccgatgtacttcttcgccgcctcgatggcctcctgctccgtcttcaccagcacgtcgccgacgccggagatggagcagtgcatcttcgcgccacccatcttctccagggtgaccttctcgccgatgaccatctccgccatgcgcgggctgnccaggtacatggaggcattgccttccaccatgatgaccaggtcgc

SEQ ID NO: 874 - DNA, 8056 bp, Myxococcus xanthus
cagctcccccacgcgttgctggccggcgagccccatgcgccgcgcccgctcgcggtcctccagcaggttgagctgcgcggcagcgagcgactcgacgtccacttcgcgcggacctcccggtgcgccggggagcacggggaccagcaggcccgtcttctcgtggtcgacgatttccgacgggcctccggagcgcgttgccaccagcggtagaccggaggccatggcctcgatggccgtgtagccaaagggctcgtagagcgaaggcaccagcgccagatccgcgattcgatggagcagcccgagctgctggcgtggcagtttgcccagcagcttgatgcggtggcgcaggtgcgcgtagcgctgggtcagcgtctgcaccatctgcgtggactctcgcgagtcggtgccaccggccaggaggaagcgcacgttggggcgccgttcgagcacgcgctcggcggcggcgaagatggcgctgatgcccttcatgggatggagccgacccgtgtagaggacgaccgggtcatccggcgtggccactgtggcgcgcagccgggcgtagtcctccggcgcgtgcgagggctggaggaaggggcccgcgtccatgccgcagtggatggtgtgcagcagcgacgccggcatcccataggtctcccggatgagctcgctcatggagtcgctcaccgagatgacgttcgtcgacccgtcgtagaagctgcgctcctcctcgagaatctccgggtcgggcgtctgtccccaccatcgctcggcgggctcggagatgtagtggctggtccccagcaccggcacaccggtctcatgggccagcgctcgcgcggcgcggtgggtgtgccactggtggaaatggatgaggtctggcttctcctcgtggatgagctcgcggcctcggtgaatcaggtcgtcgttgaagacgcggatgccgcccaccagggagagctttcccgcctgggagaggctgccgcggctgggcggcatcatgtgcacggtgaggttgggctcgcggagcacggcgggctcgccgggcgtgtacgccaggacggtgaccttgcacccgccgcgcgccagcccgcgggccagctcgtagacataggtgcccacaccgccggccacgttcggcgtgtactccatgggcaggaggagcgccttcaggggtggggagataggaggtgccattgggctgtctctcaaaaagggtgtggacgcgcggctaacggctggccgcgccctccttggcggtgagctcggccaggattcgcagcagggcctccacctccgggtcatcatggccggggctcttgcgctgctcggctaccagggccgccagtcgagccaccgtcggcgcctcgaacagcgattgcaacggcaccgtgaagccgaaggtgtcccgcagccgtcccaccaccgtggtggccagcagcgagtgtccaccgagcgcgaagaagtcgtcgtggacgcccaccggccgcacgcccaacacgtcctcccagatgcgcgccaccacctgctggtcctcggtgtcgggagccacgtaggccacggccaatgcggggcgggagtagcccgcggcgggggcctcaccgggctcctccgtttcggggacgcgctccgcggacggcgcggcggccagggcgcggtgcccgtcgggggagacccagtagcgcttgcgctcgaaggggtaggtgggcagcccgacgcgttggcgccgtgcctcgccgttgaaggcttcccagtccacatccacgccggacatccagagctgtcccagcgcgccgagcagcacggtcgtatccgcctgtcgcgtgtccggatgacggagcgaggtcaccgtggtgggcgcctgccggagcgcgccaggctgtgacgcgaaggtggtcagcgtgcggccggggccgacctccaggagcacctgcgcgggttgtagctgcgcgagccccgcggcgaagcggactggctgacgcaggtggcgggcccagtaggccgggtccttcgcctcggcggccgtcacccacgtgccggtgacgttggagaggaagggaatctgcggcgcggacagcttcatccggcgcaggcgctcggtgaagggcgcgacgatggggtccatcatcgccgagtggaacgcgtgcgaggtgtgcaggcgacgtgactggacgccacgtgcgtccagccgggccttcagcgcgtccacggcgtcgtcggggccggcgaccaccgtcatcgacggcgcgttcaccgcggccacggacagccgcgcatccagcgacgacaccagctccgcttccgacagcgcgacggagagcattgcgcccggcggcaggtcctgcatcaactggccccgtgcggccaccagggctagcgcgtccggcaaggtgaagacgcccgcgaggcacgcggccacgtactcaccgatactgtggcccaccatggcctcgggccgcacgccccaggacatccacagccgcgcgagcgcgtactcgatgatgaagagggccggctgggccaaccgcgtctgctgcaactgccgctgggcttcctcggcgcggtccgcggcggggaagaggacctcgcgcaggtccaccttgaggtgcgggatgagccgggtggcgcagtcgtccacgtccgcgcggaacccacgctcgttctcgtacaaaccctgcgccatgcccgcgtactgcgcgccctggccagggaacatgaacacggtggggcggctggtgcgctcctcggtggcggagagctgccggctgatgtcgcccagcgccgtgagcgtgtcctcacgtccctgacaaacgatggcgcggcggtgcgggtggcgccgcctgcccacttggagcgtgtacgccacgtccgcgggctccaggcccttgttcgcgcggaggtgctcctccagccgggaggcctgcgcggcgagcgccgtgggtgtgcgcgccgacaggatcaggagttggtgcgagcgcgtggacgaaaccggagcgcgggagggcggctcctccaggatgacatgggcgttggtgccgcccatgccgaagctgctcacgccggcgcgccgaggctcgcgggcgggtgccttccactcgcgcagcttcgtgttgacgtagaaggggctcgcgtcccaggggatgttggggttcggcgtctcgaagttgaggctgggtggcagcttgcggtgcttcagcgccagcgccgtcttgatgaggcccgccacgcccgccgccgcgtccaggtggcccaggttgggcttgatggagcccagggcgcaggtgcgcggtccggcggcctcgtcgccgaaggcgcggatgagggcctgcacttcgatggggtctcccagcgcggtgccggtgccgtgcgcctccacgtagccgatgctcccggccgatacgcccgcgctgcccagggcctcggagatgacggcggcctggccctcgacgcccggcgcggtgtagcccacacgcgcggcgccgtcgttgttcaccgcggagcccttgatgaccgcgtagatggggctgccatccgccagcgcatcttccaggcgccgcagcgccaccacgcccgcgccgctgccgaagacgatgcccttggcctgcgcgtcgaaggggcggcagtgcccgtccggcgacaggatgccgccatccacgtagcggtagccgccctgaatctggaggttgatggacacgccgcccgcgagcgcgaggtcacactcctggttgagcaggctctgacaggcgacgtggaccgcgaccagcgacgtggagcacgcgctctcgatgttgaagctggggccgcgcaggtccagcttgtaggcggcccgcgtggtgaggaagctgcccgcgttgcccaggttgagctggagcgggtccgccgtgcgcatcagctccgcgttccccatgaggttgagcagcaggtaggtgctcagggcctgtccgccgaagacacccaccaacagctcgggagtcggcgcgccatggcccgcgtcctccaatgcctccagcgcgcactccaggaagaggcgttgctgcgggtccatgacctccgcttcgcgcggcgtgtagccgaagaaggccgcgtcgaagcccgcaacgtcgtccagccgtgaggccaccttcacgaagtgcggatccttcagcacctcggtgggcaggcccgccttgaggactgcctcgtccgaaagcggctcaatggactccacgccgtcgcagaggttgcgccacagatcctccaggctgcgcgcgcctgggaagcgcccggccatgccggtgattgcgatctccatccccgtgttgctgtccgacacgctgtccccctcttgcgctcagttccccgactggcgccgctgctggatgagctcccgacgcctggctccgcggcttcgccggtcactggtggtggccgacgcctgttcctgccctcgggtcagcagccgggccatggcgctgagcgtggggttctcgaagagcgacaccaccggcaggtccttgccgaagcggcgcttcacctcgttgatgaccttcaggccaatcagcgagttcccaccgagctcgaagaagttctcgtgcagcgccacgctctccacgcccaggaagcgctgccagatgtccgccagctcgcgctccgcctcgtccatgctggcgggcgccgcgcgctcggccgccggcgcggcgtctgtctccatggggcccatcaagtcttggagcagcgaggcgctgcgcgccatggccgctcggaggtcctcggtggacaccacgacgtgggtgggggcctgcgccaacacgcgctcgaagacgtccacgccctcggccggtgtcagggcatgggccagcatcgcctcccgcatcgggttggcgccgtccggcatctgcgtcgttacggcctggcccacctcgcgccaggtatcccaggccagggagatgatcggcacgttccccgtcgccgcggcctggtgagcgaaggcatcctggaaggcgcacgcggcgcagtggtcaatctgcccgggctccgccgtgtaggcggtgcgagacgagcagagcacgaagaagtccaagggcgtgtcgcgcagcagcgcgtgcaggatccaggtgcccgacaccttggggcgcaggacgtcctccacggccttctgcgtgcggagctgggccagtccgcccgcgggcacgccggcggcgtggatgacgccgtggagttcgccaaaggcctgtcgcgcctggcgcagcacctcggccatctgctcggcgtcgcccacgtccgccgggaggaccaggacctcggagccgagggcctctagcgccagcacctggcgaatgcgctgactcacccggtcctgctcaccgtgctcggtgatccaggtgtcccaggtgtcacgttccggcagggcattgcggcccaccagcaccagccgggcctggacctgccgcgcgagcgactccgccagcaccaggccgatgccacccagtccgccggtgatgaggtacgtgcctcgcggacgcaggcgcgacggcgcatccgcggcgggcgcggagatgcgtacctgctcgaacgactgttcccagcggctcgggccccggagcgccacggcgccgttggaggaacccgtggccagctcacccaccatccgcgccaccagggcctggagcgtcttgctacagcgtggggcctccacgtcgatcgaccgacatgacaggcccggcacctcgtgcggcagcacgcggcaggcacccaggagcgtggccttctccggggccagcacctcatgtccggtgacggcctgcacgccgctggagaccaccgtcatttgcacgggcccggacgcgctctggccagccagggcctgtgagaggaagagcaggctgaagaagccggtgcgctgggcgtgctccaggcccgccagtccttctcccgcggagtccacgctccacaggtggacgatgcgctcgggccggcaggagtcctcggcgagcgcattcagcagcgccgcgtaggtctccgggcgggttgggtccacttcgaagacgccgtcatccacgcggcggaagtcggagccctgcgatacccgggtgacccggccgccgctctccgccagccgtgtcgccaaggcgtctcccagcccgccggtgtcggtgaagacgagccagttctggggcgcggcggtggtcgcgcgcggtgcgagcgtgcgcttccaggatggcagatagaaccagtccgccgcgtccttgcgccgggcgagcgagacgtcgctggcgatcgcgataccggctgcattcggctccagccagtgccgcttgcgatcgaaggggtaggtgggcagcaccacgcgccggcgctgctctccggcttggagacgccgccagtccatgggcacacccgccgcccagagccggcccagcgtggtgaggacgaagcgcatgtcggagccgggctcacgaggcgcccgcattgacgtgagcaccacggtgggctggccacgctccacctgcaggcgcgcgagcgagcccagcgtccgcccaggaccgacctccagcagcacgcgcgacgggttctccagcaggcaacgcacgcccggaccgaagcgcaccgtctgccgcaggtggcgcacccagtacctcgggtcggtggcctcctcctcggtcacccatgtccccgtgacgccagagacgaagggctgcgtcggcgtctggagcttcagccgcccgacgaaggccgcgaacgccggcaggatggagtcgatgaggtgggagtgcgcggccacgtcgatgtggacgcggcggtgctcgatgcctcgcgtcgccaggtcggcggagagcgcatccaccgaggcggtgtcgccggccaccacgcattgcgacggtccgttgacggcggccagggacaggtgctcgcccagcatcggcagcagctcctgttcggacagggccacgctcaccatcgcgccggagggaagctgctcgaagaggcggccacgctcggccaccaacgccagcgcgtcctccagcgagaagacacccgcgaggcaggcggccacgtactcgcccatgctgtggccaatcatcgcctcgggccggatgccccaggactcccacagcctggccagcgcgtactccaccgtgaagagcgcgggcaggcccacggagggacgaggaaggggcgcgcctgcgtccgcgtcgcccgccgggtacagcaccgtgcgaagcgacggtccgccgcggcgctggaagctggcggcgcacgcgtcgaaggcttcgcggaaggcgggctccttctcgtacagctcctgccccatgcgcaggtgctgcgcgccaccgccggggaagaggaacacgacagaacggccaccgtccttggccacgtccgtgaacacgcgctcggggttcatctcggacagcaccgtggccgcgtcctcgccactctcgcagaccacgacgcgccggtgcgggaaggccttgcggccaatctggagggtgtaggccacgtccgccagggactgctcggggcgcgcctccaggtgcgtgcccaggttctgggtgagcgcgtcgagcgcggccggcttcttcgcggagagcaccagcaattgccagggccgcgacggaccggagggcgctgggggcggcggcgcttccagcagtgcgtgggcgttggtgccaccaatgccgaaggaactcacgcccgcgcggcgccggtggtcatgcggctgccagtcccgcaacgcggcattcacgaagaaggggctgcgcgcccaatcgatgttcgggttgggcgtgcggcagtggagggtgggggggatgcgtccgtgctccaccgccagggccgtcttgatgagccctgctacgccggccgccgcgtccaggtggccgatgttcgacttgaccgacccgagcgcgcagaagctggtggcctcggtgccggcgcggaaggcgctcgtcagcgcggagacctcgaccggatctcccagcagggtgccggtgccgtgcgtctccacgtaacccacggagaccggcaacacgcccgccagggcgtgggtgcgggcgatgacctccgcctgtcgctcggc

SEQ ID NO: 875 - DNA, 7628 bp, Myxococcus xanthus
ttgtgccgggccaagcgcgcggcccggaaccgggtggacgcgaaggccatcagcgggctttgagtttcgggcgcgggccccgcgcctactggccgaagcccagtcgccgtagcgcctcgcgcgatacgtgctttcacatgggaatccgggtctcgcgccgctgcgtccgatagcgcggccgccgcctgcgctccgccaatccggcccagcgccgttgccgcggccacccgcacaggggcctccgtgtcctcccgcaggcacccggccagcgccttcacatgtgacgcgcggccaatctgctccagtgcctcggcggcggcggtgcgcaccaccccatgttccgactccagcagcatcgcggcctcatcgcctcgggacgtctgccgttgaagcgtcagcaactccagtgcggcgctcaccacctcgggagccccgtccctcagcgcacgcgtggtggcctccgacactcccggctgccgcgtcgtcaaaccgctcaaggcccgcacggcacctgcccgcagcaacggctgcgcatctgtcagaaacggctccaccgaggacacccggtcccgagccccctcgctacagtccgccagttgcgccagcgcggcccctcggacggatgcggccagcgccttgtcccgcgccgtccccaggaagaacgccacacaccccttctccctcgccatggcctccagccacggccgagcctgcatcgcatcactcgactcgatgcgccgctccgccgccgtgcgcagcgggacgccttcagcctcggccagcgcccgcgccgcatcccggcgcacccaccggtcggaatcgccgagcgcccgctccagctcccgcatcgccagcggcccatacactcgcaacgactccaccgcgcgtcggcgctgaagtggatccgccacggtcagctccggctgcatgccctccagctccttcgaatacacagcgaagagccggttgatgcgcgcctcctccgcgggcttcgcctcatccagcagcatccgtcccaccgacgaccggctgcgcccggccaccaccttgagcgcgctggcgctgaccgcatccacgctctccggccgcgccgccatggcgtccagcaggacgcgtgcgggcttgcggctcaggaacccggccaggtgggcgagcgccgagccccgaaccgccaggtcctccgcgtacagctccagctccagcgcctcgcgaatggcatccctccgcccccacacgcgggccgcggcattggcgccgcgaggtccggcatctcgcaggaacttcgcggaggaagccccggcctccgccgcggcgcgagccgccgtcagacacgccgtcaggttggacgacaccggctccgccatgacccaatccgccagggcccggcgatccgtgacgccctgacgcctggcatccgcgcgcaccgccgcccacctcacccgccagtccgggtccttcatggcggagacaagcggcgcccggggaatgggccgctgccccgccaggccctgcacccaggaatccacgcggccgcccggcaggcagctgccacaggtccgagcgcgcagggatggatccgtcacgtgccgctggcaggacatccagcattctcgggtcggggtcccaccttgctgctggccggtcgtcaggagtaccaccaggaggagggctgggctcacgaggcggacagtgtagtccatccgacttagccttttcgtccagcgtccttgcgttttccctctcagtgggtcatacccgctgccccttttgatctacacccacatctacgtacggcggaaggaggtgactgcatgcccggtatccgagtgaaggaaggagagtccatcgagagcgccctcaagcgtttcaagaaggccaccgagaaggctggaatcctttccgagatccgtaagcgcgagcactacgagaagccttccgtgaagcggaagaagaaggccctcgccgccaagaagcgcgctgtgaagaaggcccgcaagtcgttctaggcgcgtgcctcgcgcgtggagccggggcgccaccgatgtcaggtgccctggctcccgccgtcgaagtccccctgaacaacgtcttaccctccggagctgcgaccatggccaccctgaaggagcggatcgacgcggacctgaaggacgcgatgcggtccaagaacgagctgacgctcagcgtgctgcggatgctcaagagcgcggtgaagtacaaggaagtggagcccggcgcgtccgcactggatgacgcgggagtcctcaccatcatcgccggcctcatcaagcagcgccgtgattccgtggagcagttcaagacgggtggccgcccggagctggcggagaaggaagaggctgaaatcagcatccttcagaactacctgcccaagcagctgaccgccgacgagctggccgccgaggtccgtgccgccatcgccgagacgggcgccaagggtcccaaggacatgggcgcggtgatgaagaacctgaacgccaagattcacggcaaggcggaaggccgcgccatctccgaggccgtgaagtccgagctcgcgaagctctcttgagcattccaccgttctgaggtcagcgctggcgctgtcgggaaaccggcggcgcctttgcattgaagggctggacagggatgcggaaacttgctccctcggcccctcgtcattaagtgcctgggtcagtcccgccgtgccccccgctccccccagcggaagtcgcgtgcaggggcctcaggagtccaccccatgccgcaaccactccctgccctcgcgaacgctccggcttcagcccccatggggatgatccgccaggtcggccggtgggcaggcgacgtcagccctgtcaggcaggatgcagaggctgggcccgcccaggggtgggccagggggtgggagtcgtgattccggagcacaagatccaggaggtcctcgaacgggtggacctcgtcgggctcatctcccggcatgtcgacctgaagaaggccgggcgcgaatggaaggcctgctgtcccttccatcaggagaagaccccctcgttctacgtggtgccggagaagcgcttctatttctgccatggctgccgcgcgagcggtgacgcggtgtccttcgtccagcgctacctgggcaagacgttcctggatgcggtgcgggacctggcgcgcgagctgggcgtggacctggaagccgagcaggaccccagcatgcgggagcggcagcaaatcaaggaggccacggaccaggccgccgagcacttccgcgccatgctgtggcagcaggacgaaggccgctccgcccgcgcctacatcgccagccgcggcgtctccgacgagacggccatggcgttcggcctgggctgggcgccgctcgaatgggcctcactgacggagcgcttccagaagctgggcatgctggagtgggcggcgaaggccggcctggtcctcaagcgcaacagcggcgacggctactacgacttcttccgcagccgagtgatggtgcccatccgcgcgccggagggccgccccatcgccttcggtggccgtctgattggcgcggatgaagggcccaagtacctcaactcgcgcgagtcccggctctacaacaagagcgagacgctcttcggcatggaccagtctcgcgacgagattcgcaagcgcaaggccgccgtgctggtagagggctacttcgacgcccttggcctccaccaggtgggcgtgcggcacgcggtggcgctgtgctccaccaacctcaccgccggacacatgcaggtgctgaagcgcgccgaggcccgcgagctgattctgctgttggacggagattcggccggccttgccgctgtcgaacggctttccggtcccctgctcgccgcgggagcgaccgcgcgagttgccctgctgccgcaaggggatgatccagacaccttcgcgcgtcgagagggccaggagggcgtggaacggctgctggaaggcgcccacccgctcaccagccacctgttcgcctcgctcctcccggagggcaaggccgcgagcttcgaggagaagatggcagcgctcgagcggctcaagccggtggtggggcaggtccccgtgggcctggtgcgcgccaccctcttcagcgcggtggccgagcacttcggctggcggcctgcggacgtggaggcagccctgcgcagcaaggtgcccctgcccaagcccgccggcggggacgcacctccttcgagccccaaccgccccgccccgcccctggagaagccgccccccgcgctggagtgcttctacgtgggcgcggtgttgaaagagccacggttgatggcgcgggacaccttccgcgtgtgtgacgagctgtcccacatgggcctgcgcatggcgctggcgcatgcgacgtcgggacacggcgcaaatgatgcgctctttgaatcctcggaagccgtgaagcgcggcattgaaagcgcgctgcggcagctcccctcggaacctgttcccctggaggcggcgttcctctccatctgcagggaaatcatggtgcggcgcatcgacgagcggctcgtttatataaagcgggcgacggagcagacgccgggggcgttcgacctgacagaggagacgcgccagctccttgtggagcgcgtggaactgttggcgctcaagaagcgtgtcctggaggagctcaagcctgcctcctcgggaacaaaggcgcccatgcaaccggtttgagttcgcgtttgtaagaaaccctgactttgcggtagatcggccggctcgcccaggcctcaagcccctgaatttgctcaaggagaagtacccgaatgccgacgcagaagccctcgaaggcgtccgtgaagccgaccaagaagaaggtggatccggtgatccgcaagaagaaggctccggacggtgccgcggcgaagggggccaagacgggcgccgaggagaaggaagaactcgtcgcgagggacgtcgtcgccgaggcgacggagaagctcaagaagaagaagaagggcgtggcgccggccatgggcgatgacgtggacccggaggaggccgcggaagaggccgccgccgccgtccaggtcgaccccgacgccgtcgaggacgacatcgaggaggatccggtcgccgagcgcaaggaggtcaaggacctgctcgccgcgggccgtgagaagggcttcctcacgtacgacgaggtcaatgacgcgctccccgccgacatcgtgtcgtccgatcagatcgacgacgtgatgagcatgttcggcgacaacgacatcgagattgtcgacgcgcagaaggccgctcagaacaacgaaatcaagcccaccgtcaccgtcgaggaagagaaggaagacgccgacgaggacgagaaggacgaggacgacgagccgggcggcaagtcgaacgacccggtgcgcctgtacctgcgcaagatgggcagcgtcagcctgctcacccgcgagggcgaggtcgaaatcgccaagcgcatcgaggatggtgagaaggaagtcctccgcgcgctgctggcgtgcaaggtggccgtcgaggagatactcgacatcggcaacaagctgaagacggccaagctgcgcgtgcgcgacgtcatcaaggacgcgccggaggagacgcagtccgaaggtgccgaagaggcgcccgaggaggtcggtgaaggtgacgctccggcgcagctggcgcagagcgagctcaacaagattgagcagatctgcaagcagatcgagcgcttccgcaagttcgcccaggactgcgacgtcttggaggaggagctgtcctccaagaagaagctgaccgaggtccgcaagaaggaagtgaagcaggagatcaaggacctccggaccaagatgatggaggtcctggaggagatgcggctcaacaagaagcaggtggaccgcatcgtcatcaacctcaaggccctcatcgagcgcgtcgacaaggccgaggacgagctgcgtgatttggagcgccgctacgactgctccatgaaggagctgcgcccgcagctgaaggagtcgcgggagaaccccaacatcggcaagaagctgcagaagcagctcaacctcacgccggagcagttggaggtcctggaccgcgacgtgcgcacggcggtgcggaagatcaagaaggtcgaggaggaggccaacctccccgtcgagtcgctgcgccgcaactacgacgccatccgtctgggtgagcgccgcgccgaacgcgccaagagcgagctggtggaggccaacctgcgcctcgtggtgtccatcgcgaagaagtacacgaaccgcggcctgcagttcctggacctcatccaggagggcaacatcggcctgatgaaggccgtggacaagttcgagtacaagcgcggctacaagttctcgacctacgccacctggtggattcgtcaggccatcacccgcgccatcgcggaccaggcccgcaccatccgcatcccggtgcacatgatcgagaccatcaacaagctcatccgcaccagccgctacctggtgcaggagattggccgcgagccgacgccggaggagatcgcggagaagatggagctgccgctcgacaaggtccgcaaggtcctcaagattgcgaaggagcccatctccctcgagacgccgattggcgaggaagaggacagccacctgggcgacttcatcgaggacaagagcctcgtgtcgccggcggacgcggtcatcaacatgaacctggcggagcagacccggaaggtgctcgccacgctgacgccgcgcgaggagaaggtgctccgcatgcgcttcggcatcggcgagaagtccgaccacacgctggaagaggtgggccaggacttcgaggtgacgcgcgagcgcatccgtcagattgaggccaaggcgctgcgcaagctgcgccacccgagccgctccaagcgcctgcgctccttcgtggagagctgagccgggcttgagctgagctgaacgtgggcccccgctccattcgtggaccgggggccttcgtgtttctagagtccggggccgtggcgctccgagcgaagacgaagacaccgaaggcagaagtgaagaaggctcccctccccttctccaaggcggtgtggaaggcggtccgggccattccgcgcgggcaggtgcgctcctatgcccaggtggcgctctatgcgggccgtcctggggccgccagaggcgtgggccgggagatggccaccctgccccagcagcccgagctgccgctgccctggtggcgcgtcacgcgctcggacggaacgctggcgccccaggtggcccaggagcaggcacggcgcctgagggccgagggcgtggaggtgacgcagcgtggggacaccttccgcgtgaaggtgccccgcgaggtgccggcccctggactggcaacgaagcggcagcgctgaagccgggtaaaacgacgccccttgccaggactgcgtacccggcgatatgcaatccgtcacgcggttggttggcgcatgagggcccttagctcagcggttagagctgtcggctcataaccgattggtccctggttcgaatccaggagggcccactcctcttaaccccgcatggcgcctcgggaatctccactgaggcgccggcgcggggagccgcctccgc

SEQ ID NO: 876 - DNA, 7225 bp, Myxococcus xanthus
tgctctaagctacgggcgcggcacccacttctgcctgggcgcgcccctggcccgggtccagttcgaaatcacggcgaacatcctcctggaccggctgccggacccgaagctcgtccccggccaggacttcggcacctggcagagcctggtgctgcggcagatgaagcacctgaaagtggagtggacccccacctgagcccacccacccgggagtgaacgagggcctggcgaccgacaccggtctccaggcccttgtcatgtccggagacccgctgtttccagcgccaagcggatgatttcccacaaagaagggtagaaacccaccccacttcgagtgaatgggcgggacaaatcagacccccatggggtacaggatgacccgaacaggcgcgctcactctggaacacgtgcattccagaaagaattttcttgcctcaccacccatttccgcgcgaaagagtccaggaacaccctgcttccgagtaaagcagaaggagccccccgacatgtacgctcaagtggtggatgaggccgacattcagtacgcgcaccgagtggaccgcaaggcgctggcggccatcacccgggagatgtcgaaggtgaacaatggtcgtgcgctgtgggccatggccgctcagtggctggtcatcgcggcggcatttgccttcgttctattcgtggaccgctggtgggcctggccggtggcggcggtgctcatcgccacccggcagcacgcgctgctggcgctgatgcacgaggcggcgcactaccacctcctgtccaaccgcaaggtgtcggacgtggtcagcgatctgctctgcgccttcccgctgaacatgacgacggcgggctaccggcacgagcacatgctgcaccaccgctacgtgaatacgccgaaggacccgtacctggccggccagctggtggacgcctcctggcacttcccccgcacgccgatgcgcgccacggccgtcttcctggcggatgcgctgggcctgtacgcccccaaccacctgaaggtggtgctgccctggacgtattggggccgcctggtgggccgcgcgcagccccgcatctccgcgggcgagcacctgcgctactggctgtacgtggccacgctcgtcacggtgctggtgacgacgggcgcgtggctgcactggctgctcttgtgggtgctgccgacgacgacggtgatgatggccttcttccggatgcgcgccctgggtgagcaccccatcgaggagacgaagtccggtgacgagacgcgcgagacgcgcgacatcctgggcaccgcgctggagaacttcttcatcgcgccgctcaacgtgaatctgcacctcacccaccacgccttcccctccgtgcccttctacaacctgcccgccatgcacgcgcagctcgacaaggccggcctgctggaagacggcgtgaaccagttcgacacgtacctgggcaaggagaacagcctcatccagtacctcacgcgtgagccggaggcctccgccgccgcggccgccgcggcccagccgtcgcgcctgagccagccgctccactcgtaatggtcgccgcgagccgggcctcgccccgtgccgtccaggtgtagccggggggctccaccaggatggccggcgaggcctgggcccgcggtcagaagcgccgcagcgaggaccaggggaagggcttccagaagggcgtcaccacgtcctcgccctccagcggaaaccagggtccggtgtcgcctccagcggagagcacgtggaagtcctgcgcgggcatgaaaccctgccccagcagcgccaccctcttccccgccgcgttggccgccacgtccagcaccagcaccgcgtgcccggggcttccacccagcacgaagaagtccccgggccgtacgtcctcgcgcgagggccgccccttgagggattccagtgagtgcgtgcccgcgtaggtgaagaccaggtccagccacgcacggaagctggcgcgtgaggcatccggcgccgcgccgcgcacccacgacaccttcgagcccgatacccgcgcccggtccccttccgcgtaccgaggccactccgccaggtgaccgctggtgaagcggtaggccaggcgctcccgcttgccactggcccagagccactccgcatggaggcggatgacggagtccgcgcactgctgaaggttggcggtgcccacgtccagctccgccaccgccgccagccgcgcgtcctccgacgccagaatccgcccgccctggtggctgagcaccggcgtgccatccggccgcagcggcaggcctcgcagccaggccccgaaggagcccttcaccaccggcacccgcgtgtagccctccggcggcgccaccgcggcctccaaggggcgcaccaccgcctgggccggcagccatgcgtagcgcgtcagctcctcccgcgtcgcgggccggggctggccttcctccgcggcccacccggacgcgggaagcaggcacaaggcccacaagagcgtccaggcccacggacgaaagcggccctcggtggcgggccaggacggggaggacgagcacggcgagcagtcgaacgcggacacgaagcagccatctccaggagtcagggcggcacgacaggtggcgccgcgggttggaggtttctcacgggcctggagttccctcacgctcgctcgagtccagccgctccctgactgccccgcgttcccgggggtgggtctaccgctgaacgctcgccgcccccggaacgtgcgcggctgggaccgagcactaccttgagtcgtatgcgccgacaggcgagcctcgcgctgctcaacaccttgtcgctgacccggctgcccctggcggtggccttcatcctcgtcccggatgcctgggttcgcgcggggctcgtggtgttggccgccttcacggacttcctggatgggtggattgcccggcacaaggggctcgccacgcggctgggcgcgctcatcgacccggtggccgaccgcgccttcatggtgacggccatcctcgtctgctacctcgacgggctcatcagcggggtggcggtgctgctgctggtgctgcgcgacgtcggcaccaccgtgggcttcttcgtcgctcgactggcgcccaggctgcgctcggtggaactgaaggcgcggatgatgggcaaggccgtcacttccctgcagttggtgacgctgctgtgcgtgctgctgtttccccccgcggtggtgcccctggtcgcgctcatcggcgtcctgtccttcgcgtcgatggtggactactcccacgcggtgctgaaggcccggcagcgggacgccggaccgcggcggatgaagccggagtccggcggcgcgacctcttcgggctcctccctgccgcccgtgcgcaagtagggccgcggcgtcagggctgcgccgccgagtccgcgggttgggctttgggaaggcccagcacccgggctctttcggtggcgatggcagagcgttcgccctcgctcatctccatccagacttcatccatgtcgtcgagcagaccgtcctcctcgggtgagtcgccttcagggtgccgggcgcggacgagccgcagcttgttcaggagtgcacggtaacggtcgtaagcagacatgatgggaacctcccccccggggacgagcatcgggcgtgcgactgacgaagcgtggatgggcctggcacctcacttcccagccggagtggaggggagcacggaaatctccatcgtccgctcttcatccagcaggttcaccactgcgcggacgtgctcgccgggctcgagcttccgcaaggcgatattgcgcccgtcccggaacacccgcgtccgagggtccacacgcagcgtcagcggcggaccgtccccgatggcgatggccacctccgtgtcgcccacggagcgcaccacgccggtatagacggcatccaccgcggccgtccccggaggcgacggcacgcccgagccctcgggtggcacgtcattgacgacacccgcggcccccgtgcctcccgtgcccgtgtcctgctggtcagccgtgtcccgccgagggctcaccaccctcgcgcctggaggaatgcccgcgccgcccgtgcccgtgacttgcccccgaagctgcgtcacctcctggcggagctgcaacagctcggcgcggagctggtccacttcgcgctggagcgccgcggcgtccgtcgaagtcagggcctgtcccgttggcacctgctccgtccgcgcgggcacctgctgtgtgccttgtgccgtcaccacgccaccacagagcagaatggacagccccgcgatgcccaacacccacaagattgccttgcgcagcatgaggccctgacctcctttccgtttcaaagttggggcctgccgggtgacggacaaccaccggcccggccaggatgcgcagagggagccacccacctggcgggccaccgcctgcccccatggggaccgtcagcggcgcggaaattcttcgaggccgcgctgaaactcccaatcgcctcgcgtcactccttgggcgccgggcctgagcaagcctggtccggtggtgtcacgcggcggaccgcggcgccacgggtgtgtcttttcctggagaacaccatgtccaagtcgtctgtctgggtgagcctgagtgtcggtctggcgttgggcttcgcgggagggcgcttggcgcgtcccaccgaactggccacgggaacggcccacgcggccaacctcgcggcgaaggcccccgcccccggcgcgcgtccgcgtgcgccgatttcgcccaccgtctacaaggtgccggtcaatgactcaccgacggcgggagcggaggacgcgctcgtcacgttggtggagttctccgactacgagtgtccgttctgctcacgtgcgaacggcacggtgaagcaactccaggagcgctatggccgcaagctgcgcgtggtgatgaagcaccacccgctggccaaccacccgcgcgcgcggccggcggcgctggcggcgctggcggcgggtgagcagggcaagttctgggagatgcatgaggcgctcttcgccaacccgcgggcgctgagcgaggccgacatggagcgctacgccatgaaggtgggcttgaacatctcgcgctggaaccaggaccgcgcggacccgcggctggcggagcgcatccgccaggacgaagcgctggcgatgcggttgggcgccaccggcacgccggccttctacgtgaatggccgcttcatcagcggggcccagccgctggaggtcttcacgggcgtggtggacgaggagctgagcaaggcggaggccctggtgcggacgggcgtgcggccgacggaggtctacgcgcgcaccatctccgcagggaaggacagcccgcccatggagcagatgatgcccgaggagccggccatccagcaggtggacgtgggcaccgcgccgactcggggcccggccaacgcgccggtgacggtggtggcgttctcggacttcgagtgcccgttctgcgcccgcgtggtgccaacaatgaaggcgctggaggccgcgtaccccggcaagctgcgggtggccttcaagcaccagcccctggcgcagcacgcgaacgcacaggtggcggcggaggcggccatggaggcgcacgcgcagggcaggttctgggagttccacgacgtgctcttcgccaatcagcgcaagctggaccgggcgtcgctggagcactacgcgcggcaggtgggcctggacgtgggccgcttcaacgcggcgctggactcgcgcaagcatgacgcgcacgtgtccgcggacgtcgcccaggccatgcgcgtgggcgccacgggcacgcccacgttcttcatcaacggccgtccggtgacgggcgcccggccggtggagcacttccgcgccatcatcgacgacgagctgcggaaggcggcgcggtagtcgcgcagcgactcacggctccgaggccgcggcctctgaatcagagaccgcggcctccggctccggcggccgtctcaacacgcccacgttcgtcacctcgcgggcgttgacgttgaactccaccgtcccaagagaggtgcgcagcacgtgtcgacccggcttcagccccggcacgaagatgcggccgtccaacaacgtgtagtgcgacgcaccgacccactcatggttgacggtgatttcctcgcggtagccccagaggtggtcgtccccgaaatccatcatcccggcgacggcgcccgtctcctccaggtggatgtcgacggacacacgctcccccttcccgcctcggacgacggcgctgcccgcgcggccatccggcagccacgcgaagattcgccccgcgcccacccggggcgtcaccacgaattcggggccatcgaagcggacctgcgcgtggtcctcggccgagttgccacacctccgcccccgtggaccgggcttctgcgacccaatccaggcccccttcaccggcgtgccgtccgggaggaagacgcgaccggagacctcgaactcgccagggtcgctggagtacagctgccacacccttccgccctcctcgagcgcggagaaggggaacgcgatgaccgccggagcaccgggcgccagcgtcacgtccttccgtgccgacaccgcccgcccgttccggcggccccacacggagacggagtggcgccccgactcagtgatgcccgtgaaggtgccgtcctgctggggctggagctggacattcacgtgaacggactccaccgagtccgtcccacgccggcgccccatcaccggcttgacggtgaccgggacgaacgcgccaagctggaagtcgaaccgccgcacctcgccggcggccagctccgcgcccacggaccggtggagcccctctccctcgggggagaaaggcgtcatgccgacggggtagcccggcgtcacgccatccagcgtgtagcgcccctgtgcatccgtcgtggcccagacaggcgtcatctccagcaacatcgggtcaccggacgcgaccagccgaacaccctccgccggcgtcccgtcatgcaggaggacctgcccctccacgatggcccctggcggaagcttcagctccacgacgagcgagcccccggcgaccacgcccacgtcccgctcacagcgctcggcgtgaccggccccccgtgcacagacggtcatcacgcccgcgccaggcgccatgaagctcaccacgcccgacgcgtccgtcagcgctgtctcgtcgggcaa

SEQ ID NO: 877 - DNA, 8025 bp, Myxococcus xanthus
gtgggcagccgaggccgcgcgtgacgacgagacggtggcacgggcctggctggagctcatctgggcggtgggcgaggagcagtcccgccccgacgaagcggagaagctcatccggcacgcccgggccgccgtcgagcggctggggcgggagcgcttcccggacatcacgacggaactgcacacgcgcctgtcgtcgctgcgagaggcgtacggccagatcgccgaggcggagcaggaggcgcgccagggactggagttctcgcggaggaggaatcacccggacagcctccgcacgcccaacctcatccatcagttgggacgcatccgcttcggccaaggccgctatgaagacgcgctgaagctccaccgcgaggccctggaactgcgcgagcgcatccttggcgctgacaatccggccctcgtgacttcctacaaccgggtcgccactgcctcgctggaggtgggccggtacgccgaggccgtcagcgcctggcgcaaggccctggcacttcaggaggcatcctccgacccagagaccacccccatggggacggttctgttgaacctcgccgtggtctcgcgcgtcgcgggtcgactggaggaggcacgctccatggctgagcgggcgcgcgccatcttcgagcgggcccggggccccaaccacatcaccgtcatcttcgcgctctcagcgctggcagacatctccagtgaggcgggccagggcgacgaggcgctgggccttgccaccgaggccctggagcgcgtccagcgttcactgggccaggacacgccacgcgccgccctgccgctgacagtccggggacaggtgtacctgaaggcgggccgccatgccgaggcacgacgcgacctgctggacgcgctccagcggctcgagaaggaacatggcccggagggcggtaagacggtgaccgtgctgcttcccctcgccgagtttgccctggcgacccgggcttcgaaggaggcgctcgcgtactgcgagcgggcgaggaaggtcaccgagaaggcgggtggcgcggagtccccggacggtgcgagcgccctggcctgctccggggaggcgcatctggcgctgggtaccgcggcggaggcggtccccctgctcgagcgcgcccggcgcatccaaacccaatggggcgaagtcaaagacccgcgggtcgccggcaagaccgccttccttttggcccgggcgctcatggaaacgcgcgcttccccggagcgggcacgggcgctcgcgctggccgaggaggcccgggcgcggctggagtctgtgggggtccggggccagtcggagctccagacggtgttggcctggcaacggcgtgagacgaaacgatgagtgacgaacagcgaacaggctccctggcggcgctgctgcgggcatacgtgtctccgaagctgcgggcggagctggaggccgaggagggattcgaggcgctgctggacaaacacgtcgaggcagcacggacccagtggcccacgttgtcactcccggcagagaccttcgtgaggcacctggcccggcacctgcctgagggaaaggccgcggaggtgatgcgcatcctccaaggtgccgacctgtatctggcgtgcgcctgcaccaccggggatccggcggccctcaaggccttcgaacaacacatcctccggcacgtcccaccccggctcgggaaggtgtcgccgcccctggtggaggaagtgctgcagatgctgcgcgaacggctgctggtgggcagcagcaacacgccaccgaggattgcgagctatggggggcgagggcccctgcggacctgggtgagcatcgtcgccgcacgcatcgcctcggagttgatgggccaggacgagcgccatcagctcgtcgcggaacctcccgaggaactcgcgcggatgctggccccgagcgaccccgagtacgcgctgctgcgcgaagatgcacgccaactcctcgtcgagtcgctccgaaaagcggtggcggtgctctccgagcaggagcggaccctgctgcgcttgcaccatttccatgggttcacgatggaccggctgacgctcatgtacggaggctcgcgctccggcgtcgcgcgcaaggtcgccgatgcccgcgagcagttgctcgagcgcgttcgcatggagctcgcgccaagaatgaagcaggaccaactcgccctggagagcctcctgggactggtcagcagccgactggatatcagcctcctgggattgctggactgaagcccctaccgcccatctgccgccgggcgcccgactgctggcactcctgacgcaccggcgtcccgccgacttgccagggcaacgccgccgccagcgtcgtctccggagatttttgggacgtcggtgggccacctccctctttctcttcgattgcaggggacgacacgcatcgactcgcgcaggccgtacgcacctcgggcatgcctcatgcccggccctccaatcacatgcgcggaaatgccccatccagaggagatatcccatgggttcagtgacagcggtcggtggttctggtgctccgaaagtcgatcccgccgaagcacagcgccgcgcggaggaggcccggcagaaggcggaggcagcgcggctcgccgccgaggccaggcgcaaggccgcgacggctgcccgggacaacctgacgcaggccaagcacgacgcgggtgccgcgcgacggcagaaggccgcggcggagaagaccgccgccgctgcacgcaaggccgcggagaggccaggacagacgcccgcagaggcgaaaaagtcgaaggaagacctcgccgtcgcggagaagaagctcaaagaggtcaccgaagcctccaggatggcggctcagaaactccaagacgcggaggagaaggcagcccttgccgcgaagagcgccgaagaggccatgcgcaaggcgaacgcggtggccgtcgaggaatccaagacgcccccctacagtcagaaggacatcgacaaggtcaagccgacgaagaacgaactcgaatcggccttcgagggcacgagtcgaaaggcggagttggagaagttgctgggattgacgcccccgcccccgcaggaagtcatccagactgtcgggagcggagcagcgcctggggctccgttcgacgcgatgaaaacgatggacgcgcaggacgtcgcccatggcccctttgggcagacacacatggactcgtccaccgacgcctggttccaccagcgacagggctccaacactggggtggtgccttccgacgcgacccgcggaaacaccgtccccatcatgccggatggcagcgccccgtccccggtgacgtcgaagcagtaaacgacgtcggacgccatgcgcgagaggacgtcatgcatccttccatctacgacaatgcaagagtcgttttgtcgagcggcctgtcgcgacatgacacctgcgtctggctcatgtgcctcgggctctcccttctccccttgagtgcccgaggagacgtctccccagacgtgtaccgctgtgcggtctccatccaccaattgataggagacctcgagtacgagcgagcactggagcaggttgtccacggcaaggcgatgtcgaagaggcctgaggatcaggtcgtgatgtccctctacgagggcgtcatcatggtggagttgagtgggcggttgagcgacgccgaagccaccttcaaggcggccctcttcttgaaccccgctgcgaagttgccgctgcttgtctcacccaagctgaagcggcacttcgaatcggtgcgccagcatgtcctgagcgagctggccgcgcgaggagtcgatcgtgagcccttgaagatggaggcccccacagaggctcagcgggttcaggcgccacgagagccgcttcccgcggtggcctcgggactcccggagtcttcatcgtcgccagtaccggaggtatccggctcgcactcctcattgcgagaccgagcgctcatccccgcggtggcaggaggggccctcgtcgtcacagcgggcgtcttctggggattggcggagggaaagaagtcgaagctggcgcacaaggcgcagcacatcggctcacaggccgaggccaggaacgtggccagcaacgcgcgcgggctgcagacagtctccgtggggctgctggtgggaggcctggtggggctgggcgccgccacgggaatgtacctgctggggtcgccagagaagcaaggctaccctacaattcggggtggatggcacgtccgcgttcgtgtatggaaggtggccatgaagcccctgcgtcggtcaacagtccttggattgctggtgctcagcgtccatctcgctgcgtgcctagacgtcgacgaggcggtggaccaattctgcaacagtaaacctggcgcatgcctggatggcgcctcggatgcgggccctgatggcaatggcagcctggatggaggtaacgatggaggtgggccgcacggcgaggacggcgggccgcacggcggaggggacggcggttcggacgcaggcactgacgggggacctccggatggcgggcgagaaccgccggggtggaagtcggtggcaccgatgcagacgcggcgcacagggcatacggccacggaactgagaaatggtcgagtgctcgtcgttggtgggagtagctcaggcaacacccccacgaacaccacggagctctacaccgtctcatcaaacagttggagtcctgggccagacctcgcgacggcgcgcatggaccacaccgccacccttttaccgaatggaaacgtattggtggtcggtggccggggccccggaggtggcgcgctgaacagtgccgaaatctacgatgcggaagcgaatgagtgggctcctgccaatcccatcccactcggagcacgcgccagccatgccgccgtcctgcttccctcggggaaggtgctggtggcgggtggcgggaactcgcatctcgacgggctgaacaccgccgcgctctatcacccggacaccgactcctggacagatgctgggagcttgaatgtcaaacgcaacgtactgacactcaccctcctggaagcgggcgtggtggtggccattggtggcttcaatgctgctggagcggagacgacggccgaggtctacgactcgaatcaaccagaggcgggatggcgactcctcctggcacagatggaacatgggcgccacgggcacgcctccacgcggctgccttctggaagaatcctggtgaccggctccctcgagggctcaccaggacgggtcctcagggcagcggaactctttcaattgagcagcacttcgtggacgccccaggcggaaatgatggaagcccgcttctttcacacggcgaccgcattgccctcaggcgaggtgctgattgcgggcgggtattccagcccctacgcaatgccacgtgcctccgcggagatattccggcgagatggctcttcggagttcatcgctcccatgtcatcggcgcgcgtcaatcacacggccacatggctggaatcagggagtgtgctcatcatcgggggtatcgacggcggtgccgtactgaacaccgccgagcggtatgtcccctgacgcctgtgcctgtctcgtattcggtcgctgcgtagtgagcttcaaagaactcgcttccccggagtcatcccatggccaaaatcacagcccccaagccgcaaaccacaaccagacccgcggagagcaaaccgcagagcgcccggcctcaggcacagcggactactccccccgggcacacaggcacgtctagctttggcaaggctcccaaggacttctcgcagatgggggcgcccacgccgagccctcgaccgcaggacccgccttcgactccgcccgtcaagcctccggagaaaaagccggcgacacctccgaaggaggagacagacgccacggagccgaagaacgctccctcggggaaggaagcggcacagcgtcttcaagacaagcaccgatacatcggtggcgcggggcggaacgagcggacccgcgagttcaccgagaccatccagcagcaccagaatgatccgggctatctcaaacaactctacgcaacgttaggagacaaggacagcaaggagttgatttccagcgcatccgcgcagatcgcccatgaccagaaggggctctacaaaacagatgcggagcagacggcggcgttgaaagcgctcgccaagagcacgggctccgcgccgcccagcgtggtgaacgacctggcacgcgaggcggccaagagccaggtgccagacgccatggtctcagtactcaagcagccggagaccccggagtccgttcgtcgcacgttcttgaatgaatccggcaagaccgcggacaagaacaccatccaggcgcagaacttcgcggacgtactcaattcagaccccaagctcatccagaattacggagcagagctggggagagacaagttcgtcgcaatcctcgagaagggactgcagcagccaccgcacaacaacagcttctcgggccgagagcccaccaggtcggacggcgcggtcaagatacttgggcaggtgccagacctgttcaaggggccggcgtattcggaccaccgtgcgaacatcttccgtgtgggagccaacgcgttgggggacaagaccgaccccgcccgtgcgacccagttggaagggctcaagaagattttccgctcggacccctcgggcatcatcaatgaactgacgaacaattcgggtgggcccaacagcgcctacgacgacacgctccaggcgcttccgaagttcttgcgtgattcgatcgtccacggctcgggcaaggacccggggttcgcgaagttcgtcaaagaggacttgcccaagcaactccgcgcaggggcgctcaaccccgcaactgcgggtggaaagccccccgtcaatgaccattacgcgcgcacgctggggagtctcacgggagccatggtgggagcgtatggactggagatcaaacgcaccgcggacgcggggcagttcaagaaagacttggcggagaccatcgcgggtgtggcgttggcgcccttgggtcctgcgggcgaggtcgggaaagtcgcgctgaagaacttcatcacggaggtgctctccagcaaggacacgtcctggacggagcaactccgcgaggtctccgccgcagtgaaggataaagcctcggcggggctccagaacttcgacaagcacaaggatgccaatggaagggacatctcgggcggcaaggattggaacacccagacagagcatcagttcgaactgggctatgacgccatcctcgaacggctccgcatgttgagtgccaattagttctacagttgcaatttgagccgcgcgccacatgctcggtagtgtgtcggccctcaagctcctcgttcccctccaacgagaagttccttatcaaccactgcccccaggagtggttgataaggaacgcgagtcagcgccgggcgggagggatgctcacctccgtcacgcctcgggcgtcgagttggaggacggtgggcgcgcgctcgcactcccacgtggtgacgttggcaaagcacgtgtccccttcgcgccacagcccgccgtcgtcgtggatgtggccgaacaggtgtagccggggacgcacggcgagcacgcgctcgcgcaggtccgtacagccgccacgtccccccaccgaggagcggtccccgaagcccgccggaggcccgtgggtgatgagcacatccagtccctcggggatggccgcccacttgctggcgagggcggcgcctcggggcaggttgaaggcccagtcgttgtaggccggctgccaggggctcccccagaagcgcagaccctccacggtggcctcgccgtcctgcaggtagacgacgtcctcgccagcatcagaccgaaagggaccctggtgagggtggcgggctggagcagagggacgaggagggccgctgccagcggcgtccgcgccgtgtgcccaggccggtgccattcaattccgaacggtgacgacaccagtgcctcaccgaag

SEQ ID NO: 878 - DNA, 7035 bp, Myxococcus xanthus
  unsure (1)..(7035): unsure at all n locations
gatgagctgccaaacaggggcgctggcgctctagccgacgacgtctatgcccatggagcgtgcggtgccagcaatggtgctcatgcaggcctcgagcgacgcggcggtggtatcctggatcttcttcttcgcgatttcctcgagctgggcgcgggtgatctgcccgaccttctccttgcccggcttcttcgcgcccgaacccttcttcttctccgtgtggagacccgcggccttcttgatgaggacggcggcgggaggggtcttcaggatgaaggtgaaggagcggtccgcatacacggtgatgaccaccgggatgatgagcgcttccttggcttccgcctgggtcttcgcgttgaactgcttgcagaactccatgatgttcacgccctgctgaccgagcgcggggccgatcggcggagcggggttcgccttgccggcggggatctgcagcttgacctgacctgtgatcttcttcatcgaacgacaactgcctttcgagtgggtggtgcgagcgggctaccagacggggaagccctcccacccatgagtccggccccaatacggggaccagaaatgcgaacgccgcgcacgccatacaggagtacacggcgcggcatcaactgctagccggcggtcttctccacctgcatgaagtccagctccaccggggtggctcggtcgaagatgctgaccagcaccttcaccctgcccttctccgcattgacctcttccacggtaccgttgaagttcgcgaacggaccgtcgatgacgcgcaccgtgtcgccgtcgtcgaactgcaccttgggcttcggcttgagcgtaccttcggaaatctgcgacgtcagccgcgccacttcctgatcggagatgggcaacggattctgattctgcaccgttcccgggaacccggtgatcttcggcgtgttcttcaccaggtggagcgtccggtcgttcagctccatctgcacgaagatgtagccggggaagaacttgcggcgagaggtcttcttctcgcccttcaccatttcgacgacctgttccatcggaatcaggatttcaccgaactggtcctgaaggccctccaaacggaccttctcttccaggctcttcttcgcctggttctcgaagttcgagtaggtgtggaccacgtaccatttcatcgccattacaacttcccccacatggctggcagccactccaccatcaggttgtaggcggcggtatcgatgcagaagaggatgacggcggcaaccagggacgccacgacgacggccatggtcgacgccttggtctccgaccaggtgggccaggtgaccttcatcaactccgaagccacatcgatggacagcgcatgggtgcgcgggtggaagtacgcccccacagccagtcccacggccagcacgtagctcaccagggtggacaccttccagtccaagccctcgatgaggaccgggtcgctccagctgaatcgcgcccacagcaatccgagcagacgctccaggaagagggccaggacgatgccgacgagaagatagaagatgaccacgagccgcttcggatccatcgccgagcggttagcctgctggctggcctctgatgccgtcgccatggtgcctcacgaggtactgcggatgcgaattcgcgaaactgcgaaaacacaggaacccccggcacctccaggtaccgggggccccgcgactactgagagttggcaggccaggagggattcgaacccccaacacgcggatttggagaccgctgctctaccgttggagctactggcctagaaccttccctgaactaccgacctagaccttaccttccttgtggtcctgatgcttgcggcaacgaggacagaacttgctcagctcgagcttatcctggctcttccgcttgttcttcgtggtcgtgtagttccgctccttgcacacagtgcactcgagcgaaataatggaacgattgcccttcggcatgacctacctcaccagatacgagaggggaaggctaccacaacgcagccctcccctcggaatcgggacagtgagcccggcggcctcacggccgacccggcattactcgatgatttccgccacgacgccggcgcccacggtgcggccaccctcgcgaacagcgaagcgcagctccttctccatggccacgggggtgatgagctccacctcgatggcgatgttgtcgcccggcatcaccatttcgacgttctccggcagcttcaccgagcccgtcacgtccgtggtgcggaagtagaactgcgggcggtagcccttgaagaacggggtgtgacgaccgccctcttccttcgacagcacgtagatctgcgccttgaacttggtgtgcggggtgatgctgcccggcttggccagcacctggccgcgctccatgtcctcgcgcttcaggccgcgcaccagcgcgccgatgttgtcgcccgccatgccctggtccagcagcttgcggaacatctccacgcccgtgacgaccgtcttctgcgtcgggcgcagaccaacgacttccacttcctcgccgaccttgatgataccgcgctcgacgcggcccgtggccaccgtgccgcggccggagatggagaacacgtcctccaccggcatcaggaagggcttgtccgtcgcgcgctgcggcgtcgggatgtagctgtccaccgcctccatcagcttcaggatggccggctcgccgatgtcgctggtgtcaccctccagcgccttcagcgccgagcccgggatgatggggatgtcatcgccagggaactcgtacttcttcagcaggtcgcggacttccatctccacgagctcgcgcagctcggggtcgtccagcatgtccaccttgttcaggaagaccacgatgtacggaacgccgacctggcgcgccagcaggatgtgctcacgcgtctgcggcatcgggccgtccgccgccgacaccaccaggatggcgccgtccatctgcgccgcgcccgtgatcatgttcttcacgtagtcggcgtggcccggacagtcgacgtgggcgtagtgccggttcgacgtctggtactccacgtgcgaggtggaaatcgtgataccgcgctcacgctcctccggcgccttgtcaatcaggtcgtacgccaggaacgtggcgccgcccgtcttcgccagcaccttggtgatggcggccgtcagcgacgtcttgccgtggtccacgtgtccgatcgtgccgatgttcacgtggggcttgttacgctcgaacttctccttggccatgacactcctcaaaaataaatggagccctgaaccaggattgaactggtgacctcatccttaccaaggatgcgctctgccaactgagctatcagggcttggcgatgctgtgactacaacatttggagcgggaaatgggattcgaacccacgacattcagcttggaaggctgacgctctaccaactgagctattcccgcaattgccgagtggagggagatggattcgaaccatcgaaggcgtagagccggcagatttacagtctgctccctttggccgcttgggtatccctccagatattcacttgtcctaccacatcccgggccctcatccgcggccccgtccaacctggccggcggcgggatttgaacccgcgacctactgattacaaatcagttgctctaccagctgagctacaccggcactcatccggtactgcgactgccgccctaccccgccccagcgactccgtcaaccacccgtcaccgccctgagaggggcgcccttctagaattcccgttcgcccaagtcaaggagattgatcccaaacttcagctaccggccggagacggtgccccgctggcgggcgacctcgtatagcagaatgccggccgaaacggatgcattcaatgaaccgacctgacccgccatcggaatccggaggcggaagtcgcagtgcttgagcactccgtcccggacgcctgccccctcggcccccacgacgagcgccaacggcccgtcgagccgggcactccacatgggctccttggcgtcgacgtccgccgcggcgacccacaggccggcttccttcagttcctccagagcccgggagatgttcaccacccgcgcgatgcggctgtgctccacggccccggcggacgccttggccacggtgcccgtcacctgcaccgcccggtccttggcaatcaccacgccgtgggcccccagcgcatccgcggagcggatgatggctcccagattgtgcgggtcctggattccgtccagcacgaccaccaggggaggctgtcccagtgccttcgcggcctccaggagatcctccagctccgcgtacttgaagccgcgcagctcgaccaccacgccctggtgaacgccgccctccgccagcgtacccaggcgctcgcgcgtcaccttctccacgcgaatgccgaactcgcgagcccggctgagcagctctcccgccgctcgggcgccgagctgcccctccaccaggaacaagcgctccacctcgtccggccgggcccgaagggccgccaggacgggattcaccccgtagacgaaacgggaggcttcgccgcctccgcgctcgccccggctggcgcgctgggggacttcttcgcttgcgcgctcaccaccacggccgcccttggaagaacgctcacgcatgggaactcagaggacctcgacaggaagggagaaggtcttctgctgacgtgcgcagatcttctccgtgcagatgaagaagacgagcttcgcgtccacggagcccttgcccgcggcggccgtcgtgaaggggacctcgaagcgagggtccgcgaaggcttgaccctcggccttcttcgccacggagtccgccaggaccagcttctccttggccggagtcaactgactccccttcacctcaagcttcaacggcgcctcgtcggagacatgggcccccgccttcgtcttgatggcgaggacgaaggtccccttctcccccgccttgacctgggtcgaggtcccctcggtggagacctcatacagtgaggccggatccacatccgcggccagtacgggcgcggagcaggtcactgccgccagcagggcggcgagggaggaaaggcgttggcgacgaagcatgggcgtctcctggaaacgatgggtgcgtatcacgcttgagacagcgggggccgtctttctcttcacgcgccgccttcgccggtccgagcgcggcgccccgtgcccttccggtccacagggagctgggcaggctcagatgacgcgggcagggccgacggaggcgacaggtccggcacggacacgggcggctcccccgccacgagcgcttccgcgcggatgatgatgagcgaggccaggtccacgcccgtcaccgcctccatctcaggaagcgcgggggagctgttcacctcgaagatcttgggttggccctgcacgtcgagcaggtccaccgccgccacttcgagcccgatgagccgggtggccttctccgcggtggctcgctgggcgggtgacagctcgtgcgcctccagccgggcccccttgatgagggtgtgcgccaggcgcccggggcgcgggcggcgacgaaccgcggccaccgcctgcccacccacgacgagcacacggacgtcgatgcccgtgctcttcacgtactcctgcatcacgagattgtgccccagccccaggacggcctcgagcgcggcctccagcgactggaggctctcgcacaccatgacgccgtgcttctcctgcccctgcagcagtttgacgaggacgggcacgccgcccagcaagcccaccatctccttgaggtgagccgcgtcgcgcgccatcaccgtcgacggaatgtcgatgccgtgcgccgagagcagttgcagcgagcgcatcttgttgcgcgactgcgcgatggcctgcgcgtggttgacgagcgagacccgcgccaggccgagctgattcaccacggccaggccatagttactgatggactgggcgatgcgggggaggacgacgtccgtgggcgccagcttcttgcggccgtagtagagcgtggcgctgcgcccatcgaggtgcatctgcacgcggagtgggttgaggacccgcacccggtgccctcttgcgcgcgccacctcgacaagtcgccgagtggacgggatggaagcggagcgcgagaggatcgtggctttcatgagcggggcggccgttccggggagagagggacctataatccccgcccctcgccgggtaaagccgccccgcgaaccgctggactagcgctgacggatggcccgcacttcaatcttcacgggcgcctccggggtggaggccaggatgcgctcgcagatctgtcccgtgaagcgcacaccgtcgtcattcagcgtccaggtgctgtcgctcgatggagtccgctcgccttccacgtagaccacgagcagcttggggtcggtcgggcgctggggaccatccagccgaatcaggcagggctccgggatcttcaccgccagactgatctcctccagagcgctggcaagttcagcctgattcccggcctggaagaaggagcggttgcacagccccgtggtcgggttgcacgtgtcaccctcgccgcacgggcgttccgcgctacacgtacgtttgaagccgcccgcgcgcgccatcgcttccagcactgccggcccatcccccaccgcagtctccgcaccaaagccgatcacgatggtctgaatgcccttttcatgaagctcccttacagcagtcacggaggcatcggtgtccagacatccacggttgaggtaaccactctggcattggttgccctcgatggtgcacttgcacaactccgggttcgcaccgctgttagggttcgccgcgttgcagtttggcaggccgtccgtcaggaggatgacgaagttctcccggtcggggtcctgaagcccctcaagccctcccacgaagttcagacttccgctggtcggcgtccccccaagaggccgcccctcaccaccattggggatgccctgcagcanggtgttgatttcatt

SEQ ID NO: 879 - DNA, 7186 bp, Myxococcus xanthus
catggacgagcagtcctccgccgcggtgcgcgaggtctttgtccggctgtacgaagagggcctgatgtaccgggcccagaagctcatcaactggtgtccttcgtgccacacggcgctcagcgacctggaagtggagcaccaggagaagaacggctccatctggcacatccgctacccggtgaaggacaccgaccgcacgctcaccgtggccaccacgcgcccggagacgatgctgggcgacaccgccgtggccgtccatccggaggacgagcgctaccaggacctgattggcaagcacgtggtgctgccgctcagcggccgcgagattcccatcatcgcggacgccgaactggtggatccgaagttcggcaccggcgtggtgaaggtcacgcccgcgcacgacttcaacgactaccagacgggcctgcgtcacaagttgccgatgctgtccatcttggacgaatcggcccggatgacgaaggagaccggcaagtacgccggcctggatcgcttcgaggcgcgcaagcaggtgctggcggacctccaggagcaggggctgctggagaaggaggagccgcacaagctgtccgtcggcacgtgccagcgcagcaccacggtggtggagccgcgcctgtcgccgcagtggttcgtgaagattgaaccgctggcgaagccggccatcgaggcggtggagcagggccgcacgaagttcgtccccgagtcatggacgaacacctacttccactggatgcgcaacatccacgactggtgcgtcagccgccagctctggtggggccaccagattcccgcgtactactgcaccgcgtgcagccctcggttgggggacgacaccgacctgccgctggattccgcgacggtgaaggtgggcggcgtggacttcgcgcgcgcggagccgattgtcgcgcgtgagcagccctcgtcctgcccgaagtgcggcggcgccacgttcatccaggacccggacgtgctggacacgtggttctcgtccgcgctgtggcccttctccacgctgggctggccgcgcaacacgccggagctccagacgttctacccgacgtccgtcatggagacgggccacgacatcatcttcttctgggtcgcccggatgatgatgatgggcctgcacttcatgggggatgtgcccttccgcaccgtgtacctgcacgcgatggtgcgcgacgagaagggcgagaagatgtcgaagacgaagaagaacgtcatcgaccccttggacgtcatcctcggcgcccccgcggacaagcttgagccgacgctcaggaacaagttcccgcagggcatgcctgccttcggcgcggacgcgctgcgcttcacgctcgcgtcgctcacccagcagggccgggacatcaagctgtccatggaccggatggctggctacaaggccttctgcaacaagctgtggaacgccagccgcttcgccctgatgaacatgggcgagttcacgctggatgagcgtcctctgaaggagcgtccgttgacgctggcggaccgctggattctctcgcggctccagcgcgccaccactgaggcccgcgcctcgctggagacgtacggcttcgccgaggcggcctccacgctgtaccagttcctgtgggccgagttctgcgactggtacatcgagctggccaagggctcgctctacggcaccgatgagcaggcgaaggactccgcgcgcgcggtgctggtgtactcgctggatcgcatcctgcggctgcttcacccgttcatgccgttcatcactgaggagatctggcagaagctgccgatgtcccggtcggtggacagcatcatgatcgcgtcgtacccggagcccgacgcggacctggtggacgaggccgccgaggcggagatggccccggtcatcgcctccatcgagggcctgcgcaccatccgcggcgagagtaacctgtcgcccgcgacgaaggtgaaggcggtggtgcagagcccggacgctcgcacgcgcgagctgctggagcgctggcgcgcgtacctgatgccgctggccggcctgtccgacgtggagattggtgcgcccggcaccaagccgccgcaggccgccgccttcgtgggcacgaacctggaaatctacgtgccgctggcgggtctcatcgacctggacgcggaacgcgaccgcctccgcaaggagattgcgcgcaccgagcaggaggccgccggtgtgctgcgcaagctggagaaccccaacttcgtggccaaggcgcccccggacgtggtcgagaaggaccgcgcccgcgtggaggagttgaaggagcgcaaggccaagcttcaggaccatctgcagcgcattgccccggagcccgccatgcccgcagcgccgccgtccgagagccgcacgccgaccgaaagcgttgagccgaccgaggccgacatcgtgactgaagccgacgtcgcgaccgagcccatcacgccgcccgagagcgctgctcgattagagacgccgcctccggccgaggggggcgctgaatacgagacgctcgccgagtccaccgaggaggaggaggaagccgctgctccggccgaggtgaaggccgcgccggatgcggaagccgaggggaacgtcgacctggcggaggagttgaaggacgagctcgaggccgtgggcggcgtgcccgaagccgcggacccccaggtgcaggacgccctggagaagctgcgcgcggggacgaaggaaggcctgtctccggccgaccatcatgacctcggcgttgcgtacatgagcatgggcctcgtcgacgacgcgatgcgggagttcaacacggcgcgcgccggtggcgacgcccgtgaggcgcccgccgccgccgagcagacggtggcctccaccgcgaaggccgtggtgaaggccaccctggccgccgtgaagaaggcgtcgtccatcgcgaaggagacggtggtggaggctgtctccgcgtccggcgaggatgaggagcctgccgctccggcgaaggcgcgtcccgcgaagaaggctgcgggcaagaaggcgcctgccgtcgcgaaggaggctccggcccagaaggccgcgggcgcgaagggcgctgccaagaaggccgctgcgaagaaggctccggccaagggcgcgaagggcgctgccaagaaggccgctgcgaagaaggctccggcgaagggcgctgccaagaaggccgctgcgaagaaggctccggccaaggtcgccgcgaagaaggctgccacgaagaagtccgccgcgaagaaggcgcctgccaagggcgcggcgaagaaggccgctgcgaagaaggctccggccaaggtcgccgcgaagaaggctgccacgaagaagggggccgcgaagaaggtcgctgccgccagcaagaagccggtgaagaaggcggcgggccggaaggctcccgcgaagaagggcaccggggcgaaacccaaggcgcgggcaaaggcccggcggtagcaggaggagacgtgcagcagcaggattacctcgaccggctcatcgcgctcgcactcgatgaggacctgggggcggcgggtgacgtcacctcgcaggccctcatccctcctgactacgagggcagcgcggaactggtcgccaaggagcagttggtgctcgcgggactggatgccttcgtccgtgtcttcaagacggtcgacccgaacgtcgaggtggagctgttgcgccgcgacggtcaggagatcaaaccgaagatggtcgccgcgcggtgtcacggacggatgcgctcgctgctcgcggcggagcgcaccgcgctcaacatcgtgcagcgggccgcgggcatcgcgacgctggcgcagcaggccgtcacgtccgtgcgtggctccaatctgcgcgtcctggacacgcggaagacgccgccgggaatgcgcacggtggccaaggaggccgtccgcatgggcggtgcctccaaccaccgcttcggcctcttcgacggcgtcctcatcaaggacaaccacatcgccgccgtgggtggttccatcgcggaggcgctgcgccgcgcgaagctcaacgggcctcggctgacgaaggtcgaaatcgaggtcaccaacctcaagcagcttgcggaggccatcgagcacggcgccgacgtggtgatgctcgacaacatggacgacgcgcagattcgcgaggccgtgaagctggcggcgggccgcgtgccgctcgaggtgtcgggcggcgtcacgctggaccggctgcctcggttggcgaagctgggcatcgacttcgtgtccatgggcgcgctgacgcactccgcgcgggccatggacctgtcgctggaaatcaccgccgcggcgaagcggcccgcgcgcagcaagcagccgaagccggcgtagcgcgcggacacggaggcgctcctagctccagcgcctccgtgtcgaagggcgtcccggcatcccgcctggacgcgcggagcctgtccttcacggaacgcggaccggagcggacggcgccgtcagagcgcgtgtccgccacgctgacgcgttcgctcacttgcccgtgaggacctccgcgcggggcttgccctccgccgaagcgggcatgcccatctccatcagcgccgacagggtgggggcgaagtccacggggtcgatctcctccaggtacatgcccggcttcacgcccttgcccgcgaagacgacgggcacttgtgaatcataggaatgcggcgtgccgtggctggtgccggtggggatgtagtggagcatgtggaagggccggagcatgaagagcacgtcgccgctgcgcccggggtagtagctcttgcgcatgagcgtcaggtagccctcggtgtccggcgcggtgaacaggtcgtcattagccacagccgtgatgaccgacgggtgcttcgccagccacgccgccgccgcgcgccgcaccgccgcgtccactgagcccccctggtgcgtcttgccgcccaggtacacgtccagctgttcgagcgtggccgtcacgtcgccgccgaactgctgacgcagcgcctgcgtcaggctctccgccagctccttcgagctcacgcgcctcgcggcgagccccttggcggcccactgctccggcatcgccgcgccgccgtggtccgcagacagcgcgatgaccaggttgccgcgtcctcccgcggcgcgctcggccgcggcgatgaggttgcccatcgccttgtccagccgcagcagcgtgtcctgcatctcccacgagtagggcccgtactcatggaacaccaggtccgtgctgctgaagctcacggccagcagatcgggcacgtcgtcctggcccagtccctcgccggcgatggccgccttggccgcctccaccagcaggtcatgcgagtccggtgagagggcgaacgcctggtagaaggcagggcccggcgacggcagcccgccgtccagcgggtgggggaaggtgaggcccaggccgtagacgtctgcctcagcgaggccttcgtcctcgcccacgtactccgcggccggccgcatcagctcccacttcttgccgaaggacgcctccggcagcttccgcgcgttcagcgccttcagccacgccgggaactccttcgtgtaccaggtgccggtgacgaacttcccctcgcccttgtcgaaccaccacgcctgtcccgcacgcccggccagggcgatggccgcgtggggtttgatggacaacgccaccgccttgccacgctcctgcgtcgtcacgcgcagccggtccgccagcgtctccaccatgaggtgggcggggccggagtcctggcccggcttcagcggcacctccagcaccggatgggccgcgtccgcgaaggccatcacgcgcttcatcgtcgagcggtccacccaccggttgtccacgatgccgtgccgccaggggttggcgcccgtggagagggtggcgtggccgggcgcggtgcggcattcggcgtagccgtagcgcgcataaggaaagtacgcgccctggttgaggagctggtgcaggccgcccttcaggcgcggacggttgcgtagcaacacgtcgctgccgagcgcgtccacgctgatgacgagcgtcagcctgggaggtcgggcaaaagcgggcagggtggccagcgccacggcgagggaaagtgcgcgaatcattgggatgagaaccatctccgccgggatggtgagaagcaaccaacaacgcgtgtcactgcttggacgccgcacatcgcgctgttagggtcgctcgattcatggtcgaggcccgccttcgcgtcatctacggcgacactgatcagatgggtgtcgtctactacgcgaattacttccgctatttcgagttcgcgcgcagtgagtacttccgcgcccggggtggcagctacgccgagctggagcgctctggtgccctgctacccgtggccgaggcgagctgccagtacaaggcatccgcgcgctacgacgatctgttggtcatccaaaccaccgtgagtgagttgcgccgcgcctccatcgtgttcacctacgcgctgtttcgtgacggtgcgccacgcacgctgctctgcaccggtatgacccgtcatgcctgcgtggggcgggacggcaagccgacgcggctgccggactccctcatccggctgctcgaaacgaccgggccttccccgggctcttccccttccacctgaacccttccggcatacgcaaggagcacacacatggatcgcaacctggcaatggaggtcgtgcgcgtcaccgagatggcggccatcgcctccgcacgactgatgggccgcggcaacaaggacgagtcggatcaggccgccgtggacgccatgcgccgcgccttcgacgcgctgcagattgatggcaccgtcgtcatcggcgagggcgagcgcgacgaggcgcccatgctctacatcggcgagaaggtgggcaagcgtggcgagggtgcgcccgaggtggacatcgccctggacccgctggagggcaccaacctgtgcgcctacggccgtccgggttccatcgccgtggtggccatggcgggcaagggcgggctgctcaacgcccccgacacgtacatggagaagatggccgtgggcccgcgcgcccggggcgccatcgacctgcgcaagacgcccacggagaacctccgctccatcgcggagaagatgaaggtctatgtggaagacctccggtcttagagacacgt

SEQ ID NO: 880 - DNA, 6960 bp, Myxococcus xanthus
ctctaaagaggccgagtggagcgcgtcacggacgcggaggcggacgcgtacttccagagccgcgcccgcggcagccaggtgggcgcgtgggccagcctgcagagccagccgctggcgactcgcgaggagctggaggcccgcgtggcggaggtggagcagaagtacgccggccagcccgtgccgcgcccgccgcactggtccggcttccgcgtggtgccggaccgcatcgagttctggcacgcccaggagagccggctccacgaccggcacgtctacctgcgcgaggacggcggctggcgcacgcagatgctctacccatgagggcacggctaccagggcacttcggtcccctggtagtcgaagaaccggccgctgtgctccgggttcagcccgtcgatgacccgcagcatgccgcgcaccgaatccggcgccggcagcgtggcgtccgggccgcccatgtccgtctgcacccaaccggggtggagcagcacggtgacgaagccctccgggcgcaggtccgtggacatggagcgcacggccatgttcagcgcggccttcgacatgcggtacgcataggccccgccgtcggtgttcgccgccaacgagcccatccgcgaggtgacgtgcgccacccgccgcaaggcgccttgccgcaagcccggcagcatcgcgctggtgacacgcagcggccccagggcgttgatggtgaacgtgcgcgccatgtccgcgtagtccacgtcacccaacgcgcaccacaagccggagacaccggcgttgttgatgagcacgtccacgggaccggtacacacgttggtggcgaacgcgcgcacgctgtcgtcgtctcccacgtccagcgcatggatgcgcaggcggttgcccgccttctgtttcaacggctccagccgccgtgctccctctggcgacctgaccccggcttcgacggtatcgccccgcagcaggagctgctggacgaattcgaaaccaatccccctgctcgctccggtgatgacgtagcgcatgcatggcattaacgcgctgaatgccttccgctggcaaaacacgcgtgttgacgaccagggagtgcacgctggtaaccggatgcaccacatgccgaggacaactggaatgaatgtcgccgtcgtgggaggtgggatttcggggttggccgtcgcgcatcatttgcgctcgcgcggtacggatgccgtgcttctggagtcctccgcccgacttggcggcgcggtgggcacgcatgcgctcgccggctacctggtggagcaggggcccaacagcttcctggaccgcgagcccgcaacgcgggcgctcgcggcggcgctgaatctggaggggcgaattcgcgccgcggacccggcggcgaagcgtcgctatgtctacacgcggggcagactccggtcggtaccggcctcgccgcccgcgtttctcgcatcggacattctgccgctcggcgcgcggttgcgcgtcgctggcgaactgttctcccgccgcgcgccggagggtgtggacgaatcgctggccgccttcggccgccgccacctgggacacagggcgacgcaggtgctgctcgacgcggtgcagacgggcatctacgcgggcgacgtggagcagctcagcgtcgcggccaccttccccatgctggtgaagatggagcgcgagcaccgcagcctcatcctgggcgccatccgcgcgcagaaggctcagcgccaggcggcgctccccgcgggaacggcgccgaagttgagcggcgcgctgagcacgttcgacggcggattgcaggtgctcatcgacgcgctcgccgcatcgttgggtgacgcggcgcacgtgggcgcgcgcgtggaggggctggcgcgcgaggacggcggttggaggctcatcatcgaggagcacggacgccgcgcggaactgtccgtggcccaggtggtactggcggcgcccgcgcatgccaccgcgaaattgctacgcccactggatgacgcgctcgccgccctggtggcgggtatcgcctatgcgcccatcgcggtggtgcacctgggcttcgacgcggggacacttccggcgccggatggctttgggttcctggtgccagcggaggagcagcggcggatgctgggcgccatccacgcgtccaccacctttcccttccgggccgagggcggacgcgtgctctattcctgcatggtggggggcgcgcgtcagccagggctggtggaacaggacgaggatgcattggcggcgctggcgcgcgaggaactgaaggcgctggcaggcgtgacggcgcgcccctccttcacgcgggtgttccgctggccgcttggcattccccagtacaacctgggacacctggagcgcgtggccgctatcgacgcggcgctgcaacgcttgcccggcctgcacctcatcgggaatgcgtacaagggcgtgggcctcaacgactgcatccgcaacgcggcgcaactcgcggacgccctggtcgcggggaacacctcccacgccccgtaggagcgggcctcaccccgcacgacaacccgcgcacgcggcgccagcacacattcgtggcgcccttgctcccaccggctgacctggcatgtcagcccaaagcctctccacacaaaccaacacgccaaccacaaatcaataccaacctcccaccaccttgaccagacaccgccacaagacaactccacactgccttgagaaggcaaacaccacccgctaggcttcagacgcgaaacgacagccctctgcaactgaaagcggatgacggtgcactggtgactcaacccctctcaggagacagctccgccgcgaggcgattccttacccggctgggaccccattgggcacggcaggccgcggtcaagaacaaggagcccagcctgacggagttgctggagcccgcgaagcctgacttcgccgagcgccttctcccctttcgggaccaccctacctaccagggcctcgacgaggcgatgaaacgaagggtcctgagctgcggctggctcatctacaacgagcgggttgtcagggtggagctggacgtcgtcaatccggtctgcaacgacgtgctcctgagcaagctgccaggagccacgagccaggcggctcgggagtccatggcccaggcgctggtggacgaggcctaccatatcctcctcgtcgtacgtgcctgccggctcacgcgcgagcagcgcggactcgaagacctgcgtcttcccgtggttggcgtggtgcggcggatgcatgcgagacaggcctcctgcgcggaagcatggcaacgggacctggtccagttgatgacgggcgtggccacggagatgtgcatcagccgctatctctcgctgctgtccactgcctcggaaatccaggcattcaaccgcgtcaccacggcgctccaccaacaggatgaagcctcacacgtcgacctgttcgggaccctggcacgtgacgtgttcaatgccctggagcccgtgcagcaagagttcgtgcgtgaaatccttcccttgccatggctctggttcagcgaaggagaagcggatgtctggcgttcggtgctgctgcaactcggcatcccccgcgcggatgtgatgatggacgactgcatcgccaacaagctcctgagcgccaatgaacgggcgatgacggatgcccagaagttctcggaggcgctgggcatcgacaacatccattgggaccgcgccgccgcgttgctctgagcttcgttcgcgccatgccccattccatcgccagcaccgtcccggaggcaggtccaccgctggacgtcgtcgaactcttcgtccggcaggcatcacgcaccccacatcgggtcgcgatatcgacgggaaccgtccagctcacctatcaagagctcgagcggcgcgcgcggtccctgcacgcgcggctcgggttgctcggggcagtcccccagacgccggtgggcgtcttcgccgagcgcactcccgaggcgctggtagcggcgctcgccgtgctcatggccggctgcgtctacgtccccatcgatccggcataccccaccgagcgcatcgactacatgctccaggacagtggcgcgccgctcgttctcgggccccacacgcaccgcgacaccaggaacctcgccgcgcgattcctcgcactcgacgaggagaacgcgccccccacctcactttcagaagcccgccaggcgccaccccatcctgagtcactcgcctacatcatctacacgtcgggctccacgggactccccaagggggtgatggtcgagcacggcgggttgctcaacctggtcctggaccacgtcgcagcgttcgatgtcgtccccgaggaccgggacctgctcgtcacgtcgccgtccttcgacgcgtcgatgttccagctgttcatcacctgggcgacaggcgccaccctgctcctccccccggagcacgttgtcacagaccccgatgcgatggtcggctggctcaacgaacaccgggccacgctcctgtccatgcctcccgcgtatttgcatgcactgggccggcggcccattccttcggtgcgcctggtcaacaccggaggtgacgcccccatcgaggaggatgccctccactacgcacggacgtgtcgctatgtcagtacgtacgggcccaccgagacgaccatctgctcggcctatcacgaggtccacgcagacgcgtcattcccagaaggcatccccctggggcgtcctgtccgaaacgcctcgatgttcgtcctcgatgaggcgggaggcatctgcccaccgggccagctcggagagctctgcatcgccggccagggcgtctcacgtggctatcacgcccgccccgagctcacggcgcagaagttcgttccccacccgtaccaccccggcgcgcgggcataccgcacgggcgacctcggctatcagcggtcagacggcgtcttcttcttccgtgggcgcgtggaccggcaggtcaagattcggggttatcgagtggagcccgaggaggtcgagtcgcggctccaggcgctcgaaggcgtcgagcgtgccgtggtgctgcccgtgggcgccaatgccagctcgcggaggctcgtcgcccatgtggtgggacgtccagggttggagcccgtggcgctccggcgcatgctggctcgtgagacgccggcgtacatgctccccagccggattcacgtgctggatgcgtttccccggacgcccaacggaaagattgaccttgcacgcctgcaagtgctcgagccccgaaggtccgcctcccatggcgagccacgaacacccgaggaggaacacctgtgcgcgctgctcgaggaaatcctcggggtcagcgtggaggccgaccagggcttcttcgaggtgggcggcgacagcctgagcgcggcccggttcatcgtcgaggcacgcgcgcggcaccgctacatgctgccgatacaggccttgctgcaaggggccacgcttcgagcgctcgcgcgagcgctggtcactgcgccacaggcacccgctccggaggtggcacgactgccagaggcgcctggatatcccgcctcggacgcgcagcgccggctgtggctggtgcacgaggtaaatggtggctcggcggcctacaacctcgtccatgcgtggtgggtggacggagaactggacgtcgccctgctccgccgcgccctcgatcggctcatccagcggcacgaagccctgaggacacgcttcgacctcagggacggcgtactggtgcaatgcatcgagcaggaagctcgcgtcgactggctggagccccaggggacgccggccccggagctgttcctggaggcagaggccgcccacgcattctctcttcgcacaggtccgttggtccgggccgcggtcctggccgtggccccccaaagatggctcttcaccctcaacatccaccacatcgtctgtgatggctggtcgatgggtgtcatcacccgggaactggagcacacgtatcgggcactgcgcggcggcgcctcgcctcccgtcgtcccgctccccctccagctccgcgacttcaccgcgtggcagcggcaacgcgtggagggccccgctggacgcgatgccgcgcactactggcgcgcccgactggcggaggaagggggctcgcccccgctggacctgccgctggaccggccccggcccgcgcgccccacgcaggcagggcgcgtacaccaggtgcgcgtgccccccgagcaactgcgcgccctggagaacctggcccagcgcacccggacgaccttgttcgtggcgctcaccgccctggtcaagctgctgctgtaccgggagacacggcagagtgacatctccctcggggccccgctggccgagcgagaccacctggacctggcggagcaggtcgggttctacgtcaacaccatcgtcctgaggacccggctcgacggacgggaatccttcgttcaactcctcgagcgcgtccggcagggcagcaccatggcgcagcaccatggcctcctccccttcgaccgggtggtcgaggcgtccgggttgcctcgtgagccatcccgctcccccctctttgacgtgatgattgcgctccagcaggaggagcatcgcgccctgcgcctggcggggaccacctgcacccgcgtggagattccccaccacacgagcaagttcgacctcagcttcgacttcgtccggaccggcgaagcgctggtcatggagctcgaatacgccacggatctattcgacgcggaccgcatcgagcgactcgcgcagcgccagctccagctcctgggcgaggtcctctgcaaaccggatgcacccctggacgcgctgcagcccctgcctccggcggagcagaccttcatcctcgagatgttcggggggcgccgccttcccacgcccgctcccgacggcctgctcgccggcttccgtcacgccgtcgcgaaggacggaggccgccccgcgtt

SEQ ID NO: 881 - DNA, 7617 bp, Myxococcus xanthus
gccccgcgcaagagctgggcaagtcgagcgaggcgaaggtaacgctcaccgactcgcgccagggctccgcgcaggcgctcggcctgggcgggagcatgggccgcgaggtgaatgtggaaatcagcggcaacctcgaggacatcgcgaacagcggggcgttcaccagcatcgccaacgggcgacgtggggcaggcggtgacgcagcttggcggcaaggtcgacatcaaggccaccgtgcaggacaagaccacggtgaagggggacatcggcgtcggggtccacgccggcgtggtcggcgccgaggcgggggtcaccaccgagcgcaccacggtgggcgaggagcacgagctcaccgccgcgcagctcgtggagctgtacctcacgcagcgctggtccgccggagtcgccagctgagaccggtccgcggcgagggctgctcgcgccatgcggtgcgctcagccctcgcccttgcctccggactcgtacttcttgcgcttgcaccacagtgtgggcgcgtcgatgccgagcaccttggcggcctcgtccagcgtgggcgcggaggccatgacgcgcagcgtgtgctcgcgctccacctcctccagcgtgtgcggcccccccagcgccaccaccgagcccgccgcagcggcgatgtgggccgggaacgcctgcggctccaacacctccgtcggccacacgatgagcgcccgcgcataagaggaacgggggccctgttgagggggagggagggtgcataggggcctaggagggccgcccgagcgatgctcccggccgcgggacaggtcgcttgagcccacttggggcgcacacctggccaggccgcgctcccatcaggtgcgtgacaggagccgccagcctgttggctgtcttgagcctcaacaccacacggcctggggtggccctcgtgccggggccaacctcgcacatgccgtgggcaagcccaggtgctccacaatcgcccgcaccccgggggcccccttcacgtacgccaacacccgctgcctgcctccacacctcacacaggcgaacacgtcgaagtcgaacgtcctcctgcgcaactcggcgaaagtccactcgcggtgccctctccttcacccgctgtcccgagccatggtgacgctccactcgctcccacgcctgcagcgtctggcagtggcggccaccgtcggcgtgggccagcccgagggccggtccgccagcgagcgcaccctcgccgccgagtggcgtgtctccgtggccgaggtgagtcgcctgcgcgagctggggctgcgccgactgcgtaaggctctggagaagatgccatgcccgtaatcaccgcgacgagggcgggcacgtgcaccgccgccgggtgcggtgggcgaatccgcaaaggtgagctgtgctggttcgagtccagcatcggcactcgccacctggagggggactgtcgcgaggctgacgcaggagcgcgtcccaaccgcacagcgacctcgtgtgtcaggtgcggccgtcgcgtcggcgccggtcaagggtacttgcgggtgacggagcagggcacgcggaagacgtacacggtgacgtgtgcggtcgcctgcgggccaggacgccaacgcagcaccaacagagggagctgagccatgagcggcctgtcctccctctccgatgtggtcctcctcgagcggatgctcgccgcagcccgccggggccgtgtgccggagggtgagcgccgggccttcggcgccgaggcccggggtccgctccgcgaggacgtgcgctcgggcagaggggcgccgtagcgcagcgtcccctcgcggctcttgtcatgccctcagttatttattgcgaagcgagcgctcaatctctactgctcgcttgacgcgtgcctgcgccgcttcgtcgaatgctgcggtgagttcggggttggcgacacactccgcaaggcccgcgaagcggattgcagcggcggcgtgcgcgagcgctgcccattcgggctttggaggcggctccttaaaccgccgccacgatcccgggacgtgcagagggaccggcttcccaagcgggtcgagttcctctccatcccattccgcagagacgcgccgcaacatttcccgaggattgcgcccctccgcgagagcagccgcagccatgtccgcgagccggtcgacgaccgacaccgcctccatcttcactcgccacggatccggaaccgggcttagttctggaggaggcgaaggcagaccgaggtccaccggcaccggaacgtcggggagccgcagccgccgcggccatatgtctcgtatttctccccgagccatgagcttgagaaaaaaggaaatgaagctgttgtccaccggcatggttcgccctcgtgtcagtgtcctgctcacgtcgacactgaccacgatgatggtgccgcgcagcaagcgctaagtgtcgaaccaggaaggccgcccccttccgccggacgtgtgccccccggcgtaggcaatgcgagccttggggaaggaggctgcccgtcgctcgtggaccggcccggcacgaagacttcccgctcgcagccattccgaggacgtgcgcgcgggccacggctccccgtgacaagcagcgcacgacaccgccggtgccgctgaaaccagtgtttgcccgctcgaaaatctccaccgaaattctgggactcctccacccgtgcccttgagcgatctcggggccgattaggggctccactgcacttgaacagccgtctctaagttactgcagcgccgacaaggccatgggcggcgagggaggagtgtgtccgcgggccagccgctctcgtacttccgcccggccgtcaaacctccgaagatggagaaatgccctccatccacttcaaatgcgttgatcatctcaaccttcaccgcgtttccgacgacgaatacgaaagcgggaactgggttgtcacgccggccgatgcccagcggctcattggagggatgctctacctgcataacacgaagtccgagcgttcctacttcggcggcaagatcaagtcggcccgccaagtgcgcaccaacgaccgcatccccgatcgtatcgtcttccggttcgtcccgctgtctgaagccaggggagttcgctggaggggaattgaccacatcaacgcccatcagagcggtgtggtggaggacgaataagccattcccatgatgaaggaggagcgcctgcggcctctcgtcgtgcgctgctccgaactccttcaccgtcatcctgtcttcctggaagtgctcggcttcatatcaggggatgactcaggatcgggacctgcgtagtggaacagttcattgggctgcctcactcgcgtcatcactcccttggcgagttaagataagtggcaatacgctgcgggccgcaacttagtaatcgcatttgagaagaactctcattggaggcaacaatggtgccagcaaagagcatccgtgatgctgcaaagtggattcataaagttgcgcttgggaagatgaatcctcccgctggctcttccccaagcaaagggtatgcaacatacaccgaattctgccaacacttcaaactaggcgatccccataataaccactatatggagcaactcctactggcagtaatgaaagaatgcgcccaacaaggctggccagatttagcttcactggttattcacgaatatggcaccggacagcgcgaaggacctggagatggatggtacgaagggcacggcttgtggattggtgatactccaacgtggaagcgttacagggatgagtgctggcgtcgtgcgacacaatttacaattccgtgatctgatgcgacttggtcactgcggcttttccccgagggaattcaatgcttggggaaaccgccaagctcctgagagaaatgtctgagtaggactcaagggcgctcgactgagggaacagtcacaagactttgtctctaaagaggcggcactgatggtgcgactccttgaggcccctcgacgatctcaataagtccaatcctggtccggatggcttcgcagatggcatcaacctgctctacaatttgctgctgattctcttctgcttcttcccagtacttcatgtcgacacccttcttctgtcggcccttgtagtagtacgagaatgcttcccgcctggatagggactgtaattcgcggatttttgcgaagacctcttgggggaaaaagggctcgttctccgctattacactcactgctgcattaaaagcctcggcaaactccttgtatcgtcgctctcgacgctcctcctccgtttcgcgcacatccaccacgtcaccgactggccggagcgtcagagtctttatcttcaaggcgtggagcgccttccatgtgtcggcgtacaactgaaactccttcgcgaactgcaggttatgcactcggtgccttcgtgagtgctcagcctcaaggttctttaggagaacgtccgtgcgctccttcagcgcgtgaagacgctgcgcggactccgcctgcagtgcttggagttcccgctggatggcgagtttttcacgctcaaggatgcggttggcccaaaccttcccaagccagttcgacagcccaaggataaggccgcccgcgctgccgatggagaggagaatggaccaagccaaatcccacgtttccgagaacgtcatggtcttcgagtgcctccaaccgcgtgtgcggatataaagtatcacattgatgcgactataggcggcagcacgctgggctcgccgcgtatgcagtgagggtggacccaagcccatagcgactacttggccccatatggctcagaaagtgcccctcccctacccctataagcccggaaaccggacacacctgcacagcggtgcgcgccgtccccagaatttctagtgagattttcgcaggggctatcgttcctccgctccgcccgattcttcttaacccccggcaccgcaccacaccgccccccacccatgtcctctcaagcgcccgcgtgatcggaggcagttttttggggtcttgacgttatcgacatgaacctgtgcggcatgaccgcgaggctcttgcgacccgagcccccaccccagcctcaccataccttgtcgaactccgctgctattcctggcatggtctcgtggggagcgaacgcggagccggaggagttgaatgagcgtgcgcggggccatctggctggtgttggcgcttgccatgacaagctgttcaaccactcgactcgtgcgcctggacacgggggacgggcgccccatggtccacacgccactcacggaggacgacgccgcgcccgtcgagttggacgatgacgatttcgaggaggcagtggttgcgctcgcccgggatgtgcggcccttctccaatcccctgcgcgaggcccgccaacgcttcggcgttcccgaacgcagcggcgtgtacctgtatcagcctcgcggcccccggctcatcccccagggcgaagcgatggactcggacagcccgcgcctgctggattcctacgcggatgacgacctgacacgcgcctatggccgctggtgcgagcgcaagtcccagcccggcgactgcctgcacctgctggccgacggcccgctgctggccagcgacggcaaatactcgctggccatggccatcgccatggactcggtttgggacgagacggccgaggcgctgcgtgacatggccgaccctcaggccctgctcgcgacggtcagcgcctcggtcagcatgtatctgctcctctggtcgcttcccgagccagtgagcaagggcctggccgcgctgctgacggccacagccatcgcctacctgggcgtcgacaccgtgtggcgcatcctggacggctgggtgacgctggtgcgcgaggtggaacgggccaccaccttcgtgcagctcagcgaggcgggcgagacgtacggcgaagtcctcggggagaacgccgcgcgcgtcttcgtcatgctggccacggcggccatcggaaacacggcgggactggcagccaatacgtcgcggctgccgggctccgcgcaggcggccatcgcagtggagacgcaggcgggctaccagtacgtagccatgggaggcgtgcagtcggtggcgatggcggccgagggcttcaccatcgcgctggcccccaatgcggtcgccatggcgaatcgggggatgggcagcggaggctcaaggggaaggagccaagagcaccaccttgccacggacaagaacagtgtctccaccgctcgcggcggaccctggacgcctgaattcaggaggctcttcaggaaggctggaatggagttgaaagaccctgagaacgtcgttgatgttcctggccacaaggggcctcacccgcaggagtaccatgaggcggtttacgaaagactccgcgatgcgacaagaacgtgccgcaccgtggttgcgtgccgcaaatcgctatcggccgcactcaaggagctggccgaggaagtcacgacgaagggaacacgactccacaggctcgtaaccaagggcaagtgaggtagagaggaagtccaccatgcccaagcgctacttcaggctcaaagaggacatgcaagccgagaactgggacctgggagaccccctggacgagaaaggccaagaggtggacgacccctacctatttgcggccggacagcctgttcgtgttgcaggccgactgacgattcccgtcgacgcgcccgggaggcgattggacttcggcaccgcgggcatcggcgctgcacctatcgtccatgtccgggtggccaccctcttcgcggagctagcccccgacgacgtgcagctcatccccgtggacatccagggccatccggaccagtacctcatcctggtggccacgaagcgcatccgctgcattgacgacgaagcgtgcgaggaggtgcgctactggaagccggagcatgggcagccagagcggattggcgactacaaatcggtgatggggctgcgcatcgacgcctcgaaggtgggcgccgcgaaggtcttccgcacggaaggctgggacatcgccctcatagtgtccgaggacatcaagaaggcccggagcgcccgaaggctaccggcgcgaagttcacgcaggtgtagcccgtgcaaacggcccccatattctccgaggcgcccatgcacccggaggcagggggatcttggggtcttgacgtcatccacatgaagacgggcggggtacttctcactcgctgctatcaggccacccctggaagacgtcccatcctcctggaggcggcgggaaacccaacgcatccagacattcgcgggcctgggggctccatccggactccatgaggctttctgggggagtgcctgccagggatttgacgagcgtctgcaccttgggaactgctgaccggaagcgctccgcagccggactcccccgcgcctcggcgcagagagacgccagcgcttccatgcgggcctggagcgctgtgtgcacgtccgctgtaggggcttgcgtacgccgccgcgcatagattcgagggggggccagcacgaccagcagattgagcgcctcagcctccaaaaaaggtttataatcccacggaacgtcagccacggaaaggcctcagaccagcgggaagctcacg

SEQ ID NO: 882 - DNA, 7581 bp, Myxococcus xanthus
gggtgggcaacgtcgaggcggggcggcaggcgcgttacgtcgtggacacggaggcgcctcaggtggccgcgacgccacgggggagcacgttcaccgggacgcgcgcggtgacgctggcgtgtgacgacggtgagggcagcggctgcgcggccatccactacaccaacaatggcgccattccctccctggactcctccgtctatgaggagcccctggtgctgacggccaccactcgcgtgcgcttcatcgcggtggactgggtgggcaatgtctccgaggtggtgtcggagctctacacgcgggagacctccggcgaggaccgcgtggcccccacgacgacggcgacgcccgctggcggtgtctactggagtgcgcagtccgtcgtcctgggctgcgcggatgacgccgagggaagtggctgcgcggggacgtactacacggtcgacggcagcgcgccgacgacatccagcatccgctacacgggccccatcaccgtggcctcctccaccacgctgcgtttcttctccatggacatcgcgggcaacgtcgaaccggtgaagtccgagcagtacacgatggacacggtgccgccggtgacgaccgccacgcccgtgggcggcgtctaccaggacgccgtcaccgtgacgctggtgtgcaacgacggtggttcgggctgcgccgcgacgcgctacacgctggatggctccgcgccggtgtcgagcgcgttgctgtacgagcggcccatcacgatcactcggaacacgatgctgcgcttcgcctccacggatgcggcgggcaacgtggagcaggcgaagcaggagtcctacgtgctgcccgacctggaccggacggcgtccgagcagatccaggccgtgcgcaacgcggcgaatggcccggtgaacctcatcatcaacggagcccgcatcaccttcatcaaggacgccgtgggcaacgcggtgaacgacgcggcgggtttcttcctccaggcggagcggaccgggcccgccgtcttcgttccggtggacccagcgacactatcccccgttccgcgggtgggagaccgggtgcgtgtcaccgtgaatgcgaagagcgtcgtcaacggccagacgcgcgcgagcctctctggcttcaacgtgctcagctcggggcactcggtgtcggagcttctccaggacgtcagcgacgtggacgtcaccatcggtgggacgcagcccgagtatgagtccgagtacatctccatcaccggcaccatcggcgcacctgggttctccgccgcggggctggggcatctgcaggcgccgctgacgacggtgggcgtgccggcgggctccgtggccgcggccgtgctgcgcctgcgcgtggtggagccccttcgcgacagcttggcgttgacgtcgggctgctcgctgacggtgacgtctccgctctggatcttcatgtccggcacgcggatgacgcccaccatccagcccaccgtgtggacggcgagccaggccaccgtgcactcgtgcccggcgccccgggtcatcaacgcatgggccacgacccgcaacacggtgatggtgcgtttcggccgcccgctcgacgcggcgagcctggtggccaacggcagtcagttctccatccccgggctgagcgtcacccaggcccagttgcagagccgcaccgaggtcgcgctgacgaccagcaaccagacgccgcgccagcagtacaccgtgacggtggcgaccaccgtgcgtgacgcgcgcggcgtcgcgctggatccttcggccacgcagacgagcttcccgggctacgtgcagacggcgcggctccgcctctccgaggtggcgcccgccgttccccagaaccgcgacctggtggaactcgtcgtcctcgcgagtggctccgtccagggcgcgacgctgacggatgggaacacggtgctggccacgctccccgatgtgcaggtgtcgacgggcgacatcatcgtcatccacctcaacccggaccgcgtcacgctcgggtgggacgcacccgcgtcggagacgaccagccgggccgaatacccgcggagccagtacgccgcgaaccatgacacggcctgggacttccaagggggtacgacgggtatctttccgggcaaccgggtccttcgcatccgggacacgttcggcaccacccagcacgccctggcggtcatcgagaccaacgacgccttcgcgaactaccccacgatgctccagtcgctccaggcagagggccagtggtggccggcggactgctccggtgtgccctgcgactatccggatgcgtgggacgtctcggtggactggacccaggccttcggcacgccggggctggccacgtcgttggggcgaaacgggcagggggacacggactcggcgagtgactggtcggtgagcatgtcctcgttcggctacgccaacccgttgccgtagctcgcgccagacggcgcaacgacaatcgccgcctcgtcccgggagcgtatccccgggccgggcggcgattcgtgtttccgcgtcgtgcctgtccctaccggcggcgcgcggcgacgtcggagtgcttctccacgaactccgagtagggcccgttgaagtcgagcacttccttgcccgcctggagcgaccagatgcgggtggccacctcggagatgagctcctggtcgtgcgtgacgacgatgaccgtgccctcgtacttctggaggccttcggccagcgcggcgatggactcgaggtccaggtggttggtgggctcgtcgagcaccagcacgttgtcctgcatgatcatcagcttggacaggagcagccgcaccgtctcaccaccggagagggtgtcggtgttcttcatccgctcctcaccggagaagagcatccggcccagcacgccggagatctcctcgttggtgagcttgtcgtgcaggtcacgcagccagccgaagcaggtggtgcccttgcgcacgacgccgtggtggtcctgcggcaggtagcccacggaggcctggtggccccagccaatcttcccgccgtccggctccaactggccggcaatcatcttcaccagcgtggacttgcccacgccgttgcggccgatgacgcagaccttctcgcccttgcagaccagggcgttgaagggcttgatgacctcctggccctcgaaggacttgtggatgccttcgaccatcagcgtctgcttgccgctgaccaccttctggtcgaagcggatgaacgggcgcgcgatgttggagcgcttgaggtcgtccgacttcagcttgtcgatctgcttgatgcggctctgcacctgcgaggcgcgggtgccggcgtggaagcgcgcgacgaagtcctggagctgggcaatcttcttcttcttctcctccgtctcggactcgacgcggctgcgcacctgcgccttctgccggaccatgtcgtcatacccaccggggtagtggatgatggtctcgtagtcgatgtccgcgatgtgcgtgcagatggcgttgaggaagtgccggtcgtggctgatggtgatgagcacgccctcgtagtcgtggaggaagctctccagccagcggatggagtcgatgtccaggttgttcgtgggctcgtcgaggagcaggccttccggcttgccgaacagcgcctgcgcgagcagcacgcggagcttgaggccgccggtgagctgcttcatgggctcttcgtgggaggcctggtcgatgccaaggcccgccagcagggtggccgcgtcgctctccgccgagtagccgtcctcctcggcgatgacgccctccaggtcgcccagccggttgccgtcctcctcggtgatgtcggacttggccagcagctcgttcttctcggacatggccgcccacagggcgcggttgcccatgagcaccacgtcgaggacgcggttgtcctcgtagcggaagtggtcctggcgcaggattcccagcttgcgaggccggacgatgttgcccatgtccgcttcctcgtccccggcgaggatcttcatgaacgtggacttcccggccccgttcggaccggtcaggccgtagcggcggcccggcgagaacgtgacgttgacgtcctcgaaaagcttcttgggcccgtaggccttggagacgttgatgacgttgaacatggctgcggcgttgtagcggaaatggtgcggtgggccaaagcggcgacgtgtttcgcgttctgcaggagaccgcgaggactccatgtaaccgctgggaaggcgggagaatgccgccccggtgtcgacttcaggccgccggaagcggcggcggaggacgtgagatgccgggaggccggcggcgttccgcctcggacggaatgccaggacgcctgtacggctgtccaggagggtaggtggccccggatgacgggtggggagcgggcagggcagatggatgcggtgcctgccgggcatgacgggtataagggccggcccatggccgttcgtttcgagctcctcaccaccgaccccacgggcgcccgtgcaggcatcctgcacacacgccggggttccttcaaaacccccatgttcatgccggtggccacccacgcgggcttccggcacctggccatggaggaggtgaaggaggcgggcgccagcatcctgctggccaacacctaccatctgatgctccggccgggcgccgaggtcttcaagcgcttcggcggcatccaccccttcatgcagtgggacgggggcgtgctcaccgattcgggcggcttccagatcttctccctgccggaggaccggctcatcacggagaagggcgcccacttccgcagcttctacgacaacagccggcagctcctcagccccgagtcgagcatcgccatgcagcaggccatcaactcggaaatcatgatggtgctggacgtgtgcatcgactcgcggaccgacgaggccggcacgcgcgaggccatggagcgcacccaccgctgggcggtgcgaagcctggaggcgaaggcggcgcgggacaccgggcaggcgatgttcggcatcgtccagggcggcgtcttccctcacctgcgtgacgagagcgcggccttcctgacgaagctgcccttcgacggcttcgccattggcggtctggccgtgggcgagacgaaggtggagcgcgagtccatgacgttgcgcgccaccgcgtccctgcccgccgacaagccgcgctacctgatgggcgtgggcacgcccacggacctggtggaagccgtgttgcgcggtgtggacatgttcgactgcatcatccccaccaagatggcccagcaggggtatgcgtacacgttcagcgggctcatccgcatctcccgcagcgtgttccgcctctccgacgagccgctggacgcggagtgcgactgctacgtgtgcaagcgctacacgcgcggctacctgcagcacctgatgcggggcaagcaccacctgggctcgcgcttcctgtccgtgcataacgtccggcactaccagaagctgatggggcgcatccgcgagggcatcctgagtggtacgtacgcgcaggtgtaccgcgagctgaaggcggccatcgccacgcccaaggacttgaaggacgaggccaacgcgcgcgaggtgacgttgaaggaggtcgggtgagcaccgcacccgacgccaacccgcgcgacggcgacttcgagctcatcaccctgcgcaatggcgctcgcgccgtgcggcacctgggccatggcgaggtgatgcacccctccgtggggccgtggcaggaagcgctgcgcctctatgtggagcaggcacggctggcggaccggctgcgccagcccgggccgccgctggtgattcatgacgtggggctgggcgccgccaccaacgcggtggccgcgctcacctgtgccaggagtctgggcgcggagcagcgccggctgctggaggtggtcagcttcgaggtggacctggcgccgctgcggctcgcactggcggacgccgagggctttcccttcctccagccgttccgtgacgcggcggagacgctgatgcgcgacggggtgtgggaggcggaggggctccgctggcggctgctgctgggggacgcggtgccgcacctggacggcacgctgcccgtggcggacctcgtctacttcgacccgttctctccggcgtccaatccggagatgtggaccgaagcggtgctggcccgcgtgcgccggcactgccgcgaggacggggaggggacgctgctgctcacgtacagcgcggccacgcccacgcgggtgacgttgctgctggccgggttcttcgtgggcgcgggtgtgtcgacggggacgaagggcgagacgacggtgggcgccacgcggcgtgagtcgctggaggcgccgctcggtgagcggtggctggagcgatggaagcgctcgtcatcccgggcgccgcatggtgggcagctcacgcccgacatcgaggcgcgcgtgctggcgcacccgcagtggcggtgacgggccgggccgcagggtgccctttggcacgccacgatgtgtggctcggcacggcgttgggtcgggtttccggggcgggtgctgcttccgcctctgcgtgcggactccgagtgacggaagacattcgccgcggtccggggtaatcgacgggacatgcacgacgcccttcagatggaggactggggcggcaccggtccggtgctgcacctggcccacgccaacggctttcctccggggtgctaccgcaaactcatcgagcacctgaagccgcgctaccacgtcttcacgcttcgtacgcggtgcctcgtgccgggctccgacccgcgcgagctgcggacctgggatgacatggcggatgacctgattcacgccctgcgtgctcacggcgtgcagggggtcgtgggcgtggggcacagcatgggcggcgtggcgacgctgctggcctccgcgaaggcgcccgcgctcttccgggccgtggtggcgttggacccggtattgttcacgggggcgcgggaatgggcgctccgtgccttgacgctgctcgggctgcgaagccgcgtgccgcccgcgagtctggcgcggcggcggcgtgagtcatggggcgctcgtgaagaggccgcgcgaagctacggcaagaagccgctgttcgcgcgcttcgacccggagtgcttccaggactacatcacccacggcctcaccgaggccccgagcggtggcttccggctgaccatccccaaggcctgggaggcgcgtgtcttcgagacgtctccgaaggatgtctggcgcgagctgggcaccgtgaacgtcccgtctctggtgattcgcggcggtgagtccgacacgctgacgcgcgacgcactggagcgggcccgcctcaccttgaatgatccccagacggaggagcttcccggcacggggcacctcttcccgctggagcagccggagcgatgcgcccagcgcatcgtcgagttcctcgatggcctggagtcggcccgcgcggctgccagggccgtgcgttgaaccacaggagcgggtgctgacatgtccggcccccacggcctccaggggcgctgaccggacccctccgaagtgaccttgcgaggtcgctgttcgg

(The sequence listing continues in the following parts.)

We claim:

1. A substantially purified nucleic acid molecule encoding a nitrite reductase of SEQ ID NO:11926.

2. A recombinant DNA construct for expression of a nitrite reductase gene in a plant cell, wherein said construct comprises a promoter functional in a plant cell operatively linked to a nucleic acid molecule encoding a nitrite reductase protein of at least 70 percent sequence identity to SEQ ID NO:11926 over the entire length of said protein.

3. The recombinant DNA construct of claim 2, wherein said nucleic acid molecule encodes a nitrite reductase protein of at least 90 percent sequence identity to SEQ ID NO:11926 over the entire length of said protein.

4. The recombinant DNA construct of claim 2, wherein said nucleic acid molecule encodes a nitrite reductase of SEQ ID NO:11926.

5. A plant cell comprising a recombinant DNA construct of claim 2.

* * * * *